United States Patent 9,328,346 (POLYCOMB-ASSOCIATED NON-CODING RNAS) - sequence listing, part 33

SEQ ID NO: 5486 - RNA, 91334 nt, Mus musculus
uguuuugggaguuuguugaggcacagaaaacgugccacagggaagacugaagguucugcagccggaggucgucgggagcugcccgggcugcucaggugugccgcuuaggacugcgaagagccguggaacagugcaaggucuuuaaaacguuacucuugcuaccuuaagaaaugggguuucaaagaauggagccggggugguguuuaaauuaggauaucaguguggggaaagauuuccaguguuggggacaguaaaccagaggggaccuccuguugcuucauuccuccgacggcauucauuauuuaaaaauuuaaaacgggauggaagggaagaccuuagaucuuucccuucagucuguggauggaagggaagaccuuagaucuuucccuucagucuguucaaagaaaacgucgaauuucgugucacccguugguugauuaaacgcagaaucggauacaccuuauuuugaaauguaaacuuaauauaaugucggaaauucuaaaaggccugccccaacugaacaggggcaauuacguuuacucuucuucgguagcgcaaaaacagcacccaaaguuuuagaugcugggagagggacaugggagacagagagcagagcgacucuggggauggggaucaggggugucacacgucccagaugccaccauuaggacacggagacucggugggaggcuagggagacaagguaagacccagaggagggagaguccagacugguucaaauugaaaaaggaauucgcagcuagcggcuugcaauuagacuacgcagugcacgauugcgcaaauuauuuuaaaggcgggagggggggcggugaggcgggggagggguggacagcuguucugcaggaacacuggugcugccagacccucgaguaggugagagggagcagacacacccuuugugcgucuucuuugaacuggagcccuuucuuuaaagucaccaaagaaggagugaguggguuuaggaugacccagagauugcuuucguucggagauaaagagaaccaagggugcugacagagacccuaaggauaccagagggaucuuucugugucgcgucccuccaggcucagggaggaauggguugugcagacaaacuuuccgagaacuccuggccuggcccggaguucccgcugucacuggcuagggugcugccugccacuuccuaagugcagagcagauucugccgcguggauggcugcugggcuugcaaucuaguguaauuggugagcaagccaggcagucuaaaccagagucggggcuacucgagcuuuccagccuucgcaccuucgcuaaccgcuagcaccgcaaucgcgcugaacuuaggggcgcagagcuggagggguggcccggagggcagcgccuggagcugccaagcuaccuuuuccgauuuuugaaauccggagagaugaguccuacucaggaugacacuuuuaaguuccugguuacgucucaccuuacucgcaccuuuuuagguucucgguuccuggcaagcauagagguuaggcacaggcagaggagggcuugggcaggugccagcucugaguaccuacccagcguggucacguucacuaugggaucaaugaaccaugcgcugccucuuucacaagcagccugggcguuuucugcgaggauuuacuuuuuuuuuuuuuuccuuucuuuuuaaaaggaaccuucaaggauuacuauuuaaaguuuuaaauguuuugauucaacagacacuuguaaacagaacaaaagggaaaggccugacuugaaacugcuuugcuuugaaacuauucugcuuugcugaauaaaacagcagaggaggaauaauugagggggaaaaaaaaaacauugguuaagugaguauucagcuguaaauaaaguaacaggaaagacccaguaaauaggaaaaauaauaaaauaaacaguagauacacgacacagaccguugggaagcucuguucccacugaaagccucuuucucccagggaggauauuugugggggaaaauuauuugguuauuuucacaguauuacagcucccuuugaauuaaacuuuuuuuuuuuucaucaacuagacuuaguucuuuaauuaggaagcacaauugaguuucuaacagauguugucagccgcaaacucugauccaaaauaauaguguaauuaguuugggggggggggacaucuuuaguuuauaaggccugaaauuaaaauaugauguuuuuaaacauugugguacaaagccaccgggaacauuuguuccagagucuaguaguggcaccacuuccugguucugccuuggaaaaguuugcaguaggaugcuuagggcccuucuuauucuagaccucucuacauuuccuucagcucuugggaaauucaauuuuaaaaaauguuucugacugaaaaaaagugaaaucccuaaaacacagcauguucccaguugguuaaguuugguuuuuuaguuguuuuuuguuuguuuguuuuaucauaaacugacuguccuagagauggcuaagcaggguuuuuuguuuuuguuuuuggcuaacuauaguuuuuuuuuaaauauacauaaugugaauuaauguuagcaaacuuuuuguaccuugaaauauaaacauaaauacagauuuuucucuaauagcugucugaaaaaugaaauguuugcuagcuuuucucugugguaaaacuagcaaucuggccuaucugauuugaauauaaguauacgacaucaggauaaacuaaacaggacauucuccugcaucuaguuuuugcucuuacagcuugauguucuucuagacucuaugcugcacgguacagauuugucuuuauaaauuauccauuucguacacauuacaaggugcaggaagucaagcuauucucuacaguacuuagcaaauccacuggcgaaaauucuuauggcuuaaacgguguuuuuaauacaugccauguuucaaaaagcauuuagcaaaaaucaguuucuguguaaaaauagccuaucacccuuuuguggaucucagugccuguuuucaauguuuuuaaauguuaaaggccaagaggacauucauuacauugugcugucugugucuucuucagaaccccucuccauuggagccuuuuggguccuccuuauuuucuaguaacaaugccucuuagggacagguagaguuaaaauuacccacuuuggcagacagaaacuagaauccuuuguuucugacacaaaguaaacauuauuuuaaccaaauaggcuaucuccugccuuagagucacacacuagguuuugauuugucuucuuuggguuacaagaaaacaaacuucugcuccaaacauagcugcuuguuuucagacugagauuucuuuaacucuaugagaauacuguucacugacagcugauagaggucugagccuuagaaucuuccuaagugggaaaucuaauauaaaugacacagggagcaaagacaaggaacuuagcacucaaaaaauaagucccauugauaaauguaaaggucauugauaaaugaaagccguucacaaacaaguuccuucaugcagaaugaaugcuagaccaggguuaaauguguccuaaguuauuucuguuuguuuccucuucagucuuauuauaccaauguaauuugauguagguuuaauugauaaaaugauuucggucaguuauaaacaaauguuauuggucugucuccuggcacuuugguguugaucuauauauaggaauagcuccggguagcuccccuugaagguugcaggugaugauguuaaaguucucuggguucugcugccagugacuccucagcccuucuaacacggaaguagaucagagagguugcccucaaaaaguuccuagcccaugcauuuugcauuuuugaaaggaaaauuuuuggauuguuuccugauuuguugggaaugauaaagucaucgggggcaucacaacuuccuagcauugauugggaauauagguuucuggguuuuagaauaaguauuuagaugaaaguuucugaguacauauuuuuuaaaagaauuauacagccucgauuucaguaaagcuuuuuuugcucuacacuaaaaucuuaaauguauuaagauucaugaccuucaaaauauaguugaauuugaaggagauuuuuuuucucccccaaauuuagccacacuuccuuguagccuuuacaaaguucuacacacagcauugcagugggaaguuguuucuagcagcugucucucagcaguugccugagcugagugugugugggguuuuuccuaaugaaauuuuaaauguggcucuguggcuccuaacacaccauguggauaauaugugaacaaaagcaugugugcugaacauuauuacuguaaaagaaaaauaguuugcuucuuuuaaauggaaggauacuuuaagcuuuaguaaugaugggggucacugcuugaaaagaaaaugccuaauuagcaucugacagcaaaucgucaaucuguaacuaauucaguuauuaagaugauauugugugcuggaacaaaacuuuccaaguaaacugguuguuaagagucuagaaacuuccuauuagaaaaucauauguuuagguaguuucucuuuuuacauuaauuuguguaauggcaaauuauaaguagcuugaaucaaugaauucuaaguaucuuuauuacuaauuugauucuuuucugguggagguuuccaacaacuuuguucuuacagaugaacucagcugcuucucaguguuuccugcuaugucugaguauguuauucagaauucaucaaaguggccuguguggcuaaauguuagccuuuucuuucuguuguuagcuagaaagacacuuuaaauaugacacacacaucaaaaacaaagggcuuugaaaagcuacucuacuuuuaacgauaaguauuuucuguacuugacagaaauugaucuaaaaccugaaaagcuuuaguaauagaaaaauccagaucuacauaaaccacuaagucggaugaacuuuuccuaccgacaucugacucggggaaaaauguacuuugagaagauuugugggacugggaauauggcucagugcuaaagcacuugccuaacgcgugcaaggcccugcguccaauccucagcacaagugggagggaaggagagaggaaaaaauggaaggaaaagaaggggagagggaggagaaaauaaagggaguugggggggagaaaaaugagagcuauaaaaccuaucuguaauucuggcacuugagggguagaagcaggaggauugcaucaaguuacuauggcuacacaguaaguuccagacaagccuaugccaaagagugaucucucccaggauuagcagucucaguuuguuccugcaucagaccuaguuuaaaaucauaacaucaauuucccauuuuccuauguuuguuuccuucucuuacauauguucucaggcuaaagacagucagucagcuuucauuacaaaguaacuuggguuggcaguugucagagcaccugucuacuaugucccaggccgaggguuuuaaccucaaguauuuauccucaccucauaacaagauaauaacguuucucauuuaugauccugcuucugcuaggcugguagcauccaucuuucuuucuguggucauuauaaucaaccuggcuaagauucucucuuaucuuuucuauaauuguauauuucccauucaaauuuggcaguuacauuauaaugaauuuuaacgaaaauuuuuauccaaaagugauguauaauucuguuuacuugaauuaagcuggagcaagacaucagucucugguuauugaauuuuggaacaucccauaaguauuucgccucugcacagagagaacugaggccccagguacacagcggacgcuaugcucuaucaaaagcccucuucucaucccucacucaccagucuuugcccacagcuuugcuggccacacgcaauacagagugcuccugcuguucagaguagacauggcuugaaugucauugacacggugggcucagguguacugaagcaggauucucugcccucggugguuugguacugguucacagccccaaaggcagucaaaacagaccaagucuucauguuuaccaacaaguuuaugcaaccuuuguugaucucuuacuccagcggcuaagcaucaaacagagaguauaaaguuauacacauuugaaaaaacaaccaacuaaaauucaacagucuccaaacauuuuagcuucuaucaucuuuuuucaagaauuacuuuuaauuacuugcaaauaugugugccuucaugaguuuauauacaccacauacaugcagccaggaggguacuggauccccuggaccuagaguuauaggcuguugugagcggccuguucuaggcucugggaacugaacccauggccucugaaagaacaguaagcauucuucaucacugagccauuucuccagccauauauaucuuuuaaaauuauguuaaaauauauggcuuuuuaaaccaguauauuuuaacaaugucaagaggcuuacagaauacuaccaaugcuuaugucaguacaucuuccucugauggccuacuuuccaagacacaucaaaaccauuuugcccauauauaucuguguguguguguauauauauguguguguauguacauauauaugcauauauguauauguaaauaguaaauaucucauauauaauauaguuauauaucuuaacauuugaugugugucuguguguguuaaaauuuccuguguacucuucccaucuucucccuuauucucaccaguuauuucuuuuucuuuuuuuuuuuuuuuuuuuuuucugguuuuugagacaggguuucucuguguagcccuggcuguccuagaacucacuuuguagaccaggcuggccuugaacucagaaaucugccugccucugccucccaaucgccaguuauucuaugcuugauuuuagacuuuguauuuggauguuuucauaguacaguuggauuagaaaacaggacaaauacaaucaggguguauguauguuuguuguuuuuguuuguuuguuguuguuugguggugguaguguguguguguguguguguguguguguguguguguguguguguguuucuucuggagacaggcucucauuauguaacuuagcuugccuagaacucacuauguagcucagacuggcuuugaacucacaaagaucugcccacuucugcuuaccugacuuaccuauuucuaacuaaacaggauuuuuuuuuuggccugucuauucugaugaggucaauuuuacuaaugauauuguaguguucaacuacuggagaucucauuacuuuaucuuuaugguaauguuugcugugcaaagguggcucuugugaccuucucagaugggucaucuuacacauagcaauaauugucucuuuaagauauaccccacagaaaugggauugugaggguauagaauaaagcuguucaccugucagucuuacaugucaguccuugugucuguccuuuuucuuuccuccaucugcauuacugcagcagaguaaacugcuuugucuuuaacaucugguggacugaguccccugcuguguuaaaacaucaucucucuuugcuugugaaguauuggagacaaaacccagagcuugcacucuauggagaauauucugcuuuugauucucccuuguagcuuacagccaguguacguccuuuuuccauacugaagaaaacauccuucaaccuuuuggacucagauagccacaaauagcucuccucaggugaaagcauuuaauaugcucucuaugugauuuuuuuuuuuuggaucaucauugaaauuaaaacacauuauauaaugaauggauaauaaacaccaacuuccagucuacuguuucuuuugacugucuugguccugaacuuugguacagaaacaaagucagaaaguucguuuaauuuaaaaaaauaaacaaacgaacauccaaaaguuugacuaagcagaagaguauuagauugcuaaaauuaaggcguuuuguuuuguauuguuuugcuuucuuaaggagcauuugaauugcgguguggaggcaagagcagguaauggcuuucucuucccccuuuguccuuaagaggggcagaacaauggguguuacuugagaacaccuucuaaucuuugucacucuggaacaugccugcaggucaucacaagguucucaguggugucucgauuuuuuuuaauuuaauguuuaacuucugagagaauugcuuagaaacauuuacccggccuugcuggugacucagggaaauaguuagauaagggugaccacuggucaagauaagauacuucauaacaagcuuauuuuggacaaaugauuaaaaguagaauugucauggcuuugcuaaacuggaaauuuaguuugauuuuuuuuuauucuuaagacauauagcaugagaaauaagccuuaauaucaaaauuuaagauaucuagagcauugaucuuuuuugaaauauauuuugcuuuacacaaauuuagaaaaaucuuuggaucgucuuuaucaaguauaucaagugugaauuuucaucauaauacauuuguugaguuuuuuuuuuuuucuucuuauucuuccuuauugcuguugcccuuggugggguggggagaugauacuuaaagcagacaguuuguuccccucugucagaucauaugcacuggucugagaggcaccugugccaucuguaaucagcggcccaugguccuaauuucaucuuccuuuucuguucaaggcuuuacuuggcuggguucuuuaguagcgugugaucaagguaacgaggagaaagcaacauucagcaagauucugcguuauuucggagugaugguauuaguuuagggcuauuuuuuucuucuuucauguuuaaauuaauucauacauuccaagagcauaaaaaccaagauaccuauagauagauaccuuauacuuuggauaaugcuucauguauucauucacugugguggcuauuucugguuguuaauuugacuauaucuggaaugaacuacgaucuagaauuggagagcacaccugugauccagaucuugaggcuggaagacacaaguuucugaccuggaucuugacguggagaucuugaggcauaguggcuaugaaaagcuuaggcccaggcaagguaguaugugccuuuaaucccagaucucugaguucaaagucaaccugggccaaagcaagucccagauccaggcauggugguacauaacuucaucugagucaugccuucugcuggaggcuuacauagggaaauuggaaaaugaaagccucuaucuuuuuugacugcuuacacugcagcacguguguuggaaacuauuucuacagaagaccagcuuaaauaacuggccuuauaggacugagcaacuacuuagauucuuggacuucccacccacagcugcccauuguuggauuaguuggacuaaaucaucacaauaaauucccuucacacagagagacauuccauaaguucugugacucucgagaacccugacuaauacauucacccacuguguguagaugugcauccugugacuaaagcgaucauggaacucauuggcuaccacgggacacuuugagagugaaaagggacauuaggaauaauuagucaugauaauaagcacaagccaagaggcuuccuggcaagucagaaggcucgaacgucuaugcgucaugauuccuacagccaagaaguuuuaaaaauaacuuacuuagcucucaggaugagaaaggaagggagaguugauuggaagggagggaggcuucugcguaggcacuguaccuauuaauaacacacacuaacacacacacacacacacacacacacacacacacacacacacacacacaccagaagacugccuggcuggaggaagguuauuaagagagcuguguguauuaguugccuugaaugugcgugcccagugguugugagaauugugucuuuauuaacuccucguuauccuuggcauuuaaaaaacauuacccggaauucuuuucucuaagacucauaauauaugucuguccuuagucuuucuuccauuuuuuuuaaauuuuguuuuauaguucuguacucaucuagguaaacuaauucacuuuuggguggggggcuacuagaggagaaggccuccuaguaggccuuauguuagccuucuugcucaaucaagacaccggucuuaguuauaaagggucugaggggccauguagaauauacuagcucccuacaccacauaagccaggcaugguggcacugugaucccagcaguaccaggggaggggaggagggaaacaggaggcucaaaguaucuauccuuggcuacauagcaaguucuaggccagccugaucuacacgaaacccuagcucaaaaaguaaaggaugugugagaggugggaagccuuccaggccagccuagagcgugcucauuuuuggacauaagugcaugugauucucaaaacagagcagcuuugcaugccuccauugcuguauuuaucccuccugagggagagcaagugagucaggauagaggugacugcuggcaaagggguugccucucuuucaguuaauauaaaaaggcauuuuggggggagggggguugugcaucaugccccuccuccugcuucugaaaucauauacuggggaauacaaaauauaggaguguguuugcugaucaacagaucaaagguucccauggggguuaaaccaccuggaaggagaaaggagcucuggucuuuuucugcagccugaacucucuacccuccauuuuagccagauuuuaaguaagcaacagagagagagagagcugcagcugggcacucugccuucccagcucugggcugcaugggaugugugagucuguguaugggcccaguaaaucugagcuaguggagacugaagaaaaagcaguaacauauauucacacaaacaccaaaacucauuguugaccaguucauaagucacucuugguuuaggaugcucuugcuaggcaaggaugaauggaaaugcuaacucauacuguuuaaaagauauuuguggcaccaaagacaagcauauccccaguaacuuucugaggauuugcaaauauuugcaggcuaaaaaaaauaaauauagucggaaaaaagaaccaagugaugucuuagcagcgaauucucuggucuuccuauaauuuagaagauaacauaucaauaacgauaagaauggggggcuggcugugggacagacaauauucacaaaaauaauuguuuucuuuggggaguuauuaauauuacugcuuuccauuaucagaaagaaaccugggugguuuggggggauaccagcaaugcuaaccaugugacccagucauuuaauguuggcauuccaauaacccaggcuggccuagaacucauagcgaccauccugccucagccucucaugguaauauuaaaccugugagccaauacaugaauguauuaaaacauuuccaagugucaucaacaggugcucucaagggccagagagccugcuuaaguagcaaggguacuuaccgucaaguugaugacuugaguuuaauucuggagacccacacagugaaaggagagaaccacuccccgagcugcuggcuaaccuccaccaauguaccauggcucaugcaugugcacaugcgcacgugcguaaaaaacacaaacacuauaaauauuuuaagagguauauccacuuauguuucauacauuuugccauuguaguuaagaaauguugggcuggagagguggcucagugguuaagagcacugacugcugcucuuccagagguccugaguucaaaucccagcaaccacauggugccucacaaccaucuguaauggggucugauguccucuucuggugugucuaaagagagcaauggugaauacauagaaauaaaaaauaauaauaauaauaaauacugacagcauaaacccaacaugcuuguaauccagcagugggaaggcugagaagggcuggcacaaguuugaagccagccugggcuuuguauagcaaaaccuuguuucaaacaacaacagcagcaaaacaaacaaacaaaaaaauguucuuuaucuuuucuuagaaugcauguuuaacuaaaaauauauauccuucuaugugguuuauccaacuagcuauccaaaugauguaucugugaagaacggggaacaaguuccccccaaaucaguauguuuauggaagcaaaccugucggauuccuucugauacaugggucuaguggugcagucccguuccaccuuuaagucuuucaccuuugcugccuaggacugugagugcuggcuggaauuuuccuaaggcaaaaagaaggacauauucagaaagucuuugacaacauuuaaacaacucuuaucaaaacuuaauuuccaugaaugauugauuuggcggcuggaggaugcucaauuaccucuuuuucaugugcuaaugaagccgagggugacuuuagggaauuuggugaagugaggcagccuguuuggauaugcacaggacuucuuugcuuucuaucccaguguucauagcugcuuuguuauugucuugccaagcaacugugguuaaucugucugccaggccacaggccuuggccuuccucaguaggaagggcuggaauuagugaagcugucaagccagguguugaguuucaagagaauuuauuuuguacaaaucuuccaauaaguugcaaaaucaacaaaauucagguuucacuccacccccaccccuaggugcuucuuggcaauucauuuuugagugaaaucauuuauacugggaaagaaaacuuucaauuucaaauuuugaggauuugggugugguggugcaugccuuugaugccagcacucaggaggcagaggcagguggauuucugaguucgaggccagccuggucuacaaaaaaaaaaaaaaaaaaaaaaaaaaaaagucccuuuuauugaaaaauuaaaaauagaauauuucccccucacaaaauauauccuuacuacaguuugggcucccucugguccucccaggcccuuccagccucccucucaccuggaucuacucccacugugucucccauuaggaaacaaacaggcuuuuaaggaauaauaauaaaguaaaacauaguaagagaaaacaaaagcuaacauauuagaauaggacaaaacaagccaacagaaggaaaagagcccaagaagaggcaugagaaaucuacagacacagacccacucauuaugucgcucagaaauuccauaaaacauaagauacccaaagaacaaaaauacccacuaaccuggaaauaaagccaaagaccuguggaggaggggcagaggcagagacagagacagagaaaauauauaguauacaaaaauuaaguuaaaaauaagauaaaauuuuaaaacacacacacacacaaauacacacacaccaaggaagaugccugacagaaccuuccaaauaccuauugaguuccauuucuguuggcgucuacugcugggcaugcagccuacccauaagaguaguuuguguccccagugagacucccucagaggaaacuaaauuuucaucugugguugguaaucuauugaagguagcuucuaggguauggacagguguaugugucuacuucucucagcucgagaaccccaccuggugcagacccauacagguuccguguuugccccucaagucucugaguucauaugugcaucaauucugcugguuuauagucgugucuuccuggugcccuccauccccucuggcucuuacacucuuucugucucucuuccucuauguucccugagcuauggugggggaggaauuugauggagacaucccauuuggggaagaguguuucaaggucucuuauucucugcaugaugucuggaugugggucucuguauuuguucccaucugcugcaagaggaagcaucucugaugauggcugagcaagcacacugaucugugccccccacccccaacucuccugccacccuagucaggaccagagugccaggcuuugaauuuuaaaaguugaccuccagauccaaguuuucacacugcacuaggguuuucuucaaccaagcuugucuggaaauauaaguagggugcuaaagaaucccuaguuccauuuuugaguagccagagaagaaaagaaagauugcuuugauuuuugucagggaagaaagguccuguagaaaaauuaguugaaagauucuuuccaagaacguaguugcuauuuggacuuaagucuugaugauaugcuaaguguucuugcagagacugaacacgaaccugaaagcuucugaggguggacaguuacagacugguuuugugacacccccuccuuccaaaguaagacacuuccagccuuuccuguucaaagcaacaaucccagcagaaccaauugguuccuauuccuugcuuccgacaaaggcuguugaggccugccagcuuagaaagugaugugcauccaguagaauaggucuuugcuuccauugaggcaaauacgcagccugcaaacacuaacugaguuguucuagcagacacagccaaaacaucugggcagcuuugucuugcuuccccuguagccaugguaggacuagcucuuuagagcuucaguuuuggagguacggggcagguugucauggugagaaucugcaaguccuuucaugagaaugucauaaacuuaccccuugagggguggccuuggagugcugaucaaccuuaggauucucuuagaacauaauuugcuccaggucucauucuauaauuccacuuguauuuauaaaguaucuucucucgucuuccagccuccucuucccacaacaaaaaauaaacaaggcagucagcccuuugccagauagcauccaaguagccacugugucugacugaugcacauuucagaaacaggucauccguugcaguugucggagaugaaggcuggcccuccacguugcuccaggacacacgucaaucagguguuccgcaauggugggaaggaaggaaucuucuuaguggcuucuccucuuugacagcagaguauuguccuggagggcccuggccccgagugucacacagcacgcuuacuauaucuacaguuucucuaaugucagguucauggcaacuugaacauuccuuucccagaugauagaaagcacuuuggauucuaguuaguguguauugugcaagauguccccauuguuccuuuggggauuagucauggugaaaagugacuuuucuccauuauuugcuuacuauucugcacguauuaagagcuagcauaucaaaacuucucuggaaaaaaaagagcaaguguuguuuuguuauacuaucugagcagacuguucauguaaaacuacuuacugugcuauccucuagauuacgucagggguggauuguuuuuuaaaacauuuuauuaaucgugugugugugugugugugugugugugugugugugugugugugcgugcgcgcgcgcgcgcgcgcucuugaaugcgugcucucaugcguauacugaggcaagugugugcaugaguaccacaggcgugcccucagaaaccagaagagagcaucagauucccuggaacuggaaucacagacaguuggagcugcuugauauggguucugggaacugaacccucguucccuggaagagcagacguguucuuaaaccacucagucaucgcuccaaauccuaagccaguaacuuuuaaaacucauguuuugguucuuuaacuguuuuuauaucuuaagauuuuuaagcaggagacaauaugcuccccacacuauccagccuucugcuccucccucccuauucuuaccccgcacuugaaggcuagcaauccaggccaccugucugcccaauuccuuuccuuuucgauggucugucuauauauuuuccuaaacucaacuccuaaggauuuucuccagcaccagccuuucccugggccaauccucucucccgagcaucaucggcucaaguucccuaaccauuagggcauccuaugaggacgcaaucuaagcuugccucccacccaccacacucugguguagugcagugacuauccauucugaugaaaucucuuugacucuccagacccucuaaggcaguguuucucaaccuguggcucacaacccucuuggggucaaaugauccuuucacaaagaucaccuaaaaccauccugcaaucagauuaugauuacauuacgauucauaacucuaccaaaauuacaguuaugaagcagcaaggaaaauaauuuuauggucaccacaaugugaggaacuguauuaaagggucacagcauuaggaagguugagaaucagugcucuaaaguuugcuucauuuacuuacagaccagacagcaagcgccuuaauccuccaucccuuugcaaucccuuuaggaaaucauuugauaucucuccccuccagagucuguccaugugcgcucucuggcucacucucccuuugcaauuaguuuuccuuuuacagcauuaaugagagcauuggccauguguuaauggauguugaagauccugcaagccuucuucuucugggaucucucucucucucucucucucucucucucucucucucucucucucacacacacacacacauacacacacacacacacacacacacacacacaaucgggaaaaggaagguaggucuagucagaugacaucuuuguguaaaagcaguaugggaguguuugguaguacccuuaccugaaauaaaggcagagaucacaucuguagucaccccaguuccuacaggguuuauccugagguauuaagaaaacugauuauuggcaguugcuugguuucucuugauugucuucggguacauggaaucccuuccgcuuuaacucuauguaggugaguuucaccuucuccauacagcugugaccaggucuguggcuggacaucacauuucucugcugaagaccaggggcugagcacaguucccccaguugggcugguugguguucuaccaggaguccugucuucccuuuggucucagccccugcuccugucuuggucacucaucuccccucaacacucaugaaggcugugagcauuugguuuugcuuucauuguaaaguaaauuaacuuugacaugagauauuugaagcaggggaauugggcaaauuccgaaugacuaaaagacaugcaaagcauauauguaacaaucugacuucaaaacauuccucaggugcuucaaaguggguuugcucaacucucagcuuccagggaggcaaacacuggugcggauuucuaagggccacuuccucuucuguuggaagggaaguaucacuguagacuggggaaaaacugaggaagguauaauuuuacuggagucauuagcgcucuuugggcagaucugugcuuguguuuuaauuuuuugaaagaauucugcucacuucaaaauccucacauauucaaagcaguaauguaagagacgaccaaggaacacaucgucauguacacauauggaagagcaaguuauaucaaaagagagagcacaggggaaugacacuggagucuaguuuaaagagaaagggagauagccagaucugaguuaccuccagagugggagacgcggagcaucagaguugaggcacagaagaacaugugaguugaggcacugugaugauauuuccccuucuuaauuuuaaggucacugcugggacagguuagagucagcagaggucugcugggccacucuaggagcuauguggucccaaguuauggucaauccccggcucuggugcaugguaaggcgaguuuagcccacuauaaccuagcuuagccggacuuguuaagccucagggcuugggaccccagagaaucuggcugagcacucuucugcaggugccuugggguuugcuauauuuuuuuuaaccuuuggggacagaauucacccccuccucuauuuuaaauaaaugcuaagaaccucggauuuaaaaaauauguguuauacaguggaauuuuaggcagccguggagaaaaaugaaaucgugacauuugugggaaaaugggaugcggcuagaaauaaguauguuaagcaaaauaagccagacucacaaagacagcuacugcaugcuuucuguccuaugcagaaccuagauuuaaaacuguguguguuuauguguguguuuguggcucauugaaccagaacauugaucaugaaagagaaggaggagcuagauagaucuuagggaugagacaacuaagguaguagaauacaaggaauuggaaaauggagaaaggacuaggugggcagaggggcgcaacaccagcaggacagaaggagggacacagaggaggagaauagcagaggggaagggugaaggagagcaaaguacaaugucacauguauauaauaaagccaagauggaacccauuguuuuucaugcuaaccuaaaaaaaauuuuauguuacagcuuaauacuauaaauaauacacauagucacacauuuaaauucuuuguauauguuuucauucaaaacauuuauuauugagguaaauuaauuaaaugcuaauugaaacccaccugugaaguauaugauucaugaugcugggcauggugagaaauccugaggcagggggaucacacauucauucaaggccuacuugagcuucacaggauguuaagguaacuuagcaagaucucagaauaauuaaaaggcucugaauacagcucuguggaugaucaaggcucacucagccuguaguacuuaaauaaauaaauaaauaaauaaauaaauaaauaaauaaauuuuaaaaaaucuguggguauacauagucacagccuuacuucagccauggugcuugaagcuuaaucucuauagcuuggucucuucaucuaauagcuugucacaugaaauuauuggcugguuugauucaguucuugagauggagguggacagaugccucguguugggguaggaggacaagagcugcugucacagcucaaaugagugacuugcaucaaaugcuguucugcuuauuauuccaucugcuggugucuuaguuaggguuuuacugcugugaacagacaccaugaccaaggcaacucuuauaaggacagcauuuaacuggucuggcuuacagguucagagguucaguccaguauuaucaucaaggcaggaacauggcagcauccaggcaggcauggugcaggaggagcugagaguucuacaucuuuaucugaaggccacaaagagaagacuggcuuucagggagcuagcacuaagguguuaaagcccacgcucacagugacacaccuacuccaacaaggccagaccuccuaauagugccauucccuggcccaagcuuauacaaacaauuacagauggcguugccaaaggacuggcccucuucagcaaccaauuuaaaugaaauccauaucuuuguggcucagguccccuguucucaaccagcgcccugcccccacguucucacacaaauaaucucacacagacacacagucuucccaugccccugcauacaccucagcacacaacccacugugugcacacacaauaccagccacacaaccacaugcuuugcgcaugcccuacauguucauguacaagggacauucguguaaacucaugacuguuucucaaguggcuuacaagucgccccucagccagcacgugccccacauguauucaggggaaggguuuucuaaagcaaucucaggcaguuuugaaguacuaacccuuaacauuuugucccggaaacaagauuacugguuccucuguguguuuaaaaaugcaaguuaaaaaauagaauuugauuucuuucugauucuuggcuuguuaccuacaaaaagacagauguauaacauuucccagguccuuguuuuucucuuaccaguugaccaguugaccaggauaguugaacccccugggcccgccucgaacaugaucccagaaccugcccagacugagcucauuuuugccuuguguauaaauugccuuuugacccuggaguuucuugucucguuccuuaaacaccauuuuuggcaagagucagcuuuuaagacucacaaggucagggcuaccaugucugagggcccuccuaugucguuaggcagucauucccacucucuccucuguucccacucucuucuugcccaugcugucuucugcugcuuccugcccaggcaggcugcugcugcugccugcaguuuucuguccucaauuugcccccauccuucacugggguugaacaucuccucacagaaguguuuccuggugcuuuuaucaaaagggcuuccucccgcccaucuucuuaucuggauuuagucaacuauuuugucgucuuugccacuuuccaaaugcauuuaucaguuuguuuacuucccuauugucugacucuucaaccagaaugcuaacucucccaggcaaggaaucaguuugucugucuccuuugucuggagaacuuaacuugauggcacauaacaguugcuuuuuguuuguuuuguuuuguuuuuaaugaauuuaaaaacccacuaaaugacuuugaauacaaacgucaauauguuuaaggauuuuuggaaaaaaaucuggacccaugcacaguggugcauacccuuaauaccagcaaagacaggagggucucugaguucaaggccagcaugaucucuagaaagucaggggugcacagagaaacccugucuugaaaaaccaaaaggaaaagaaaaggaaaggaaagaaaaagauuaugggauccgguguuuuuuacuaaauaguaucuaccucuuagcuuauaagucuaaaauguaaccuauaauacuaguucauuauagacuauuauauauaagguuauagauuagauauuuaaauguacauccuuucuauaaucagauuacaaaauuguggauuuggccuuaaaaaauagaaaguguuugaggguuuuguuguuuuauaguauuuuaaaagacagcaguuggcuuucgggugacagguguccucuuuuuaaauugccaaagcugugaaugauugugaccaaaauaguucagggagcugauggggcugaugggcuagcccagccgcugagaucugcuuauuucuuuugugagugggugcuggaaagaggagccaugcagacugcuugauaucauauagguaaaggguucucaaaguucaagauacagggucuugcagggugccaaguggauuuccuuggauuuaaaaggagcacuuaggccuuccaguuugagcaauggucaacuagaggccacccccaccccagucucuuccuuuccuggguggggaagggcgaggaggcugcuuuucuuccuuucuuuuacaaggugguaaucuccaaguggccuauggacauaaagggcuuugaaaggggauauuuacacaguuaaacuuuucccccagggcaagucagcagcccuaaugcuccugaaccuuuaagucuucucgcccucccccccucccuuccuucccucucucucccuuucccuccucucugucucaacuucuguuuaaaaugaaguagaaaguggacuucucucuacugguuuuacuugaguaaaauuuuaauccugccuacaacuguaaaaauccacaguucucgguugacauuuuaagauucaaaauucuuuaaggauucggcaaggugcuuagcggugaauauagucugcugccuuuuaagugaaagagauggcacgcuaacaauaugcuugcugaagaaacaggaagauaaagaagagcacaacuaacccuaguaauucuaguaguccugggaauggaaaggaugcuggagagugcugacuggagccagccucuaugcugaggcuucuaccucccugggcaucuucuuauaucauucugacuuuggaaccauguagaguaauagcuaccaguaauuuauaaaggaaggcuggacaugacagcacacuuacuugggaugcagaggcaagaggauggcaguaaguucacagucagccugagcuauacagugagcaccagcucagucagggcuacauagcgagacuccccugucucuacagagacaccagcaggguuacuaaacaaucagaaaaccagaaccuuccaaauuccuaacucccaucccauuuagauuuuagacuuccagaucuuauuccguuuguuguucguuugcuuguuguuguuguuguuguuuuuuaaguaguaagaugcaugccacaaaauccaccauuuuaaugccauuugguuuguauaacguaucagaccugaggccuugcucacgcuaggcugaaugugugcucuaccacagagcuaagccuagccccauuuuauccaugacugagacccacaaucagugugguacuaggcucauccacccugcugucaaccgucaccaacacagccuccagagccuuuucugcaucccagguggaagcuguucacugacagcccuccccacccuccugcuggaauucugcuuccccuuggcugcuuucuauccgcuaucucuuguauaugaaaucauacaauauggguccuuuuguuccugccuuacaucuccucauauggugcuuucaaaguucaugccuagugcaucaucugucaaaacuucauuccucauacgacugaguaauauuccaugauacacuuguaccaaguguaagcgaccauggacauuuuggugaauccugugcuuguuccuacacucuggcuauuuguaguaaacuuuaagucuucaagugcugccugagguccagaacaaguuuccagucuacuacauagagagcaaaagagaagccaaagguauuuuuugagcccugccaguuugaaagcaaugcccuccucuaucuggaauuaguuuggagcuaaagcccauuuagaacauaggaaauagccaccgaaauguaaccauuucccaaacaugacguggcagcuagacagcaauauuaaugaacacaggcuaaugggaaacacuaguuucugagucugugugugugacuccacccucuagagagggugaccugagaguaugugcccucucccugccccaggguggcauguuaagaauaaagcaaccaaguuuagaacugggcaaagggagcagcgacaauuuaggacaaguucacacaguugcuuggccacugacccugggcaaauguccccucgucucucaaugauggauggucuagcaacuuugacuaagcuaaguaaucuagguuccaaagccagcugccagauuucuuuccuuuuuggaaagagccccuaaaggcauguugauuuaggagcauccucucacgguugacucugucagucacgguggucauacggaagcagggccacuuaaaggccaggaaugagaaauggagccuuuaguagggaguucuccaugauuuugaacggguacuucugucuuugggaagaaugauguaaagaaggcuccugauaauccacuccagcuucucagauguacagaugaggaauuuagcacaagggaaucuuaggauguuuagccuauaccagagcucauuacacagguacuaagaacuucccagccauugggaagcaaguugauuuuuuccagcaauaacuauucuuucauuaaaauaccuaccuugaaaaagaaacuguaauaaagccaaauauuugacucuggggggaaaaaugaguuugguaguaauccaaagcaguuauuaaaauuguuuugucaauacaaggauuuauagugucuuuuaaaacucuauauauguguguuuguguguauuauauauuucagaacagcuuacauuuucagaaaaauugaggaaauuguacaggggggccuuauaugccccacacccagucuccuuugcuuuuaauguguacaaauuaaugagcuguaauuuaauauaacaguauugacccaguuuuaggaacagauucaaacuucauccccacaccccugguuauuucaucuuugagucccagggcggcagauagauacgacauuccauucacugauccugucccuuagacuccuggccuggaagagguucucaggugaaaguugucuguuugcuuaggcuggaguuguggauuguaaggaggaagagcacaaaguaaaaccccgucucaucaugucaaggguccauuuugacaauguaugaugccuggcaccucgaugacacaacugaagucaggcuugucauguuucaacucagggaagugacucuuuuuguugcuaugaccuucccagaccauauguuuuggaaguccccauauucaguuaaugugagggaggaguuaugugacacuuuccugagcagggaagcgaugcaaaucaccagguaaggagggacuuuguacucuaaugaauauuuaggaucuucucuagauuuuauagaucauauagaugguuuauauauugucgauuuagagaauguuagcuaaauugcaucucagaauaacaagauuuuucccucuauaauuaaaaagaaaaagaggaggaggccagaauagugauacaugccuguauucccagacacagagcaggcugagguaggaagaccagccugagcuacacagggagagucuugucucaaaauuaaauuaaaaguuaaaugugauucauuuguguuucuuucauccauaucaagagaaaaccaaaaaugucgguuaagaauagaagccagugaaccagagaauggugcugccaguaauucugacccgagauccaggucuagaacccacacaggagggagagcugacucccucacguuuuccuuggauaucuguauauaagcgcucucucucugucugucugucugucugucugucugucugucuuucucccccccccacacacacacuuuuuaaaacuggagugggcauguuaggcaaguagaugugaauauugcacacaauggcuauuccaaugauguccuguuuaucaaugacucaauuuccuuuuuuuuuuucuuuaucauuuuuuaaaacuguauuaaagcacuggaagagggccagagacagagaccaaggauggagguuauacuuugcauguauaagagaaaagaacccauguucaggaaaagaaagccacugcaugaauggauuaagcagugugccucaaauuuacucaggcuaaugugaaccuccuuuaagccuaaaucccccugagauguguuuauuucuuauacugugcacucgaccacugacaaccuauuguuccugugcugcacagugaauuuugauaacgaggaccaaagccaacaaccaaccagccucacaaacacgacucccagagccacagucuuggcauuguccacccaaccacuuucccaugacgugcacgagucgugagugcuggcucucaguuagaugggcaagucccuucacaucugaauccguuuccaaggagguaaagacagacggcggagggugucaucccugagguccuucccaagcgucgcaccugcauccugugccacgucacucuuuccuauucuuuucgagcuacacauccuguuggcugaaguucacuccaaguuguuuuccuacuaugucucaacuauggccugaauccuuacuuucucucuaauaaaagauucagaaaaaaaucaagccaguccccacacaucugcguaagggaucagagucuccuguguuggagcgccagcccucccuaaggagcaugucuugugaugguuuuuuuggguagcuucgaacccccacaauuaaauuauauuuauuuuuugauuccccaaaaccuacacaguagaaggagaaacacaacuguugcauguuuacuucugacuuucauauacaccauggcacauguacacauacacacauauacauauacaugcauauacacauacauacacaaacacauaugcacacaugcacacacacacacacacacacacaaaauaaauuaaaaaaauauuuuccacccaauugcagucuaucuuacucaggaaaguacaaaugaaaucacaggguugauggggaguggugggguugguagggguugauggguuggugggaguuggugggggguugguggaggguggugagggguggugguggggguuugguuuaugcuggagcuggaagcaagucaaguauuccacagcugagcuaugcucccaagcuucucuucucagcacgauccacacacaguuaucugccauagcauacagugaacucacuuuucugcuuggcuguugggucuaacacauuagauguauguguuagguaauacacuaaucuauccacuucuaauaaaacagcagaugucguucuguacagaaaucgagcacuuaggauugaaucuacauuguccagucugaagaauuucuuacuucguaucucugcaaggcagaacaucuuuaugucucaaacuguguaugugugugugucugcauguuuguaucuguauauaauuaauaacuuugaaaaauaaauaauauuguguauaauggggacuuuaaagcaugccugagcuaucugaaaccaaaauauguucucgauuggcuuucauauuuaagaaaaaggggagaaagaguagugauggggaccuuuugcaaugaaaagguucuacaggaugaaaucuuaaaacacaauacuguugcuauguaauuuaggcuuucccacagcggucuccucuguacccuugaaucuauuaauguuuaugccaugugcuuagcauuauccauaauacagaaugauuccaaagcacaaaacaguugaauuugccuuagagaauccacagcuuucagcuuggugccauuguuuggugugcuggauauuugucugacuuaacauucagucggaaugacaaugguggccuuuaaugccagcacucaagagacagaggcagguggaucucugugaguucaggacagccagggcuacacagaaagacccagucucagaaaaacaaaaacaaacagaaaagccaaccaaccaacaaacaaaccccauuuaaauccaugugcaauacuuucagcacugcaaguuuggggcuaugcuuucuuuccgguuauuuuuugaguggaacacagauuuagaacauucaagucuugaguuccugcuuuagaagaaaacacuucagaugagacuaaguuuccuaagaccaaaccacuuagacccauccugaucuggucaagugagaugggguggccaugugcuagggauaauuuauacaguagacaaauguaagaacaguuuuccuuccucuucuagaauagaguugacuguguccucucugucucaaagauggaagguggucuugugcaucuuacgcucaaauuggugcucuggagaguuaggaacuaguacuuagguuuccucagagucaguaggccuauuacauacaaaacuaacaccuucugacgugugucauauuggagaguaauaaacaugacuagaagcugguuaucuuacauacuaagaauuaggaguuuugaagcagccuguguggaguucacagauucaacaaaaccuuaagaagaguucauauguucuuaaaauucuuuccuucaacaaucuuccugcagucuguaaaagauaacucugguaacagucacuucuuccugguggucuguugugaguuuaggacugacauuagggaaauaagucauuggauacuucuucuaccucaccucgcccccucagcacagggcuuugagguggagcaagcaugcuaccauugaccaaauccucagucccacugagaugacuccuuugaagaggcuuguuuccuuuugccuuguuguauagcuuucaucaaagguacaauccuaugcaugcauuugacuuacugagcagaaaagggaucgacauaccuuucucugaugugaucgauggaaggggaggaacauggauuuaugggaaaggguggacugaaagaacucuguccaccaaggauggguggggccuaagaauuagcuucugaggaguccgggccuuugauaagcaguucuuuauuuuucuucucuccuguaggggauucuuuuggcaucuggagauaucugauugcaggcaggaggauagagaguaagagcaaguacgaagcagcaaacaauaaacuucccauguguuggggaacauggaagagcaaaaccacagaggggaaacagugauaaaucuaaacaugucccgcaguuaagcucgagcaaauggcagagagaauguaagacgugcucccuuuaccaaagacacguguccgagucuaagcaccaccuaccgaaaccuacaucuucucuuucccucgcuucccccacuuucacaucacugagauuugcauccccaccacccaccucauucugccacaauaugcccugugugaucuauucagaccucauuaaacugacguacugggcccacuggcucugcucagccucaguuuauuccaacuuuguuuaagauucgggaagugcugggggcggggcaggacauuaaucgcugcgcuugugcaaacggagugccagcugauuuauggcaaagguuauaaaggaaaaguauuaaccaugccucgucccauuuggcaaaaccauccugcacaauguccacagaaaccccaagaguccuguuuuguggaaagaaggggggaaaacuccaccaaagauacacucuucuucuuuugagcauuaauuaagacaguaaaucacgggccacaugaaacaacuguauucgacagaacguggaugguccaggaacucugcuggaguugugugaguggucugaauaccuccgccaaagcccuaaagggagggcagacuucaaagggcacuuugggcaugaaggagagaucugcuccaucagggagagaaacgguuguaaaguacagacugcaaggagaaauagugaugaggaccagugcagaggggcagaggguaaugcagcugugggcuuuuucuuaaagggaccagauaaguacucgguaguguauacucuuuucuaaaagaggaacuuggauuucaucaucuaggaaugucuuccagaugaaaacauaccucuguuuuuaaggagaguaaaggaaaucgucucuguuuuguuguuuuaacauugguauuuuuaacccauuugaaauggccucugucuguuguauugacuauccaccauaucccaccacuggauccuggaccguuuuuuuguuuuguuuuguuuuuuuuguuuuuguuuuuuuacaagcuucagugaguucaggacaugugagccaugaguaguuugcaaagagugacuuuaucuuaacucacuugccuccagacagggucagcacuucgcacagaggagggggaauauuuuggggagaccuuguguacguuccccuucagucacuaaguucauacugaagaccuucaacgauacuuuucucuccugauuuguuuuuaacugaaugucuucgcauuuagggccgaggguuucuuuuucuucugauagggcuauguuucuauucaguuuuccuuacacuaagguguccaaaagcuccaaauucauacagauccuauugccucugccuccugaguggugcgcuaggauuauaaagcacgugcccagguucuccuuccuauuugaauccuagcuuauaaugcauacauguguaucuauaagcguguaaguauggguauaguauaacuccuagaaaggagaccaagaaaaagaaauaucaguugauaaggaaggacaggaggcaagccaaagguucugugaauugcaaaagaggauauauauaaagacaauuuuuguuuccuaguuucaacucuauccuaguuuuuuuuuuaauaugugauaacuggcaucucaugauauaauaaaucuugauguggguucccaggguucauccaacuuggcauuuagaguuuagccauuuagaguuagauccuuguauauaaaacauuucaucaaaccuugacgauuuucagccuuuauuucuucaaauaauuuucccacccccucucucauaagacucuugugauggauacgcugguuaguuggaauaugucccauuugugauagacauacugguuaacugggauaugucccacucaugauggacacgcugguuaacugggauaugucccauuugugauggacauacugguuaacugggauaugucccacuugugauagacaugcugguuaacugggauaugucccacucaugauggacacgcugguuaacugggauaugucccacuugugauagacaugcugguuaacugggauaugucccacucaugauggacacgcugguuaacugggauaugucccacuugugauggacaugcugguuaacugggauaugucccacuugugauagacacgcugguuaacugggauaugucccacuugugauggacacgcugguuaacugggauaugucccaccagucucuugggcuuugcuuuugucaggccuuuucuuuuuaucccaaauaccuaagcagcuccuugucuuuccuuuaaacuugcuuacaucugacaaaaugccccuggcagaaguuugcuuuggaauauuuuagucuccuugugauuuuucucucuaauucuguuucucuaucucuugacuuuauuugccuuuacaucuucagcauuuuaagcuguuuuaaaaacuucauuuuguaagucugccaccugcauucccaagggauugcuucaaccuuauuuuuagaucagcacacuuuucuuggaauuccuugugauuuaucuuuuuuccccccuuuuugguuuuuuugagacagaguuucucuggguaucucugccagaaaacaaagaaccugaaacaaugaguagaagguauauacaacaaacucugagagaucuuaugccugcacaaacccaugauuagagucuguagucaaugaucaaaauacagauccccaaauuugaaggcagaauccuuacugguuguuugaguucccacuagcugcugcaagaugugcaggaaucuauucauaggugccuaucaugauccuagagguuaagggaauggauagccacuguuaagauuaaaaacuaaaauugaccaaguuuaccuccaauuuaccauucaagccuucccuuacaaauugcagauauucaacggacuacacgcucccagaugguuccaucagacagauuuugccaguguggugguuguguauguguaaaaaaacugacucuuuacugacccaccuuuccaaagcucucccaacugucacuguuauuauuaugacuauuauuuuauauuguuaagaaugauauaugaugggcaacuggucuaccucuagacuacauaacccaaguccccugcccacuaucauuucaaaugcauaacucuucauauccuuucgcauguacuuucagcaauuuuguccugacuugaacugauuacucuuaauggacuauggcuggcaugaucaaaugagauacugugcaugcauaugcuuugauacccuuugaaaauaaguaaauuauccucuuuuuuaaacccacauucuuuauaaguaggccacaaacuuagaaaaauacagacaaucuaugauauaaguagucucuaagauguccuauaaucaccucugucuuuuuauugggaagguaaggagaagcugagaugugcccucuaaggauaaacauuuuucaggcaaacaaccauuuuauguguacagguuuuauuauuauuauuauuauuauuauuauuauuaaauuaagaguaaguacuguuuacugaucugaguauucauucauaaacucugaucugagguugacuuuuuuguucaccuaaaagaaaagggaaucaauccccauuauacaaauuuguuguuuuauuugaugaagccugaaauauaagcaccuggaauuaaugcccuuucaucuccuaagcauuaaauucaaguguauaauuuuagacucgauuuguuccgugaaacaugaguaauacuuaaaauaagcuaguuugcagaaugacaguacuaaguggguuagucacaaaucuauugucauagaauauuagaaauaaguauuucuugaugacauuccugccaaaaucaguuagcugauccacaguggcuuagggagauugugguuaaccuauuucccaaaugguaauuaagaaaugguuucagguuccuaggaaaggcuucuuagucccauuacauucucucuccauccucucuuccucugcaugucucaugcuucuuuuuugucacuaagaccagaccauucaaagcauucccuguauguuugggcacugcccaccaaggaagaagaaauuaagccgccaaauguuugaaacccagccuaaaugagccgauuagucuacuuaacucucucuuaucuugcacugugcagggcguaauggcugacacccauuguuugccuuuucuuggcauuaaugaagaaaucagaguauccugccacccugggcguuuccuccaguuaauuuagccgucuccuucuuucuaggauccuucugaaagaagagaguaaacauggaagugagcaguuguuagaauuaggauguauauacucaaacucucacauacagcacacgaaagccaggauguguuuggccccucguaaaaggacuguggccccuagaaaagcaagaggaaaacuaccacuccgugugugcaguaagcaguauccugcaugaacaucuggauguuagggaacagcaaaacuuucagggucugccuccaaacauacagaucuuacugccuuuaaguuccuccaugcuuuuuuuuuuaaaucucuuuauucuaauuaguacauuaaugaaaacaucgcaugucuagauuaaggaagccaugcaaacacuuagcaaguuccaggcucuacuuccuagggaacuagcauggcuauucugaauccauggggcuucgcuuaggguuuugauuccuguagucacuacaaaacaaaugaacaaaaacuaugauggaguugaaacuaggaaacaaaaauuauauugacuuccuuuuucgugauucacagaaccuuuggcuugccuccuguccuuccuuaucaccugauacugcucuugcuuggucuccuuucuaaacauuaugcuauacccacgcucaccugcuuacagauaugcauguauacauuauaaaugaggauucacagauaagggagaacuuaagagauguucuuucugaguuugggucuccuuguuuguacuguccaaaucugcccauuugucucaaaauuucaugauuuuauuuuuuauuuuuguuuugagacaggguuucucuagguagcucaggcuguccugaaacucacgcuguagggcaggcuggccucaaacucacagaaauccaccugccucugccucccaagagcuggcauuaaaggccugcaucaccacagucaugucuccaacuuauguuucuuuacagcugaaaugauauucuauuuuguguguauaccacauuuuccuuuuucuagucaucuauugaucacuugguugguuccauaucauagagcagcaauaaacacaaauauacaaauaucucagauauaauguggaguucucugcauacuugcccaggaauggaaggaauaccugcaucgaaugcaaguucuguuucuaaguuugaauauuucuccagucuuuucaccauacuuucuagaaaucgugaaguuucuauaccuauauguuuauguauuuauuauuuacucauguauucaucugacacaggacuccucauaaucccccagccccagaguccuggauaacuggaauuguagguguugcuagauagcucacacuugcuagacauucuuaauuaucugacccaacaaggaucaaagaccuagcccccaaaaucggugacuuuaagcaaucucauccucguaaaaggauaagaggaaguaagagaagauuguucucauuuccagagagaauuggguaauagccagaaguaagaaaaaaaaaaaguuggaguucacugagcccauucccaaucccauccauaucccccauucccugcccaccaauggaaaaaggugaacagacgguaaacucucuugugucucccuugcuaagaccuagcuaagcuuuacagggaaggugacagaugcauuacccgggcugcgugcacuagaauguguuugaaggcgacuaauucuggauaacuuuuccugguacaccaccagggcuagacgguaugauuucucagcucucuuacuaucaccccaaacgggaacuaucccaacauagacaccaugguccacgagacacaauucaguucacugggagcagcagcguuaaucuccagagaaauggcuauugcacaagguguguggagaaagggaggcgaaacuuggauuaaggguugcaaguccacgcuuuuacuguuuaacuuaagauauauggcucaaaaaaaaaaaaaaguuucgucuuuggcuuuuuaaaagcaaacaaacuucagcugagauuucucuuccugguuucuggaacaaugcccucauuuauuguggguuauucaaaacagcacauuuuaaaauagcaauuauagugcagaugauagagcaggccaaauuugcacugugcuaaucucuguacagagaccugggaagucagugugguugcuucucuuuuauuaguagccgaaagccguuugcaagcguuuucaguuaaagagccuuguucacauucacaggguuuguuguugucuuaaaacccgaucgaggucaggguggaaggccccaucuccccuggcuuuuuuggagucuaucuuugguucucucuaaaacaaaaugguuaauauaauagaaaggcaagaaucucuuuacauuuccuucugaugagaccaugagggagauuuacaggaagcggggucuuuaaaagugaaauugaauguggaguguuuucucaacaacagccaagccaaaccaaggcucaagaccuggaaagugcucuaaauagcagucucuucuccccuaccuaggccuaugccauguccucauaaaauacccacuacacaaggugccauugaguguguguuuaccuugaacaagauaagaagugucaccaguguuagaagaaaggaaaacaggagcccuggucccccuuuagagaagggaaaggaagacaaaaaaaaaaaaaaaaaaaaaaacuuggcaggaugcuaaucaggccuauucagaaaagcccuaauuaauguaauuaaaaucugucagaucaaacugauuacccugauacucaagccuggaguugggacugaggcuccuggggggaggggaggcagcugcugcuucgaagguggaguuaaaguugccggagaaugagauggauggucuccuaagugaucaaagcaucuugagagggaggacagugaacuccugacuggagauccaguuuccgccccaugcgcaaggaggcaggugucuggcuugggauggcgguaggcagggggcagcuugcuuuccucucuaacagcuagaccacaggugagagacacuuucaucuccugacaggccccuguggaaggaguuggccaugaccacugcucacgagcaggaagcaaagaccaugccguguggcccucccaguauggcuacugauacaccagccuuuggcaaauccaccugaacacaggcacuggccagaguccaaacugcucugcucuagagagagggcagacucugaagcgauagcuuugcagaaauuccagguggccugacuagaaaaauggauauuucaucaacagcaggagagucuuauucuacccaaauggaagaaaggauaaaucaacguaggauaaacacauccucugaccuucuaaucaauauccugacaguguccucuuccugaaggcuauaaaguagcauucucuuaacaguuuauucugaagauaauggcagguacucguuaacucccuacuaaucagaacauuaaaaagcaggauucaccuaugagacugcugauaaccuuaugaauuaucuuauauacucuuccuuguuuguuuguuuguuuuaacuugauuuuuuuaagacagggccucugaaaggcucagaacucuguuagaccagccugggcucaaagucauggagaucaaccugccucugccuccagaaugcugagauuaaagagauguaccuuguucaguguuguugguuucuuuauuuguuuuuaacagaccaaaauaaugcaagacuaaaucuccuagcucacggagcaauaggaauguuauacccaguuugauuuuucuccuaauaaaaacuagagagaggagguuaaucgguggaggucagagaagaaguugguguuucagcucgucuucuauugcaaaugcuguuuguauugugccccugguuaguuacagcuuuggaacguuaguuuauggggcuucuuuuuaaaaguugucucucacuacagaauggauuuucaguggcaacacccauagaaugguggacagacaugagaggucaaaauauaaauuaacaguugcguaucuuccuuucaucguguguagcuuaacuaaucacauaagaauaauauguuuuuuuuuauuaagguaaaucauuauuguaggaaguaaacaggaccugacaaggagaauguguguggcaggaucccuaccacagagaaaugugguagcacucguuggugucuccagaauuuaagugaccaaagcagccaaccuaagcuauguagugaguuaaagggaggacugggcuacaucuccagaauuuggugugccuguacgugugcuuacuccaaugcuuuccucuguuauccucauccucaaaguugcauugugcuaagaaacaggcacagugguucuaccaauguggauuauagggcuuucacuaaaagcugaaagacuaauaagcaagcugucuuggaagcuaagagaguaagcguugggaguuuaugacccaaggccuguuuuuucuuguugauuggccaagcaagaacaaauucuauacuccaccccucagcuucuuccaggcuaagaugucaaggccagccuagaacgucccaguucugaaacucugagccauuuuaacaacuaaauuccagguacagagguggacuuugguggguggggaggucucugguuuagcacaucuuaagcaauuuaugccaggaacuguaaaauggacugguaaacaaaugaguucuaugccuuuauuuacauauuauuuugaauggauaacuagaaauuggagggaaauccccucuuuuacagacaccugagggcuuggguucuaugucuacccaaagcaaccuaucuagaagcagcaguuuguguucaaggcugcagaccuugaguccauggagcugaccgcgcugcagugucucuaguccagaguugagcugcaccuguacuggccagcuucagccaagcccauauuugccuugucccccuuucuggcaauuucacaauuuuaugacccuccugcuuguauugauagccuugaaaaagacagcugacuucaauuagcaaaccugcaguaagugugcucgccuggucagugcaggcgcuuaucagggcagaaguggauuuuauggugcaccgaaggccagaaagccaggggaagccuuuucucuuuuucuuugguauuacuuuuuuuucuugcuucagauuuaacccuuuccuucccugcauugguagaacuaucauucuuccugaaugugaagugauaccuuuaaacuugauaguuagcuauuuaauaguuagcuauuguguguggucuagagacacaacuacugaaaugcaaauugaagcccucaaaacaaaugacaauacuucuguuauuccucucguagaagaagauuuuaacaacaaauguugagaucuguggcuuccuuuucccagcaacccuugcguggcugaccuaaugccauacaucuuacauucauucauauggacauguuuuccaugcauuucuuagggcguacacauccaccaucacaucugcagacaugucuccuaugcuucugucagaugucucugaguugaccaguguggugggaaagacccacguuagccugugcuagccacuacaauucaguugcugucccaggacucugcuuggaugauauaccaucucugucacucugccucgucugcuccucuuuccucugggcucugcugagcaucuuggggacauccaacauagacugcacacacgcacaugggugugugcauacucaugugugggcucacacacacaccagaaacaacagcauagugggugccagcacuuguaucacacauggcaugccugaguaccagauguagaaaagagugaugaccacuggacuuuccuaagcuggggagucuuguccucccaggucucuaguucccuuuacuuucuugucuuuuugacucugaauuuaggugaucaagaauuucggggucugugagauggcucaccagguaaagguccuugcugcugugccugaucagcucuuuccaucccugcgacccacaugguggaaggagggaaccagcucccauagguuguuccucuaaucuccacacuuguguguguguguguguaaagaaaaaacuaacaucaaacccacaucucuccauccacaccaauauguugcccacuguaguucuccuccaaaugcaaaauaagcucuuggacaacuuuuccagccuucaacauuuaaugaggagguccacagacaaaggcccuccacaguggagggaugaagugaugggguuuucauguuuguuuguuuuguuuuuaauauuuuguuuugaagaagggucccacauagcccagguugggcaucaaucuuacuauauaagcugaggcuggucuugaacuccugaucuuucugugucugcuucuugccuggggaaauuacaagcaugugauagcaugccagacuaaaaggugauccuguuggacuucuguuuccaccaccggcagugggcgaguugaauaagucuuuagguugccuuugugauuggauaucugcuuuugacuacuacauuucuuuuuugaugucccacacuguacugaguaucaguucuagggccucaaacaugcuaagcaaaugcuguacuagcaagcagcaccccaaucuuuguugguguguguguguguguguguguguguguguguguguguguguguguguguuaguaugugauggggggggggguuguuuugaauuugaaacaucaguguccagaacuuaugcagacacauuaagaagaggucagaaaugucuuuaacuauaccuaggaguaaaagucauggcuacgggaaugugcgagauaaaauacgacugguuaauggguaacgcuugucauugccccuggcuccuugagcaaacgcagccagguaggaucuuuugcucaaagacuguuagggguuagcuugaggacugaggcagccccuuccccagaccuagaguggacccacagcagguggccuuucacugucucuucaaacagaaagggaaggaaucauguuacuuacauugcuauuuucaaauaaagaaggcaaagagagagacauuucuguaaauguccuggagaccacggggugccugaccugccuuucucagcuguuauuuuugcuuguguagcugacccauugucagaacagguguaaggagcagugagaaauuucuuagggcaguagcauagcuuccuuuucugucuagaagaaagagaggcaaaaaggagaccacagcgugacuuggcuagaagaugcuucagucucagcccuaaaggggcaaauggugcugaaaccagaguuuccuuauagaagguaaaauuauuuccaaaaaggugagugguuauuuugguuauauuauauucagggaaaggugcuacauauauauuuucugaaaaauaaauuuauuuucuuuuauagucuaugugcaaguagacugguugggauuuucauuuaaaaacaucagcaucauccugauaagccagacacaaaaaagacaaauaucauaucauuccauucuauaugaggucgccagaauagucaaguucuuagaaguaggaaguaaaaugaagucagcagagccggggggugggggggugggguggggggguggacaaaguucaugguuacuauuaaguaguuugaggcaaugcaaaguucuagggguggauaaugauggugguugcgcaacaaugugacuauacuuaauaucacugaucugaaugucugaaagugguaaaaauaggaaacuuuauguuauguauauuuuaucacaauaagaaacuccauuauaaagauugugcaaacuugcaaagacuugauccagugacuaacugauuagcacaauuaagaacaagcccccuuccccacccucugcucuccuccccucccuuccccucuaugcucuauggaagacuuuccauguacugugugguaaaugcaugaacuguuaaaauuucuaguuaauugugucuuuuaugucuuuaauguuguguauauuucacauuuaauuaacaacuccaaagauaauuaucagcuuaaugcuaaugauuucuaucuuggcucaucagacugcaucauagcgaaauagccaccaugcuaacuucacuaguuauuuugguuccuuuggggaaaucuccuaauugucaggauuuaaggaugcauuuggcagaaaggcaaguuuaucuuuaaauacuucuagauguguaauaauacguaauauaaaauucaccagagagauaaacuuuggcuuaguuaaguuuuaaaucuuagauuaaguucauucuuuugucauuugugauguaaauuaaaauggacacuuccugccucacuuggugacuuuauauaauuuuaagagcauugguaaucccucuuccaagaagaagaaaaaaaaaucuuacugccaacaauuuaauuuuaauuucuuuuuaaaaagcgauuacaagccgggugugguggcacacgccuuuaaucccagcacaugccuuuaaucccagcacuccggaggcagaggcaggcggauuucugaguucaaggccagccuggucuacagagugaguuccaggacagccagggcuacacagagaaacccugucucgaaaaaccaaaaaaaaaaaaaaaaaaaaaaaaaaaaaagcgauuacguuuuuauuauguuugugcaugugcgugcacacacacacucuugcgugcaaacacagcacagauguggaagucaaaggacaacuggaccuucaaccguguguucucugggucaccaagcuuggcugcaggugccuuugcucaccgagccaugucgucugccuuacuuuuuuuuuuuuuuuuuuuuuuuuuaauuucuaacccaaacauucuggaaaaaggccucuuaguugaaagcuaaaauggaaauaagcaaaugagagaguggaaauauugagcgacgcgcucuuguuugaaaauaggagucuucuucuuucauguguuuuugccuguugccuuugcaauuuagaaaaagagaaagugugcauccauguuugugugucccacguguguguuuaaauucuucugaacuuaucuuuuauuaccuaaggaugcuuacaaaauuuuaauucucaagcccagguuuuuuucuuuuuagcauccuuuuuaauggaaaacugauugcuuucauccaguguauucuaguuccagcuccccuccucccagcucuucccagauccuccccgaauucccacccguccaaaucacaccguuuccuucucucuuaucauugaaauccaaacagguaucuuuaaaaaauaauaagauaaaauaaaauuaaacaaaccaaaauaggacaaagcaagcaaacuaccaggagaaaaagagccaaagggacaaaacuauaggagccauauauagauccagaaacacccagucaaacccacagaaauccugcuaaagcucagcaccaugcccaugauauaugugcagaagaccugggaagaagagagaaauaaugcccagacaaagccuuaugagacaaggaacuucccaaugugccguagaguauguuuuguguugaccaucugccgcugggcaaugagaucuguccuugcuaguauuuuguauaccuagugagacucuacuggagaaaaugaaugcuucugggauccauuggacauagcuucugggauacgggguuguguccacuuccccucuuagugcugucaaaugcaguucuugaagaggccaaaauggaguucacuaaauaaagaggccuccugaagaauacugcugugauuaaugucccuuuuuaugguuuauuuuagcaguagcaccaugccuuccccagauguuuacaacacgcuguuuggguagaaaguugaugucuuauagcauccucagccccuguuuuacagaguggcaagauagucugaggacaaagguuaugaacugcuuguaaaggguucagaacaagagccccguuaggguuucauugcagagcacggucacgggcuuggucuuguuuuuauugggggcuaucuuuggcucaucgaucaucugccuacagcaaugucugcuaguucuauguuaacuagcugagcaaaggcugaaggcuucauacaguaacugcauuuaccucaguguagcaggcgagcagauaacaggaggggaaaaaaaucauucacuaauuuuuuacagcuguguauaaaaaaauaaaaaagcaaaggaagguacaaacccauauucuacagagggcuucaagaugcguucaggcuuugaaggaaacugcuugacucuuccuaaauggacuguaaaaaucuuucauguauacuuaguguaucacuuuaagcuacuuguucccuuauguuugucugucucucguuuaaaacuaauccuaaaaccaagugugguggcacacaccuguauucagcacuuggaagcuaaggcagaaaaaggacugagaauuccaagccagccaugucuggaguccaugucucaaaagcaagcaaauaaacuauccuuaguugcagguagauggggaagcaaggauugccucugauaauauuugauuuucuuuuaguaagauguccacaaucugaaagauuccugcaugaguuuaaaaauaaacacaucaaacaaacaaacaaacaauaaacgaaagcacacuuucccacuaaaccaguguuuucuccugugcuuuacaaacgaacaccgggacacgucaagcuaagaagaugacugucagaucaauguguaauccuugagaauuuaaggacucauacuccacugguucagguagaacuaagaacagccuuguucagcuuagcuuacccaguuauugcauggugacuguaaugagccacaacugggcuuuccaagaaggaaaaacaacuuuguuccaugcacuucaaacuucccuaggccaagaaaaggccugauuuccuuugucuuuaugagacuagauuccuucaugaauauuccuucagcaagaacguucuucagaucguuauuagaacacguugucguugugucuaaccauggugagaagaguucugggcacuuuaaaaugguguaagaaaucacagacacuggcaaucccucccucacuuggaacuggugcauuuugaaaugacacauacugcuuuggggaccgggacauagcuuucagcacuugacuagcccucaaaccuaugcccuacccaagacuauaugagcugagaaaggaaagcauucauacagagcacaucccacuucaggguccucuauaauuaauggguuaggcuuggcuugucauucccaaagagauuacccuccccuaaguaucaucaucacuggggagagaaauguuaucguacccaccacaaccuccggcucgaaaacauacugcagagcuuugcccuaagacuguuuaauagcuaagagucccugccacaccgcuaccugagcuguccuaguaucaggugggaggcugaucaugaauagauaucugcauuaucagaaacguugcccuacuugcagcucagugaaacaaaaggaagacuucuuaaaggaguguuuucuuugaauuaucuuucugcaaagcaaaugcagccauugcuuagggagggcccaugcgaguccuacaguaugugcacaggaaacauaauauuaaucgcagugaagccugauacaugguuauaacuaucaucgaaacuccucuuauauuuuauuuacuguuggaacacuuuaagggaaaaugauuuuccuuugaguguccccaccuugggccggggcggggaaagaagaaugaacuacgugucccuuugaaaagccuuuggauuagauuaucagcacaguuaaugcuugagggaccuugugucuccuuaacuugccaauuucuauuuguugaguguuguaagaguuugcuaauuaaacaguucccaagguauuuugagaagaacuugaagacguuucaccaacugaacaauuuauugcugcaguugaaaaaaaaaaaaaagguaguguuuauuaacuuucuugcugcauuuguggagacuccugguuauaaguccuggcccuuaacuggauuuugagacucgaaucagccuuaagccuugcuguuguuucaauguaucacugucaguuucaguaaaccugaaucuaaguaaugagacccuugcugcagaguucaaauaaaagcauugagagcucauaggaacauuucaguuuuaaaaaacaaaaaaacaaaaaaaaaaaacauugcuucagauaguagaauuggagguauuuaagguuaaaagagaacacuuucaacuuagaaauucucgucuccuaauuccuuacagaugaaucuaugaaaguaguuucacuccacuauugaaacacaagccucuguuaaccacacagaccugggauacggggccuccuacuccaggcuucaugugggaggccacagcugggaaucggaaggguacauagaugugggcacaagacgaacucgagcauacagaauccuucucuaaaaggagcugugcuggccuucugguuguagccacuucuugucucuccugggcaaguaaacuaagcuaagcggccaucuuucuuuugggggaaggggcaguagggguggagcucagggccccaugaaugccaagcaagcaagcacacuagcacugagucccauuccccagcuccuagcuggcuauuccuaugcaauuaguaauaauauuaaucuagcuuuuacaauagcguaaaccccacugcaguggguagcauuucgauagaccuuguagccuguugaucagccacacacaagccgccuggaagcuccaaccagagaagcucccccggaggaagugggugugugucugccugcccuuuguuguggucaguaaaggaacuacuugugcuuuuuaauuagaagggugggaccagauucuuccuaauugcaauuugagcugcaauacaaagcuuuuacagaagaacuguguuuaaaagaagugcguggucauucucucccgcauucaaccccaagccuuccuuaagugacuccucauuuuacaguuuagcgggguuuuuuguuuuguuuuuuaacuuaccacaaccuccuccgaaacauagucuaccucuacucuguaguuccaguuuugaaagcuacagcuuggcuucuguuugagaaggauccggagguaugcaagggccgccugggacaauggauguggauacaaagugcuccaaagaggaauucagcaguguccauucagaauagccagaaaguguucauccgaaauugcagacagcugcucgugcuaagugggauuuauccuuagaacuagacaaggaaauuuguauuuccuguuuuaauuagaagggacuuucacaacauaagaauaaaaggcaugguuugccccaaagacaugcaucugcuucauauaaaaauaaaugcauucuaagugugagaaauugcuugaagauggccaugauauugggaauaugcuguguauuuacuuuauagucaucugagguuuucuuuuccaguaagguuaagaaccucaagaauuuuuaugacugaguuagagaaaagagcauggccaaacgcugucguucauguuguguugguacgaagaagaagaaggagaagaagaaagaagaagaagaagaagaagaagaagaagaagaagaagaagaagaagaagaagaagaagaagaagaagaggaagaggaaugcuuuuugucucauacaccugccaacuauguucauggaagggcuguucuuguaacccugacaggaagcaguggaauugauuuuucaccgcaauuguugacuugggauacauaguaaaugaaauauaaaucaguaggcaggugugugugugugugucugugucugucugacuaacucugugucugaguguucaagcuccugaauuugaaaggaaauauaguggcuuccugcacaacauugauuuuuuuuucuuuuuaauaacuuacuuuucagauaucaaugcagagaaugucgaaaggaaaccaugugagucauuuuaaauuauucacaaugacaaaauuucuagcagagcuguaacucaucuuuugaaguuaacaugggcauaguaaccauuuaguccuuccucuguguaauacuguucgucucuuuggcuggggauuuuggagcuggcauugaacccaauaaaaaucaguuuuuauuccuacauccuuacucuaagaaaagaagccuugaggcuuaaggagugggccugcuuuuuguuguacagauguagggaagacaaaauuaggauagauauagacugaaaguuauauucuccaugcuuuguucaaagugggcagaacuuaauguaaauuacuuacaguugcccucuuuuuuaaugcuccuaccugggcaggagggagcuuguaguuguacaggguuagguuuggagcucuuugugagucuucucucuguggcaaccuccuuccaaguauauaccacccucugucaagauuugccacaagcucuuuucaugccucaugugauucucugaagagccuucaagucuguuggaacuucuccaagagugcagcacgugacagagaugucugucccagagcugcgcgcgagcgaggagguccaagguccauggagcauaguuugugcucuggugaggacugccuccugucaugugcuagacuaauucucauggcagaaagggaguaaggaagcucucuauugucccuuguaggagucagcuuauaccucagggggcuguauucucauucccuccuaauaaagucacauugggaaacaggacuucaaccugugaacuggggagaaaagcaguugaucauuggguuggaagaccuagugugguuucaggaauauuuggcaucaaguaagaaguguucuugggaagaaaaaaugugcuggaagggagcugggguaggaggcggcacugugucauccuggugugaugucaaacguccagcugauggcugagaaggagacacagggaaagaggggccuccaucauguuguagauaacaagaagugcagcuagagaagacaagagugaucuucaguccuuaaggggaaaggcagcaagccaugauauaucagaucucugacgucacauaugucaaaagaucugagguugguauuguaguauagaaauguaaucuaauggcagucacgggaaugaggagaauccugaacccccaauucaccaaaauagccaugcauuuaucuagacuguggaaguggcucuaccacccagaaccaugugccuuccagcagguucaguuccucugccauaaaccaccugguucaggaaugaccaguuucccagccucaccagcaccucccugucuucacuucugguugaauuugccugcauaaugguguuacaauugcauccugucauguaaugcuauuucaaauaugacuccuagcauagauucugagcucuucuccuccauuuuauccauucccuacaagaaacguggaccuggagucccgggaauguauaauguaguauagaacaugcuaugucuuguuugacuuaaauggcuuaauaaggaaaucuaggcucagagacauugagugauaggcucaaagcuuucagcuaauuaggggcagaggucuccgugcaugucagagaguuggggaguuguuaaugauauccaccaggcaaucugagcucugacccaaccgugaucaaguucugcauuaaaggauagacuuggaauuuagaucugugugagaggacuuggagugaagcagauaggcuucaaagcaaccaggagaugugcucaggauagcucagaucucagcaaucccaacacaucucacagaucuuccuaagcaaaaguagcugaaaauggagggaaaaaaaaucaacucuccgugaauuccauaccaucaucaguuuaaaaaaaaaaaaaaagagcccauuguccauuuuuauuucuuaccuugaaauuuauaaauguuguucuuauagcuuuuauaucugaaaaguagauccuggucauuucaaaacagaacagcuccuagauuccagugugcgugugcauguguuauauacaauacuuuuuguuuuuugauuuaaguccuaaagguaauuuuauauuucucugaucuguagaaaacugaucauguucguuucuuuucuuuuggggagggaaaguacauaacuccuuucuaagggaaauccugauguagaaguuucuaucuagaacagucuuuccacugaucugcauccugcagaaugaugugagauuuaucuccaggggaacuggugccgcugcaagggaagcagaugcccacuaagguuauaguaauggcaugagcacagaacacgggagccacuuaguucuuucuaagagaaaaaugucuuuccugaugaagugucccaauuggaguaguuccagcauagaaagaauagugaguaguuuucagaaccuagcgucacugauccgugcacacacaucccagcacacagccccuuuugagugauaaguuuuugcuugcuguggcacagcaggagagcuaguguguucagagauuccucccugguugcggguugcuuccugggauggggagggguaucagggauagaaaugaauaaucauugcuggguuuuuguuuuuacgagccaaaggaaauggcagcccuguccccugccaccccaucaugccccaucccccuaaaacagccuaaaugaagauggauggguucccuucccacaaaggccgaaggggacgcccuucgagugcaacaggaaugguggggugacuuuggguccccacaaaugaagcccuuuccgagugcuguuuuucugggguuuccuggcugugagugcugcuuagcucuuaaaaacuucuacugccaggucaggcggaggucaauguaaacuaacucaacaccuccuuuccagaccguucuucaaauggcaagaaaacaccaggagaaauaguguguuuagaugucaaaggcugccugguauagcaaguauucacauuacuagcuuuucauggcucagcugcacagcagaccaucggaguaccaacuagugugguggaaguccguucuacauguagagcucuuuuggucuuaaucuguguguugccuauaaaugucucuuauucugcccccuccucaauaaagaaaugagaagucacaaguucaauccgaaacaucaauucuagugugccagauauagggauggggggcggggggggggggagaaacacauuaugaucuauucccacacuguuagucaauucugaaaauuccauuuuaaguuuacucauugugaaguaaaucauucauucacuugaaacugaaaagauagcuaaggacgaaucacucagaagguggaaggcagaaacuggucaagguuacugcuaggugugugcuagcuggaaguuacuuuugcaguguagagaagaacugaauuuaaaacuguuucagaaggaucaaaauccauucauucuacagaagauaauagugccacaguacaacauuucuauuaccuccaacccaguaccugggcuugacccaguguaucaggaagucuguuucucauagaugaaaggacuuauggcccugucuaaaaauagcaaugccuuuccaccaguucaucucagcuggaggugggauuaaccgguaauugucuggggaaagaggcauugauugaauggagcugcuucuccagcaaggcccagguggugagaguugaguagcaucauucagauaaggcccugaagcaggccacuucucugucuauuggcucuucugcaaaaugguguggagcuguggacagacaagaugcaggccuguucacaaggugagagggcuacugcucagacuguuggugagcugcugcgccaacaggaaagcuguugaccucuuaaagcucuacuggcuguuucugccacgcccccaggcacacagccuugcagagcauuugccaguagaauuggaugugcucaacuaggaaugauucuccugccaggaaccgggugagaggaggugguaagcacaaggacgguaugccucgccuuggccacuagucacaggggaauucuggguuuccugccacuguagcuauaagcugggaccuucucuuucagauguuccuggagcugcaugcucuccuuagagagagagagagagagagagagagagagagaaugugugugggcaggaugcagaguuaaguaaggugugcacucggauaggaccaggaaaaaacaaacaaaagacaaaacaaaacaaaaaaaccagaagaagcuuuuguuaaagucugugaaccucacucaugcgguaggggucucaccucagucauugggcaccauuuguagauggaguuguugguuaccugagacuugcccaggcuccuguaguacuaaggggcuccuauccacacauuuauuauaacagcuaaaguauuuggggguucccuugauggcuggggugauggucuguggcuuugaaguuuuuuuuuuuuaaucaauggucuucuuauugauucauaaaugucuuuugaauaaacuacucguauacaccugcucccaugcaaaccgauacacaagcucuagccccuagauuauggcacaauuugaaagggcugucuauaacaauagucuucuacagugcuauuauuaauaagcugaaacaaacagugggcuaagagccuuucacagggaaacgauaacccacaguucacccuuucuuauacgggcugucggugugugucacucacgaugguaaagcuacuuacugcaauuauguacugaaagggcuguaccuuuggcacacaaacaauuuucaaaaguguguuugaaauuacugcaccaaaguuaauacaugaccaggcugccugucuaagaauguuguguaaacauuauagaaaacgaucgcuaucucaucuguaguuuaaaaacugggucaacgagucugcggauaaaagaagauuggagcuucagugcucccauggacugagcccucgacuuccaaacucagggggcugcccuguaauccuaauggauugauuuccgaaauuccuuggauuuguccugcugaacuagucuagucucucgggggcuuagcuggaucccugucgauaaauauuaugguuuauacacaguaauuccacucaguccagcuguaaacuuaagucuauuguauuaacacaacacugaaaggaaaccuugcucuuccagggacgcugagccugacuuucagacauguuuagaaaaauauacaggguuuucuacuagcugguuggaggcccuuggagacaggacccucccuggccacccauugucuggaguuucggcuugcuccuuccaaaugggccaaauaaggagcuucccagaguggucauuaaugggccagcuuuggugggggcuuuguucuuaacugggggcuuuaucuuaucccugcuggcuaagccccuccauguacuccucaccugucauaacugucacgcauuuaauccaucauucgggucgacggacggccucuccgaucgcaccacgggaugggcgggugaggaggaggggaagagcggagggcggaguccacugaggaugauuagcaggguuucauaaagauuuuaagugagauuuuaaacaaguaggcagcuuggcgggagagaacccucugcuucaugguuggaacauaacagcuaacauuucaaaagacagcgaacgcaacaaaguguuugccugaagaaucuaaacugaaaugguaaaaaggaccagaggacaggccccuccgcuccuuuccuaccuaaacugcauagagacuguccuuucucucucaaaaacauuuuggcacauuuuaguguguguguguguguguguguuuguaugucuguguguguguaugccucugugucuguaucugucugugugugucuguguaugucugugugugucugugugucugucugugugucugucugucugugugucugugucuuugugugucugugugucuuuguguaucugugugugugugugucugucuaugucugucugugugagugucugugugucuuuguguaucucuguguguguguguguguguguguguguguguguguguguguguguauggucacucauauaaugacacucauguagaagucaggacaaccucuaggaguaagcuaucuuuccaccacguggguuguaggaggcuuaagcucaaaccugauggggaauucuuuaugcauagaguuauguucaaucuuugacaaaaauacagaaagaaaaaaaaguagcauuuuuaccaccuacguauaauagauaauuuauauguuuguauuugucaccuaauuccuauggagaugcaaacauguauuuuccaacaaaaaauuauuauggugauauugaugagucuacauauuuucaccauuauauaucugcaaaguugauuuuuuuguuguuuuuuuuuacauuuaacuuugcuuuuuaugggcauuuugccugaaugugugucuauagccauugguucugagccaccauguggguacugagaauugaaccugguccucugaaagaggaaccaguguucuuaaccacuaagccaucucuccagcuccccaacugacauuuaugauaaggcuguguuuacggugaaguacuugagucagcucuugagcacaguuugugugcuaggcauuguucucaaugcuucauaugaauuacaguucccggcccccaaaaccuugucaggagcugagcgcugucauuuccauucuguuaacaacaaaggaaaagggaagaagggaagaaguugccuggaugcaggccgugcagaaccaggagaauuaagaucuuaccaggcaagauggccucacagccaugucuuuuugccauuauucccaaagagucauaauguaccuagucuaaaaacuacauucagagaugcugggaugguccggcagaugaacucaccugcugccaaggcugauggcccugggacucaucccguggagggagaggccggacuucuguaggauugggcacacacucacagaaauaauuaaauuuaaagggaagcaucuuuggaauuuugugaaaauauuauagaccuuuuccuuccaauagcaaaaaauuaccuagacuauguccagguuuuaaugucuguuuguguguguguggugugugugugugugugugugcgugugcgugcguguguacccagaggcuacuuacaucaggcaucuucucaauugcucucuguuuuacuuuuuaagauaugguauuucacugaccaggagcuuucuggccuaaacuggaugccagcaugccucagggauccucuugucccuaccucccagagcugggauuacaaucugcuuccccacacccgccccccccccacacacacaccccagguucugggcaagcugcaguucucauacuugcagaguaugcuauccauccggacucuuaacaccccaguuuuauacuuggagcaauuguggacagagcuggauugagaaaauccagcaguuuguccauuccggugaugucaggccucguuacaacagaaagcuacuguccuuuccugaggcucgacaguacccugcccugugcagacaccugagaguagucuaggagacucugaacgacacgugcuuggcacguggacaguaaaucuccuaauucaguucucucuuucagcacucucuggcagagagccaagcuaaauauuucugcucgauaaaauaugcugagugcucuacuuugcucugguggccuagcuuccgugauaggguuuuccucagcgagaugaggauaggaauaggaacuagacaccaggcugguagcgccuguguguauacuuuucaccacagacugucuuuaugagcuaugauuagaugagcuugugcaagaaggaagaccaaggauuuugaaaauagauugaaugugaaauucuuucuccugccuauuaccuauucuuauuuguuuuuuuuuuaauuaucuuuucagauuuccuaggugucugccauuuauuaucuaucuguuacauuuuuuuuaaacugaaucaauuuuuaagguuguuacaguuggucaacugaaagaccuaacauauggaccaguguguuuaugccagaugaggauuauaguuaauugaaauaugugaguccugucuuaauuaggacuaauuagaagagaaggagcaacgacauucagcuagcccuucucauggcuuuagacaugucuucuucacaucaaagggcuuccuaggaguuuucugaaguaacagaauuauagaacuuugugucuugguucuucuucucuggugguuuauugugugaguucucucuacuacuuuuaccucaaagccuuuucaaggucugaauuauagccgugucauaaccaacaucaucaucucaguagcaaguucccacaaaugucaauacucagaccacuuccaacuuaguauaacuagauucaacagucuaauuuaauaugccuguaucacuaugacugcucaaacuauuuucccauggaucucuuccuaugccuaugaauuauuuggccaaagauuauggaucuucaaggcucuugauauaucuacuuaaauuuacuucuagaaaaaguucuaucagggcuagagagacagcuuggcaguuaagaacacuggcagcuauuacagaggauucaguuccuauaugacagcuuacaaccaucuauuuccaguuccaggggauaggaugcccuuuucugacuuccacagucaccaggcaaauacauggugcauauauauacacacgcaggcaaaacauucauauacauaauauaaauaagucuuuuuaaaauuuagaaaaaguuauuaugaaaaagcauguuguauaaauaccuagaaacugagauuuauccuaaaaauuuaaguacuaauaucuuuugauguuucuuuuuauguaaguauugaugacauuauuaauggaccauugucuagcuuuuguuuauuugaaaaacauuguaagcucugacuagguuugggguaccaugccauaucccaaagagcagcuuuugcuaccuugaaauguuuauucuuuuuuuuuuuaaagauuuauuuauuuauuauauguaaguacacuguagcugucuucagacacaccagaagagggcgucagaucuuguuacggaugguugugagccaccaugugguugcugggacuugaacucuggaccuuuggaagagcaguuggguacucuuacccacugagccaucucaccagcccgaaauguuuauucuuaugaucauauuccacuguuucuuugaagaguuacaauuuguaaugauauguuuaauccauguauuaagacugugucuuauaagcuagguguggugguucaugccuuugaucccaguacuugagagacagaagcagguguaucugugagacaggccuggugugugugcguguguguguguguguguuuguguguguguguguguguguguguguguguguguguuaugaauaaagaaucaauguauaaggaugauaaugccaacccacuuuugauagaauguagaauuuguguuauuuuggcaguguuggggauccaacucaaugucucucucauacaucugagauuauaaguacuuuuucaacaaagcuauaaccagccacagauuguauaauguuuagucaguuuuccaguguuggguaugcauugguauuuauccauccacaucuuggugauaguuuccguucugagucacaaagucauccauaacuggaauaggcauacgaucuggggccacuggggcagaacucguaugcuugacuucauuuucccaugcccuucaucaaucucagaggcagacugucugcuccaagccaugcacauagaagcuguuucugucccaagguauaagcuacauaaaagcaggagagaacuguauagggaaagggggacaagaaagaaugaagcagccgggcagugaugguacacacagcacucggggcagagguagaucucugugaguucucagagaucucagcuaaagugccagccucaucuaaagucaucuccaggauggccaaggcuaugcagagaaacucugucuugaaaaaaaaagaaaaagaaaaaaacgagagagagagagagagauagagaagaaagacaaacaucacauuuuuuuucaugcagaauccagauuuagcaauauaucuguccaucuauaugaggaaaaagcagaagagaugguaauagaagggaaagggauccagguaauaaggacgucaaugugagcaaauacaaugauguugagguaggaggacaccauaaugaaauucauuaucuuguaugguaacuaaaaucuagauaaaaaagauuuagcagccacaacucacaagcacagagcacugacuuugcaggaagcauuaggacagacaauaguuuauauguauacaacauuuaaaagguggaaaucuggcuaaauaaagcaaaggagcccuccccccgcccucuccccccccccccccccccauuuaucagcauguucgagucacccaagaaacuuugucaaagacagaauuagcugggccaucaucucaucauuugauuuaauugguauagauccaaccugaaugguaauauuuuuaagguuuccaggacauucugguaugcaccaaaguuggaaggcuacuucuacugaaagcauuuguggagcguauuuuaaugcuuucccggugcaccuguguguguccuugccugggcuuuuguauucaagucccccaccaagccacaggugagucucuucuuuaucuagaguggaaaauaaaaggguauccuugggagcgcuuagcuuuuucauugugguugagaaagagaugcaaagagccaauucaucuuccaagagguagcaacaaugaaaucaaccuggaaauuauucuguaggguggggaggggucauggggaguauuauucaguucuucugccagaauucagauuugugaaugagaucgcucugagaagcauggucuuccuugccacagcuacacaagaaugcagcacacugcuaggaguugccucgccugagacugaaacauagcuuggcuauuguuuguagcaacagagaaauguagaguuagguaaaugauagauagauagauagauagauagauagauagauagauagauagauagauagauaauagauuauugacagacagacagacagacagauagauagauagacuuagauagacuuagauagacuuagauagacagacagacaaauuuuuuccuaucucacacuuaguaguacuguuaguguuuucuucuaagacucaucuguaauaaaacucaagaccagacaucuggucuugaacucagugugugccuuuggaaggcucagcccagauaauccugcagcucuugccgccuguugaggagaauugugcgacaaccuaccuucuagccauucauguccggggcuccuuguaaaggagaacagaaacauggucgggcugacugagcgcuucucuggaaacaggaugguuucaauccucuucaucccacgcagacuuccaggugcuuagaaaggaagcucaugccagcaggcuugaagcuuccuggaagccacggccugugcuguguccagaucugacucccaagaaggggaaguagugaaguuagcaaggagaugagaacuggcuguugccuccaacacgaggcagcugagcuccgggcuuggcagagggcucaacuccaggagauggaggaauguguggcaagguacauugauggucugaaccccaagguaagaggucuaagcuauuucucaacauuacaguaguguuaaggagccuuauuuauuaacuuuaaguuuuuuuuuuaaauauauuuauuuaauguguauggaaaucuugccuguacauaugucugcacacuacaugcaugucugguaccagagaggccaguccaggacaaugaauagccuggaaacuggaguugaugauacuuguaagccacaguguggguucuaggaacccaacucugcuguaagagcagcuaguauacuacaccacggugccaucucuccauccccagagauuuauugcuucuucaauuuagaaauucucuaaaaaagugauuaagccucugguuggcuaaauaauauuaaggaacaauuuauuuuaaauugaaagcagaggcggcuuaaggacagccaggacuacacagauaaaccaugucucagaaaaaagaaauuauuauuuuuuguauauucauuauacauaguacuuacuguuuuuuuuuucauuuauguuuuacucagaaaauauccggcaaauauuuuauaaguucucaguuacuuuuagcuagucucauggcucacaccuguaaucucaguccaggggaggucucugagacaagaagauacccaugcauucaacuuuugcuacuuagugagacccuaucucagacacaaacugaaacaacaacugcuacaaaccagcuacuuacuguuuuuaaguuuguuugaaaguagacaggcuuaugcuucauaguuaauuugggcaacuagaaucacuuacaacuugguccccaugaccagcuggggagagacgccuccucccccugcugcaugucccaugcucuaugugcaggacaacccuuggguauuuagaugugacuuccgaauucagaauuguuuaaauccugaacaugaggcucaaguucaguuucuuagagaauucugaguaguuuaaaaauacauuaaggcugggguguagcucuaggguagaauaggaacuuuagccagguccugggcuaauucuucagcacugaaaacaauucauauaugcugaucauuaacuaaauuuuuaaaaugaugcauaguugcacuuuggaguacucuguggccacuaagagugcagaagauugagagaaguguucacaguagaaggggaacugucagucauaaaacacugcugggcacuagagagguaaccuacauaguaacagcuggaaacuagacucaggaggaucaggaguucaaguuggcuaagugagacucugucucaaaagaacagaaacaaacagaaccauuauuugagauacaaguccauuuagaagugacacuuaacugcuagaaucuacaccaaauugcuaacaaugacuggcuuuuuuauaaaggcccacuuggcagcaaggaauaauaaacucaccuguuugccccuggggcugugugagguccucuguggcaauguaugggcaggacacaaggggcaaucuccugaugcuuacaggcaaauucaggaaagcuaccuccugggguuuucaggagccaacugucccacaauagcuucucccucacucaagggcggagcuuagccucccuuuaguucucucauuuaccuacccaaccugauccuuaucaccugccgccagaccccuggcuuuuaugaucagaauagaucaaugcauuucaauuagaaaucccucuaggucuggggaaauggcucagcagguaagcaugccucccgugaaagugugaggaccacaaaaaugugguucccuuccuggcacccagguaaacgcagcaguguggucuugguagcgggccaucacugagaagcagagaccugcgaugcccagagaaauccacagcucuuguaagagaccgggaaaacacaaaacaucugacaucaguucaucaguucuccugucucuccaaucucuccaaucucuccaaucucucucucucucucucucucucucucucucucucucucucucucucucucucucucucucucucucucucucucucucccucccucucccgcccauuguagccugaugguaauacucucauggagcaugcuuaagaccuuagaaaaaguaguaaccacauuugaaaggaagaacaguuuguuaucaacucucagcagcuucauuuucaaagaaaauaauucucaaaacuccuaauucuccuauacugaauuauauuucugggagcagagauaauauuuuugccauaguuucugcucagacuuaaguagauguauacauuuugaaaggaaugucuuucuauauccaguauucuggauaaaauacaaauguaauauuuagcaacaauggcuucuugggcagucccuuaugguaaccacaacaugucccugguuuugucguuggcccugggaugcuauugugguugcuucucuggauuuaacacgcugaucucuuuugccaucaucagaugcucggcaggacuuacagaggaaggggccuugccccuaguugaaugcagaugguucaguuuuggguggcaaugcagagagcugcuucuuugaggcaccacacucccguuccaaauuuuaagaaagcuggcuggcauaagacuaccauaggaaucacuaaaagaaaaguuaguguauauaaaacuccacaccaacacugauguaucacgcuacauggacauuaaauuaaaagugaacacagaaauaccgcuucaagaauuuacagagacagcagcggugaaacuuuaagcacuauauuuuguauagaagccauuuggggaaaugggcauauugauuauauuuuucucugucuuccuuuuacaaacaccugcagagcuuuucucucucucucucucucucucucucucucucucucucucucuuuuuacuuacuagcagaaaauaaggaggccuuugucucuaacaguuuaaaacucugagcacuaauccaaacuagguacaaaguaguauuaugugaggaaacccuaacacugagcaaaguguaaucuuagucuacuucaucaagcugcacacauaaacaaauagaacagaugcaaggcggccacauggcuuacuuacuuacuuugcuuuuaaacuucucugcacauccaaaacaauuuggcaaucagaauuaucagcccaauaaggaacgaggagucugauugguugauuucucuagcuuuaccuaauugcuguggggugaaguggcuacagagggaaaguagggccuaagacuggcaggaaagcuuucagaaagaauuccaggguugggggggggguacuuacaggugagagugaacugagcagcccccaacaagaagcagagagcaucugugccugccaggucuacuagcauuaggccuggcaugguggugcacaccguuaaucccagcacuuucaagacaaacgcaggcauaucucuguggguucaagaccuggucuacauacugagaucuaggcuagcuagaguuacauggugaggcccuguuuuuaaugaaagaauguguuuucaagugcuggggucagaaguauacccuuauguugauggcuucugcccugaaauacuuccuaaauucuaugacuguggacuuugugcccuacaauacgguuucuuuaguacaggugucuucagagccuguuucagugcuucguuuucagauaggauccgagaaccacuuuuaaucugcucagcagacauugauacagaccuauguuaauacagacauuaauacauacugagcugaguaguaaguguucaauagccaugacugcucacaacagguagaggagcacagauaaucucauuuacuaguaaauguccuggugaagcuugaauaaaacaaaagcagccagcacggggacggggaccaacagcucuguuccaggcacagucuggccuggaaaccuguguuugcuucugugccuuguguuggcuucagccaacuuugaaggcuuguaguaauuuagauaguuuaguggccucugucuugccucuguaugggaacuucugaaauuaaaaaugcuucuaagaauguucggaauaauaugaagcaaaauguacauuuacugugcaugacaguuugagguuuaaguucauauguuguuguuguuguuguuguuguuguuuaaccacguuaauuuuuacaguuuuggaaaacuucuacuuuagagaacgaagaauucuuucuucaagucuggcagaaaccuuuuauauuagugcaaacuaauuguuaaugaaagucugguccacagagaaauaaaucuuugguuuguuuaaccauauucuggaaagaacaucaagaagcaacggagucagucacccgaggcggugagagcuugaagaccauccaguuacgcagcggccccgacaagauuaguucucuucuuguggggauaaaugcguuuacuuuuaucuacugguuuuuagacuaguuaauguguugcaccagauaaaucuguuuccugaguccaucuuucagcuuguucuccccucucuggugcugacaaaugguuggaguuugacacaguuuaucaguugagccccugcugggggcugccugucacucacucggcuugcucagacugccgcagaguaaacgagagaguuaucugcaauauuuugcccuuacucccuagagacagauucggguugcugugaguuuucgccuccuguugcucacguguccucagccagaggugggcucuuggugauuuuccaacagggucacuguagaaaugaggcacaguuuuaaauuuauacgaaaagggaagccucaagccuguuucaugacccgacgcauauaggaagggcacugaaggagccuuguuucgcaagcacugaaaaagacuuucuccaaaguaauugcagcccgaagacucguucuuuugguguuugcugacacagcaggcaaagaaagcaagcaccuuauccgccucagaauugaggcuucucgggugaacucucucuucuugucuguuuguaucaguacacaucaacugcaccggauaauggguuuuauugugguaucuucacauauguauacacugcacucugaccuuauuucaauuuaacuucccaccaugcaaauacaaagucgacacaaaagcugagcuuugagugggucucuaagguucucuggcauuccaaaugcucuuguugggcagaacucauuggaaugcuggaugaagcgaaccuuugcucugagcagcggcuauuagcacaaucagugagacuucagcuauaugcagaaucauugggaccaugcacgcuugggagcuggcagugggauccuaggagugcuucgugccacuuguugaaccuacuaaagcaaaaugcaguguaaucgcugaccagcccaaaagcauguuuagcuguuaccuauuagugcagugacggggcccuccgagacacugauuugaaugcagccucugcccucuucccaccacccuuuacuguccuccuucacauucaggccagggggaagaggggcaucguagaagagggaacaggguccagaugggaagaaacggaaggcugggaagaucguuucggaaauaggucagguacuugggagauuagacaagcuugcuucaucccugaauacaauuaggaggaauuagaccugcagcaaguagcuuggauuuaucagcuuuaauugucuauugucagagcccagcucuccucuggaggauccugguggcaguguacacucuaauacuuuuaauggcccuccguugugggcuuagcucuccuaaaaaccagugucugcucuuuucaaaggagcucugggaagccuaccuacaaacaccaagcuguuacuuucucugugguggaucccauucuaagguccccacaggugcaccuucacggggaaggaagauggcuauugaacauuaauaggcaccuagcuucccugguaggcccuuucaggaaacaaugggcuguagauggugagcagauaaguccaggcugauggcuucagaaucucccacucucuuugucagggcugaugggucaaagcccccucacucucuuccuguuaaaaggguuaucaggcuuauaugcagccaauaguagaaagguuuuuucagaagauaaggugucuauuggacgaggccuguuauuguaauacuauuguucucuguuuccucuauuaccccucagccucucaggugggaaaggcaguauuugaagaacuagucaguugucuccagacuccaggccuaacguaaaaggacuuccuuccugcucucuaagcuuggugugauagucggaacucuugaguuuuggccuccacaaguuguaagguuguuuuccuaggcaguaggcaugccggugagcugccaucccccaagggucaugguugcaggugagaucuugucaccaugagcagagccaggaagcaugugcguccuaagcuucugcaaagcugguccacagcuuaccuggcagggaaaugggguuuugucuuaaaucugauauucagcucagguaaagaacuacaccccuuggagcagaauuuaugugugggacaggggucagugauucuagaacucaugacuacuucuuuaguucucuuuaucugcuucuaacuccuggagaaauugagugcacauauguacuaucaagcaaaugcaugcauacacacacagagacacauccucuaccaucugcaaucuucccuuagaaaggaugaggcguagucaucacacacacacacacacacacacacacacacacacacccuuuugccuccaugacagagccucuaugcuaggcuaaccugcuuuguagcugaaaaugaccuucaauuuuuuaucuuccugccucaacacccccagguggagauuauaggcguauguuacuuuguuugcuuugugcugugcuaggaauugagcccaaggcuuuguguacaccgaugucuuuuucucuccacugugagccuuucuccuugcugugaggccucuccucucacugaaagagagagguguacuuuggucccaggcucucacugauguggaagcuauccuuccucccucagacucugagagaagauuuuucaaggaaagugcccaugagcgugcaccugcccugcugccucucucucccuaagcaucccugcccuggcucgucuuaguucaggcucauuccuuuucccaccaaauucaggauagaugucuucuggguucagaaaugauugcuuuucccacagccuuuuucaggaguuaagaucccucucaugucugaaucacuauaauaaaaacauaguuagaaaggcaaucagaucuuagaaacccacagugguuuuccccguuugccagggacacgaugguuacuguuggcacuauuuguuaaguugguggauguucaacugaauaaauaacuuaaaaguauguggauaaucagauaaaaccagaacugugacaggaccaaaauaugcugaggcauccugacauggcagccaucuugaaaguuuuuaccgaccuuaggagagugcuuaucuuuguuacauuacgagaagagagcucugcuuuaauuuacuuaaucuuuguuucucuucuuuaggaagucaaaacagugacaucauccucuaccaucccacaggccgcuaggaucaccauucccaagucuaggcccugacaauguuuguccuaguuggggggaggggugaguuaugugucacgcaaaggaagcuuaugcuauuuuuagauugauuuaacacaccauugaaacauaucauacacauaucacacccaugacacacacgcggcguuguaacacagcaugugucauacauacauucucucucacucacacacauaacuugcucuucuuguccggcuuuuaaaaauggaaggcagcccagagaagccaagcccgguugacuagaguugaaaaggcuguuaaaguuuaaaagccaagugccccuccaguucucagcccggcuuugagacaugugggagggcuucgaagccacagugccccucucuaaggcucaggcuuacaguugguccccaaauguuuaccagcaugaagaugccuagcuuacaggaagugggaaaugggugugggggguugagggugggugggugaguagggaguggggaagaggguggggggugaucuauugaugugguuagccugucauugaccuuguuuggcuauagcaggaguugaauuagaaaaugaaaacccguuucaucuugagcauauuuuaucccuuuuuuuuuuuucuuacuuuccuuaggggaaaaaaacuuuuuuaagcccaaguggaguccagucuccagauuuggugcucagguucccuccgugccgcaauagcagcuacuauagucguuuugcucauagucaucuggccgccuacagagugauucccaaccuacccaaagacuaaaggggcggggaaccuggcccaggagcugaaacugaacgaaugguggguuugcugaugcaucaaaagaaagggacggggcuuucagagaacauagcuauugggauugugaugggcuaccauuucacagaugaaugaagacagcugcugagauugggguguccugacacuggagaaaaugaaaaaacaaaacaaaaaacaacaacaacaacaacaaaaaaaaaaaccgaccaaaacuguauccagcguguugcuuagaagaaauauuuuuuaaaagauuuauuuauugccgggcggugguggcgcacgccuuuaaucccagcacuugggaggcagaggcaggcggauuucuaaguucgaggccagccuggucuacagagugaguuccaggacagccaagacuauacagagaaacccugucucgaaaaaacaaaaaaaaaaaaaaaaagauuuauuuauuauauguaaguaaguacacuguagcuguguucagacaccccagaagagggcaucagaugguugugagccaccaugugguugcugggaauugaacucagggccuucagaagaacaaacagucaguguucuuacccacugagccaucucuccagcuccuagaaggaauauuuuaauacuuaggauuccagaccauggccacuucaguucuuugugcugugcacaggcacuagcaccuccuggucuccuagcuuuaguguccacauccgggagugcggggcuccagccuuuggagggugcuggguggcgcucagcccacagucaggcccugcuuagcuguucugcucuggacgcuaccuaagugcuauaauaugaauuugcccuucaucuuagcuuauaccacuaucucuccuuaacuaccaccgucagcaucagaacuuggccuggaacuguuuguuuuguuucccccucaucucguguucguuuguccuggagcaaauacuucaaggauauuauacuccaaugaugcucuaucccuuuuuuuuuuuuuuuuugguuuuuugguuuuuuguuuuuuuguuuccugaugguuucaccuauggcuuuguccagcacagcuggaacaccuggaacuaauuuuaggguugccuggaugagccucacacugauauuugauguuugcguccucccuagacucaagccuauuucgccaccucggaaggugagcccaggcugauauuaauuaaccaugaguugauucacaggcaucuuccagucauuaaagcaaacauuuggcuuaaaauagcccucuucccacucugacugccacccuuugcuucuuucuuuacaccacagugguggaaucacugacacuuacaugguaucugugccccaagagcaaaguuuuucaugaaaggaaagcaggguaaaccguguuaacugcugugcaguggagacagcuagcagcaggccagacccugagaugacuacauuguuuuucuguccauaguggugcugacucagcaucgguuaauaaacccucugcaggaggcuggauuucuuuuguuuaauuaucacuuggaccuuucugagaacucuuaagaauuguucauucggguuuuuuuguuuuguuuugguuugguuuuuuuggguuuuuuuuuuuuuuuuuuuuuugguuuuuggagacaggguuucucuguauauagcccuggcacaagagcaagcuaacagccuguuucuucuuggugcuagcgcccccucuggcagaaaaugaaauaacagguggaccuacaacccccccccccccccccaguguauucuacucuuguccccgguauaaauuugauuguuccgaacuacauaaauuguagaaggauuuuuuagaugcacauaucauuuucugugauaccuuccacacaccccucccccccaaaaaaauuuuucugggaaaguuucuugaaaggaaaacagaagaacaagccugucuuuaugauugaguugggcuuuuguuuugcuguguuucauuucuuccuguaaacaaauacucaaauguccacuucauuguaugacuaaguugguaucauuagguugggucugggugugugaauguggguguggaucuggauguggguggguguguaugccccguguguuuagaauacuagaaaagauaccacaucguaaacuuuugggagagaugauuuuuaaaaaugggggugggggugaggggaaccugcgaugaggcaagcaagauaaggggaagacuugaguuucugugaucuaaaaagucgcugugaugggaugcuggcuauaaaugggcccuuagcagcauuguuucugugaauuggaggaucccugcugaaggcaaaagaccauugaaggaaguaccgcaucugguuuguuuuguaaugagaagcaggaaugcaagguccacgcucuuaauaauaaacaaacaggacauuguaugccaucaucacaggauguccuuccuucuccagaagacagacuggggcugaaggaaaagccggccaggcucagaacgagccccacuaauuacugccuccaacagcuuuccacucacugcccccagcccaacauccccuuuuuaacugggaagcauuccuacucuccauuguacgcacacgcucggaagccuggcuguggguuugggcaugagaggcagggacaacaaaaccaguauauaugauuauaacuuuuuccuguuucccuauuuccaaauggucgaaaggaggaaguuaggucuaccuaagcugaauguauucaguuagcaggagaaaugaaauccuauacguuuaauacuagaggagaaccgccuuagaauauuuauuucauuggcaaugacuccaggacuacacagcgaaauuguauugcaugugcugccaaaauacuuuagcucuuuccuucgaaguacgucggauccuguaauugagacaccgaguuuaggugacuaggguuuucuuuugaggaggagucccccaccccgccccgcucugccgcgacaggaagcuagcgauccggaggacuuagaauacaaucguaguguggguaaacauggagggcaagcgccugcaaagggaaguaagaagauucccaguccuuguugaaauccauuugcaaacagaggaagcugccgcgggucgcagucgguggggggaagcccugaaccccacgcugcacggcugggcuggccaggugcggccacgcccccaucgcggcggcugguaggagugaaucagaccgucaguauugguaaagaagucugcggcagggcagggagggggaagaguagucagucgcucgcucacucgcucgcucgcacagacacugcugcagugacacucggcccuccagugucgcggagacgcaagagcagcgcgcagcaccuguccgcccggagcgagcccggcccgcggccguagaaaaggagggaccgccgaggugcgcgucaguacugcucagcccggcagggacgcgggaggauguggacuggguggacaugagagaggcuuaucucagauguuggaucuucucuuggaaaaacguguggguacgaccuugguaaggaaccagauucugucuuuaauacgauuugaaaccuuuuaucccuuuuucuuucuuccuuuuuuuuuuaacuuuucuuuucuccccccucccccuuuuaaaaaaaaaaaaagaaugaagccucaguagaaaccagcgcuucuguuuuaguacgcggagcacugucaaacauuuagaagacuuuuuuccuccguaugaaucauuaacccuuucaguucuagacauaauugucaauucacugaaauuucaguagugguucuuguccgcuucgccacucgcugccuuuacauuacuguaacuaucccggguugacuuagguuuucacuuguauuuaacaucguuuguuccacaugaccuuacauguuggaacuaaauaagaaugagauaguuuaaguuguacccgggacaaggacaaguaagcaucuuuccccuucucggagcguccuaucuagggacgaauuguaaagaccagcuccggagagggacucccgcuguacuguguuuacauuuucacaagcgcgcguucuaacaugguuauccuuauuccuaauuuuuaucugcggcgucuaugugggaauacguugcagaggcuguuuuaucuuucuugcuuuuccucuuuggaaaggacuuuuuccgagggcagauaagaggaggauccccaagucuucuguauaacuuuaguuacaguaaacugugccacuucagugacuucugggaauucaugcacuuucacauuuaaauagaaagugcuauuuguggcugagggcuccuaaaggaauucucuucagggaauucuauugacuuuuuuuuuaauauguuuuguuuuuaauuuuucuaucuggcucgagaugcccacggauuaaaaaaacaaacaaaacugcuggguguuucccucuuccccaauuuuucuuuuccugugguccaugggagcucgggaaggcugguacucaaggaugcuggcaggaugcaaccccucucaggcuugccugcuggaggaugaaagagacugaacgcgcgcgcgcgcgcggcagagggaggggaccuaguuguuuugaaaguugcuucgcuagggagcuggugggaaaguucaguuuuccccauuuggaaaaggcagacuggguuccgcuccugcaccacacguguuuuccauuuuuagcuucauucagacgcaggcagcgccccugccucuuccuccccuuguuugugacacuucucugagacagcuuuuccacagcucugagggucuggcggccaugaccccgggcgucccgggacacaggacgcagcagcgcccacaacacauuucugccuugagugauaaagccaaggauuguucaaagguagcuguucuuucucucccgaugagguuaacauauacauauacgcuuuuuuuuuuuuuuucagccaaaggcugcauuuuaaaaccgugcuucuucaaggcagucuacuuuacacggcuuuggacucuuacucaacuguacaaguacuccaagcuuuuaaagucuucagagcaccguguuagucauagccucuaagagggaggcacaggagcgccggacaauggggauuaaaagccuuucccuucucuuccaggcugcccccaagucuagcuccggcuccgugaaguuucaaggacuggcagagacugggaucaugaaaauggacauggaggacgcugauaugacuuuguggacagaggccgaguuugaagagaaguguacauacauagugaacgaccaccccugggauuccggcgcugacggggguacuucuguucaagccgaggcauccuuaccaaggaaccugcuuuucaaguaugcugccaacaacagcaaagagguaagccggcugccuucuugaagucugacuggcaauugggccagcucuccuacuacuaucucugagaaccgugagaauuuauaugcauuggcaaauaauugaucgcuccaguggcuguuuuccuugcuuucucuucaaaccaauuccuauucauuucuuccucccuucagcuguccuauacuaauuaguaaacaguuaaauuuuuuggcaaguugacaugucuugggaaagcuaacuggcagcacuggugggcagcaugguaaagggcucagugcuucacccccuggcccucuuggaugacaguuuuaaaggaaagaaacuuccuuagaaaaagaaguuuuuccucugcucaugagauggcuuuauucuuuuaacgagccagcuuuauuagcuggguuucuaaaauuauucucaaaaccuugacguguuuaugaacugaagagauggcauuaaccaggaagagggucacguaaaaguguccucugucaggaugacuucacuaaccacccuuuaccuguggcagcucccuggccugggccaggccggcagguccauguuuuauggcuucugaaguggguacacucuuuguaucaaagacacagaacaccugaggagcaccugauuuguguuuauauaacaauuagagucggcugugaagugauuugcaaaauaacuccuugcucugagaaucuggcugcugcaguugcucuccugauggcuuaaguugcugaggcuagcccucaggagacuucccaccaucaccauugcccacagugcugugguuucugauccuugcugucuuuggggagcagugaaaggagggauucuguguuguaaggauuccagauuugcuccuaggacuaugcauuaugaaagugccaggucacuuuccuccuucccuaagcgacaacaugggaaagaaacuccagaguuggggaaacacugucucuuuccuguuugugugucucaguucaggguuuggggggggaaggagggagguggcaaagaccgagagcuaaacuuaaagagaggaauucuaccuuguguuucacuaaagcuccacucuuuguucuauuucugaugggagacuuauuuguuuuaugaaaagcaaauuuuaaauuguaguuuguguauaaauaccaccaaaaaaaauuguaaccccagaggucacccuuaauuauaccucuuucugaaaacaauguucuucucaacagaaagccucugaguauguaacccguggagucaauguggcguuuguuuggguauuugaggucuggcuguggcuuuaaaagguguaguguguucuccccccaucagauuugccuaaauauuggucccuucaaaaagggccauucauguccuguugucucuguagccuguugggauagaaauaaagacuccugguuuuuugucaucggcucuguucuccuucagaguccuucucagcucagcccuauaaaguuuuucaauuuuuguuguucuacugaaaacuauggcugaacggaguuaugcuauuagaucauuuaguucaagguucagauagucaacuuccccgaaggcuagaguuacagccaggcccagacugggagcaaaguucucugauugcuccagguguuucuagaucaugcuacucuggucccucuuggugucacuguggcuuuauuuaucuuagcauaauucaggcacagcuuuucacuaagccuguuugauucuguuucuuuucugcugaauuccuucccaucucuguauguuaagcaaccagaaagaggcagcucuuguguuucugacagggugcccuucacaacacacagaaagucaggguucuuugagccuacucuauguuuuaccgaaagaaaagucaaaucguugugguagcaccucuucgguccucaaucaugaaagccaccaggaaacaaaauuuaagcaucauccuauccuaagcauacaccaaaaugugggccuguuuuucccuucucuccagcgccuucuguuuugaacuuugggacaggucccuugggguggugaaagagaaggacagaauugagccauugagggugugauagcugcaaaccaguuccaggccagaagcaucuaggauggaggaaguguuuacauuaccauuguucaguuaguucugugaguuccaugagcuguagaaacagggaaaggccuuucuacguguagcuuuuaucugacugaucuggcuugcccaucuuuaaauguuuucauuaaaauagcaaaagcuguuacuuuauguacugugugcugacauccuggggacuuuuuuuuuaaaaaaaaaaaaaacaagaucauuuuucauuaugaauuugugcuaugugucagcaccuucccacccccacccccacccccuugauuuaaaaacaaaacaugcaaacuguauuucugaucuuaacaucaauuuuuagcucuggcucagaaucauucuguucuuuuauuggggccguuugaucauucuuacuuccuauuuccagaucuaaaaccaaguacaagcacacucuucaaaacuuuuagaacguuuaaccggguggguucuucuuccgugggauuucccccucguccuccugaaauaaucucugaauauuugacugcauuaaaaaaaaaucaguuuugacauugggagagcaguauccaggacaacuuucugcugucagcugagguggcuuguccucaggcacuguguggcuccucugacucuggucugaaguugaguggugacaaacaucaggcagaucuagggacaugguguccauucugauugaaguccauuauuaaauugagccaucuguauggaaucucagcacaacaugcaauuccaccuccggacuuuuuuauuugguaguaugugccagagugccaccacaucucccuucacauaaagauaacacgaagcaggagaccuuucaaaaacaccugcuaauuccuuugaaaacuggacugaaguacagacuugauaucucggucuauacccuuauaguaaaaauacaggaaaggaaaucuaauuguugggcgagauuuggggaggggaaaaacagcaaguaauuaaaguaaccuuaauuugaagugaggaaacucaggccacuuuuggaacugaauagugucuccuuucaaaucccccugcuuucuacugggcuccuauaucgaacacucucuaaauggcuguuuguuuugaaagcaaacaaacagaccuaugcugcccuuaucauccgacuuucauucuguacucccacucccacucacuccauccugcacuguaggaaucuuucuuuucuaaaguuaaaaagaagcucugcuuuuugucucugagcuccaguuuguguccuauagccaaagccacugacagagacagaugugcccagguggcagaggggucggcuccgcaagucaagcaagccaugaagagcuuccguggggcugaagcaugggcagccuaaggaggccucuuucucuuccugauggguguagggaaggcacacagcagccaguccccaggaguaauucuuuaggacccuggucaguuccagugaaguuucuuuccucaguuaggugagcacacucuuggucuuuuuagcagugugcaacucaaagcacaggucaaguuucucugugcccucugcuuguuccuaggguagggcacuguaaacaauggguuaggaagauggguugggcuaagacacucaucuggaucaguuuccugcuuuccauuaagaacaacccuggcucuuacccccauccuaagacaccccacaaucaccauaaccuuagagccgcaguuucuaugucuucuuugauuaaggaaucagacauggauuagacgugaagguguuuauuguguguuguuagcaugcugaacuugagauggcuauaggugguuuauuugauguucuuuuuucugagauagaaucuugagaugucuguagucggaaugcaggccacaagcugcugaucuuccugcaugcuaugauuagaggcaugcaccacaccacaccuagugagacaggugauuucgaagcuacaggguuccucuaaccucagaaugcugaauugugugucucuguuuaccuaucagugugaauuuccucguguucuucagcucuguguauaguaggaauuuuaaauaucaagguccuauuguacucauaaaaacaaucuaauauugcauuuuggucugguuauauuucccagacugaccuuggacucaauaaucucuugccucugccucagaguggcugggacuugaagccaccccagaauuucugguuacuccuuuuucucucauucacaugacuugucuguugaguugcauuuguaagguuaaagauggcaggcgcuccaaacacugacuuaaacagcuacagugccaacuccauaguugugccuaaaagguccuagauagcuuguaccuucuuucuuuuucuccccccccccccccccaagauucuaaauaacuuccuuuuggccacaggacaauguguuuuguuagcguuaaaaucgguaggugaaaaccaagcgucucuucuguagagagaauggcaaucuggaagggaagcugugaccucauuguacugcuccuuguugguaaucaagcucugacucccaagaaacugugcgcaggaggcuauaauuuaaaacaaaguugaugaaccagucgagugccuuucuuaaaauuacugcuuuaaaguggauauguugaaauuaucagcugcuaauuauuggcucccugacaaauggcauuauuuguuuuuccugcuuggcauuuuaauauuauggaauaagcauucaaauguaaaugucuaauaauuuguguauuauagaagacaauuccauggauuuuacagaguggguucaauaauucacccgaacaagccugggaccggaaaguguagucaagcauucuguguaaaaauuuaucuccagagucucugcucugagauacucuuguucccccaaagcuaggcuaccagcagacaccaccaaugaggaggugucuuggaagcauagacaggugugacgagggcagaggaggagacgaacaucugcuuucuucagaccuuugccacaaauucaaacaggaccaaaaauaacaccuuuaacucaacgaaucuguuucgaauugugcuggauauagagaauuucuccucuccccuuuccugucuuaagaaugcccuguuaacauguauugaauauuaaauuauuuaacaaaauggcaucugacgauaaaaggacaccugucaugagaguggccuguccccacucuucauguguguuuauuccacacuagacccgaguuuuaacuauggaugaggcuggauaccaguguguaucacaguccaagucucagauuuccacucaaacuaccugaagagacauugauuugcuucucugcaccuaccauucaggaauauaaucauaggagaaccgucaacaaaaaaagccaaguaaagauaaaugcugugcauugccuugcccuggcucaccugccacugugaaagggguacagagucacucugggcucauuugaauuacuuccugguuugugucugaguuguguuguuauuuuuuuuuuuuuuuugauaccguaaaaagaaaguuaugcucaaggaagaaugccauaguuaauguguuucuucagcaaaccccacagagucagagugugugaggccuucaguuugaaaaggucauuuccucagaucuuagaagccacaucuuuuagaacccacagucucauuacauauuccauuucaaagagggacuucugaccaccauugaguagauguuggagaagaacaaaguuacuugaaagaucuuucuaguaaagagcccuuaugagcuauaagccaaaggggauggagaugucaacuggaauuuuaaaaaaacaacaaaaaccuuaauguguuugguuucugguucccucggccucuauggaacagcuaaagagcauuauuuugguuucugagguuaaaacucuugcauuuuccucaagcaugguguuuaugguuugagggagaagacuggaacuagggaacugagggcaguaaucuugacccccucucucucucucucucucucucucucucucucucucucucucugccuucugauucucuuagaacggaacaucuucuggucuuccaacaugagaggccauagagccgagucagucacuagaaagcaguccguccccgggacuauuucaguuucagcacuuggaugacuguaaacgaugacugucacgaagcuuacggcuaacuguggaggcauggauggugccgugcuggguuaucaauugacaguucaauucacucagcuagcuagcuugccaucucagagucugacuaaugaccucauauuuuuuuuuuccccuuuagguuauuggcgugguaaguaaggaguacauaccgaagggaacacgcuuuggaccccucaucggugaagucuacacuaaugacacaguucccaagaaugccaacaggaaguauuuuuggcggguaaguaagaaaaccuuuuuuuuaagacuuuucacuauaggggguaaauggagcuuaaagaacaggcucaguucccuuucaacacagcagggcucacccagggaaacacuggaauucugagcaaguucccuagaacugguuaaacgcucugccuagaauauuagcuggaggugguuagauguggacuaccugugaaucucaauuuuugcaacucauugcauacaggucugggagggaaggaaacaguuugccgcuugcuucaagggcaggcucauuugcauuucucuucgaggaaguaguaaugagucacggagacuuacauuucacccuuucuugauuucuugcugaguuaacuucauuugaauggaagaguuauccugagugaacuugaugucgaagacaaaugucacuaagagagguagaugguggguuaguggaacugggaaggaucauggagcuaguuuuauuuaaauccaucugcaccauaaaacgguuacauuugacaguaucauaguuguuaagcaugaggaaaauccucgugugccuaugagauuguagacucagguagaauaacuauucuaaaggucuggccuaugcuaucuccuuuggagugucaggguuagcgaggauucugaggugaccugggagaugggauucauggguaaaaauuguucucugagaugucucuggcauguucaguuuuccucaguguagaaaugaagagcuauuuauacaaauuuagugagcuguuuuccucacacagacaugaaauauacaccacccagagaaaugguaauauccacaacuggauuacaugagaaaaagacuuugguuaaaaaauuacuuauuccugagagagucugucuucagcuaggaagucuuuguuuccagaaacguacuacuucuacaacugcaucuguagucuuguuaaguauuuguucucaauuuuuauuuauuuaauacuuaguugguguuaaauuauauugcuccaagaucgcagucugagauuaugagcgguuucgcccuuauugcuguucucagaugggagccaccagugguagauuaaucuuggccucagcugguaugaaugaagacaauccgacacugucguuuugaaaacggucaagaagcaccaaaggcucucccauuacuguccccacugucccauuuaaagauuuacaaaaagaauuagacuaaauaacuagaaggcuucccuugggaggaauuauuuaagucaguuguccacaugcaaggaagacaggaaugaaucuuuucacagguuggaagauccugauuugucaagcaggaauaggaacaucucuguguugugaggaaugaaagguugucaugcaaauuacacagucagagaugcucagguugagaaagcagugacauuucuuguaacuguaguaugaaucagcuuguguuuagucuucuugauacuggauggaaaggcugguaucagugugccuuuuacaaaagcaugaugcuaguuucuuggggugcgugugacuuucacgacauccaagguccuuuuuuuuaaaacaaggauacaguaaaccguagccaugaaaggccuacugggaucggcacacccucugcuagcuguuuccacccugguguaagggcgauggaaccccuuguuccuggaaguuugcgcgucagaguaaacaaacuugaaaaccccucuugauagcagaauccagucggucuuguuacauuuucucuuaacaagauacaccgcggaagcucucgcaggcugcuuugaugaagccacacgcaccccccacacacacacacacacacacauacaauucacaggaagucucucuuaaaagaaacugauucugcuguuuacugccuguguuaaagggacagaguuccuuuuuuauuucugauaacguuagagggaaauacagaaacguucacacagccugugugugacuaagaauacagcaaauagcccuguagagcaaacucccugaggugagcauggaagcgccguaccucuuggagacugucuuguguguaaagagggcucucugcucugaaggaaggcggugguucuucaaggagaggagcuuuucuggagaggaugaggagugagucuuugaccccuugguuucaguaggaguguauuucuccccugcucuuaacuaugccuuuaaccaagcacucugaguacagcugugagucagagguagcauugcugaagaagaaccauauauuuucuuucucuucuuuuuccaaaaggccaaacucguggcucuuguguguguagaccguguaugccagccuccucacagauaugggcaaaucucucuacuccuuuucaagagagaggcacaggguggccgccuguguuuaccaagaggaaaaguuacuucucgauaggcugucaaacuuuggccuccgugccagugccucacucuguuauggcaggugaaguucaccuuugccccacccaguguuuccacaaaaaggcaggguuccaaguauucaucugaacaaguguuacugugggacucaggguuggggguggaggauguuugcagagccuaagccccgggcgggcggagguguaggaaacacaaguacagaggccauagaaaaaaggugagacucaguuugacgcaguccucucggcugcugugcccagugacucaaagcacuagaagucagcagaguuggaacucugggcugagcagagucgccugaucgauauucgcuacuguagcaagaguaccucuuuaugguaguuucacccacucucggcuguuguuaauuggaauauuauuauuauuauuauuauuauuuugcuauccacugcccuccccaacaugagaagaccauaaaauugaaauggaaagguaacuagcacaaugugcccuguuuccucccccauuucugcugauucagcgugagucccaccggaucagcaaugaggccuggagucauggguacagcguugguugcucgccuguguuccuucugagccauucagggaagcuucccggucgcuuugggcuggccggcugucuuucacacugcaucuauccucuccuuuugaacagaucuauuccagagaggaguuccaccacuucauugauggcuuuaaugaggagaaaagcaacuggaugcgcuacgugaauccagcucacucugcccgggagcaaaaccuggcugccugucagaacgggaugaacaucuacuucuacacuauuaagccuaucccugccaaccaggaacuucuugugugguauugucgggacuuugcggagaggcuccacuacccuuauccuggagagcucacagugauaaaucucaguaaguggauuacagaacaaaaaaaaaaaaaaaaaauuaaaaaugcuaguaaugucaguucugccccugugagcuaauaacauguugucuaauuauacggcuucgucauguguuggacuaaguagguggcuuuagcuaagacgaggaagaggaaaaacauucuuuaaugucccuacuucuuauuauaaaacauaaucaucaaagauauacauauuacauauauuguauaaaauaaccaguacagaauguuguuuucggaaaguugcaggaagaaguauauuuccgauucuaauuuaugcaagcggcuguaggcacaaucccaauggguauggaccuguggaacaggccagcugcagucccuuccugcugugcugggucagagcuuugaguuuucacugaaaucuugugaagauacgugugccuguaaagccaugaucuaauguggaaagcuguuuucuagaaaaaaaaaaaaaaacugucauaauuguucaaguagucuaagugaauaacccuaagagaugucauaucugagcuuccuuccuuaugguaaaggggacugaucucaucuuucaaucaggcuuacgguaaccgccuaucucuuuaucuugacaaauucuugcuuccuuggguuuauaagcuuuuacuuuuucuuuucuucuuuuuaaauuuuggcuaaaguuacugucaugcccucuagcaagcuuucccucuucagucagucucagguagcuuuaggaacaauuuaagaauaaaaaaaaaaaaauucuaacuucuauuuuaacucaggguguguguucuggguuauacugccgaaucuuacagcacuuuuucaaaugaccaucuucccaugaaagcuaaauguugaagguuuaaaaguuuucauuuuaauagucucugaaauuugaguaaacauuuccagaaaucuauagagaguuccaagcuagacuuuacccaguuucuacucuucagucucauuugcuuucccuggagacuaaauguaguucauauuuuaccacugaagcacuagaaauauuaauuuuaguauuuuaacuuuuaagaccaaggacagugucucgcuagccauguucauucuacaaugcuugugcucucaggaauuuucaguuuucugaaaaucuuagcuucaguaccuuuccuguaggcucacaauauaguguuugugcccgggcccucagcucagcaacguacacccuugagcuaagcaugguggguagguaccugcccaauagcagcaagcccucuccucguguuuggguuugcuuuggguguuuguuuguuuguuuguuuguuuauggacaaggucucgugcugcuuagguucaguucagacuugauguagucagggaaagccuugagccacugucaccuccaaaaugcuaggaucacaggccugugcccuccccccaccccugccucccaccauccccccaaugccuguuccgaguguuuacucuuuguguccagaaguaaguuucauuaugcuaugaaaugacagcuuugcucuucagacacccccccccuuuugacugaugcaggagucuucugagggucacaggaacaccuccuuugucugacauuccuaggacagaaagagaguuaaccauucagcugccgugcaaggcucuugcuccugauugugaaaccuguuggcccagguguggccacugaugacugacacucugaucaggaaaauuuccagcauuucaucaggccuaauaggcagaucgaguguccaagaugggcugugcuagauuuccaggcuuaaagcacaauagaggucuguccagaaucuccguaaggacuuccaucauggggugcaggggauggaaaccuaaugaaagaauguaaguccccagaaaucacaaacugacaggaaagagaagggagagaggaauguggaaaagaacuguuaaauuuagcuccuggcccucccaaccuuuuugguaauuuuuuuuucuaucuaucuaacuaacccaucuagaaaucaguugaccaaauuauagacuucugaauguuaaucugcuuucucgguuucaguugaaaacagacuuuguuuugccuacugcagaacuucuagguucuuucuuguagucuuaggggugcuuauuauagaucgaaaaugugagucggcauaauuaagccauucagaaccuuccaaagcagcucacucuugaaaugacucuguccgccuacagccauuuaagauuuaagaacaaaaacagaucuugauuuucuuuuucauguuaacucaagcugcuaagugggagaguuagaaaugauaucagcuccugugauuagucagcugcugaaggaugaguuuuuaaaaauguaccuucauauacagucuauaauuuccagcuguaaaguauuuuagagacugacauuuugcugcggauauuccuucaggauaaguucucagccugguuguuuguuuguuuguuuguuuguuuucugaagacagagccaccaaacgcuaaauuaugcaugucacggagaaaaugaaaagcucugacuucauuguuucuugguucagucauuagcuucacaguaguucaguaacuaaagugcuuagcaagaagagagccgauuaaaccugugcucuacacuggaagaaagcccaauucuuuauacuuaacagcuuucauuuguuaaguuuccacugugggacuacuacaaaaacauuaugagucuuugaugugauuugccacauuaaaaaaauggcacagacaggggugugguggcacacacccucaaucccagugaucgagaggcagacgcugguggaucucuuuauucuuggccaguccaaucuauauaacaaguuccagaccuacugagacugcacaauaagucuucccccagaacccccaucaaaaaaagagcagaguuaggaaggccguacacaagcaggcuugcacacucucacgcgcucgcucucgcgcgcccacacacacacauacauaggcauacgcacaugcgcacacaacuucuuuucucuuaaccugagggugcuucuaaaaucauuaucuuuuugucuuaccuccaguaaaucccuuccugugacugugggaugccucgccugucagccuuccagcuuaaccugucucucucuuccuuuaccauuuuagcuuuaaaaaacaaaagugacaauuugaacuuccugccugcugggccucacccgaaggacugauauugggcugauaaggggauauuuauuuugguugagaggcuugagaaauugcucucccccagaaagcuuucugucacugaccccaucaacaucuccccugauaguguuguccacgguguuuauucuggggcucuggcuuacccaggaguaacugauaacagccagcaggagauaacguccuguaaagcgcuuuccgacuggcaucaaaucccuccagccugucagccuggagaauggaucugaaagcuuuaguucugggcuuccacagaguucaucuucagaccuaucagguagcaagcuuggaguuccuucucaguuaagcccaaaagggcuguuuuauaagagcacaaaggauacuucuuuacauugucuuaagugucauuccaaaccugccagaucuuggaggucaagaaucuuguuucuacuccgagcaugugcaccccccaacuaaugaugcucucagcauccuggggagaagugccuguuugaaugagcaucccagaaacacaacucagccugugcaucggauguguuuuaucuuuggcccaggaaagcugagcugaggcuuuuccugcgaaauagggcuacauaacuauggacaguuuaggacaguauucuccuugucugagcuugaccagggcauauaugcugucucuaggaguaaauguuugucucuuagcugccucugucuucuuuggugcuguaaguaauugaacuagcuugggaaguaccugucgugguuuggcagaggugacugucacaccucaugauuccaggagacagcccagaugguagucugguuagaccagaaccuuggugaaaugcucgcacugccgagcaauggcuagaaggggcagccgccaugcccuucuaguugauacaggcaauucgaacagggcucaugaaguuccuauguaaagagaaucgaguuggaaauugaugacaguucauuacuuaaaacuagucuuaaucuuucaucuaaguuugcacagcauucugauuuccucuagguaaacugcgaaugacuuauuaacccgugacaaccccccacccuguauuuuuuccaccccaucuuagugaacgcucugcccguuccaguuugaacagcacuuuucuauccuaguucucacuaauggaaaggagaucauccaaggggcacugggcucuauggaggcuggcauugucccaggguuugauguuauucccgauccccccccccccgccccccggaggaaguggagcaguguuucugaguggguggcccagagcccucccuccggagugagaggcguuaggggccaggugucuagccuuuguauuugcugcugcucaggguuucucaagaagagagaauggcuuucugauuucacuucaguucuccacagcccugugaguaaccgcccuuucuucuucauuuuagcacaaacggaaagcaacccaaagcaauacaguagugagaaaaaugaacucuacccaaagaguguccccaagagagaguacagcgugaaagaaauucuaaaacuggacuccaaucccuccaaaaggaaggacaucuaccguuccaacauuucacccuucacuuuagaaaaggacauggauggcuuucggaaaaaugggagccccgacaugcccuucuacccucgggugguuuauccuauccgggcaccucugccagaagacuuuuugaaagcgucccuggccuaugggauggagagacccaccuacauaacucacaguccccuuccgucuuccacaacuccaagucccccugcgagcagcagcccggagcagagccuuaagagcuccagcccccacagcagcccgggaaacacggugucaccccuggcgccaggccucccagaacaccgggacuccuacuccuacuugaauguuuccuaugguuccgagggccugggcuccuacccuggcuaugcaccugccccccaccucccaccagcuuucauuccuucuuacaaugcucacuaccccaaguuccuguugccaccguacggcauuaguuccaauggcuugagcaccaugaacaacaucaaugguaucaacaacuucagccucuucccuagguuguaucccgucuacaguaaccuccuuaguggcagcagccugccucaucccaugcucaauccagcuucccuaccgaguucccugccuaccgauggagcccggaggcugcuuccaccggagcaccccaaagaggugcuuaucccagcaccccacagugccuucucccuuaccggggcugcagccagcaugaaggacgagaguaguccccccagcggaucuccaacggcgggaacugcagccacgucagaacacgugguacaacccaaagcuaccucaucagugauggcggcccccagcacugacggagccaugaaucucauuaaaaacaaacgaaacaugacugguuacaagacucuuccuuacccucugaagaaacagaauggcaagaucaaguaugagugcaaugucugugccaagacguucggucagcucuccaaccugaagguaggucuccagacccccgcggguuucugcccacagacccgugcugguuugcccuuggcugccaggcagugcauuguugagugcacuugagccauaggagacccagcuugagccugaacuggggucugcugaauacugaaaauacaggguuuaucucagugucuuuccuaagaggcuugcaucugcauuguacauaccuggcucugggaaacuuagcaggcaggcaggccucauugcaaccccagaguucaccccugugguuucuucccagguccaccugagagugcacaguggagaacggccuuucaagugccagaccugcaacaaggguuuuacucagcucgcccaccugcagaaacacuacuugguacacacaggagagaagccacaugagugccaggugggcaguauucucuggguagaacucuugaccucuguggaaaaauagcuguagaauugucuuccuguguuguuucaacaauacaaaaaauauggucuuguacuaggcugcuggcccugcacagcuccuggguacucugugacuacucacaggcuauacugaggauggcuggguggaugucagucaaguuucaguggguggggacauguccucagauaaacaguaccucagaguacugugugcccagcuucuccccccccccccccccccccccccaccgcagcaugagcauuguuaagaggcuucuggucucccgagguuucuggcuauuggccugccuuuccccuccagcugcaaacaauuaaucuggucuucccugugcccuuucucugucuucccuugcccucacacuuuaggucugccacaagagauuuagcagcacaagcaaucucaagacccaccuucgauugcauucuggagaaaaaccuuaccaauguaaggugugcccugccaaguuuacgcaauuugugcaccugaagcugcacaagcgacugcauacccgggagcggccucacaagugugcccagugucacaagagcuacauccaucucugcagccucaagguccaccugaagggcaacugcccugcgggcccagcugcugggcugccuuuggaggaucugacccgaaucaaugaagaaauugagagguucgacaucagcgacaaugcagaccgucuugaggacauggaggacagugucgaugugaccuccaugguggagaaggagauucuagcuguggucagaaaagagaaagaagaaaccagucugaaagugucuuugcaaagaaacauggggaacggccuccucuccucagggugcagccucuaugagucaucggaccugucccucaugaaguugccucacagcaacccacuaccucuggugccuguaaaggucaaacaagaaacaguugaaccgauggauccuuaagauuuucagaaaauaaguguuucguguugcuucuuaggguauggcuuggugaaucagggugccuuuagcaaauugcuuguacaugacuccagaucugcaaagcuccgcuggcaccgggugcuucccugcaccucucuggaauuaaagaaggacuccaauguuaccaaaaucucagggcauaaaugaggcaaagacucacuauauauacauauauacauauauacauauuauaaauauauauauacuuauuuacagccaugucuauauauuugaaccuguguauuuugaauauuuguguggauauguuugcauagcgccuuccuauuacuaaaacuauugccuagccauaauuauuuuuucaaugauaauucuucauaauuuauuauacaguuuaucuuucaaaaagcaauaauuaaagaaguuuacaaugacuggaaagauucuuuguaauuugaguauaaauguuguaucuuuguccuguggccauucuuuguagauaauuucugcacaucuguuuaaaugccugagacuuagaagauagcucugugauuucaggcaaccuuucucuaugauaaugcuuuaaaaugagguuuugauauugccaaagucaugugguugguguguuaacucagaagaucacacaaucugagugacauucucuaaguuggggauacaugugcagaauugcucagcaauaauuugaggggaaggaagaagaaaaauauuuuauguuucagaaugaugguuugguuuuccuccuccuagucacaauuuuaccaaacagugacaggaaggcuuugccaaccugucucccaaugucacaugaccauucugaguggccauaugacuuuggcaucccuggguguuaucugaaaaugugaagaagauaaaaaagccguguucagaagaucugucguaaagcacagauguuguguguguguguguguggguugggggguuugagucuggcugucauuuugcuguuggcuuguuuuuguuuuuuuaauaucaaaauugcacaaagcuggugcccuaccaagaaggauuugauauagaaaggcucaggccacacuuaaaauacaagcaagcaaagagaacagaaaaaaauaaaaguaaaaacggguauucuuaucaucuuagguuaagcggguaaugaacauuccuguccccaacgcaucaacuguauuguaucuguaaaacucagcuuuucucaguauuuguguuuuugcauuguauaauuaacuuaauuaaagaugaaagggcauugcaaaaguguucaacaauuaccucauugaguguauccaguaggagugcaggaauuaaugucguaucucaugaguugcuacccagcugagcgugugugcuuccaaaugguaggcugggugguucgguccuguauucuccuaagcccaaagguuaccuguugguguucaagguguaauaaagaaugcuguauauuuaugaaccuauuuauaccaguauaccauguguauauaugauauauuuauaaccacuuaaauugugagccaagccauguaaaagaaccuauuuuuccuaagagcaaaaagaaucucucugaaguuuugcuuaaaacuccaugaccucgcuaugacuuuggugcuugggcaccacccugccuacuaccagagagcagagcaccucagugcagaggugaggguguguagcaucuugggauggauagaaacaccacaccauccagucgcauuugauggccuugcuacaugugugucaguugggucacagaauaaaaaucauuuuucuauuucugcucuccucuuccucuuccucuucuucuuccucuuucucucccuccucuagaacccugacucaugcucacugcucagucugaugcuuaccuuagaguuuuguauauauagaucaacuuacaaagagggaaaacuucagauccucugggggaaacccaagagccuuacugaccuguugcugugacuagcuagauggguuucucuuuaccuuccaaggaucaaaaccagagauuccacacaugcuagcaagcaagcaagcugucacugggcugcagccccaacaagacugacauuucuggaugcaucuguauuugagaaaaauacucacuuaauuguagguuaaccaaagcaugaccugacauugacaccaaauacaaauacgauuucuuugcagugaacuuggguuguuuuccuccugugcuuuucuuguguugggaggauuuuuacaaggacaauugcuuuucuugccaucugucuuccucuuaggccucuuacaugagaguguugagcccacaaugaacagugguugguugguugguugguugguuuguuuguuuguuuuuuccucagaguuaaaacugaccaaaguuauuggcuuuuuacuuugcuagaacaacaaacuaucuuauguuuacguacugguuuacauuguuauuuaugugcaaauugucaaaauguaaauuaaaauauaaauguucaugcuuuaccaau

SEQ ID NO: 5487 - RNA, 1844 nt, Mus musculus
cacucuaggcccagguaagcaggcagauuauacagagaucuagcagcuuacaggccuaggccuagggguaguuggaacauaaauagaaaugaucugggcucagccaaaccauguauucaaaaguuugaguacgccucucaucucaucaccuucucuggucaacaaaagucacauuuacaguugacauuagaaaacgcaacauuuuuccuaagugauucuagaaucuagugauuugucaucuuggagaugacaaguuaccaguuugaaaaaauaauggaacaagcgaaacaacuggccgcacuggcuaaucuggagccuggugcuaccauggagacuccuucaggaaauuuuuagaaagugguuuugguguuuuuuguuuuuugguuuuuucuugauuucauuuucaccuuuagaucuccugacaauguaaauauuuaugccuaaaaaacugacuugauuguagaaggaaggcaucacauauuaauaagaucugucaauugguucucacuggacuccaagcuuccugugauagcuggucuuuaucacaaacuuuaucagauuuugaguuaccugggagggaaaccucugcuuuccaacaaaggccuaacagagaagagaggacuacucuccaagugggcagaacuuuccagaagugccucuucuugcaaaaguaagcuuuucuguuguugcccugccaucccuuacagcaugccagcuucuccagccuuccaauccaggcuuaguaccagugaauuuccagagggcuuucaggaucaguuuacaacaucaagauaucuaaguuugugaacugaucagcuacuacugaguuuucugccuccccacaaugcagauggucaggacuaccuaacccuuauuauaaaauccaaucuaaaagacucuguguguguguguguguguguguguguguguguguguguguguguguguguguguguguguguguucuguucccuuagaaaacccugucuaauauacuauccuaaauguauaaugugaggauucuuaaggaaacaguuucacaacacuguaaggcauucagugaagauauuuaauauuuaauauuuucuuuccuuuuuuuuuccuucguguagaagugguagugaguguguguggucuauugucauguggugugugcauauaugcacugguuuguguguacaugcauagaaaccagaggaaaauauuaaguguucugcccugucacucucugcuuuauuaccuugacacaaggccuaugacuaaggcuggcgcugggcuggaagccaacaagcccuaggcuuccccccccccacccccgucuuccuuuccuacaccacuggguuuacagguguauggguggcuacauuuaacuuuuuacaucauugcugggggguugaauguaguucuucaugccugucaagugcuuuuauucacuaaaccuccucuccagccacccuaaugcauucuucauguuuuaaucucuaguauauucauuaaauaaaaguucuuaauuuguaagugccugcaaaguucugacauaaacacacgucaaaugaauguggugucuccuccucuuucugcuuccaaauaugaggaacagcuacauguggcacacugacaguauuuaaaacgauuaggguaagggaugguagguagguucaguggguaaagaugccugacaccaauucugaugaucauuguuugguucccugguacccacauaguagaaggagaucuggcucccacaguuauccucugaucuucauacacauacaauagcacccauccccugccaccaucacacacauacaaacagaaaaauaaauggaaugaauuuacauuua

SEQ ID NO: 5488 - RNA, 4288 nt, Mus musculus
uccuagcaagauuagaauuuuuccuguuuuauuuuauuguuugagaauuucauaaacauuucuuauacaucguguuuugaucaaacccacccuauugccuucucccuaacuccucucauuucuaccuacuaccuuuccccaaaaccaaggcaccaugucuauuuauugcugccaauaugugcauggguccaggaaccucgauggcagcaggggcaguuuaucaaggcacacaucacugaugaaaacuggcacucuccgucuuccagcagccaccaauagcuccucaucuagggcauggcuuugagagcccccuucccauccauguuaggguuuuagcuggcuugaucuccauccgguuuugugcaugcagucacagccauuaugaauucauuuguaacacgauauuguucagcaauuauguguggaagagcaguugaaaguguguaagagccagagguaguagaggaacaguguuuucuagauguaccagggcuauagcacauaugaaaggccaccuucagcaguaggaaaaggauaguaugcauacuauauuaagaggagagaaauaacaaaaucuguagguaggauauagagaaaauguaggaaugucaagggggaaggaagaugaacgugauagcuaagaaacccacuuuaagaaauggguguuagccgggcagagcgacacaugccuuuaauuccagcacgugggagacagaaguaggcauauuucuaugaguccagccagagcuacauagugggacccuguucaggaagaaaaaaaaaacauagaaaaaaggugauuauuuaauaaucgguagaauguagaaaaaugagggggugaagggaauuccacauuaaagaucuaagaggauccucagccaaaaugucauuuuaacauguuuuuaaauuuagcccucaccauagugaguuucgcuaugacacaggcauacauauguaacugcucuuugcucuuaugcagcuucucuuucuucucccuggucuucuuuccucuucugcuuucauaugaaauacugaaauguacuucuaauucuauggagagagccauugggguuaagaggaaacagaaaugguuuucggagguagccugcuggggaacagaccugcucuggguguguguaugucgggcgucggggagagagcugaggcagggggcugacgucccugucucagcucauucugcuucgauucugaggcggcccaacugcucccucccuuccagcccaccuuucuaccucucucacgguuucccuuucugcuucuccgucugugccuccugcaaccagagagaccaagugagugaucaauauggagggcccacuagagaagaauagagcagcagagaugguuaugugcacgaagcaucucucguagguggccuaagguggggucguggaaaggcaacugcgcgaaggaaaugcuaccuguuugucucguuuuguuuuaugggucaguuuuacuuuaagccccaugaugggcagggcugagggucuacacgcguuuucuuccacagugaggagaggcugggggagaaugccuccauuguguggagcugucugaggauuuauuuuccccccucuagaggagacaauuggcauccaggaaguggucaggacugagaggcaggagagaugacuucaguucaugcucacccgccaucugugcguccuuuggguuagauucucgacccucaguuucuucccuggugaaggaaacacccugccacuuauucugcuagagaaagugacuguuuuagguuagggaaacuggaaaucacugacaaaaaaaaaacaaaaaacaaaaaacaaaaaccccaguaccucuuguuuugcucuaucacccuaaaagagacaaucucugugaaccuuccagcuugcuguuuagaaacugaaaaagggaaggaaccgaaagggaaagguuaccucccuguuucucuccgggacccaucaagauaucucugccucuaauaaucgccuggauagaaauuuccaucuuagcccaaagcagcucaaccugguuuugacuaacgccccaucucccuuuuuuuguguuccucuaagucaacaagaggaccuggacgagucagacccugugugggaagauuggagaaaagaaggaagguauggaaaccaccagagauggagauaagcuaaacauccuggcaaguugucacgguguacagcucgugcagaaggcugagcaguugggaagguaguuugcagacuggcuuuaaaugcuucaucuaauugcaagcagcugccgauuagcagagcuugcccaacuguuuucaauucaguggugauggagagaaugagccuuguaagggaaacuggcaggguggaguguaugcaaagagcugcuuacacuuuuuccagaggucacagagugcaguaacuacuaagggacacucucuaaaaucacugcaggcccucaggacaaugauuuuccucaaccucaccaccguuucucgaguuuggcgggaggcaagcuucccuguuagccguauuccagagugaucuggggggcaugauucaucaauagcuagauuucaugccaguucagaagcgacuguuuucugauggggcaauaaaaucacaaugagagguaauaauaucuuuuaaguguccucuuggaucguuucauucuuaaaauuaaaaaauaggaaagaguagaaauguuuucacgaguccucuauaauuauggaaccugcuacacaugacucaaauugaugaauuuccuggaagauaguuugagcauccaaauuggucgagcuuuucccuucuucaaaaacagguucuuaaucuuuacucgguuauuuuacuagaccucauuucuugucauacauuuuaaauagucguuuuaauguuucucuucugugaauugaagaaacaguuauggugauggaaagcagcuucuacaaaccuaggaaggccuguguuccuucaggugcugccuaacuagccagaaguguaugagaaagcagaagugugugaaaaaaauuccuaucgugcaccaagauuuaucaacaagaaucuucacucauauuuuugauaauagcagaaauuuagaaaucccacagugacuaaauauuuuaugguguccauuaguacaaucuuagguagucucgacaauguugaauauauugauguaggaaaauagcuauaagaaugugauagguagaaaaugggacaauauaaccauuguuaauagagauaucuuugcauauccaucuauucuucuagaccuagaucugauaggcuucaagugugcaagaguauauguguuucuuuguguguguguguguguguguguguguauuaguaugugugugugugugaguguacaugugugugucuguguguguuagugugugugugcauguguauaugugaaugugugugugugcaugugugucugugugugugugcaugcgugugcaugugcauaugugugaguguguaugugaagaacaucauagaggcaauagugcugagauuauaagcacuuuaaugauuugucauuuuuuucuaaaugucuugggaaacacauauaugaguuuucuauuuaggaaaauaaacuuaguuuauaauggaguucccagagagucagauuucuaucacugguggcuucaucccuuguuaagauaaagcuaagagggagacucaugcccagcaaaggagaaaaggaaucaagagagacagcacucaauaaacacccaguuuuguuucugcuaucaugccuguuugaagcacucacacguauuugccucagcuagauaagucagccccuuagaaacacucacaguuuccgccagcugcuuuggaugguugagguuagguuuuguuuuggugaacuucaccgccuaucccgugagcuagcauaugaaccgugguaaagagagucucugaggcagacucagaggcacgccgcuaaucuucugacauccgcaaggacuggaaaaggcagcgccaucuguuucucucccagggcaggccccuugaugucaaagagauggaccuucucagguccagucguuagauggacauccaguggcugcagccgcaccuugugagucugauacucuggaggaagcagcgcaacaaagacuggagugaucaaccguguuagacccaauuuacaaguccuuucugggauugguuucccaaauucuuucccaugaauuaagcauuugcgaguccucuagcaggaagcucuuugucacugagagcugucaacgagaggcugcucaugucuuugcccaagccuucug

SEQ ID NO: 5489 - RNA, 729 nt, Mus musculus
ucuuuucuuuucuuucuuuuuuuuuuuuuauagaacagcagacaccauuauuacacuaugcaugaggcucauuugccuuuccgggcuuugaucuuccgcagauagaacuccagcuccuugccuucgaacacacagccgucugcuccgccacacuggccugguccugaggcaacgcaggcgagaagcucgcccugcuggaacugcuccuccagaagacugcugauuuuggcauuuuuuucccuuucgucguauuucuucugaauuuucuuugaucguuuuuuguuuaaaaucucuuccuccucaggagucagcuuggcccccuucuugcggcccaggggcagugcaauagugggaccuguaccacugucgguacagcgugcugucaauaagcaugaugcaguucuucacuagggucuugguguggacacgcucguuguuggaugcauuguagacaacaucaaugauccuugcuuugcgaguacaacacucagagccccaggaaaaguuccccacauccaaucucagggcacgguacuucuuauugccuccucgaacucggacuguguguaugcggcgagggccaaucuucguguuggcagcgggccgucccagcucauacuuccgcuucuugugguaggguuuucgcuuacccccggucuugcggcgcuugugccaguugucccgagagaugcccaucgcucggcgcuggcuggaaagagauuuacaggg

SEQ ID NO: 5490 - RNA, 134519 nt, Mus musculus
cgagcccaggagggaagcggggccgcggcaggaaaggcgcgagcgagcggaggcggcggcuggugcccaccccagcgcggucugguuggcagccgucggugcggcggacugacucggcuuagcauccuagcguuccugggcgccggccgcagcgagcucgcuccuucucccggccugugcggggauguagggcgcgggucgcggaggccgcgggcgcggcgggggcuucgcggaggccgcgccgaggauggagagagcgauggagcagcucaaccgucugacgcgcucgcugcgccgcgcgcgcaccguggagcugcccgagggugaggcgcccggagaacgcgcgcugcacuuuuccgaggcuggcgggcggggggagucggcgggaggcgcgggggcgcggccggcgggggcuggggcuggggcggggacggggaccggggacggggacgggcuguccggugggguucgguccgagcggaaaugcguuccgcgggguccgggccccgcacugggaaagggugcgguggcgccucgcacgggcucgggcuggggacgugcuggguuugcuuaagcuacagagugagguaggcgggcuaggauuuauuugaaaugcggggcgccucgguuuuggcacuagacaaagguuggcagccaccagacagguguguuugugcagcucuguugguguagcaggcauuccugcuguagcuugccugccuccaucguuuaguccugcagacuuggguugagugggcugggugagaacucugugugugugugugugugugugugugugugugaauugugggcugggugagaacucugugugugugugugugugugugugugugugugugaauucacaccggaauaaaagcucuguuucgaacuuuugcuuuggcaaacuccaaauagaggagguggggcggggcugggggcguuguuugaugccuugugaagucagacuaauuuuaguggcggugagacaaggcagucagguuuguaacccaggcuggcugcaaacuuuagagccuccugccucagccuuccaagaauuuggauucuaggcauucgccuaccuugcucugcucaguuugcuuuauuccaccuccccccccgcccccccaccaacuucguuuuaguuagcuaaggagagugaugaaaagaaauguggaguuugugaguuuggggauacuuuuuuuuuuuuuuuugaaaaguuuuauucuuuaugauucugaguagagaaaauuuguggcaacuguuucugaguauauauauauauauauauauauauauauauuaauuuguuacuuuccuagacugaaacaauuuagaacaaucuaguuuuaggaaguaaacgucagcuucaacuuuuucuuuauuuccucugugaaucuuuucacuaggggcugcuuucacauauuuccugaugucaugcuaucuauugguaacagcugaugagggcugugugcguagguuauuaacauugcuauuuguauuguuaacuuauauccggcauuuugcauaaauaugauauaaaaggcuuugauaauauuuccugguuuuaaacauuuuauauuuaaauauauuuauauauuuuguauauuuuaauuauagaaagauuugauaauaaaaauaaagaaaaaucugucauucuauucacaauaguaaacaaucuuuuugcauuuuuaccuaacauuuuucauacagugucuuguuuuguguuuagaaaacaucguggauguguauccauaaauguaguuaaugauuuggcaggacuugguaggaugaaugaaacaaaaacuugcuuuuuaacauuuuaauguuuuuacugauuuuaaaagaacagcuuuguccuuaaggcuuagucuucuguuuccuuaggguuuguuccuagaagaugagcaggauuuaauuauacagccgacauuuaaaagaccuuaauuaucaguuucuuaaccuagucuuugggaaguucuggucagcagucugagugcuuggagacuuaaauauuacaauuaaaaauaaaguguuuccucuuguugcuaggcaaaaaauggcauauugcucacaucucuuugauuacacaucuucauuugauuacagugaauuuguucauuuuguucuuugaauuuaccauuguuuugaugaaucuuugaauucucuuaguuuggcucuuucagguagaucaucauguucagugaauucuaaaaauacaaauuauugugguugcacuuuaaggcugaacagagaagcugaugaacggggucaguguguuaaggggccuccccagaccuggcuaccugacuuugaucccuagaccucauguagagacagaaagagagaacugacuacacagcguaguccucuggccuucacgagcaugcuuuggaauauuauuauuauuauauuuuuauaauaauaaaaaagacugagcagaagugcugagaucuuucuaaaauuaagaaauaaccuuuuuuuuuugcuuuguuagaauuuagcagucaacaaauaucuaauuauaauuagaauaaauuguuaaaguauguuucuaaucagcuuuuacaguaaaauuaacauuguuguauagcacuaauaaguagacacuugauguacugacugggauacugagagagccccuuauguuacuagugagugauguggacgagucaucccgcgcagggauaacaaagugugaaagaaaaggaggggaaggcaaagaaauuauguuggagauguggccucucugagucuuagaaggcucauguguauugugcacuauguggagaaaacuaaacuguuagguuuacauugaagguaguuuguuuaauaggauagaauuugagugcauuuuagcauauguguuugauucauggucagaauaacugccagcuuuaaaaacaacagcaacaguaacaacagcaacacuacaucuuucccguuuuguggacauugcuggagcagcagucaaauugaaguucaucugacuucugaccaaagcaggaucuguaaaaagccucucagcggggccuggcaaacacagaaguggaugcucacagucagcuauuggauggaucacagggcccccaauggaggagcuagagaaaguacccaaggagcuaaagggaucuacaacccuauagguggaacaacaauaugaacuaaccaguaccccggagcucuugacucuagcuguaucagaagauggccuagucggccaucacuggaaagagaggcccauuggacaugcaaacuuuauaugccccaguacaggggaacgccagggccaagaagggggaguggguggguaggggagugggggggggaggguaugggggacuuuugggauagcauuggaaauguaaaugaggaaaauaccuaauuaaaaaaaaagcuucucagcguccuuuucacguguggaggaagauacaucuuucccacuuuucagagagcugaggcagaagucugauguucugucugugcccguuugaaaggauggugaaggucaggcuguaagaggacauuacagaggcccacagauugguaaaaggaguccaggucuaccggaaggaagguguggccugcauggugcagugaggaaaggcuaauggcucagcugucuguggccacucacccuagcaaggugggaucaccagguucaugcuggacaaaugcuucagaaaaauccuggaacgaaaagccaaauccugccagguaguaaaggagaacaaauacaaggaagggaugcgaguggagggcucugauauacaacuuucauucaagacugcuuaaggaacaaaauacccuagguuugaagaggaaaugaauguacaguaauagguacacuuuggucaauauagucuucuguugaguaauuuaguucuaaaaccguguaaauaaaaguggucaaccuaucugauuuucccauccuuagaaaguguucuauuuccaccuuucaagguaucuuugugaauguggagaaggaaguaucugagaacaaauauucuuaguauaguauuucuuaguuccuuaagaauuuuuaauuaaaaaucaguuuaugcauauggauauuuuugccuaaauguauguauauucuacacuuuagugcugguggaggacagaagagggugucagaucacuugcaucuggaguuagagagcgugugacucaccaugugggugcuaggaauugaguugagccugcaucuccugaaagagcagcccuuugauagucuuauuuuaacauuacaguuuuauuuuauuauucuuacauuuaauguuugugaucuaucaucucuuuguccauccauccuucugucuauccauaucuaucuuguuugagagacauagggucacuaaauguaccccuggguguccugggacucuauguagaccaggaugaccucaaacucaacagauaucuaccugcuucugccuccuuagugcuggaugggauuaaaguugugagguaccaugccugguugugaucuauaccuuuauaagguuggugaaacuuaaaaauaugagaucccuaucuaaauuuuaauauaaauauaauuaaugcaaauguuuugaugcucacuaaugcuuacuuaaguugugugcuuuaguuuguuuuguuuucuugagacagagucauuguguagcuguggccagccugguacuauagguugguuucaaacugaaggcaaauccucucgacucagccuuucaaaugcugagauuguaggugugccguccugcuaggcauguacugucacgauuaaagcauuuagguucacaaguacagguauuaccuguuucugacaguugguuaugagguuugggauugucaugguuuagaagcuccaagugugagaaaggaugccaugaugucagcagaaacuuaggacaguauuuucaguccugaugauggccggcugguaguuagagacaacaguuuacugaaaugcaaucagcauuuuaaagaaauggauaaaauaauuagacuauaaugcauaccauguauuguuagggcucuggaaucagucacuuaaaugccaacacuacacagcuggcuuuuuagggccaaaauagggaucauagugucuauauuauaaggcaguugugcuauaaagaucucuuauauauggugaugccuuacuggcuuuaguuacacagaaagaauucaaggccagcuuguugagauccagucucacccacaucccccaaaagaaagauaauauguuuugauuauuaaaguauuauuuguaguugaagaauuauauccacauacugaauuugaaauguugauuaacaauugguuuucauguuuauacucacaaauaguaaugaaaugguaauaaguuuacuauauauaacucaauccuauauuucuuaacacauauuuuuuaaacauaaucauaauaccauuaucagcaucaauacaguuagcagucuucuugcuuuuuucuuaauuguucuuaacccgugcaugcuuauuuuucuuucuuucaaaaauguguguuagagcuggggaucaaagccaggaucacaggguuucucucaggcuauguaagcagucuacuauggccagcaucucagcucuucagguugguuuguucaagucaguauucauggucagcccguuauguuuagcugauucaucucucaagauuuaaugucucaggcuuggugugguggugcaugccuuuagucccagcacuugggagguagauacaggcauaucucugaauucacagccagccuggucuaccuagagaguuccaggauagccagggcuguuacacagagaaacccuauuacaaacaaacaaaaaacaaagcaaaacaaaacaagaaaacaaacaaaaagacuuaauaucuccaaaaacuucuagaaauaguuugaacucuguugcacaaccaugugaauauugucacuaguaaugaauggcuuacuugaaaauggcuaaugguauguguguuuguuuuuaucacagugagaaaaauauguaucguaaacaaaagucauuuuuggcuguuuuaggcuuauagaaaauccagcuuucagcaucugguacuaccguaguacaguuaucaaaucuaagaaauuaacaugugcacaauaucacugugaacuacacugcagagucgaugagcguucuagcuuucccacugucaucugcuuuagcauguacuacaggauacucaucacauuuaguuggguucuuuagucucccuagugcgucuucugaucacuguaagggggacugcucauacauuuuguggucucgcuugguuuugucaggugucuucugaugauccgagugaggucacacauuuuggggaguauggccuuuucuguggauuguaggaguuauuucuaaugauauuaccuauuaucugcccauuaaagugcuaggugcugggguaguuacuguaaauuuauucuuuuuccauuguaguuuuuaggagauacuuugguauaagccucaguguuauaaggcuaaguaaaaucucuaaaauaacacgauacuguuaguaauguaaaaaaaagaaauaaguucaaaacacaagcugaaacacaacauaaacgcaauguggcaucucagauacugccuguguguguguguguguggguguaucugcacagaggccacugucuuccauccuguuucugugagauaagagucucccauuggacuggauggguaggcggcaagccuuggcagcugucuacaugucuaauaguggcaggguucgcggugcacgucuaugggugucgggcucagagcucagaucccccugcuuguguggcagcugcucucgcccuugcccacagagaccucuucccugccccgcacaugcugaugcuuaacuuuugaggcacauuguuuguaccuuuaucuagaaauauaugacuauaagacuuaagaauguaaagcaauaaguguauaguucagguuucuuucuagguaaagauauucgucugucugucugucugucugucugucugugucuaugugagugugugguuguguauguguuuggguauggguggccaggagggucagaagaagucagaucaguuggagcuagaguagcugugagcugccuggcaugggugccaggauccagaugcugguucuucccucgagcagcagacauucuuuagcccugagacagcuuucucuucaucuuucuauuuauuuuuuuucuauuuucacacauacuugguuuuguuugucccgcuucccucuuuggccccccaucucccugcuguucaucccugcuaagccuauccuuugccaguguuucuccuuucauuuucauaucauguuuguucuuuuaccaucucuacugcuaucucuuaaaauacccuuuucccuuuuaugggguggugguggugggggguggggggaggagaaaagguguuacagaggcuggucuggaacaauguguaacauuccuuuugccucccccucugggguacugugauacuugguggguagagccaccaagccuagcauauaguuaagauuuuagaauuauuguagcacauacauaucuuuuaauauccuaauauuuaaaauugggguguuaacauuuccuuaauuucuuaagaauuucucuaauuccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauuaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaggaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugauacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaaugucuaagaucaaaaauucaggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagacaaugugguacaucuacacaauggaguacuacucagcuauuaaaaagaaugaauuuaugaaauuccuagccaaauggauagaccuggagggcaucauccugagugagguaacacauucacaaagaaacucauacaauauguacucacugauaaguggauauuagccccaaaccuaggauacagaagauauaagauauaauuugcuaaacacaugaaacucaagaagaaugaagacugaaguguggacacuaugccccuccuuagauuugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuauugaaaggacccagauguagcugucucuugugagacuaugccggggccuagcaaacacagaaguggaugcucacagucagcuaauggauggaucauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaagggggagugggugggcaggggaguggggguggguggcuaugggggacuuuugguauagcauuggaaauguaaaugagcuaaauaccuaauaaaaaauggaaaaaaaaagaauuucucuaauuauucuuaaauaauaaaacaugugggaaugaagugucacuuguuaaaguccaggagagacuagcucuccaauuuugucuuauacccacaggcuaagcuuuucuauggcaguguaggaggcauaaacagcaaaggagaugagaaauccuguguugucauggaauuugcaguguguuugguguugugccugucggaccuuuucacuucuguguacagcugggaaaacuaauuguuugugucacuuacuguaaaagcaggagauacuugaauucgguuuguguucguuuuuuuacucagauaaugagacugcuguuuacacacugaugccaauggugauggccgaccagcacaggugaggaggaggcacuugcuucuuagguuugugaugucaugcuuugcuuugcugauuuuuaaaaaauuggauauuuuauuuguuuacauuucaaauguucuuuccuuuccugguuuccccuugcaaccccccacuccauccccccuuacccugcuucuaugagggugcucccccacccacucacauacccacuccagccucaccgcccuaacaugccucuauacuggggcagcaagccuucacaggaccaagaaccuccccucccacugaugccagauaaggccccuuuggcuccuucaguccuuccccuaacugcuccauuggggucccuguucccagucugaugguuggcugugggcauccgcaucuguauuggucaagaucuggcagagccucucaggagacagcuguaucaggcuucugucagcaagcacuucuuggcaucagcaauagugucuggguuuggugucuucaugugggaugaauccccagguggggcagucucuggauggccuuuuuucuucagucucuguuccacucuuugucccuguauuuccuuuagacaggugcaauucuggauuaaaauuuuggagaugggaggguggcccgaucccucaacccggggccaugucuaaccucaggauauggucuccgcuuugugggauauuucagcuaauguuguccccgaaggguccugggaggcucuugcuuuccuggcaacugggacuuucuggcugcuaccccaaguuccccaucccccauugcuccagaccccuguucaauuuccugaccuucuacaucuucuccaucuccucccauaccugauucugcuccucuuccccccuccccuuccucucuuccucccaagucccucccacccucuuugcugauuuuugaacaguguuguauugacugucauucuucagauagacaacuguuggaauuaauaacuguuguaaaagagcucuugccuugauuuacuacauuuuaaaaauauguuuauuacuuauauaucaucaguucuuuauacuuuuuggggacuauaggucuguuucugaacuccuaucaaauucaaaauuugaugucaauuaugcauucggacgugugaagagaagcuugcuucacauugcugcaaaguaagccugaaauaguucacauuacacuccagucuagaguaaggguuggaagcuuuguauccauugccuugcggcagcuauggggaaagaugagagcuggcagcuaaggcugccguguccuguuuagcccuuaaugugcugugcucuucauaaauuguuagcguugauauggaauucaugucucgaguucaugugcucauagcuugcuuuaggugaggcuuagggguugucuagauagguguaguguguguauucaccaacauuucuuuuaccuuaccacugugagggauaaaaggggcaugguggaugcccgaggacccagcaguuuuauaccugggugggaguaucucuuuauccauagucugacacugacugauaccagucuuccuuucaggauuuagguggcaguguugcagcuaauuguucaugauuagcuagcucccggaaagccggaaaguaaagaguauuuguuugguuucuuucagaaacuaauuguuuauuuuacuauauuuuaacuuguguucauaguagaauuuaacauuuugaagguugggguaguucauuuuuauuaugaguuaaaugguagguaaauugggaccuuaaaaaaaauaguguuugauagauuuuguuuguuuuucaauuuugucuacuauggcuguucguugaauguaucugguugucuuuuauauuguucuagcuguggaucuguggaaugcuugguucuucuguugaagaaaggcgcaaacccuaacuaucaagauauuucaggcuguacaccccuucaucucgcugcuagaaauggguaagcuuuguuuucauagugaugcauuaucaggccuggaagcuucuaaggaacucauucuugaucuuuuuuucuucccaacauuuaucuugagaaaaauuacaaaguuguuuuuuuaacuauuuuuagucuuuuaaggauauuugucuacuuuucucuuuaaaauuggucucagauaauuuuauuaaauuugcaaaugauggucauacuuaauaauuuauugaauuuuuuugauaguuuuucuuuuguaaguggagauuuauuauuauauggauauaaugacagucuauguuuuucuuguuucuuucucuguuaaucuuuacauuccuugguuuauaguauaauauaaacuacuuacuauauaauuauauauaauauauaacauuauauaauaguuaauauauuguauuuaauauauaguaauauaauauauaauauguuauacaauuauauaauauaaacuacuugucuaguuuauauuauuaguggaguuaaauuauuaacauauuacacaguuucuaauuguucaagagugaauuguaugacuaauauuucuagguggccgcggcugcuguugcugcugcugcugcucccacugcuccccuuccucuauuuggguuggccaggguuucaaucagggauugguuuggcaugcccacagcaaguagugagaucaagauaacccccucagaggcauggccagagacuucucacacagcugugugaaaaacuuccuaaguaaauguguuuaacggacaauacuaauguuuccaaaaugugaaaacuuagggaugacauacuagguauaucuguuugcuuauuccugauauuucuggucauuauugaccaauaucauuguuauugugugcuauuuuaagcccgucugggcuguuuaugguguuucuugucuuuuucugccacauguuucaaauguuacaucucuuugccuuuguccuguauguugguuagaucuuugugaacuugacccagcuaacgucauuuggauagagaacuucacuugaggaaaugcuucaauuguauuggcauguaggcacgucuaugggaccuuuucugcagauugaaguggaaacuuaaggguucuuuggaaagucaguuguguuggaugguguguugcugugcugcagacccucuuuggucucugguugcagauggacaaggaguuggcgaaugacagacaaaaucaacucaagagguuguguagaaucugaauguaaugccacaaagugaacaccagucuuauacagaaaauaaagggguagcaugucacagcaggcaaaguacauugauguuaccugacacaaaacaaaggaaugacuucaaaaggacucacaggaaccagguagauguuuacaguaaagauaaagcaguccugccuagggucagcuuagugacagguaaggauuucacacccuagucacaguuagugcuacuccuuugagccuugugaaagcuagcaccaggggguucugcucugguaugaauaaugcaauaccacaaaccuccuauuuccuaggccuugauaaauucuuguaugaguguaacuuuuaaguguggagaauuuccauuugucagaagaauucaccaacuugcuuuuaauaugcaauauacccugcuauaccuggcuguagaaaagauaccuaucucagugggauucccuagcucuuucuugguaaacccaccuauuagcuaggucauuguguauucccuuguuuggaugagacuggcuacuguccuaaguaaucacucugcagaccagcccugagcuauuagcucuguucuuuguaaugccuaguuaguuucaccggcucuuccaagcuccuuggcuucaagcauuuucuaggacguuggaacacuggcgaaggcuuagcuaugucagaauuaaaucuuuaaaggcacuuauaauaaaauaauacuaaaagagagcauguggauccauacacuagacuaacgcggggauaggguaugaguauacgaguuaugauaaugccaagguuccaggagguugaguuuuuuucucugaaacucuuugccucgugagugcuuccaggccucuuggccugccaaguagaugucacuggaguguguguaacauucucccccuuugguuuuauuuuucagccgaaguuccagaaugucccgcuugucguagcuacagaucuuagaaguauucuaaagaugaguggaaacacaacaauuacuaauaaaauaaugccaauaauaauagcaaguaggauuauauauugaacccaauccaugggaucaaugcacuuagguuauuuuuuaaaucucuggccaauuuaucaauguuccaaguguccaagugacuuuugcuaauaucugaaaauuuugccuuucuagccuuaauauuugcuauauccuguccuauugcuaagacuacuaguucuaagacauuaaccuuugccuccaauuuuuuaucuauaauauguugcucugacaaagcuauggaaauauuccugugcuuaucauuaacaaaaugagcauuaugcagcugcugaucuaaagcugugguagauaucuuuucaaaguuugcauucccagauuuuuaaaccaaggaucauuuccuaacucuacaggcaguaaaacauaagcaggucucuuuaacaaaaucauaacagcagauuccuuaucuaaauuaggaucuacacaauuaguuaauugacaagaauuacaaugaauaugaaaagacuugccaagauuggugauccuaacucuuaaaauuaucuaacaauauagcauaugggugagguacacaagcuuuuacagcuauaggggaguuggccuaaauggccaaaagcagugucuuugacaaaaucuuguccaauacucuguagcagucccucugccucacgagacaucauuuuuaguuguucccaaguugacaccaggucugcacuccuugcuguagcccauggcggagauaggaaguuucuucaucuuguuugcaagugguugcucucccugauuccucuuucuuugugcgcucaacacaguuuucuugucagggcacucaggaacucacaggucagccugucacauuggaagcuagcauccuccugcagcauucuguggaaaaaccagaaacauugcccccuuccccccauauuaacuuucuguuuaggaucaugccaugugccaauaaguggauccuuuucaucucaccuagacaugauuaugucuaguuuuuaaaaauaaaaaugugggggcagacauguaaaggaguguucuccugaaguggacacgggugaaaggguaaggcagacuugugaagaaacauuuugcugaagcagauacaaaugaaaaggauguuuugcuaaagcaagcaugugaaaggacaugugaugaaggauucuucgccaacaacaugaauuggucugcucuguaguugagcucgauuugucaggacucuguaaagaaaugcaccaaaaaacuucuagugguguguuguggcuuuuuccugcuccagcaaacuugggcugauuggcagagugaugucaggugauuuagacccaugugcugaggugacgaggcaagaccuguggaggacacaugauguuuggagggaguauaaaaaggacuugaagggcagugacagaggcuggggccgagcuuggcuugcuguacagugcuuauuggucuccaguccucacuuaucuuugcugagaguggcacagcugagaacuuuccuggcauuccuguggcccugguuccuccugcugacuggugcugaggcugaggccuggcugucucugcuagguagugccaccacugcugauucuuguuugcuauccugacacuacugagcaggacugcugguggauccaugaaguguugugaguggaccaggcugccacugcugaccugugaacugacugccgauucccagacaacacggaugggagcugcuccaaagaacucuucuaagcagguucacccccaccccccaugcuucccacuaccucugcuggguguaggccagaagggagcuuaaagucuuucagagccaucauuagcaauaaggcuugaaaaacuuaauuacagcagauaauccuggguuauauaagauauaaaugauaccaaaauaaaccaucauuuuaguagcauuccuuaauccagugcgauuuuuauaagcauagaucauuugcuuauuaagaaaauaaaaaaucaucucaaaguuuuuugaucuaggauuugaggaauuuagauuuauaaaucuuuuucaaagauuguaaauuuucucuguuagucuacuuuccuguuguguaucuuuuaauuaaucuuacagauauuuuuauuuuccgaucaggcauuguauguaauugaaguggccacauacaugaaauggcuauggagauaacauuauccauuucauuagcuugaggcuaauguuugcauagaaguguauauauugaaccaaggagauagugaaccauaauuaucucggguuggguaggagaaaguuguaguauuugggcuaaggucucuuugacugucccacuuaugagugagccaguuuaacucugcacuaacugguaaaucaccauguaccaaguaagcaaccaugugaacauuagguauguuguugugugacacaacuguuaguuacuuuuuagauauaucgauuauauuggcaggauaaugacagaucuuucuugaaugguuacauaucuuacaaugcuuuugaacaguuacauaggaaaggacaacuuggugcaggggagggauuaaagaguuccuuuagacgaaguaugugaggaccaaggugucagacuuaaaagacagaauggucuuguucuucuagagagacuguucaaauauagugcuucugaaauaaaggccuuuuaaggagaacauacaaaguacuuuugaucauuauugucaacaguaauugaaaagacauuagcauuuuaaagauacagaaguagggcagguaaugcauaauucacuuagcaaucagcaagaugaaaaggugcagacaauguauucucuucuuagaugccuuucuuaugucuaccucuuaugucuaccaagaauacuugugacagucaguacuuaaauauucuauuuucuauugcuuauugaaugguugccuuauacaauauggagguccuuacuaaguguuugcuaaaugacucaaguauucaguacuucuggaaguacugguauuuuucaaaauaacuuuuuauggggccugcaagguggcucuccagguaaaggugccugugaugaagccagaugaccuacguucaauccuugguucccaccugguggaaaggcaggagggacuccuacaagaacugacuuucagaggcaggccauggcauacacacacaugguaaauaaacaugcaauaaaagcaaaagaggccuugaaggagguuuucuacuuuaauaaccaggcagugguggcacacaccuuugauucuagcacuugggaggcagagggagacagagggaggcagaucucugauuuugaggccagccuggucuacaguuccaggacagagaaaccuuaucugaaaaaacacaagcaaacaaaaacguguuuuacuguaauugaaguaugaaaucaaauuuguccacaccaaaguguaaguuauauaagaacuuuguccuuuuagcugguuuagaguuugguuucuuuugcuucccucaacuguuccugucagguggacaguguguaucuguuggccuguucuaucagauguacaguguauaucugccacggaccgagcucagucggccccccucaauccgugggaaucagggucucggacagaugggcauagagucggcgaaaauggggugacaaacagucaggacacaagggagugugcugaaucugaauguaauuugucaaaucgagcaucaaacuuuuuauacagacgaaaauagggaaguuaggugacacaucagcaagguacaaaugagguuacuguaugcuuaaugacucuuacacaaaacaggaaagcaaacacaaagacuggcaggaacugggcaauaaagcaacugagacagagucagcucuaucuaaggucagcuauagucuuagaagucaggugugagaacuuuucacucccagggcaagggcuuucaugcccaagucaugguucuaauuagggaguuucgcucuagcuaaccuucucaugaauaaugcaauacucuaaaaccacagcccaaucuacuuccuaaaccauuguaaauuccuguauaugggagcaacuuggcuuuuauucuaagugauaguguggggggacuuucuacuaauaaguaauguagucugccauacauaacuauaauaagaauuuuaaacuuacguugcuaagcuugcccugagauuucuaacucuauguaguagauaguaaagccugauuucuuucacuaucucucuuacaauacuagaggcaauucugaauguuacugaacaggcaacauucuuacugaauuccaagcucaaggacuaccuagggcauuggugaaggccaggaagcaaaguucgauuuugcuuagguauuuggcaagucauugcuuggaggcaccuauaacaaaacaauacugaaaggaagcacacagauccauucgcaaggacaaaauuggagcaugcgcaugcuauggaaugccacaguuccaggagacuaaguuuccgugaaacucugcgucaggacugcauccaggguuuuggccugucaugcgugucacuacuggaguggauguagcauauaucuauuggcuugcucuaucagguggacaguuuauaucuauuggcuugcucugucagguggacaguuuauauccgucguaucauaggcauugugagcuuuuggguuaguauauacguagugaguacauacaguguguguucuuuugugucuggguuaccucacucaggaugauaauuucuagguccaucccuuuggcugcgaauuucauggauucauuuuuuuaaauagcugaguaguacuccauuguguaaauguaccacauuuucuguauccauuccucuguugaggggcaucuggguucuuuccagcuucuggcuauuauaaauaaggcugcuaugaacauaguggagcauguguccuuguuacauguuggagcaucuucuggguauauacucaggaggguuauggcuggguccucaggcaauauuauguccauuuucugaggaaccgccagacugauuuccagucugcaaucccaccagcaauggaggaguguuccucuuucuccacauccuugccagcaucugcuguuaccugaguuuuugaucuuggccauucugauugguguaagguggaaucucaggguuguuuugauuuguauuucccugaugacuaaggauauugaacaucuuuuuaggugcuucucagccaugugguauuccucaguugagaauucuuuguuuagcucuguaccccauuuuuuaauaggguaauuuguuuuuuuggagucuaacuucuugaguucuuucuauuauuggauauuagaccucuaucggauguaggauugguuaaagaucuuuucccaaucuguugguggccuuuuggucuaauugacaguguccuuugccuuacagaagcuuugcaauuuuaugaggucccauuugucccuacucgaucuuacaagcacaagccauugguguucuguucaggaauguuuuuccccugugcccauauguuugaggcucuuccccacuuucucuucuauaaguuucagugucucugguuuuauguggagcucguugauccacugggacuugagcuuuggacuaggagauaagaaugggucgauuugccaucuacauacuaaccgacauuugauccagcaccauuucuugaaaaugcucuuuuuuuccacuggaugguuuuagcuccuuugucaaagaucaagugacuguaaguauaugaguucauuucugggucuucaauucuauuccauugaucuaccugucugucacuguaccaauaacaugcaguucuucucacuacugcucuguaguacagcuugaggucagggauagugauuuccccagaaauucauuuauuuuugagaauagucucuccuauccuggguuuuuuguuauucuagaugaauuuggaauuuguucuuucuaaaucuaugaagaauugaguugaaauuuugauggggauugcauugaauagguagauagcuuuuggcaagauggcuauuuuugcuauauuaaucguuccaguugaugagaugggagauguuuccaucuucugagaucuucaauuucuuucuucagagacuugaaauuuuuauccuacugaucuuucccuugcuuaguuagagucacaccaagauguuuuauauuauuugugacuauugugaaggguguuguuucccuaauuucuuucucagccuguuuuauccuuucuguagaggaaggccacugauuuguuugaauuaaguuuauauccagccacuuugcugaaguuguucaucagguuuaggaguucucugguggaauuuuuggggucacuuaaguuaauguucauaucaucugcaaauagugauauuuucacuucuuccuuuccaauuuuauuucuuuuaccuccuuuuguuguccaauugcugugucuagaacuuuaaguacuauauugaauaguuagggagagaguaggcagccuuaucuagucccugauuuuagugggauugcuucaaguuucucuccauuuacuuugauguuggcuacugguugcuguauauugcuuuuuacuauguuuagguaugggccuugaauuccugaucuuuucaagacucuuaucaugaagggauguugaauuuuuucaaaugcuuucucagccucuaaugagaugaucauacgguuuuucuuugaguuuguuuauauaguggauugcauugaugaauugccuuauauugaaccauacccgcaucccugggaugaagccuacuugaucaugauggaugaugauuuugauguguucuuggauuuggauugugagaauuuuauugaguuuuuuugcauugauuuucauaagggaaauuggucugaauuucucuuucguuguugggucuuugugugguuuagguaucagaguaauuguggcuucauagaaugaauaggguagaguaccuucugcuucuauuuuguggaauaguuugaggaguaucaguauuaggucuucuauguagguuugguagaacucuguacuaaacccaucagguccugggcuuuuuuuuuugguuuggagacuauuaaugacaguuucucuuucuuuaggggauaugggacuguuuaggucauuaaucugaucuugauuuaacuuugguaucuaucuagaaaauuguccuuuucauccagguuuuccaguuuuauugaguaaaggcauuuguaguaggaucugaugaauuuuuuuugaauuuccucaauuuuuguaguuacaucucccuuuucauuucugauuuuguuaauuaggaugcucucucugugucaucuaguuagucuggcuaaggauuuaucuaucuuauugauuuuucucaaagaaucagcuccugguuuggugauucuuuauauagcucuuuuuuuuuuuuuucacuugguugauuucagcacugauuuucauuauuuccugcagucuacuccucuugggugcauuugcuucuuuuuguucuagagcuaucaagccgcuaguguaugcucacuccagcuuuuuuuggaggcacucagaguuuuacucuuaggacugcuuucauugugucucauaaguuuggguaugcuguggcuucauuucauuaaacucuaaaaagucuuuaauuucuuuauuucuucuuuaaccaaguuaucaaguuguucagcuuccacguguauguuggcuuucuauuauuuauguuguuauugaagaucugccuuaguccaugguaaucugaugggauguaugggauuauuucaaucuucuuguaucuguugaggcccguuuugugaccuauuauauauauggucaguuuuggacaagguacuaugagguggugagaagaugguauauacuuuuguuuuaugauaaaauguucuauagauaucuuaaacccauuuauuucuuuacucuccucuauuccuauuauccuuagguuugaucuucucauuguguccuguauuuccuggauguuuuagguuaggaucuuuuugcauuucacauuuucuuugaucuuugugucaauguuuucuauggcaucuucucuaccugagagucucucuucucucucuuguauucuguugaugaugcuugcaucuaugacuccugaucuuuucccuagguuuuguauuuucagaguugucuuccuuugugauuuuuuuuuuuuauuguuucuacuuccuuuuuuagauccuguaugguuuuguucauuuauuuuuccuguuuggauguguuuuccuauaauucuuuaagggauuuuuguuuccucucuaagggcuucuaccuguuuaccuuucuucuccuguauuuuuuuaagggaguuauuuauguccuucuuauaguccuccaucaucaucaugagaagugacuuuagauucauaucuugcuuuucugguugugaugguguauccaggacuugcuauggugagagaguuggguucugaugaugccaaguaaccuugguuucuguugcuucuguucuuaugcuugccucccacuaucauuuuaucucaagugcucccugcccucguuauaccugauuggagcuuguccuuccuguaauccugguugagucagaacuccucagaguccagcuuuuucugugauccugugauccugggauucugucauccugagauccugggugugucugaguucuuggcagucaaguuuccucugagauccugagauccuggugugaccaagcuccugggauccugaaauucuaagauccuggaugugugagagugccuggaagugguaccuccucuggggggugguggggcuguccacugaguucgaaaccaagguagaccagugccaacuggaaggaauccaagccucugguugggcaggcuuccugugucccugcuccugcuggccccagguacucauggugguauuggaacagauguuuuguuucacuuaccaaugaucguaagauccugggcuagggcaccuggggaguggagaguccuuuguggaccauaggacugucagcagaguucgcuuccaaggucguuuucacugaauucugaaaggucuuuaauuucuuucuuuauuucuuugcugaccaaguuaucauugaauagauaguuguucagcuuccagguguaugugugcuuucuguuguuuuuguugcuauugaagaccagccuuagucuguggugauccgauagaauacaugugauuaauucaauguucguauauuuguugagguuuguuuuaugucugaguauauggucgauuuuugagaaaguuccaugagaugcugagaagaagguauauucuuuuguuuuagggugaagugcuauguagauagcuguuaaauccauuugguucauuacuucuuuuaguuucacugugucucuguuuacuuucucuuuccaugaucugucaauugcauccauucuuguuuaaaccauccacuauuagagauuugagguuacaugauauacuuuaugcucauaacugauauggguagaaaauugauauugcaucagcagaaagaaaaugugcuguguuuuugcaugucagcaaaggauugaccuguucauguucuacagagaauggaaaucggaagugaaaaaguuuuuguauuucaaaauauggucucaaacauuuuguaauuuuuacuuaaauuguuaggaggcuuggaguuauuaguuuaucuauuguccaaugcuguuuaguagagcacugaaaaaaaugauacaaguugucaauggaugagugaucaacuaauagcccuucuaguaauugauuuauuuuucuacaauaaguuacauaaaccaaaaaacauaaauuauaaguuaccauauauuuguagguuacagauuggucaauuuugaaacuuuugcauuuaaaaauauuuggaggguaaauuaugaguucauaaagagcaaaauaguuuugcucaguauucuagcaguaaaucccagcaaaaaagcugcucaguuguuggguuguuugagauugaggaaaguaguaguaguauguauuaaauaagaaagguacaauagguuucuugucuguguugcccuguaccuuuagcuuuuugcuuuuggaauugagagcauuacauggguacuuuuauucaaccagccuaccuuaaagcuuuucaugucuguuuuccuggcccauuuugacuggagcgcuuauuuuggagcuaggcuaaugaucuacauuggcuucuuaauagucuuaaaauucccucuguauggacacaguaacagcccaccuugggaacaguguaccuucaucauucccacuccuuugcuuccccuccagcucuucccagcccccucaccaaguucaugagcuuuuaguuauuguuacacguauguacuauguauguauaauacauauuugcauguguauaaugguaucuaggacuggaucagccuaaagggacauuuaugagcagacucagguuauuguguucauuuugcuuugcuguguguuuguucagugcugaccacuugugaucucugugugagcucaucucuguaggagacugauucucucucagcaggcauuucccaccugaagcucuucaucuaagggugagacuguguggacucccugucccauugucauguuaacugguguuagcauuauccucuucuuuuuuaggcaacauauuauugagacucauagauuuauuccuugagauauguggaauacauugaauacauugucgcacagcaaauguucuggucuuaaagcuuauauagucuuucugcccugguuuuuucccuaacucagagauguacgaguuuugcuauguauguauccauuggaguuggguauuaaucacuuaauagagccgucacauguguuucuuaugauuauguuuauuaugaauuucuaagaucauuguuauaauguuuuagauaaacuucguaaauauuggaacuucaauauuuauuaucagcuuuauuuuccauuucuuugaguguaauuaagauuuuuaaaugagauuuaaccuuguuucaagugcaaaaaucaaaaugagaaaagcaguuguuuugcagugcuauuuauuuacuuacaaguugaaugcuuauuaauaaucaguugauaaagcuuuauugagaauuucaauguaacugguuauguuugucacuugauuaaacauauaauuuaugacauaaagcuaauguugaacuaguugcuuaaauauauguuaugugcuauauauacuauauacuguguuagguauauuacuguaugauaauacuguuaauauguucuauaauacauaacaugauaugcuuuauuaugcuuuagugaauaagauuauuacuaacuucaugucagagguuacaccacaguuugucaauucaguacugaauauauauuaguuaucucugcuuuauaauuugauugccguaugagggauaugaguagaaaaugaaccuuucuuaaguaugugguucuauacuuucaggaaucuugaacagguaguauaaaugaaggugaauuuaagauaaagaccagauaguagcuaggaauggaucaguuggaaaggaguuucaugagcaaaaugaagugggugggcaguucugcagugcacagaagacuuaucaggaauuaggaaauggaacaagcucccagcucuacuagaaaauaaugauuaucaaaaaccacaaacacaaaacaagccauuggcuaggauguggagaacguggaacacacguagguagcagcguaaagugguaaagcugcugugaaaaacagugagauagugccucagacacuuacaaauaggauugcaguacgacuuagccuuuucacagcuagauauacucaagagucaaaagcaaggugcaaaaagcacucacugcauauauaucgacauuguguauaauggugagauguggaaguagccgggcacccaucaggugaugaauggaugaggaaaauuugguuuauacaaauaacagaauuguuuucaauccuaagaguaaagcauuucugauaugcuaaaacauagauaagucuugaagacuuuaugauaaguaaaauaccauauagaucuguacacguaaaaaugguuaggaugagcaugccuuuaguuucagugcuucagaggcagaagcagauuuccaugaaguugaggcuagucuggucuagugaauuccaggccagccagccagggcuggguaaugagaccccggcucagggaaucaaccaaccaaccaaccaaccaaccaaccaaaaaugagacauuuuauguuagauguauuuuaccacauaauauaauuauaaaaauguggguagagagguguacauauauaugcaguuuaccaguucuccgauuauguauuuuaauccuccuggagagugaacccagggucugaagcgugcuaagcaagugcuuugucaccauguuauacucacaaccuuguuuggguuacaguuuuucuuaguauuuuaaacauuuuguaaccaaaaaaguagagauacaacauugugguauuugcugugucuauugcuaaugcauuaaauguauauguuuuaaaauucaaaugaagauugcuauuccauuuaguuagccaaagcuagaaauuucuaguaauuugauuugcuuaauaaaguuaaaaauuccucagcaaucugaaggauuuuuuuuucccaaugaaaugaaaaaaaaaaaaaaaaccccaacaacaacaacaacaacaacaaaacccaaaauagauugugucauuucuuuaaucuguuauuugagucauaaaaaccguuuuguauuuuauuucagaauaguauauauacuggagcuaguuugaaauuuuagagagcacuauuauaaaaugaucuuuguaguuuaauguugguucuauuuaguauuucggugaaauagcuguuauuguacauuuccuaucauaguuaucuguuacugucuuuuuuucuuuucagacagaagaaaugcaugaguaaauuacuggaguacagugcggaugucaacauuuguaauaaugaaggccuuacagcaguaugugugaucacuuuucuuugagauuaaaaagauacucuagaaaaaauggugacugugcugcagaugcaaguuguaaucccagugguuuuuugaguuacaucuguaaagugcuugugagguauacagcgaguuuauuaagaaacgugauauccucguucaucucagcucuucuuuagguuacuuucauuaauuuugaagccuuauucuucuuguuuugucagugacuuucaagggaguuuuccuguuaagguguauuuccagcuggguugggcaugguggcacaugcggggcaugggcagaggugggggcggggcagguugggcuucaagugcuaggacuacauagaaaccaaaguuaaaucaaggggagaaacaagagcugguuuccauuaugucuuuuaaagagcuguuguuguauguauuccagggaaauuguaugccucuguagagagggucaaaggucacagggagugagaauucacuguucuuuguacucagauaacgacuguaaacauccauugcucuuaaccauuuuccaugcagaacuaaguuaguauacuuuugauuuacauauugggaaaugguauuggaaucuacugaaaggauuguuaaauagccucaaaauuuuaaucaaauaauuaugauuuuuuuggaguauuuauuuuugaaguagagguaaaauagaguaaugugaucaccgaguagcuaauuuggagacauagcagagggugcuaugcacaagcauagcagauguaauuuguuaaauugaauuuaaccuuccuuugguaacacuuguagguuuuuuucuuucucucuuucucucucuuucuuucuuucuuucuuucuuucuuucuuucuuucuuucuuucuuccuuccuuccuuccuuccuuccuuccuuccuuccuuccuuccuuucuuucuuucuuuuuuuaauagauuccaucucaucauguagccucagcucaucuagaacuuucuauauagacccugcuggccuugaacucgagagaucugccugccucuguuucucaagugcuaggucaaaaguguguaucuuugccuggcauuuguagauuuugcaucuuguauuuuuguggauaaagaauaauauugaauaccuacuuauuaaacugguuuucaagacuuuuuuaauuaaaauuucuuuagauuuuuugaaguaagaucuuguauaguccaggcuggcauuggaccuaugacaguuuccuugccucagcuccugagugcugggauugcaagugugucucaccaugccuggcacauauauauauuauuauuaauuauuauaauuuuuaaauauauauaauuuuuugauauaggguauaagagaaaguuuuccucaguuuucaaguauagggugggcuuagucauaauuauuauacaguauuuguaauuccugugacaguccagauuuuguauauauuagcaguauuguagcaucuauucuguaagguaaucuugcauucagaauacagauugccuagagaugugggauguagaagaguuauaaaacuuagaacugacacagaucuuucuguaguacagcaacuugaggcaagauaacauguucacugcuaucauauuuucauugcauaauuuccaacugccaacuuuucauuccugagcuuucaaggaagauagauuagaaaauauuuuauuuugugauuuugcacggcuucaguguggacucuuggccuucuuucccuuaauuuuuuucuacuucaaguuucugucccucuuaggaaaugcuuuucaguuuuguaacaguuauauauaugccucuguaguugaauauugcaugguaguaaucuuucucguuucagaugugaccacauuacauuuuggagcagagucuauuccuucuuuacugucuuuccucucguuucuucauguguaagcacacuucucaugucugucuaacacaaucauugcaauuuuaguuaacuuuucaaaaucuaguuuugacugacuaugauucauaucuaucccucuuuucuuugcagagcauuuuguucugugguuaaugauuaccuauaaaauauugagguaauuguagacuauaggcuuguaguagacaauauguaaaaauccuuuguauauauuucccccaguuuuccuaagcauuuuauaaaauaugauccugcaaccaggauauggauauaguucauuuuacugagauuuuuccaguuuuauuuacauguguguuuguaugaauucaauucugugcacuauuacuugugguuuaggugguuaccauuacagucauaguaugcagauuuccaguaucacaaagaauuuuugccaugcucuuucacaugccacguucaaccuucgacugccauucucuccauuucuaaauucugucauuucaaggaugcuaauuagacggauccuacuauacugaaggcuuggcuucuucugugcuuauucccuggagguucaucuggguuguugugugcaucaagaggguguuccuuuauaaugguggauggaauugcaugguacaugggucaaccuucucaccuguuaaaagacauuugaguccucuggguuuugggcuguuaugaguagagcuaauauaaacauauauauucuguuuccuuaggauaaauucuuuggaaugaaguugcugcauuugugcuugcuuuuaaagcacacuacuaacugcugucuacacugaguaucuuuucauaagcuuauuuuccauguaccuuacaccuguccuguccuguccugguauuuucaagauaggguuucucuguguuucucuguauaguccugacuuuacuggaauucucuguagaccagucuggccuugaacuuagagauccaccugcccucuugaguucugggacuaaaagaaggugccaccauggcuggcauauauaucacucuuaugugaaaugaaacaccaguucauaugugucauaguugggguuuuauugcugugaaaagauaccaugaccacgacaacucuuauaaagaaaccauuuaauuggggcuggcuuauaauuucagagguuaguccaugaucauuauagcaggacguggccaugugcaggcaaacaaggugcuagagaaggaacugagacuucuauauaucuugauccacaggcagcgggagacugccacacugggcauagcuugagcauaugagaccucaaagcccaaccucacagugacacacuuccuccagcaaggccacacuacuccuacaagaucacacuuuguaauagugcuacucucuauaggucuaugauaauuacaaugauguuaauuacauucaaacuaccacaauauucuuuguccauuuucuaauuuuuaauguucaagaaugcuuuauuggcuuauuuauuuuaaauuuauuuuuaauauauguauggguauguuguuugcuuguaugugugaauacuaugcacaaucaagucccaaugaagucagaagagggcacugaauccccaugaccugaaguuagagacaguugugggcugccauguaggugcugggaaucaaaccugggaccucuggaagagccgcaaguacucuuaaacauugagccaucuuuccagccccaagagucaugcuuuauuauaaacuucauuugcaaguauuuucuccaaaucauugguuuggcuuuccaaguacuuaauaaauagggucuucuuuuagagacagucucauuauguagucuaggcugcccccaaacucaaaauauuccugccucaaccucccaggugcugagauaugacaggugugugacaucagggugggcuaccggggugauaugaauaguaaaaagcuuuaauuuuggcauguuuuccauuuuauauaccacacuuuucuuuuuaggaacuuguugccuagugcuagguauugaaaguuuucucccccccacccccgugaaaguaucaauauuuuuaguuuuucuacaucuucauuuucauuuaguguuuuuaugaguugugaugcucagguugcggcucacuguguuugccugugagugaauguucaguuccacuagaaccauuuguugaaagguuauaaucugucucuaaucuauauauguacuuguagcugggagggguggcgcacgccuuuaauccuagcacucaggaggcagagguaaguggauaucugaguuaaggccagccuggucuacagaguuccaggucagccgggaguacagagaggaaccuugucuuacaaacagacaaaaucuguauuuauuccuucgugaaacuuguuuugugucuucuucaaaaaauggguaugcgugugugguccucgucugggccuucucgucauccugcugaugcucgucuaggcuugguauacauucuguugcugugugcaugugcuucuuugccuguaccacccaggcuugauuacuguaguagguguaauuccucucaucuuagguuuucuucaugaagacugcauuaguuauugugguuugugccuggagaaguacuugcuaggauauugacugaaauuacacucagccaguguacucacuuauguaggucuuugauuucuuccauuagcauuucauacuguucagcacagggacuuugugugcuccuguaagcauauaacauuucuugucuuuucauuuucuucagggcaguucuaaguguuauuguuucucucccuccccuccccuccccuccccuccccuccccuccccuccccuccccuccccuccccuccccuccucuggauuugugcaaaaauuagaaaaaauauuuugugugugugugcacacauguaucugaauuguaugugugggaguauaagcuuacacuuguaccauggcauguauauagaugucagagaacgauuuuggggaauugguuccuacccucuaccuuuugaggcagugccucuauuguuucuguugcuuugcagcaugugccaagguagcuuacggugagccuccagauuaauugucucugccucccauuuuuuccuaggggugcuaggauuauaaauguguauggccacauuuugucuuuuuguggcucaaacucauggucuucagcuguuacagcaaguauuuucacucuaacuucuuggcuuuucccuugacuuaugcaaauauuguguguguguguuauuauacuugcugaacuccuaauaguuucuuuccuaugacuucagugacauuuucuacauagauaauauaauuuguaaguacagauaauuuucucuuuaaaucucaaaguuuacuuuuuuugaugucuguucucauuuugauguuguuuguuaugacuagcuggucuuugcuacuuuguugcuuccucuuuuuccuaccuucuauccccuuucagcccccaacacuagauaagagagaaagaaggauagaagauagagauagagauagagagaucccugaauauacuuuuuuucucaacugcaccucccaguuuccagcucagucccuucaaagguuuccccaaaccauuccucccucaguuucccaacagucugcuuaaacagucucgucucucauuuuccccaguaguagccucuccaaacuauagcagcuguucuagccuaucugcucagcuuggcuucuccuggcucagcugucuucuaacaaugucuucugcaccaagugacuucuuuucucaugcuauuagccuaauucacuuccagaugauuguucuucccacuagacuagccuaauuccuaucuucacuugagcuggcuuaaaaaaaaaauacuguucccaguaauacaagaggcaacuaacacugaaggucauagggucaaggaguucuaucagcuaaggauucuuaaagauccauuugacuaacaacuggggaaucuuuuaaaggaucagacacacaagauaaaucacaaugguauucauauauuaucugcguauuuuauuuauuuuugagacagucucuuucucaguagacagacuuuugacuacucuguggguucauuuucuuccgucuuuccucaccucuuuucucuuuucaacccccuuauggggagaaaaagaaggauagaggggcguguaagagaaagaaacccaugaaaaaagucagggguagaaaagggguaacugcuuucugugaguugggggcgucaaguuccuugggacgaguuugaucucugccaucaggauagcuaaguucuuuuugucucuuugcucaugauuacuugacaaauuacaaccaacaguaaccaacaacauucaaccaucaaccagccauccagucacaacugucaggguucuagcauuuauauauccucugaaaaguccuuagaaucccaaaugucacacacuugcaaaacugccuguagcuggcaaaaucaugcuguguuagagcacuaggcuaaucauagaugugguuccugagcaggguacucaagagccaucccggcugcagcagguuacuccuuccuccccagccugcagcuaugaugccaccucaggagcugucaacauggcagcuucugucaaaacacccuugccuccauccugcugcugucaugaggagcaguccacggugacagcaccuccuugaguaguuccauagagacgaugccuuagccagagcugccuguggccagaaaggacuuauauucuaacccaugcucugaugcagggaaaggaaggugaaaaaaagccaccaauccccgagcuucuuacacaaccccaccaauuccugagcaugagaacucaccaguuccugagcuccccaagucagaacuugaaauccuaccaauccucagucuggaaaucucugcccaagaaauccuguacaagcccugcccuuuguucaguuccuugcugucugucccagggagcagagguggacacuucugaauaugucccuccacacuguggacccuucaagugucuuguaggagauuugcugccugguguaacucucaucugaagaagacaagaagcaaugacgagaagugaagagaaggagcagggcugaggaugcccuucuccugggagucguccuccccugagagcugugugcuuccugggcuuccacguuccaggacucccuuccaucugagcaggaacuuacaauagucacccucuguaaagcacccacaccucggauaaaacaaaaacauuccuacaacauuuuguguuuuaaaagaaaccaaauucucacuguucccucccuucguccucucuggccuguuuuuauucaucuuucuaaaugcauuccgugucuuuuauguucuuaauaaagucuugauggagugucgucuagaaaugugugucuucugcaugcugaguugauuugauucuagguccacugcuugguauucggaguguuucuuauuccuucuccuccucaucacaguagagauuuccaucuuccuuuccugcacguaugcuugugugagggugucccauccucuggaacuggaguugugagcugccaugugggagcucagcauugaaccagguuguuuggaaaaacaggcaguauucuuuaccacugagccaucuuucuagccugggagcacaucuuuugauaguuuacugaggaaaucauuuagugguaauuuuuuuuuuuuuuuuugcuauccuguauaucugaauuuggcucugaauuuguuauuuuacuaauaauucacaauaaaauucuagguuggacauaauaguuuuuccuuagcauguucacaguguugcuuugcuguguucugguuuucugguuuuuacuugggugccauuuuguuucuugauccuuuauaugaaaccugguuuuguuuguuuauuguuuguuuuuuuuccaaaaaauuuuuguaaucuacuuugucaugagcauucuaaaauuucacgauaugucuuguuuguauguuuuauccauuugcuucauaaugcccagacaguuagcauagaaacccaugcaaugggaauucaggacaacacuacauuaauuuugauuuugaugauuucuucaucccgucuguaacuauuacuguucggauauuaaaccucucagaugggucaauuuuaguaaaguaccacuuugcuuucuacuguuucuccacuucuuucugugugcuuuugggagauuucuucaacauauucuucugaguuuccuuuugaguuuucaugucccuaucacaauauugauuucugaaaaauuuuuuugcacuuuccuuugcaaaaauuaguauaacauucuuuuuuuaaaaaguacacuuguuguggguccucugagccggcagcgacacgaaugacacagacacgggucgcggaucggguucacgcagcaaugucuuuacuucaggcuuuuucuuuuacagcucucuuccccagcagcuucuucuuagggcaagggcuaaccuacucucuucauuacuacuggcuucuaccuagggcaagggcuagaaacuacucuuauucuacuucuggcuucuuuuacaacagcuagcuucuaccccuuacaacagcagcuucuacuacuccauccuucucgcagcaagggcuaaacucuucucacuacuucuggcuucuaccuagggcaagggcuaaaaaccaacugacucaccuccuucuagcuccaccccaccucauucaaucagaauucacacacacuccaggcaagagcuuaggugguucacagauaggcugacaggucuggaucacgaggaacaguccagccuggcaggcagcccacacaugcagccucacugcgcaugcucgggcaaggcaguaaacaaguggguuucauggggccugcggcugcacccacuuuccgcauacgcuuaguuuuuuuuuuucucugagaguauuaaaauaaguuuuucauuauucauaguuauauuuuucuuucacuuuucgguuuuguuuuugcuuguuuuauacgcugucauucaaauuaaaugcauaagaaggcaauuuaagagcccugucugcauucauguuuauuuacuagaggcuucagaguaggauggucuguuuggauauuugucugugaaaccuucccuuggcauugcuuuccuuagguuguuaacuuuugagccagucccauuccuuagagaaacugucaggaagauguuagcacucuaggugcuggcuagagaaggauguaagaggcucaguuuuuaggauuuaaacuuguauucaaucuucuuuuaaaaauguguuaugugcucuugauuccaugugcuuauuuucuguaauccgcagaucucuuauauucagcuuucucuuaauauuucgucagauuaaugagggguuuuuccugucuuuguaaaguggacaagugauagggauccaagagucucagguuggauuaaacaaauuuucaacagagggguuuuuaguuccaucuuguaauccaagagaccuauacuaauuaccgauucugaagccuuugagggguucuguggucuaaaucaaaugccuucuuuucuuuuuucuuuuaaauuucccuuuaaagacuuauuuguuuuuauacuauaccuaucagaugauuuaccugcauguauguaccauauguaugccuggucccauuggaggccagaagauggaauuggauccauuggaacuggaguugguuaugagccacguguggcugcuuggaacugaaucuggagccucugcaggagcagcguauguucucaaaaccccugagccaccucucuagccugcucacaugccgccuauuuacuuagcuuugcucuuacgugcuuaggauccugauuuuuguucugacaugacaacaaauauuaucuggcaagauggaauguaaugccugcuuucuagccuccaaaacuuccauuucuuccuugucuugaugggcagguucuuuaaaaaacugcucuuucacuguuaacuuuagagggauugcaguuaagcugauaaauguaaucagucuguaauuguaucuuaauauuuguaauggaaaaaucaaguaaaaaauacauacuucgucugaaauugcuccucaccccauuuuaaaaaaaaacuuuuuauugguucuuugccccuccccucauaccugcccucuacccuugcaaccuccuccacaacagaagaaagaaaaucucauuguggaagcuguagugugucacagugugucucacaguguacucuuuuguccacacuguuuugcuugcaaauauucguugcaaugauuccuuggucugaugggucugacuucuguuaguacuggcaccucacugggccuccucucagauacugugugucauagagauccuguuguuuuggaucugcaggaccagccucuucaugcacuccagaaguucauugauggggaagauguuggggugggccuacucaaagcccuggauaugcaccugagaggugucugagcuggucagccugccagcucuccugcucucaugcccucagggcuggcucaccuguaacuaccucucucccccugaacaggcucugcccuacugugcugccaggugaggggcagggcccguucucccaagugcuguagcaggugaggggcagggccagcucuucugcucucaugaccccauuggggccaucucucccuccuuaaugucacuacucagcagacagcaaggcugacucucgcucacacccucgggcagcucacuugcaacccccacguccagggccagcucuacugugcuguccaggugaggugcaggcccacucucuggagugcuauaguaggugagggccagggcuccucaucccagauuuuaaugcugaggcuuggacuuggagccuucuaugugcuaagcgcaugagccauaagagugguucucagccugugggucaugaccccuuggagggcugcauaucagauacgcugccuguccuauuagauuaugacucacaaccauagcaaaauuauaguuaggaagaagcacaaaauaauuuuaugguugggggucagcacaacaugagaaacuguauuagacggucccaguguuaggaaggcugacgacuacuguggcaucguacuaguuucugugcugccugauuauugccagcuugacagaaagcagaaucacuuguagcaaagcaaucucaguuaaggauuccagcacauacucuuuaccaccacauccuugcuccagcuccaaaaguuucuuuuuccucccuucccuuucuuccuuccaaauccuucuauguacccccucccuaguauucuucaaaucuguggccucuauuuucauuagguguuacuguaugcauguauguguagguauacacacauaugcauguaucaguauccauuuaaauauucaaaaugauccugguggcagcagugcauucucuggacucccgaaugaaagacauaaacacagaccuuacauuuuuauauacugggccacuuuuuaaccuccauguuaauccaccucccccuaccccaauauucccaagucauuucuuacuaaaaucuauauuuuuaucuuuacugcccaggacccagaggcggcuaagcucucugacccacgucuucucaggugcacugucucuucuccuccaccuuuuuccagcaugauggcucuccucccuucuuccucuguuccuugcccaggaauccuaaaagucccuccuauguucugcccagcuacuagcugcuggcaacuuuauuuuccaauaaaaaccaacuggggcagggucccucccucaguaucuugcggaccuguggauucucuugcaauuuuggggacccaaauuaccauaauauaagcagcauuagaccaaccccccaauuuacauauaugcaugcaacaacaacacacaugcacaaaaccuguugaguccauuuaauguuguacguauguuuucagggcugaccauuuggcguuggacuacuuguauugguggacuaccuuuacugcuucucgcuuuaccccgcugucuguauuucuuugugugugguugagguccagcauguguuugauuagugauuaauauggagugugcagcccacugcagaugguaggccggggcuguauauaagagguaggcuagcaagccaggggaagcagggcaguaaagcagcauccuuucauggccugugcuugaguuccugccuccagguuucugccuggcuaccuguccugacuuccuuuagugauggacugugauguggaacugaaagccaaguaaacccuuugcauuucaaguugcuuuagguagguauuuuauuacugcaacagagaagcauuuugagacaugcuuucucuguguagcccuggcuguucuggaacuuguucuguagaacaggcugccucugccauuccagugcugggauguaagguguguucuugacacugggauucuugucauuuaggcuagacauacauguacuguguagcuaagauuggucuugaauuugcugaucugccugcuccuacuuaccaagugcuaggauuacaguuuuguuccauccagcuuccucguuuguuccuaguuggaaauuucuaauauuaucuuuuaaugguauagguuuuuauaugucuuuuaaaaaugguuaaaguuuuuauuauuaguguaggguauauugcuauuuauaacuacuauaacuguguuguuauauauauauauauauauauacuucuuucuuggaaaggaagaauacuaaccuauuuucucuagcaauaagcuguuagaggccagggccuucuaagaagcagaguaucuggugaccuaagccugggauacuuacuguauugaguccuuugauucuugauuuuauaauauauggugguguagccaacaucuugaugcauguguuuuucucauguaaaagcacggaaaagcuauuacaguauuuuuaguuugaauguugugcucaguagagaaauagcacucuucauauacugacuuugaaugaaacugccuuacacaaauucuaauaacaaaauggcuuugcagauacacuggcuggcugugaaugggaggacagagcuccuccaugaccucgugcaacacgucacagauguggauguggaggaugccauggggcagacagcgcuacacguagccugccagaacgggcacaaaacgguaaaguucuccaugaagauguuaagggagugcauguauuguuuuaaaaguguuugaauucaugauaagacuuauuuuccauauuugggaaaaugcuacauuauagugaaauacuguuuucuauuuuguauggacuugugaugagcauucuaucugggcagagggaauaguaaauagugcuuuugccuuuguucaaaauaguuauaauuuugauguuauuucugauucuaguuuaaauaaaugacuacauuuuaaaaucagugugucuuuacauguauuuuaagcaauuauguuuaauaucaguuuuaacaaguaucacaacauuuuuauuaaguaucgguaaggcgaauauugauacugcuuuuuaauguuuucaguuggguuaucauaguuguuuucuccacaugauggaaguaacuuucugucggcacauuucuuuugcuuuuuuguuguucuuauuuuucuaccucccuuccauccuuauuccacccuaauuccaacccucagcacuaggcaggagagaaagaaggcuagccggaaagggguugugggucucuguuggccaacaaaauagaccacgacuuccugcugauuaggagaguuagguuccuggggcaaguccagucuuugucuucaugguaucuccaacuuccuucuuuugucaaacugugacagcagcaaccaggagcugcaggacaucagccuucauaggcacucuccagaguccccagaauuuaacuaucugcagcuggcaaaaaucacacuucugcuagugaccuaauucaugaggcaaguuuuauucacugcugugaagcagccuuuuaucucauaccugagauuaaaacaaaaucauauucauacaacauuacugggcucauaaaggaaccaaaguugucaguaguuuguuagauuucuguaacccugccuuugucccgagauguuacuuuccugucacugucauguagacaguuaacguggugauagcuuuuucauuaggagauugcugcuuuguauaaagauggagagcauaaggucuuagauugccuuucugacuuacuguauuuccuauucuguuuuuguugguuuuucuuucacauuuaaucuugaugauagaauauaaucucuuuauuugcuaaguaaccauaacaauaccaaaaugagcugaaaacaaaagucauuaucaguaacaaaaaagugcuuauuuguccaugugcauauagguacauacuuuuauuuauuuuauuuuuugagacagggacucacuauguggcucuggcugauagggagcucccucuguagacgaggcugaucuugaauuuacaguaauuaccuuugucucuugagugguggaauuacaggugugaccacauguucaguuuacacagugguaaccucucagucucgucuauuuuguaaggcaguauugggauuuagaucucucucucucucucucucucucucuuucucucucucucugugugugugugugugugugugugugugugcgcgcgcgcgcgcccgcacagccuugaguguuacuccuuaagcuaccauccucuauauucuuuuuuuucauuggccugaaauucauugaaucgcugagacuggcuggcuuuucagcccaagugaucugccugucccugcuucccaagagcauggauugcaagcugugucaccucaaccauuuguuuuucauaguauacuggccuccuuuaagacggugaggcccagguugauuuguguuuuguaagggcuggggaagagggauguaagaccuuuucucuuucuugaaauguuuccugaacaccuccauuccucugaagacuuuguuuuguuuuuaucauuuuaaagagaugcaggcauuuccuuuuuuaguucuuguuuuucucuguauagcccuggccauccuggaguucacuccauagaccaagcuggccucugacugagaaaucgccugccucugccuccugcaugcuggggcuagcuaaaguuguguacuaccaccaccuggcccaagcauuuucaaguaguauuucuucuuacuaguuuaucauuucuuucauucuuucaucaauauuauuggauuuuaaaaauaguauauaugaauaaaaugaagugucuuaauuugagugacucagcuuucuccccuuccuuugugacaccaaagcucaaaugcaaggccucauacauguagugcucauugcuugagcuguaugcccagucacagugagcuagggucuacaggaacuuacugcauauuagaaagugaguuacugauagcucccaagagauaggaaaaugauacauggaauguuacuugcuaauacuuacaguucuuaaauuuguacaggaacugcacguuacaauuggaaguaaucacagaagcuaacuuuggcuguuugaagcuaauauaaaacaagauuuaauaagaaaacauugguggcuguccuggaacuugcuuuguagaccaggcuggccuugaacauacagagguccaauuaccucugccucaucagcacugggauuacaggccugugccacacugcacauggcuaauguauuuguauuuuauagaacaaaauauaaaacuuuaagggauaaagaaacugugguaaaaaucucuuuaaaaaucuuaccaguuauuucaaauuaaagacacuaaaaucauaauuuaaagaaagccacugaaauuugcuguaacuuuauuuuagaguaaaucucaggaguuuaugaaaagauuuugaacgaaugcccaagaacucaaaagccuuguggaauuugcaaauaaauauauauucuugccuuuuugacaagaaauacuuuuucagauucauacuaauuuucuagaagauaaaagaauuggaaaauagguuccuucuuuucaugauuaagaauuugggcugaaguugaguuggcucaguggucaggcacaaagccuuggauuugguucuuagcuccaagggggcaaaaaaagaaauuggcuauacuuuguuaugguuaccuacaguaaccauaagcaguauagcugcugcuuuacugaggguagguagugaaguuucuuuaucugacuagaagaaagugcuuggaggcagugcauuuuggcuuuuguuguuugcucuuuaacuucauuguuagaaauaauagauccuuguccacacacaaacagaauuuacuaagauuuuuuuuggccaaguauugaacuuacuuuuugguacauuuuuucuuguuaucuuuaagauuuauaaaugugcaggagugccauaaaugauagauuggugaacuuggauucagaaaacucaugaacugucagucugaauauacauguuauauuacauugaggguuaaacuccaaacuguaacuuaguucauaauaaguucuacuuuuaaaagaguaauuuuuaaucccuaaauuuauacaacuuaauauguaaagcuucccaagcauuauaaaacugcaguugaacacuuguuuggguagauuuauauuaaaucuuaaaaacacugugugccgcuguugcuguacgguugcacuuacagacuugcugggaacaauggccacuucuguucuguuuguucucuugguaucuuaagcccacuucaaguuuuccucuaguuaccuacacaauuguaaaacauuaauccaauugugccuugaggcauacagguaaacaggcagauguuucagaauauauuuuuauguucagagugauuuuauuuauuccagugcuucuggaaaaugugaacagaugauaaaaauaccuccugauucuuguuuuccuaacaccauagugacuaguaaugauuuuuguaggcugucacauaacaggccagagucuagagguuuagaggguaggcuuguacggaagcuaugcaacucaucauucagaacgaagcuggcaaucuuucuuuacauauaaauuacuuuucuucguuguaauucaucauucaaacuauuuaauaaaaaggaugcuucuucugggcgguggcggcucacaccuuuaaucucagcccuugggaggcagaggcaguuguuggugguccaagagucaccccacaaaccucacguaucucagucagacagggauaguuuauuuagcauucgccccaggacugacugaugaugccacagaccagacucagggauugacugugaccacgagccaaaauccggcagagcuuuaaagccugaaauugacaaacaucugugccaaguuauucuaccagucaggaucuaggaauaggggacuuccuuaggaacaugcguuguugugugaaauauuaaaaaucaaaccagcuagugcuggcauuggcagguucucacuguugaucucauauuccagaaacugaauggaaccaccagccuugcgguugcauaucacaauacucuuuuuuuuuuccuuauaaaaaacaacauuuaauuggggcuggcuuacaggcucagagguucagucccuuaucaucaaggugagagcauggcagcauccaggcaggcauggcgcaggcagagcugagaguucugucuucauccaaaggcugcuaguggaagacuaccuaggcugagagaauuaagcccauacccacagugacacaccuacuccaaccaggucacaccuauuccaacaaggccacaacuccaaauggugucauuuccugguccaagaauauacaaaccgucacauuccacucccuggcccccauagacuuguccaaacacaugagucuggggugggggggggcauacuuaaacauaguguaaugcaaaaugcaaaaucaagacucuuaaagcuuaauuaaccaaucagauuuauguaucaauaauaucacaauuuacaagaagccaguacaauaauuucagaaccaauugauaaugauaaaaagcuuuaucccaauuaaucuaaccuuauaauaccacaacuauuuguggcugguaaacgccauguggguucauauccgcugccaucuuccuuuccccccuauccugagaugcucccugucucugcaacucuuaguuccaccucccuuuucucuguccaaucacaggccucugcuacacuaauguaauuggacagggaaaauccugcaacaaacauguuuuugugguacauuuauccuauucacauugguuuggguauccaauuguggcaaggcacuugcuuugccuaacauucaugucuugccuaccaggauaggauuuguuuaacauucaugucuuauguugccaacugggaugucaguuauccauguacaugaccuuuuugccaaauagugugucaauucccagggaggucuugggaacuuaaaacucuaccugaccccuacucaaaauggaagucuuacuccagauggcuucuuacauuggugcaagugucuuucuucaguugggguccaucccacaaccagcuucuaaaagcaaacuccauaaaagcucaugugcagcgcaggaagugcugcugggugguugguucagguccaagcuuuguauggcuaacugaccucuugugauugaucucaaagaacaccaaaucacagaacauaacagaauaugcaaucaacucaggcaugagaaaguuuccuaguaauagcaguaacaguaugcgaagguuagcuagacaugcaacacuuaucuaggccuuaccggcagucagaucucuugaguucagggccagccuggucuacagagugaguuccaggacugcuagggcuacacagagaaacccugucuugaaaaauaaaaauaggaggaugcuuuuaaggugguuuuauucacuuuuuguaaaugauacuauagcuuggacguuugugcacagcuuuacuguuuuacaaucuaaucagugucauucugagaguuggcagugauaaagcagagcucuuugggauuucugugaauuguaguuuggcgguauauuggguacagguggucucauuaccacuuucaguuagcugagauuacauguuaguguucuacuuaggguucuuggaagauuaugaucuguuaaaaauguguuguugguuuuuuuuuuuugguuguuuuguuuucuuuguguuuguuuguuuuuaaggaucuuuuaccaugugaaaaucuuucuauaaaaagaagggaucuauguuuguaggaauucaggacuucuagcagaauuuuuuuuuuuuuuuuuuuacuuugggucuuaccaugucugccucauguucuggaaaucacuauguggucugggcuggccuugaacuucccagcaaaauuuugauuuuaaaaacaaaguugguauguaugugugugcgugagagcaugaguuguguaugugugugugccugagaacaugaguuguguaugugugugugcaugagaacaugaguuguguaugugugugugcaugagaacaugaguuguguaugugugugcaugagaaugugagguguguauaugugugcacaugagaacgugagcuguguaugugugugcaugagaacaugaguuguguauaugugugugcaugagaacaugaguuguguaugugugugcaugagaaugugagguguguauaugugugcgcaugagaacaugaguuguguaugugugugcaugagaacaugaguuguguauguguguguacaugagaacaugaguuguguaugugugugugcaugagaacaugaguuguguaugugugcgcaugagaucaugaguuguguaugugugugcaugagaacaugaguuguguaugugugugcaugagaaugugagguguguauaugugugcccaugagaacauaaguuguauaugugugugcaugagaacaugaguuguguaugugugugcacaugagaucaugagucauguauuuguguggaugagaucaugaguuguguaugugugugcaugagaacaugauguguguauguuugugcaugagaacaugaguuguguaugugugugcaugagaacaugagauguguauguguguguacaugagaacaugaguuguguaugugugugugcaugagaacgugagguguguaugugugcccaugagaacgugaguuguguauguguguguaugagaacgugaguuguguaugugugcgcaugagaacaugaguuguguaugugugugcaugagaacaugaguuguguaugugugugcgcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguauuguguugugcaugagaacaugauguguguauguuugugcaugagaacaugaguuggguaugugugugcaugagaacaugaguuguguauguggaugugcaugagaacaugaguugugugugugugugugcaugagaacaugagcuguguaugugugugcaugagaacaugaguuguguaugugugugcaugagaacaugaguuguguauguuugugcaugagaacaugaguuguguaugugugugcaugagaacaugaguuguguaugugugugcaugagaaugugagguguguauaugugugcccaugagaacauaaguuguauaugugugugcaugagaacaugaguuguguaugugugugcacaugagaucaugagucauguauuuguguggaugagaucaugaguuguguaugugugugcaugagaacaugauguguguauguuugugcaugagaacaugaguuguguaugugugugcaugagaacaugagauguguauguguguguacaugagaacaugaguuguguaugugugugugcaugagaacgugagguguguaugugugcccaugagaacgugaguuguguauguguguguaugagaacgugaguuguguaugugugcgcaugagaacaugaguuguguaugugugugcaugagaacaugaguuguguaugugugugcgcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguaugugugugcaugagaacaugauguguguauguuugugcaugagaacaugaguuggguaugugugugcaugagaacaugaguuguguauguggaugugcaugagaacaugaguugugugugugugugugcaugagaacaugagcuguguaugugugugcaugagaacaugaguuguguaugugugugcaugagaacaugaguuguguauguuugugcaugagaacaugaguuguguaugugugugugcaugagaacaugaguuguguaugugugugcaugagaacaugauguguguauguuugugcaugagaacaugaguuguguaugugugcgcaugagaacgugagguguguauauaugugcgcaugagaacaugaguuguguaugugugugcaugagaacaugaguuguguauaugugugcgcaugagaacaugaguuguguaugugugugcaugagaacaugaguuguguaugugugugcaugagaacaugaguuguguaugugugugcaugagaacaugaguuguguaugugugugcaugagaacaugaguuguguaugugugugcgcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguaugugugugugcaugagaacaugaguuguguaugugugugcaugagaaugugagguguauauauguaugcaugagaacaugagcuguguaugugugugcaugagaacaugaguuguguaugugugugcaugagaacaugauguguguauguuugugcaugagaacaugaguuguguaugugugugugcaugagaacaugaguuguguaugugugugcaugagaacgugagguguguauaugugugcgcaugggaacaugaguuguguaugugugugugcaugagaucaugaguuguguaugugugcgcaugagaacaugaguuguguaugugugugcaugagaacgugagguguguaugugugcccaugagaacgugaguuguguaugugugugcaugagaacaugaguuguguaugugugugcacaugagaucaugagucguguauguguguggaugagaucaugaguuguguaugugugugcaugagaacaugauguguguauguuugugcaugagaucaugaguuguguaugugugugugcaugagaacauaaguuguguaugugugugcacaugagaacaugaguuguguaugugugugcaugagaaugugagguguauauauaugugugcaugagaacaugagcuguguaugugugugcaugagaacaugaguugugugugugugugcaugagaacaugagcuguguaugugugugcaugagaacaugaguuguguaugugugcgcaugagaaugugagguguguauaugugugcaugagaacaugaguucuaggaauugaacucggguuaucaggaugcauguccaggacguuauccacugagccaucucucugucccugaauaucucaacguuuuaaagcgcuuacuugcuguuguaauuucgacacacaaaaaugacuucaguuuaguacaguuuuuaaaguuauauuuguuaaauuaacuuuaaaauguauggguacccccauacccauguacauaugauuagaacuaguuagacucagugguuauauuuaaaaaagaaaaagaaaaaagaagauaugauguuggaggggauuauggacaggaagaguacagauuauuaugaucaaaauucauuguguacauggaugaaauuuauauuuuaaaaauguauagguaaucauuagauauuuauguugauauguuuuuaguuguuuauguuuuauugugagcugcugaacuuauuauuauuuuuuauuuuuugagacauguagcucuggcuguccuggagcuuacuguaggucaggcugaccuugagcucaaaccucgaacucagagauccucuucccuuggccucccaagugcuggacuaaaggcaugugccacuaccaccuggcucugaacuuaguuuuuuaaacaaguaaacaagaagcuguguaaugugaaaaugagaaauuaugaucaucauugcaaauugcagcuacauguuuuagaccuuuuauggcuuauagcucaauacagacaguuuucaugaaggugcuugcacguagaguuucaaggcaaggcacucuaaaauaaaugaaagagaauucugauuuauuuucuggguaaaacugaucagcacuuaucgugcuauguguuauuuguuuguuauaucuuagucucucuuuccucgguguaauauaaacucaugaaaaggguuuuagcugggcguguugacacacagcuuuaauuccagugugcaggauguagaggcaggaggaucuggaguuugaggccagucuggguugcauagugagaaccugucucaaaagauggcauuguguccuuuuuuuuuuuuuuuuuuucuuguaucucugguauuuaaaauaguuuauacuguggcuucacuuuuuuuuuuuugaggguauguauuuuuauguguguaugugugugugugugugaguguguguguguguguguguguacaccuguguacgcgugugugcuugcgugccugcaugccugaaguugggguuagguaaucuucuuuaaucacuauucaugaggcagggucuuguguugaaucuggaccugcugaugaugccagucuagcugucuaguuggccacuuugccucgggagucccacaucuaacugcugacugcugacauucagguagcugcuaugcacuuuuguuuggguuuuagggaauuacaacuugcuuagcaagaacuuuauccacugagccaucucucuaaucccuagcaggguuuguuaaauucuauuuacaacgucuuuucaaaagugugagaaaguuuuauauaaccucuggcauaucauuacauaaaacaguuuuucagaauugaucaacauauuuuguauuauaaccaauguugagaaugcugcuuguauaaauaaauaauacacgugagagaaguauguuuugggcugcuucaaaauucaucccaggucaaaauuaacuuaacuuuuucuuuuaaaaauuaagccucgaaaagacauuccuuuuuuuuuuuuaaauuuuaauuuucuaugugugaguguuuugccugcaugcauguuuguguucaugugugccuagucccugagaagucagaagagagugccagauccuguuuauagauaauuguaaagugcuacuugagugcugagauucaaacuugggacaucuggaagaacuagugaucacagucacagagccaucucuccaacucauucauauguauauggauauaugcauacaugcauauauauguguguguguauauacacauguguguguauauacauguguguauauauacacacauacauauauguguauauauucaugucagcaacucuaaaaucaaauuugaaaaucaguauaauccaaaacacacuaauuugauacugccaugcugaggaaugguuauaagauaauauuaaaauuuuaaaucuuuguuuuucauaaugaaacuaucauuucuaaagagcagagaaauuuguauguucaacaaaaacacuucaguaguucauaacuuaguugucuugaguccgagcuagaguucugugugagguggagcaaugacucuuguagugcauggcguguuccgaacaaagccugcagggugugugaugcaagugcccgugcuuccaggagcagcucagucacuacgcaguugauuuugaguuaauauucagucagugcacauucagaaauuuuauuguugccaaauuuuucaugauucccuaaauucaaugaauaugcugugagaaagaguuuuguuuguuuaagauggaacgucaaugagaggcauuuguccacuguuuucguugcauuugugaauacuugucauuuucucccuuuguaucuuuaaguggaguguguguauauuaguagcucuauuucuacaaauaauucugauuuguuugucugcuuaaaaaucuuaugguuugagaauacuuaggacuucaaaaaacugaaucaaaaauuauucuuaauuaugcugugccuuauugguaugacagaaacaucuuuaaguuguauugcuucaagagccuugauguacugauuaauuaggugcaugcucagagaauguauucuccccccugagcuucauccauucugugcauacuagcaccuuuacauuguuggaaacauuuguuaaauuuuaguauuucuaagacugcauaccaucuugaaacuuguguuagaaaggcugggcagcaaauucuucaguguaauuugauguagguuuuauuuuccaugauguuucacgucuagaucaggagagucuuguuuuuaagcaagaaaguaguugguuguugcagauaggccucugcuuuacuaguggaacuuuuauuguugcuuuggaucaucugggaaagccuugggcuuguguauugaaggcauggcaagggcuugagucaaaggcuugaggaaggcucgcuucccgucagggcucugaacuggaaggugauggggagccuugugcugccucuauuggggagccuugugcugccucuauugucuugagcacuccauaauucccuuaggagcugugacuacaguugccugccuuucuugcugcuuuuccuaugacaguguggaaucaacaguagaaugaguucugucauuucccuuccuguuuuagagcuuucauaaacguauaccagcaugcaauugaaaaauucagcgguugaugacuuuucugguuucuguuuguagccaagguuguucuggaacuugcucuguagaccaggcuggcuuuaaacucacagaaauccaccugccucugccucccagugcuggaauuaaagguaugcacuuuucagucacuuuaaugcaguuuaauacaauuacaaaaggaauauuuuuacauugagauucuuagcuauacauuguuuccauuuccauuagagcaaguaguuucccccuauucuucuguaggcaacauuuaccuacaugugaaaccuuaaaauuccuuaauaguugcaaagauugaggaucuuaaaaaaaauagauuuaugguuaugagcugccuggugugggugcugugaagugaacauggagcagcaguaaaaguucuuagccacucaacuaucuuguguuaaaacaggaaaaaggaccuaccuagauggaaaggaaaaugcuagaaucaguugcugccacuaucuuaaucaagucucuuuuaucagcauuuggcaggccaugcaagcagauggcacguacauaagaaagagaauuuuaaugucugcaagauaugugagaacauugacaauucauacuguaggucauguuuuguugcuaugauuuccuugaaguucgucugaccgcuuucuugaaaauacuaaaggaauauuuaguuugugguuaaauuaguuuuauccugaaagcucugcaguauaacugaaaacagaaagcacuguaaaaaguggaaugcuuuucaaaauggcauuauuuaaaaacaaaacaagcuacaguuuaagcuguaguugacugcuuuauagauucugguaaggauuagggcaucaguacuuucucuuuuuuauuuuuauuuuuuuauuuuuugguuuuucgaggcaggguuucuuugugcaguucuggaucucacuuuguagaccaggcuggccucaaacucagaaauccgccugccucugccucccaagugcugggauuaaaggcgugcgccaccacugucccgcucguacuuucuccuuuaauaagacauccugacaaaaagcacccgaagggaacaagugguucauucaguuuacaaguccagguuacaccauugccucagggaggccuuagcagcaggagcuagagccaugagcucacacucugcucugugccggagcagagcgaagugaccagcgcagcuugucagccagccagggcccagccugugagccggagccuucaguauucaggguguguccuccuacaucaguuagacaguccauccacuacagauacuuccacagacaagucucuucccaccucauucuaacuuguggcaaguugacauuuaaaaguaaauagaacauucuauaauucuuaagauaaaacuguggaguaauguggauucauaaaaauuggaauuucuacuuuauagagaaaaagcauacuuauuuugaucaugggcuuaggguuuuaauaucuguuuguugugugcuggaguauaaauuacuugaccuuuuuggaauucaauauccuguguacagaaguggagucauuaaauuuauugauacgugcuuaucagcacagcaucaggguacauguuaagguuauucauaucauuauaccaucucauaguuuuagcuauaauauauauauuauauagucuguguuuguguguaaguaguaaauuuuaauacuuuagcuuuuauauuuuuaggucugagcugcauaugaaccuuuccuuucuguaugggguuuugccugcauauaugucuauaccguaugcaugccugcuguaccucauugucucuaggacugaacuuagagaugguucugagcugccauguagguacugagaauggaaccuguguccucuggaaaagcagccagugacguuaaccacugagccaugucucuggcccugaaaaugugcuuucaguguacuugcuuuaccacuccugagucuugugggagauuaaguucauuguguauaaguucuguaauagcugugggcacuaauagcagccgacuguaauagcagugcccguuucauuccugcuuugagaccagaugcagcuaacuuuuggggacagaaaucugaaaagugaaaccaggauuaaaaugcacauauaugccuuuuuuuuuuuuuuuuuuuuuuuugaaaaacagggacccaaauacucauucuuaguccuauucauccaugcucauguggaggccagaggaggaugcugggucgucauuucuuucuccuuuggacuucugugaggccgagugccuuucauugaguuugaugcucaucaucaguucagccaagcuggcuggccacuuacuuuauccuuggguuccuuccugcauauguugccaugccugccuuuaugugagugcuggggauuugaacucaugucuucuugcuuucacagcaagcacuuuuacccacugagcuaucucccugggaauuggauaggagauaccaucguuuucuauaaucuuuaauuuuuucugcugggaacugaaccuaggaccuuguauauacuaagcacacaccuaaagcuaccccguccccccguccccccgucccucgugcgcgugcaggccguauguuucucuccuauuagguaugauuucuaaguuucccuuagucucuguuuguuugcuuaaaaaaaaaaagauagcuagaacugagcuuuuuagaauucaaaaauuagauuuagaauucauauugagauauuaguaaauucaggcagcaauauaugacagccuuuuaaaccuuucuuuuaaaucaagacuccugaagugguaauguucaaguuuuaaacuuuccuuugguggauaucuucaaauacuaagucgcuauggcuguuuuucaaucuuugacccuuguguauuucuuuauggguuuaaacauuuucuuuaggcaauacuuacacauaguuagguaaauucuuuuuuuuuuuuuuuuuacugaugagucaacuuguaagcacuuuuuaaaaaauacauuuuuuuauuagaaaacguuuuucaagcaauauaguaugaucauaguuaacccuuucccauccccucccaguccuucccacuucuccauaguuuuucuuuuucuuucuuuuuagaaaacaaaugugcaaacaaagcaggauacaaaaauugaaaaacaauaaaaacugaagaaacacacacacacacacacacacacacacacacacacacacacacgcacaauccauaaaaacacaaaauuagaaacugucacauagaagcaaaagcccaguaaaacaaaacaaaacaaacaaaaaaccccaaacaaaacagcaugauucugcaagucugcaaaaugaccaggaguucauucuguguuggucaucuucuuucuguguuggccaucuucugcuggcugauguggggcccggccucaaguauguuaguuuccucagugaaagucuuuggagaaaacugauuuuuuucuugcaugcaguuguaaaugggagauagcuucuagguuaggggaggaagcuugugugaacuuucccaacuuagugcuggggccccaaaugccuugaaccugugcaggccccauguaaugcugccauaggcuugugaguuuacaugugcgacagugcuguuguguguggaagacgcuguuuccuugguggccucccucucugcugagucagccuuucuaccuguucuuucugagcccugaggggacgguuugauaaaggccucucauggcuugggcagugaacacucuugaaauuaguaauugacuuccucugagguuuuuuuuuuuuuuuuaauuuuugguuuuacuucugguguuugugugguguguuguaugauguguuguggguguguggguguaccaccauguacauguggaaaccagaagagaaguuuguggagucagguaucuccuguaccaguaggcucuggacguugagugugggcugucaaggcugagccacuuggugagcucaauuuuuuucaguuuuauuuguguggucagcaguuuuccucauacguuuccauagcauugaaacguucuugucuacagagacaaguugguuagauagucugccaauucuguuuuucuuucccucaaucuggauaauuuguaaugucuuuuguauucaauuucuuauauuuugguuucuauauuaucucuuuuuuguuuuaauucauucuuuugggggaggagcaaagguuccccuauuuuuaccuucgacacaggauauuucagauauuaaaaauuauuagugcauuugauaauauauuugaguaguagcaugagugacuagagauuuaguauuuggaaauaauuaaaaaacuagaaggcuuuaaacaugauuuagauucuaauguuacauuuaugaaguuuaauguuugucugauuucaggacaugucugagaucuuacauacuuccuccuaaaaacuuuuacauggauauugcuuuguugaaguuccuuaaauguauucagacuggaugcuugaugaguuguucagaucuggcucuuuaugcugcucaguucugggcagccuugggauuagcucuugacaucugugugaugccaugccugucugcucucaauuucugcagugagucucucuguauugauucacugaucuucucaucuuauuuucuguuuauuugcuauuucugucuuguugaggucccaaauauuaucuuucuaaauguuaguuggauuauuauuuuuauuauaaaauucuaaauuuucucauuuucuaaauauuuuucuccucacauuucuaccccuguuucaugguuaaaauacuccuuucucccuuuuuaaagauguucuccuuccuucuuccuugucugccuuccucccuccacccugucuuuuugagacaagguuuuauuaugugguucuggcugaccuccaacgugcuuuguagcccaggcuguccuuauccuuggaaugcuguauuagcccccgggaggugagguuguaggcaggcaccacccugcccagguacuuuucuaaauuuuuuuguauggcuccuuuauuuucuauauuacucugaguuuuguuuugauuugauuuucuucucaguguuagagguuugcuuuaguuguaucuuaaauauuaucuguucacucauuuaguaaugagauaguaaggggcaccaacuggggaacauuguauguaggaugaauuacugccuggcuuagcuguacaccauuggcaguaguggaacugucuguauuuuggacucauuuuuuugggggugggggaggugggagugcuguccugcacaugauagaauuucuauauucccgaucuuugcucaauagcuuaccauccucucuucuguaguaaugaaaaucaaaauaucuccuggcauugccaaaugcucccuguggcgaaccuaacugacuuaguaugcuccuagacucuuucuucucucuccuuguguggguaugcacugugaucuuguuauugacuaagguuuagugcaucaguacgugcgguugauccagaguacuacuaaaacaauuuaaucuugaagcuguuuuuuuaaaugucuuuauauacuuuucuucuucuucuucuucuucuucuucuucuucuucuucuucuucuucuucuucuucuucuucuucuucuucuucuucuucuucuucuuuucuccuuuucuccuuuucuccuuuucuccuuuucuccuuuucuccuuuucuccuuuucuccuuuucuccuuuucuccuuuucuccuucuuuucuccuuuucuccuuuucuccuuuucuccuucuccuucuccuucuccuccuucuccuccuccuccuccuccuccuucuccuccuucuccuccuucuccuccuucuccuccuucuccuccuccuccuccuccucuucuuccuccuccuccuuccccuucuccucccccuccuccucccccuccccccuuccccucaaaugaggccaauaggaauaaaacuagaaaacauuauuuuugaguuuuuucccgugggcuuuguucuauccugaaucucaaacauguauuuuuaagauuuugugugaaugcacuuuugauaugagucagaugacuacaggggauaggguauauaugguugagauucagagacugugagccaguguggacuuuguugauuggaaaagguugucuuagcuuuuaacauguuguacuucaacauuuacagucuggcuuugggagaaguacagcucugggucuaauuuuuauauuucaagagguaaaaaguuuuaguuuuaaaauuuugguaccuaaaaguaauagugucuaguuugcuagccuuuuguagcuaugcaacuuuaaauaauugucuugguuucauuagccacauuucaugucuugaguagucaugacuaugacugcccuaugauggagugcucucuaaggcaaguacacuuccuauuacauugacaguugcccagaggucacaguguaccugaacugucggucagucagagagcuuucuauggaguugaacuuacucacugucauaaccaucaugagccugcacaccauuuucuuuuuaaugcuuaaugguggggagaauucuucuuauguggauugaaguucuaauaacugugucuuuuguuugccuuuucuggcuuuacuguuuuaacuuuuuccccagacagugcagugcuugcuagacagcggugcugauauuaacaggccgaauguaucaggagccacgccacuguacuuugcuugcagguaccaaacuuuguauuuucagauaugcuuccauuaaagaauguuaucuuuuaccuauauuuucacacauaaagacuguguauaguuuuuaaagcucuguuuuccuacaaauacuuugcuuuuauguagcaugauaaauaccuuucuguuacuuaauugcaggaaagcauuuucuauuaauauuauugucauuugagauaagaucuuacucuguagcccaggguugcuuagaauguacaguguagcucauuggcuggcaucaaacuuuagguccuccuccuucagccuccuaaaugcugggauuauaagauagacacuuaguacuuagcauuucauuuaauuggcaguauuuucaucaguggagcuguuuuuauuuacuugacuacuucaguuuuaggacaaagcaguaauucagagaguucuguaguuuauuaaguaccuaggaaaacuguugugugugcguuggcucagagccaagucuuuucuuuauuuauauaacuuuuuuaaaaguguugaaucauuguaaguuuguguucuguauucugccuuugcacuccugucuuaguuauuuuucuugacuuguuauuuuguuuucuaacucuuguaaguagcaaguacuuagcuuacucaccauaucacgaauacauguaagaauuaguaagcagugauaacuaggcugggguguacuagcagacaugccuaggcauaugucaaagguccuucuuccauccccagcaucagcaacacaaaacaaaccccaaacuauaauguacaaauuauauuuacacuuguaccuguaaacaugccuauaaaugugucacauagagggaguuugcaguuaggaauagugcagaaaccuacuguaacuaauuuuguuguuguuguuugcuuuccagucuuauaguugucccuugguauccuuggguauuggcucuaaaacaacuuuuucacuccugauggauauucacauuuaauauaaagucacccuauguaaaaugccaaaguauuuauaugcaauuguuaaacaucuuccuauauagcuuaaccauugcuugcaucuaauguaaaugcuauguagauaguuguuguaccauauuguuucagaaaucauaagagaaaaaguauauacauacucgauauagauacaacaauuguacacauaacuguauuuuccauccauauggaacccauagguauggauggcugcuuguaugucaguuauauucuuucauuuaaauuucuaagagauucuagaaacuuauccuguucuuuuauaucauuuaaaaauuacuuauuuugauuuucucuguguguguguuguauguaugugcaucauaugcauaccugguaccuguggagcccagaagagugugucugauuuucuggaccuggauucacagguaguuguuagcugccaucuggaugcugugaauugaaccugcauucuuuacaagagcagcaagcacucuuaggcacugagcagucucuucagaccucuuuuauaucauuuuacuagagacuuaucuucagcagaaagaugugucuuuuuccuguuuugguuguuauugauacuaccuuaucaaacugacuuagcucaucuauuaauuuuaaaaaguuucaguguuaauuauguguaggugugucuuuuggaaguauguguacauaaugauaguugccuauggaggccagaagagagugucagaugucaaaugcccuggugcugcaguuagagguaacugucacuuacuuaccauucuggaaacugaacucagguccucugcaagaguagagcauauuuuuaacuagugagcuuucucuccgaccuucuuaaacccuuuacuugaggcaauuuacaaaacucuguaguugugugggugugggugucuaucucucuauaauuuacuauuuuuaaaauuuauaaucacaucauucuauccccuccuaugcaacaccacuguccucucucaaaauucuuggccucuuuuucuuuaauugucguuuuacacacacacacgcacguaaguauguaaauauaauccauguuaauaugauauuuuuaauuuaaacuaugugaguuauaaaacuuaguuaagcuguuauaauuaaggaguuuuuacauauuacaacuuuuugaguuuuagucuucuaguucauuucugaguucaguauaaucuuauucuuaugauuuaagugauugguggauaaauguauaggaauuuuacacuccagcagcaugguugcucuggcaagggaucacacccaaauuuacaauccagcuggaauguagacaugccacacaccuuuaaucccuguggcuggaauacagacacauccuuaguauacaccauugaucccaaacaauaaugacuaauugaggggcagacaaagugaugaaucagagaaagauuugacagaaugagucagauaugauacacccaacucucaugaggacagacaggaaagagaggcuacuuaaagaguagugagggauagagagugcauccauucaauucaguucacuugugcucaguucaguucacagcaguuuaguauccggagaaaggcucugagaagucaguuugaguuagucagcuuugggaggaguuugaaccagaacaaccgaguugaaccaaccagccaguguuuagaaagagcuagaaaguguggaaagugugaguuuauucagcaguaagucuuggaagcggaaacauucuaggccucgauuagcugauggcuaaaugcugaagcuggucuggacucguagaagauuagauuauaugggggcuagggauaguuagaaucuagguauaugggcucaguccaagccauguauuugaaaagcuuggguauagcucuuaucauuuuauuugagaaaauaaaagugacauucacauuuacagauaaccaauuuccaugaccaauuaugucaugaauuuaugaaaaacauuaccuugaaucucuggaauaauauucuaccuuuuauauuaaauuuuuugaaaacauugucauuuuauguuuauggaugguuuccugucuguaugucuguauacauguaugucuguauacaugcaaaguauguauguaugucuguauacauguguaugcaauacccuuggaggccaggagaagauuucagauccccuggaacuggaguuccuggacugugguaagacuccacggugcugggaauuaaaccucguuccuuuggaagagcagucagugcuuuuaacugcugagucauuucuucagcccauuuaaaauuuuuaaaauucuuuaaauuuuucucuauauuauaaucuuugguguuuauuuuuagauuagaaauaucuuugaggcucccaguuuggcuacauuaucauaggaacucucagauuuuaacaugucccaaauacaacaucuuauuuuccucuucguaucuuucuuguaccucauaucuuccuacuuguuuaaugcagaaauuaaaucaucauuaccuuuugacucugcauuugggaccuauuauuaguaaguucuuuaaagucuuccuucagaacguuuuuugcaucuguagacucucucuaaagcuacuugaaaguuguuacaucuagaguacugcugaagucaaccuacucccccugacuguacucuugcuucugucuaguaaacucuuuccucagugaagaguuuccucaguggcccuuugaaaaacaaccaaaaaaaaaaaaaaaaaaaaaacaacaacaacaacaacaacaaaaguaaguucuugccacuugagaguguuucauuguguccuuggugcaucucacauaagccaagagucucuaggccugugagacucacucaguucucacuuguuuuagccaugcuuguccucuuuguguucucuaagugccagugcccacuguaguuucuccaugguguuuugccuguugugguuuuguaggcauuuuguguggcuuuaacuucacuugacaccugccaccugcuuuugguggagauaggagugugauccaugcugccucaaccuugugauucuccugccucugcauucccuaggcuuggauuauagaugugucccuggugucuuagucugcuuuuguugcugugacaaaagugaccaaaaucagcuugggaaagaaagguuuauuuggguuucauaugccugcucacacaguucacuaaggaaagccaaggcagcaauucaagacaggaaacuggaggcaggaacggaagcagagacgauggaggaacuuaguuuguacuuagguguuuagugagugcuuguaagugaaucaccauaguuacacaugaaacaauggcauucaaaauauuuaauacaauauauuuuaugcagaacuggacuauuccuauagcuagucugaauacaagaauauggcuaagagauuguuuuaaaaguauuuauuuuuuuccauauucauacgaaagauuuuuuuuaaaacucagguaugugccuguguauguguuacuaggaauuaaacacagggacauugugccaugcuaagcuauucuuaauuuuuauuuuagagacaguguuauucuaguccagucuggcuuguuacuacaugggcaaagcuggccuagaacucgugacuguccuuuucuccucagccaaaugcucagcauuaugggcauggccgcuggguugacaauuuuuacuuuagcaagcauugaaucuuuuugagaaaagguaguaagaagugaaacaaaaaauaaauuucucauuguaggagaaugauauauggggcacuguucauuuuacuucuaaccuguccuaauuuguguggugacaccugauuguaugugugcaaaggccagagaagaacguaaguguucaguaagccccugugauccuccugucucggcaccucuagcagugcugagguuacaggugugcaugccugguggcuuauauaggugcuuccucaugcuugcccaguacacacucagaccucccugagcgucucuguagcccucagggcauggucuuaauugcacugugauuucuacauucucagguauuuucucuauuuacagauaacuuuuauuaggaaaguaaaacaaauugaacauauauagguaaguuguuggaguuuuagagguuuuugaggcguuacaaaaguacaagcuucagagcauagaguguaacuccugccaagcaaugcuuuuuaguuagaaaacucaaacaagauaguauauaaaauagccuuuacauuuaaauacacaaaccuguaaaauaguaaucuguucauaaucaacuaaaacuguuacuacuuuaguucccauuauuagauacacuaguggaugcucuuagacauuuaagagcccaaaguuagaaagcuggguuggagaagcaguucuccuuucauaaacuacauuauggcucuggaacgauuauuaucucaaucaguauaagaauuagucuuucuaggcagagucuuuucuuuaaauguggcccugccaggaugacugcacuguacuggaugggaugccccacacccagaguauguggguggcacaaauuggacuuagugaggauauugggaaggacauggacuugggaggacagucugggaggacguaggaggaggaaugguagggugaguauggaauuaccaaagaguuaauaaacauauaauuagcuuuaauuuuuuauaaagaauaauuauucaguaaacuuugucaguuauuuaguuuaaagauuauuuuaauacuaaauaugcuaaaauacagucaaguguucaaaacaucagccugugaaggcuaacccaaaauacacugcaguguuucccauugaguauauuuguacuccauuuguaucuuagauacaaggcauuauauaucauucuguguguuucuguuuauuuuaguggauuuaauuauaaagcuggcuauuaaaaacaguuggcgcaggggaccagggcuaagaaaugggaguagguggguaggggagcagggcagggggaggguacagggaacuuucgggauagcauuugaaauguaaauaaagaaaguauguaauuaaacaaacaaacaaacaaaaaacaguuggcaauuaaaaaaaaucuuaggugugguagugcugguuuuuaguaugaguacauaggcaaaguacaucuguuuuuaguaucaguacaacugagacugguuaguauuagcuaguguuuagugcugguuuuuaguaucagugcaacugauaagagacaggcagaucucuuuauguucaaggcuauucuggucuacuaagcaaguuccaggccauccaggguuacauagugagauccuaucuaaaaaaucaaacaaaaauauuuuuucuguaacucuucauagucuuucauaggauaauuguaaacuauuacaauuuauauauguggcacuuggacuacuaauugugcuuuuuacauauugugugucacaagcaguuguuucuuauuuuuaauccauuuuugaaaugaagagucacuuuaagugugauuuucagauauuucuugaaauauaguuuucucaaaaugcaguggcauuucuucaugugcauuauucuuuuuguuuguuuuuuugagacaggguagaccaggcuagccuugaacucagaaauccaccugucucugccucacuacugcccggcgaauuuuucuuuuuaaagauuuauuuuuauuacuuccuuuacaauaagauuuuaaaaugucuauguauguguuucgucugccuguaugacuuuguaucauuugagugccuggugccgggggcauucaggagugggcauuagauccucuggagcuggaguaacagauggcugggagcugccauguggguacugggcacugaacccugaucuuuugcaaguguucuucauuacggagccaucucuccagccccaagguuuauuuuacuuuuaauuuuguguauauguaugugccuguguauaggcauauguaucaaagugcuagugcccacaggugacacuggaucccccugugcaggaguacagacauuuguacagacacuugacauggguuugcugggaacuaagcucagagacacucagccucuaagcugccucucuagcccucgugguaauauuuuguuuugcuauauguaugaccaaaauuuuuauauggaggcuuaaaaaacagcuauguaguuuuuauuuguugaucuugagcaacuauuuacucuugaaacuuuggauggaccuuuuaggaagaaacucuagauagauuaaagaacaccacauaagcuaaauagugcucagggauucagagagcgcugugcuaguagugucucaacagugagcccugaggcagugugcaugaugacugcagccauggguuugguuuauuugggcguagucugauggauuggcucugugguuggcugaaaccuaaucugugaacguagagguaaaauacucaguuuguccuacucaccauauagacuacuucugucacucugaaaugggaggcguuuccuccccgucagggagccaacacuugauuaugcaguggccauaaguugaacaucuucugagucaguuguuacuccaucuacugggugauagugucugaucccagaaguugugggcucaguccuaauagauuacucugcaucuuagguacuuggagcaggucuuauccuuugugguuucugaccuggcugccagcugggcuuucuaggacucccuccuugcguuggaauaauuuggcagaguggcucguagaucucagggagacugugcuuguguuuauuagauuuaugacagauauuuuaagagacauaaauaaacaccagucacagagacccauagaguaaggucuagaagacucuuacguguaggagcuccauuucuuguagauaguuugaugagaugcaccacccucugggauggcuucuuagucaccuuccuauaaggcugucucuucucagccagccaggaguuuuccaguucugauugguuuuuuuuguuuguuuguuuuuguuuuuguucuuguuuuuuaauggaagcuucguuguauuggcuugauugaaacauguacaacugugccaaaggaggugugugacuuacuauguuaggacagaguggcaaacccagccggaguuucuguucaaggucuucauggucuuugggcagcacuccuuccuuucaggugcgagguagggcacugucugaacugcgggcccugagauugauccuuagacaggguagaugggaaagaugucagaggagauacuuuuacucucuauggcccacuuaggauaauuugccuuggugaaacaaggagcugcuugaugagggcaggauaguacugcagaggauuugguccuaacagccuaacaaaaacugucuuuuuacuugaguguuccaaagcuacuucaagaaccaaggccagaaggccaaauacacuacuccuauuucucuaguuacuuaagauauaacaagaaauuaagcaagagcuagaaagugugggugaacacacacacacacacacacacacacacacacacacacacacccucacacacccucugucacaucugaauauuuguuaugaacgacaugcucuuccuugcuuauuuacuguugcauaggagccaucuccuguugcacagggacaucuuuuaggcuaaugguuuccuguuuauuuaacaacucauguaacacagcugucacaguuacauuccugaugacgaaaagacuaagauaacauuugucaccuauuagauucuacgaaauuguguuaggcuucugcuaguuauuuccuuucuuucuucauccauucuguaaugcuuauuuaucaaguguaugaaauauguuaaagcuuagaguauaauuuauaaagugugaugagucuguguuauaugccacuaccauucuaggugcuguagaauaagucugcuauguagauauuggcagcuuaggggcuggagagaugacauagcagccuguaacagcacuugucauggcagaggaccaguguucaguucccagcauuuagauggggacugacaaccauucuuaacucauuucuaaaggaccugacuccuucuuuugcccuccgaggacaccaggcaaauacauggugcacacauacacauguagggaaaauauacauuauaaaauaaauaaauguaaaaaguuugaaaguugacaauuucagcagaaagacugaaaauauggacauuaagcaacuguaaguuauuaaaauuggauaguuuuuauaaaaacucuagauuauugacaucuagcagaggugccacuguguucugauauaaguuaaguuuaucuuggugacuuuucaauuuuaguuucggggcauaauaggaagcagccuaacauaggguaguauaaguuaaauaguauuguaauagcuguaucauacuuuggcugguaacaccagcauaauaacacugaugccuggugaagacuucugagcauucugcucuacaucuguaucagcagcuaugugacugaggcagaauugcccugaguuuggggccagccuggacuacagagugagauuucuuauugaauauuaauaauaaugcuaauuacuguuguuuucagaggaucgaucuacugguuuguuugguuuugcuggcaaaauuuggcuacuauuaaaauuauuuauuuauuuaguguguguguuuugccugaguguauaugucuguauaccacuugugugcuuguugccugacgaggacagaagaggguauugaaucuuuugaaacuugaaacuggaguuacauucaguugugagccuccaaguagguacugggaauugaacucugauccccuggaagaguagagguucucuuaacugcugagccaucucuccaccccccuagauuauuauucuuaaguuaguucugguuaauugguauguguaucaaggacaguaauuacuguugucauaaauuaucaacagaaugauaaaaccuauuauaguuguucacuaaauucauagcagggcacuaugaauguuuaauucaaauuggcuauaaauuauguuuuguacagugccauuugguugaaauacagugagcuuguuuuuaauuuguuuacauuucugggaaaucugcauagucucuauugcugucaagugaugugucucuguauuguaguguucuaauuuauagagaaaaguuaaauucaaagauuagguuuuuaacuugguucuauuucuauacagucauggucagagagauacugcacagauucuucuauuacgaggagccaaauauuuaccagauaaaaauggaguaaccccucuagaucuauguguacagguaugcuuuuaauauauaauuccaagcgcauuuaugauagaaauuauaaauuauaaaauaaugguuuuuuguaaaugagaguaugaagauguuuagucugugaaaaguaugaucuuuaaaugucucuuuguuuuuaaaccugaaaaauuguaaauuuuguuuuuagggugguuacggacagacuugugaaguguuaauucaguaccacccgaggcuuuuccagacuauuguucaaaugacacagaaugaagaccuucgggaaaacaugguagcauaagcuugcuaauagguuguaaaugaguaguaauuaaaauuguuauguuuauuuuaguaaugaguugguugugcauuauaugaguuauaguuagcccuugauauauggggauucuacagccaaaaaaccaauuauugaucaaaaauauuauaaucaaacaugaucagacuuuuugucauuauucccuaaaaaaauacaguauagcaacuauuuacauagcacuuauauuuuauuaaacaugacaaauuaugugaagaugacuuuaaguuuaugagaaaauaugcauugaauauauucaguugcuauauuuuauaaaaaaugugaacaucuagagguuuuggguguuuagggacaaguuggaguuaacaggaauauuguagugugguauaaauaauaacaugucuuauugacauuagcccucugaaucaccugaguggcuuuccuuaugauaauuaccucauggauagaggacaggaauaugaaggaggaauacuuuguaaugacuggaaacuacuugaucacugagcucuuuuuccuguaguuuugugcugcuaggguguaaaccuggggccaugccugcugagcuauaucuucaaccccaagcucaguauuuguaauagcuauaaucuuggaaaaguugcagauuuggaaaucuuuauaaacuucagauguuuagaauuaaauuuuuagaugcauacuugauuuccuguguauuuuuuaacuggauaauuuugaagaaagauuguuuuucaucuuuuucuuuuauuggcucuuaaguuuauauagaguauaauaauuguaagguucuugauuuuaguugacugccuuuaaggcauuuauuaagcauguguauauauugauagaauaaauggguuacucacucuguaaucacuuugguuuuuaauuuauauaaaaccaguuacggcaaguucugcagcauuugucucagcaaagugaaagccaguaccuaaagauccugacaggccuugcugaaguugcuacgacaaauggccauaagcugcuuagguaagcauuccagggacucaguacagaggagugucugucugcuugaucuccucaguaauuagcuaucuuuugucauugaugagcuguguaaacaauuugcugacuuacccuauuaguuacuuuucuacacugugauagcacuaugucuuuggcaacuuagagaaggguccaucuacuuaagguugucggggauaagagugcauugcggcagggaagcauggcagcaagcagcaggcaaggcagcaggagcagaagcugaggauucacaccuucacucaaaacaggaagcagagagcaggcucuaaguggugcacauuuuaaacucuuaaagccccuguccaguucaauaacucacgucgguaacaauaaggcuacaccuccugaguuucuccaaagggccuccaacuucagagcaagcaugcauaugccuaggcuguagggccuucucauugaaaccaccacauuuaagguuugucauucuguuuaaaaagcccuggcugaucagcuuaucuaagagacuuuauaaagaaaccuagaacauacuaaugugaauuuuggcauauguguacggaauuuuguaaaaugauugcuuaagauuaguccuaccaguaaacgcgugugaagaagcugcuauugucuuggguguggucauauuuccuuucagucuaggcaguugagaucaaaaguaggaggaccaggaguucaaggucauccucagcuacauaaggaguuuguggucagccagggcuacaggagaacauaguccaggacucugaaucgccgaguuacaaaauugggucgauccccuacuguuucaguguucagcauuccuucaucauauucauuauaguuuuuuuuccuguacuguuucucucccuacuucaguuuuuaauucuuuuuuuuuguuuuguuuugguuuuuuuuguuuuuguuuuuguuuuuucgagacaggguuucucuguauaucccuggcuguccuggaacucacuuuguagaccaggcuggccucgaauucagaaauccgccugacucugccucccaagugcugggauuaaaggugugugccaccaccgcccggcuuuaauucuuuuuagauucuaugguuuuaauaacucauugcugagccuaaggaacuaaacuuuauauugcuuacuuuuauauauagcuuauaucuuugcuguacaucuuuguaugugauuagccacuccuacuaggagaauaggcagcuauuaccaaguacuuaauguguuacuguuucuuaugcauuugacccucuucuaauuuaaugcauucuucuuuguaugacucacuaauuauuucuacagugacaguuugugauaaccuuuuaccuuuguacauugcuacagaacuuucucuuucuacaugcagagucuaugaaaacuaugcauacaaagcuacauugucagacuuaugguuauucccaugaaagucauucugcaucaacaguugccuucucuuucccgacagggucuugcuguauagcucuggcuggcucugaacuuguuuagggucuugcuauguagcucaggcuggcuuugaacuugaugucuucauguuucaugcucugaagugggaauacauuugugagcuacuuauucucugcuacuuucugugcuccuguacucuuuacuugaaaggucuucugcuaauucagaccaguaucaccuucuuacuuguuuguauuuccuaaguugcuuuugauauucucuuuggaagcacuuuuagauucuucugcuuuaugacucauuggagccaagguuuccauaauguacucuguccauuuuuguuuagucauuccuaguaacucauguauuucaugaaaccugagacuuagauaggcuaauuaaaucauaggagggaagaaguggagggguaugaaugaggacuauauuugaucaaaacacauuauaugcauauaugaaauucugaauuaaaagcauaugcauauuucuauccgucucuuuuauaauacagugagguauaauuugugacuuuaaaauaauaugcuaaaacucaaaaaccaaccaaccaacaacaaaaaaaccccccaugggcuauggacuuuggagccuuccagauacaguuguaaguucagacacuguuuacuaacuuguuacacaccagcuuugacauccaggguaaacugaggugggguguaaagucaguaauucacaaguacacuuuuggaagugaauaaauuuccuuaacguuuguaucuaaagauaguauucuucauaguuuaugcuauacuggugguauauucauugguuauauucuggguacuuaaaaauuagaaaucuaauucauaacaaauaauaaauuuaauaccauguauuaauauauacuuaauguuacauacuaauauauauauauauauauauauauauauauauauauauaaauaaaauauauuuucugcucaacaaacuucuuucuccuagaauggguaagaaauuaucuuaacacagagaauucaugagacaguugguuagugaacuaaauauguuuaaaauaaauauuugaaaaucaauuuguuugguuccaccuaauguguucauauuuuaauuuuucauuuucaguuuaucuagcaauuaugaugcgcagaugaagagccuuuugaggauugugaggauauuuugucaugucuuucgaauuggucccucaucucccaguaauggaaucgauaugggcuacaauggaaauaaaacuccaagaagccagguguucaaggucagaaacguuguuguuaggagguagacauaaaggagaugacuaaaacacagcauacauucauuaaaaucaugagcaagauauaaguuugguucauaacuugguuacauauuuccccuuucaguuuugucuaaugaacaagauuuaauugguaagcuuuucaaguuuuucuuacacauaaaucaaucccauucgugcuuuuaaggauagagauauuuaguauuaaaguaauuauauugaauuacaaguuuauuuauuuuaugcaauauuaaauguugaagcuagggcuaucugugugcaauggaaaguuaacccuagcuuacuuuuuacuuugagacagaaucucauuaaguuggucagacugaccuguuccuuguuugguagcugaggcaggccucccuccuaaguagcugggauuacagauuuuagccaccagguccaacucagauaaugaauuuuuaaugcaaaauguaagccaucaucuuaaaaauguuuaacuagaagauaaaauaaccugguuuuguuauuuguauuauauacgugcuguuugugucuguauuauauauuuuggaagaaaggcuacucuuacuuaauaguucuauuaacaauuccugggauuaucuuaacaaagaguauuuuuaaaaaauacuuuucauuacuuuggcugccuuuccuaacacauaucauuguuauuacccauaucaaauuauguguuuaugaacuagcuaugcauacucuguugauaauaauguuuuuuuguuauaguuuuauguaagacuaugguuuugaucuucagcacagcaggaauuaagcaguaacaacaaagaagcaugucugugcacagcaaauguacuugugggucacacuuugagcaguuuauucuguauuaucuuuaaggguaguagguuucugugcuauaaaauuuacuuuugagguucacaaagacguuauuucuugcaacaguguuuagguuaucucuccaacuaagacaaauauuuuuuuuuauguaauauaacuuauugaaaagauuuaguuaguguuuauaaaacuugaaucuaaguuaauguuauaugcuaaauaauucugguuauuauagcuaaauaacuuuaucuuacaugaaccuuuugacauacuuaacagauaaauggcuugcaagcauuuugauauuauauuaaaaguuauuuguguauuaucauugugagugauguguguauuugaguucaggcuuguggugucaguugucuccucucugccuuucugcaggucuggguauugaguucauguagcaagcacuuuaccugcuaagccacugugcugaccacacuguacucuugaaucuaagaauaggugugauagccccuuaggaaggugccuguuaucuguguuucauucuuuuuuccuuuuggaaucaguacaggaaagauaauuuucaccuauacauauuuguuuccuuuuacuucuuuuuucaccucuugugccaccuucuggaagaaggaaaccaagcaguuuuugguuuccacauccuguuuucuuuaguuaggauuugcaguuuacuacucuuguagcauuucuauccaaguggccaaucugcuccuuugucagggcuuuucucagugagguuuacuccucgcgugacaucauaugaugcuauucuuaauguagucuggcaugguuuacuauguuagcacuuacucccguauuuuacuuucuacucagcuauaaugauaaguaggaaauuaugguagguauagguagcagucacuauuuccuuauucuuaaaauuugaaucugucuugcuaauaggcuuagcauaaacauauuaacaguuggcuuaaugcuaguuuucuauuuaaucaaugcaggguuaacuguaacaaaguaugucaaagauacuguuuccuauacucuccugcugcguuuuuuucaguguugggacguaaauauaaguccucacauaugcuaggugacauaguuuuucuuuguuuaaugaaauucagacuuuuuuuuugucauguaguuauggguuuucuuuccuuuuacuuuuuguguacugggaaaugaacccagaaccucauauuuuuuaggcaggugcucagcugccaaacaaggaacaggucagucugaccaacuuaaugagauccugucucaaaguaaaaaguaagcuauauucugaccauucaauaguuuuuaauuaaugaguauucauaccauguuuugaucaacuccuccaagauccccuaccacccugcccaccaaacuuuaucuacauuauaucuugucuuucugcucccuuacucccuuccucuuucuuucuuaaucaaaugaaaaucaucacaucaauaagaaaaaaacauaauaaaacaaaacagaaagucaccccccacccaccccaacccagaaacaaaacaaugauccuuuuguguggccagggcacagggccugucuaggagugugauugauacacccaaugucauuccauuguagaaaacugauuuuccacuucacagcaaguaucaauuguaaacacuucuuguuuaaugaugggacugcaucucuaguuccccaucucagugauaggacccuggcuggcguaucccuauguagggcuugugugugcuuccacagucuguaaguucaugugaguaucaauccuguugugucuggaaaacacuguuuccuuaggucaucuaacaccauuggcucugaacguauuucuuccuccucuuuuggauaguucccugaaccuugacagagggguuugaugaagacaucugucuuaggguuuccauugcugugaacagacaccaagaccaaggcaacucuuaucagggauaacauuuaauuagggcugccuuacagguuaagaggugcaguccauuaucagcaaggugggaagcaugacagcaugcaggcagacacugugcuagagaaggagcugagaguucuacaucuugaucugaaggcaggcaggcaggaggagacuggcaucuacaaguagcaaggagcauugagcauaggaccuuaaaguccacccccacagugacauacuucuaccaacaaggccauaccuccuaauagugcuauuucucaugggguaaucauauuccaaccaccacaauauccaauuaagacugaguacuccaaagucuccugcucugugcauuguccaauugugaggucuugugcugauucccaucuguugcaagaaguuucucugauguggacacuuugccccuucuuagaauugggaacaaaacacccauggaaggaguuacagagacacaguaguuuggagcugugacgaaagguggaccaucuagagacugccauaccuggagauccaucccaugaucagccuccaaaugccaacaccauugcauacacuagcaagauuuugcugaaaggacccugauauagguguuucuugugagacugugccggggccuagcaaacacagaaguggaugcucacaguuagcuauuggauggaucacagggcccccaauggaggagcuagagaaaguacccaaggagcuaaagggaucugcaacccuauagguggaacaacaauaugaacuaaccaguaccccuuggagcucgugucucuagcugcauauguagcagaagauggccuaguuggccaucaguggaaagagaggcccauugguugugcaaacuuuaucugucucaguacaggggaacgccagggccaagaagugggagugggugggugggugagugggugggugagcgggugcaggacuuuugggauagcauuggaaauguaaaugaaguaaauaccuaauaagaaaacaaacaaacaaaaauuuucucugacgaggaaugagcacagcacuugaaccuaugguuauuaccuuuuuuuuuuuguuuuugguuuuuuuucaagacaggguuucucuguguagcccuggcuauccuggaacucacuucguagaccaggcuggccucgaacucagaaauccaccugccucugccucccgagugcugggauuaaagaugugcgccaccacaccuggcugauuuuuuuuuuuuaagauuuauuuauuuauuauauguaaguacacuguagcugucuucagacacaccagaagagagagucagaucucguuacggaugguugugagccaccaugugguugcugggauuugaacucaggaccuuuggaagagcagucgggugcucuuacccacugagccaucuuaccagccccugguuauuaccuuuuaauuaauuaauuuguaguuuaauuuauccuuuuauugaaaauagauuuuuuucuuuauacauauagauugugguuucagcuucuccuagcucuuucaaccccccccccuucuauugauaucuaccccacuuuugucucuuacuagaaagcagacagguuucugugggacaauaaggaaauaaaauaggauaaaacaaaaacuaacccuggagugggacaagacaaacaaggaaacgagcccaaggaagguacaagagacagagcccccuuguuugcauucaggaacccccauguaacacuaaacugaaagcccuaguguauccacagugggccuggugcagaugcaugcagacccucaugcagccucagucucugaguucacaucaccuuuguucaccucgauuuggagggucuuguguucuucccguguuccaccccuccagcuuugcucucuuucugccucuucuccugcucucgaggggaaggauuugauggaugcauuguuuuuaggggcugagugauccaagaucucucauucuuuguacaguaucugccugugggcuuucauggguuuuuuuccaaaugcuguaguaggaaacuucucugaugaugguugagcaagccauugaucuaugaguauagguaaaucucuuuaggagucauuuauugcuauauuuuccuuuuuucuuauuuguguguguguguguguguguguguuuuaaggccaguauuauuugguuuuacccuagaucccugagcuaucuagucucagguucuuggucacucaaguaguguuggcuauggguuccagauuuugcagugggccuuaagucaaaucauuuauuuccuaguugauuauguccacaagcuuugugucaccauugccguagcauaucuugcaggcaggucaccauaauagaucagaggguuugcguuucaguugaugauaguauuucuccccuuggguugcaugaagaguaccuuucuucauauaccacuuagguguggcaggugccuauucuguguagacaccagcucaacaucuucauguucagugagcuauguaaguguugucuucgucaaugaggccuugcugucaauaugaagaaagugaccuauaguuuuggcaucagccugguuuguuugagugguggggguggggucuuaugggacuucuuuggcuaccaacucaauuagaugugucucauucucaauauuggaauuuucauuuggugacaagagauggcuaguuggggcuuugacucucccauuguuugacaguuuuauuuagaucuccaucauauaugcauauauuuuaggaagauuuuacugugcuagguuucuguaauacuccucaaaugucacuuaauuuuagcuguccccauauucccucccucaucuccuggucccuccccuucuuuacuccguccuccuauaccauucucccucucccuccauccuuccauaacuaucuauucuacuucccuuuccuaggagauauaucuguucccgcucuggaguccuuuacuguaugccugcccucuguggcucuauggauuguagcuugguuauuauuaaauuaauagccagcauccacacuuggucuggguuacuucacuuaggguaauaggucuuaguuucaucuguuuaccugugaauuuuauggcuuuuaaaaaaugacugaauguaaauuguaccauuguguaauaccauauuuucuuuauccauucaucugauguuuacacuuucuggcuguauggcuagaacagcacugaaaugauugaaaaagcaucucugugcuaggaugaaacauucuuugggugaaugcccaagaaugcuauagcugcgucuugagguagaucgauuuucauugauuucuguaguggcuguacaaguuugcacucccaucagcaauggaugaguguuccccuuguuccacauucucaccagcaagagcugucaauugguuuauugaucuaagccauucugacugcuguaaugugaaauaucgaaaguaguuuugauuugcauuuuccauaugacuaaggaugcuaaacauuuuuuuuaagcguuuucagccauuugaguuuacucugagaauucuguuuagaucuguacccuauuuuuaaaauugaguuauuuguuuuauugauaucuaauuuuuuggguucucuauuuauuuuggauauuagcucucuguugcauguguaguugguaaaaaaccuuuccccauucuguaagcugcugcuuuguucauauggccaugucuuuuucugugcagaaggcuuucaauuuugugagguuccauuuauuguugaucuuacugccugugcuaacacuguuggcagauagucuucaugugccaaugaguccaaggcuauucccaccauguugaaguuugugaugcauuuggaguugaguuuugugcagggugauagguauggguuuauuugcauucuucuaaauguagccagccaguuugacgggcaccauuuguugaagauacuaucucuuuuccaauguguauuucuggcgaguguguguguguguguguguuguuuuuuucuuucuuuuuuccacucaaagaaucagguguucuuaccuguguggauuuuuugccuggguugucaguucaguucccuugaugaaaggguaucugucuuugugucaguaccaugcuguuuuuaguacuauagcucuguaguaaaacuuauaaauuagggauggugauaguucuuuuaucauucaagauuguuuaagcuauccugggagauucacuuuguuuuguuuuucuauguuaagcugaaaauuguccuuucaagcuccuugaagaaguguuggaguuuugguggugaucauauugagucuggaaauuugcuuuuaauaggauggccauuuuuacuauguuaauccuacugauccaugagcauggaugaucuucccaucuucugauaucuucauuuucuuacuuccaugauuugauguuuuuaauuagacuggucuuugacuugugauaucccaugacuuuuucuauuuuuugaagcuuuugugaaaaguguugauucccugauuucuuucucaaacucuuugccauuuguauauaggaaggcuacugauuuuugugaguuaauuuuguauucagcuauuuugcuaaaaguguuuguuuaaaugguggauuaccuuuauugauuuacauauguugaacuauccuugagugucugggaagacgacuugaucguggugggugauguuuuuguguacucuuggauuugauuugcagguauuuuacaaguugacuaaaaaauaaaaugcuacagaaauuaaguauuaacuguuaaaguuucuguuagcuuuuuaaauuaaauaugguguauuugagugauggggaaaccaucuaacuucuugaauguaaagauaaauuagagacuguugcuaugcauucauguuaaguucaugguggggugaucaaguugugaacuccuggacuauuugcugugauguuggacuggaaauacauguucccuuuaccacauucuaagguagcaguugaucccuacuugucaucucauuaagucugcaugucacuuuauuguaaggaauaccucaugggccuuccauuagagcugaggguguuuauaggccauuugguuuuagugggugaaauagucuaacauccuguuauuagggguuucugauuuauuugagaaguccuuuaagcuaaucauaacacucaccacucuuucaguuuuaagagauuuucucuagugucuagcagcuuggcaguauuugaaagagaauauuguuuuuguuuuguuauuggacagugagcauaauggguggugauauacccuuuucuucccaauaguaagcugugacuuuuagugguuucauagaaauguaauuuagaauaaguuuuuuaguagccaagaaaaaguugagaaaguuagcuuaacaauuuuuuuugucaugggauauuauuuaguugagaagaacaggauuugaaagugcuaugaaauacaugaacuuaaguuagcuuuccugucacauuuugauuucacuucagaauaucuugagauuuuaaaauaguuucccaguaagcuugggguuauauaugugucauacaaauacagcacgcacacucacacacacacacacacacacacacaccuuagaguauaaauuaagguuguuugugaaucauaugacauuauguuauauuacucuugcuguguguagaaauauaauuuugugcucaugaucacuuaguuuaugaaacgaaacaauuauguugguacugucaagaaaccuguuuaauauauuucuucuuguuauugauuuauuuuuauuuuauguguauggauaacuggucugcaucuaugucuguguaucucacacaugccugguacccaaggaauccagaaaaaggucuuggauucccuggcacuggagguggagauauuugugagucaucacgcaggugcuaggaaucgaaccugagccuugaaguacucuuaguauuaccaagccacacacccacagcgcaucuuccucagugccaguugauauauauguuuuguaucuaauauauuuuguuauccauaaauauugcaaguaccauaauuaugacaugcaauaguuuauuuaauguuucuaugcucauaaucaagccuggagcucuggcaccuacuagacagauggugauaacagagccuuaccuccagccccaguauuuuccuucugauucucaucuuacucuuuuugugccuguggcuaguuauuauagguacgagugcucccuucugugacuaacaaaugacgucucagggagguaauucccuugguaaagucuuauccaguuuggaauuugacuuuauugaauauaugucuaagaaaauaagauaauacaaacgaggaaaaacaaaacuaaacaacaaaaaagaaagaaaaacuccaaaugauuaucuuuuucuccaguuucucuuaauucuuuccuauaauacuucauuucaaucuguaguuuuucaguauuuuugucaugauuauuugucuuccauuucaugcauggagaugcaaccccuguucuguuuggaaguuuacuucugaaguaguuugcuggcguacagagaguaaaaaacgaaccguacaggugauuuaaugcuguggucaugaaggagaacccucggacugggacuugaauccgagggcguuuucagugaugaucucauggucauccacgggcucuugccuaagcagcagcuguucuaaccacgagggcugacuauugaaaaacccucuucuagguugagaggcguguucauuucagcuucaucaaagguaaacuuaauuucauuaaaaagaggauacucuuguuuccugaauaccuugagucauuuauugagucagggaaggaggcuuuuguucaguguaguugugauuaauuuuucuuucuugcucaauauauaaaggggaaaaauagggaugaauugguuggaaagucagugaguaaaauucucagaauuacagaaagcugaaauaaagggaaagaagggaugugguggagguguuguuauuaaauaauagauaggugaagauuuuccuggcagagcagguuauuugcacaguuucuaagguugcaaauauggcuguuuaguaucuuuccaugagugaagacuacacaguuguuauuuuuaaauuauuuuaggucuuccuuaagugcuugguccaauuuacaguaucuguaauuauucaguauucaaaaguaagauuauauauucacugaaaggaggacagcuaauucuuaauaggaauauuuuaaguaguauauaaugugaagugacauuuaaccuguacucccuuucaaauucacuaaaugggcaugauuauuuuugugcucuuuguuuuucuuuaauaucucauuucuuauuagauauuuuauuuaucuacauuucagauguuaucuccuuucccaguuuccccucuggaaaugcccuauccccuucucccuuucccugcuucugugagagugcugucucaccuacucccacccccacccccaccuccaccccccacccccugcccucucauuccccuacacuggggcauugagccuuccaaggaccaagggccucuccucccauugauguuggagaaggccauccucuccuacauguguggcuggagccaugggaacucuuugauuggugguuuagucccugggaucucuuccagggggagggcucugguuguuugauauugcugaucuuccuauggguugcaaaccccuucagcuccuucaguccuuucucuaacucuucuauuggggaaccgugcucagucaaaugguuggcugggagcaucugucucuguauuugucaggcgcugucagagccucucaggagacagcuauaucaugcuccugucagcaagcacuucuuggcauccacaauagugucuggguuuggugucuguauuugggauagauuccccaaaugagggagucucuaucaaaugagggagucucuagauggccuuuccuucuggcucugcucuacuuugucuccguauuuccuccaccccugcuucuaagaaggauugaaccaucuacacuuuggucuugcuucuucuugagcuucauguggucugugaauuguauuuuggguauuucgagcuuuugggcuaauauccacuuaauagugagugcauaccacguguguucuuuugugacuggguugcuucauucaggauauuuucuaguuuuauccauuugccuaagaauuucaugaagucauugucuuuaauagcugaguaguauucuauugucucuauuguguaaauguaccacauuuucuguauccauuccucuguuuaaggacaucuggguucuuuccaacuucuagcuauuauaaauaaggcugcugugaauauaguggagcauguguucauauuacauguuggagaaucuuuugaguauaugcccaggagugguauugcuggguccucagguaauacgauguccaauuuucugauuuccacagugguugaaccagcuugcaauccuuaccaacaaugguggaguguuccucuuucuccauaucauuugcagcaucuguugucaccugaguuuuugaucuuagccauucugacuggugugagguggaaccucaggguuguuuugauuugcauuuccugaugacuaaggauggugaccauuucuuuaggugcuucucagccauucaguauucaucaguugaagaagcuuugcaauuuugugagguucauuugucuauuuuugaucuuaauagcauaagccauugguguucugcucaggaacuuuucccucugccuauguguuggaggcucuuuccccacuuucucuucuauuaguuuaaguguaucugguuuuacguggagguccuugauccaccugaacuugagcuuuguacaaggagguaagaauggaucgauuuguauucuucuacaugcugaccuccuguugaaccagcaccauuuacugucuuuuuuccacuggaugguuuuagcuccuuuguaaaagaucaagugaucauagguguguggguucauuucugggucuucaauucuauuccauugaucuaccugucugucacuguaccaauacugugcaguuuuuaucacuauugcucuguaguacagcuugagcucagggauggugacuccccuagaaguacuuuuauuguugagaauacuuuuccacuauccugaguuuuuguuauuccaaaugaauuuguaaauuucuccuuccaacucaaugaggaauugauuuggaguuuugauggagauugcauugaaucuguagauugcuuuugauaagauggcccuuuuuacuauauuacuucugccaauccaugagcaugggagaucuuuccaucuucugagaucuucuuugauuucuuucuucagagucuugaaguucuugucauacagaucuuucacuugcuggguuagagcuacaccaagguauuuuauauuauuugugaccauugugaaggauguuguuucuaauuucuuucucaacccauuuauccuuugaguagaggaaggcuacugauuuuuuuuugaguuaauuuuauauccagccacuaugcugaaguuguuuaucagguuuaggauuucucuggugaaauguuuggggucacuuaaguacacuauuuuaucaucugcaaccuugucuagacccugaguuuagugggauugcuauagcuguccagaagccauggagaaacuggguuaucagaaaggggggcuggaagugaaaaaggacugggugcuagagaaggguaaaaccaagacaaagguucugaucaaggcucgaaguuuaauacucagcacuguguuuauauagggagagcccacagaccuauccuuuguuucagcuggacuauguuguaaagcuaggucuauuuuucaaagcucauguaggaaacugcaaaugcaggaaggucugaugacuccaccuaggaguaaaacccauuguggcaaucccucaagguuuguuuauccugcucaaaugggggaggggguguguaaacauuuuuuuaaguuuuucuccauuuaguuugauguuggcuacugguuagcuguauuuugcuuuuacuauguuuaggugugggccuuaauuuccugaucuuuccaagacuuuuaucauguaguugaauuuugucacaugcuuucucagcaucuaaugaaaugaucauauggcuuuuuuccuuugacuuuguuuacauacuggauuacauugauggauuuucguauauugaaccaucccugccugcaucccuggggaaugguuuuuguguggcuuagguauaaguauaauuguggcuucauagaacgaauuaaauaguguuccuucuguuucuauuuuguggaauaguuuaaagaauauugguauuaggccuucuuugaagauuugacagaauucugcuguaaacccaucugguccugggcuuucuuuuuugguuuggagaccuuuaaugacugauucuauuuuuuuaagggguuauuagacuguuuagaugguuuaucugauccugauuuaacuuugguaccuguuguauaucuagaaaauuguucauuucauccacauuuuccaguuuuagugaguaugggcuuuuguaguaggaucugaugauuuuuuugauuuccuccauuucuguuguugugucucccuuuucauuucugauuuucucaauuugaauacugugccuucugguuagucugacuaaggguuuaucuaucuugucucaaagaaccagcuccugguuugguugauucuuuguauaguucuuucuguuucuacuugguugauuucagcccugaguuugauuauuuccugcaguccuuuuggguguguuugcuucuuuuuguuauagagcuuuuagucgugcugucaagcugcuaguuuauguucucuccaguuucuuuuuuguggcacguagagcuaugaguuuuccucuuagcacugcuuucacuuugucccuugaguuuggguauguuaugccuucaucugcauuaaauucucaaaagccucuaauuucucuauuuuuuccuugaccaaguuaucauugaguagggcuuguucagcuuccauguguuugugggcuuucuguuguuuuuguuguuauugaagaccagacuuaguccauggcgaucugaucagauacaugggauuauuucaaucuucuuguaucuguugaggccuguuuugugaucaauuauauggucagauguggagaagguaccaugaggugcugagaagaaguuauauucuucuguuuuaggugauauguucuauagagaucuguuauauccacuuggcccauaacuugugucucaguuuaguuucuguuuccaugaaauguccauugcugagagugggcuguugaagucccccacuauuauugugugaggugcagugugugcuuuuaacuuuaguuacauuucuuuuaugaauguggaugcccuugcauuuggaacauagauguucagaauuuagaguucaucuugguagauuuuuucuuugaugaguauaaaguguccuuccuuaucuuuuuugauaacuuuugguugaaaguagauuuuauuugauauuagaauggcuacuacagccuuuuucuuggagcauuugcuuggaaauuuuuuuucuagcauuuuccucugaguuagugccugucuuugucacugagguguguuuccuguaugcagcaaaaugcugggucuuguuuauauauccauucuguuagucuaugucuuuuuauuggggaaucaaauccauugauguuaagagauacuaaggaaaagugauuguugcuuccagguauuuuuguugcuagagguggcauuauguuuguguagguaucuucuuuuggguuuauugaauacuuucuugcuuuuucuaguguuuaguuuuucucccuguguuggcguuuuccaucuauuauccuuuguagggcuggauuugugaagagauguuauguuuucauggauaucuugguuucuccauuuauauuaauuuaggguuuugcuggguauaguagcuugggcuggcauuuguguucucuuacugucugucugacaucaggcuaggaucuucucacuuuuagagucuccguugagaagucugguauaauucugguaggucugccuuuauauguuacuugacccuuuccccuuacugcuuuuaguuuucuuucuuuguuuuuugcauuuggcauuuugaauacuaugugacgggaugaauuucuuuucuggucaagucuauuugguguucguuaggcuucuuguauguucauuggcaucucuuuagguuagggacguuuucuauaauuuuuguugaagauauuuacugaccauuuaaguugggaaucuucauucucuccuauaccaguauccuuauguuuggucuucucauuguauucugaauuucuuggauguuuuggguuagaagcuuuuugcauuuugcauuuucuuugacuguugugucaauguuuucuuugguaucuuuuccacuaagauucuucucucuucuaucuuuugcauucuuuuggugaugcuugcaucuaugacuccugauuucuuuccuagguuuucuaucuugaguuuucuccauuuguaauuuuuuuuaauugguucuauuuccauuuuuauauccugggugguuuucuuaaauuccuucauguguuuaguuguguuuuccugugauuuuuaaagcaauuuuuguguuuccuuuuuaagagcuuuuacuuguuuaccuguguuccccuguauuucuuuaagggaguuauuuauguucuucuuaaaguccucuaucaucaucaggagaugugauuuuuaaaucacaaucuugcuguucccacaugcugugauaucauccaggacuugcuauggugggaaaucuguguuaugaugaugccaaguagccuugguuucuguugcuuagguucuuuggcuugccucucaccaugugguguuauuugguauugcugucucugauuuuagcuuguucuuccugugugccugugagccugugagccugugagccugugaucuuagguaugucaucacuccugaggagaccagcucuccccugggugggauuugggucuggagggcuacccugagcgucagugcguagauggagauugcaaagaucuuuaucgaggcugcuccacuguuccugugccugguguuuuccuggcaugucccucuuuggacaguuauuggagugaaugugaugaucucaccuaugaucuuaggagugagagcgcuccucagagaccaacucucuccgggugggguucgugugcagaggguugugggacauacuuagcuccggguacagauggagacccuuuuguacucuuuguaaaguaauuacuauaggucauuuacauuuuaucucugauacuuggucugugaugaugugguuuaaacaauaaaaucuaauggauaauuacuucagagaagacaucucccucuucucagaggggauauucaauauucagaaguaagguucauuuuuguccagcucucuauuuaccuguuaacuuagcccuugaguaguggaugcgggagaaucuggagcucaaaguugucuuggcuauguguguaguuugacgcuaucuuaggcuagcucaccagcaguaagaaugauuugcuaagaucuaaguauagguacagaguaguacagugcaugcuugagguccuggcuuuauucuggcacugggggcaggggguagggagggacccacaguauccuugucugguuuuuuguuuuuuaaguuggacacuuauuuuaaaauuuuauugcuucguuuuucuuauuguguguuuaucugcacgugugugcaugugucuaugccugaugccaagguauguguguagaaaucagaagacaacguucuaaguccauuuucucccucuuaugugcccuaugcggaaagaauguauguugucaggcucggaagcaaaugccuuaauucacugagccaucucacuguccugccaggucuuuaguuagauaauuuagucauuuuauuccuuguuuuaaaaauuacugguuuuuggugcuagagagaugauucaucaguuaaaagcacuugaucuucuagaagauucagguucaauuccuagcacccacauggcagcuucacagucaucuguaacuccaugcccaggggaccugaugaccucugcuggcuucauugggcacuggacacacaugauacacagcuaugaaugcagauaaaacacccacacaguaaaauaacaauaauaagauaauucuaaaaauuauuagagaugaauuuuguauacaaguauauuuuaauauauacacaucuauauuauaccccacuuuuuacucucauauuauaaguuauauaaaaaaaaaagcaggaaugcuuuuuaagaagcacugugcacuaaacaguuuucucagauuuuuagcaauuuucaggcuuuuaaauaaaaaauacuugugacugaaaacuauugacaucaugauaauaaauguuagggcauuauaaaaggcaauaagugcuuuaaaagaacuuguuugaaaaaugaacaaucgcuuaaaauuuuuuguuagauuuuauuuucuuuauaaauuauaggaauaauauacauacuuuuuauaauacauuuauauuuuuuaaauauuuguauauuuucauuaucuuuaagcuugggaagauaaaaauguuuagaaucauuuucuuaugcuauacaucuguaagugagguuuuaguuuugccuuuuuuucuuuaaaaaauaauguacuuuaagaauguuguuuuaaaaggcuauuucuuuucuuuuuagccuuuggaauugcuuuggcacucauuggaugaaugguuaguuuuaauagccacagaauuaaugaaaaacaaagaggauucaacagauauuacuucuaucuugcugaaacaaaaaggccaggaucaagaggccccuucucuuucugcauuugagccaccaggcccugggagcuaugaaagccugcccccugguccaggggacuccaagccagaggugcuugcaggggagcaggaagccagugccgacugucaagacgucaucucugugacagccaaccggcugagugcugucauucaagccuucuacaugugcuguuccugucagaugccuccaggguaagauagucccacuuagucugauuugucuuuggugagugaagaaaagcuucaauuuguaauuucaggaaagacaaauauaauuuuuuuaaaaguuuuucuaaaagguccuauucacauuugucuuaggauacucauuguacuaauaaaaaucugguaaaaauauuuacauuuuguaaaaguauauauauuuauuuuuauguaaauuggugaaugcuacuucauaaagaacugcauuaaauuuuacaauuuuaauagucacuuguuuauauaucauuuguuaauaacaaguuacauguaauauuucauuguacagacuccuaaguugauaagaaggauguauauguaaguucuuccuuccugucuagaagccaguucuacuuaauuuacuggauuugcauacuauaucuccaacuuuguauauucugauugcuuuuucccucccccucagaaugacuucaccucguuucauugaguuugucugcaagcaugaugaaguauugaaaugcuuugugaauagguaaggcuuuauggguaagggauaugguaaggcuuggacuaucuuggcagccuuuuuucuauuuauacauuuucacuuaaacagauaaaacuaauucuguacuauucaaaauaguaauuugucauuaacaaaaguauagcagguagagauuaauauguuuuucuuguacuucagcauuauguaucugaauuugcauuuuacucagugauaauuauuguuuguuuuauuuuucuauuagaaaccccaaaauuauauuugaccauuuucacuuucuucuugaauguccugaauugaugucaagauucaugcauaucauaaaagcacagguauagacuuuauucaucuuuacuguuaauacagggaaaugaaauauuuuuuaaauuauuuaauuuuuuguaauuuuuaaaaauuuaaaauuuugucauuuagaaaauacuauuuuauuauguuugugggcauggguauuuugucguguaccaugugcauggcuggugucucuauaguccagaagaggcaucagauccccuaaacuggagcuauagacugccacguuggugcugggaacccugcuccucuuaaccucugagccauuucuccagaccuucgaaaugaauuuuuagauuuugaguuuuguuugguaauuuuacuuuaaaauuacugcauuaaagauguaacuccaugguaguuuaguaugagaagugaauugucuucuucgaggaauguguauugaguaccuacuguauacaaaggcauguacagagcuaacagaauacauugccacacuuuuaaauuaguuuaauuaguuuuguaagaucuuugaggaaaggauuuucuccccaaauauacuuaggaaauaacaccuaugccauuuagaaauuuauaaaacacaucagcaauauguuaaaggacucuuaaauccuuuugcaaaaguagcgauuuaacaugacaguucuccaaagugugcuugauuuggcagccuuuuuucuacuagguguugucuguguuucaugaaauaugugaaguacuuucauuaagaucacuuuuuugcaaauguuuacugaaaaguuagcacaugaaugauugugauuuaaauacugauagcauuuuacugucguuuuuugggguagccauuuaaagaucgaugugagugguucuaugaacaucugcacucaggacagccggacucagacaugguccacagaccagugagugagaacgauauccuccugguucacagagguacgugugugucacagagacacugauagguggauaagccgcaaaguguuguuguuuuaagucauacuauauuacaauuaaccaguacuacauauuuagauucuauuuuuaggaguagcugugaaauuguaucaaaagcaaacugugcaaagcuaaagcaggggauugcuguacgauuucauggagaagaaggcaugguggguauaaacuauaacucacuuuaaaaguugaaugcuuaccugagaguaucacuuaaauuuuguuauuauuuaaaauaaaaagacuaaauaucguuuauuucuauuguugcuaaauuugguuuucuucaauucagggucaaggcguugugcgugaaugguuugauauucugucuaaugagaucgucaacccugacuaugcacuguucacccagucagcagacggugagugugucggcuggagcuugucuguggcugucagaguccucaaacuguagcagagaauuugaucuuuguuucuuugaauagcccugaugucuagguggguguucccuugucacaggagaaaacugaagucagagugugguacucauucacauagcuuucuucugaucauucgguuuucaaaugcuugucucagggccucaaaaguucucuugagaaccuuaauaucuauucacuuucaggauuguuuguuucugucuuugacugcccuccuguacuauuauuuuucuuuaacauuuucuuuuauaaaaugguaguagauggacuuuaaauacaucuuuauuuggaaacagaauuuugcuaacccuauuugcauuucuguuguaaaaucaugaaaaucaaagucuaucaugaaaaucaaagucuaucaauugugauguccuucuuacuggcuuuauuuuuaguccuuuuaggagaucagacucggggaacugagaagcuuguacauagcccugaaagcugauggacccuuguggaaaugguucuuacagacuauauaaagauaggauuugauauuguaaacuaaauacuagugguuacaacucauuuugggagguguuuuugagaauuaucuaacuuaauaacacauauuugaagugaagguggggcugaaaaauacuauuuccccaguguuugaaagaagagauuaucuuucuaauuacaacuguugacggcugcaacuaaugagcagcacaugccuguguaaggagggugaagggaggcacgaguggggaggcacaggcugugggugugcaacugugcgcagugucucuggcacaccugcaguaauuaaaguuacucggggaugugggacugccugguucaaccuuugaucauuuucugugaggcaaauuugguguuugugauuuuuaugacaagcuuaauaaaauaccaagcuuaauuacauagacauaauuuuuuaaagcuagauccaguguauuuuagucuucuuuucuuuauaguuccuuauucugagucaguuuaguugcauauguggaguccuuagguguacuuccuaauggugagggugacagcuguguguggacucacacacuaagguuuugauuuguuauuucuguaguugaugugaguuuucuuggcgguggcggggcagggggucaucauaguauuaguaacuuaaaacucagggaaauaguccccguuguaggcuugauuguccugaagggauuaaauucaggauuuaagaauucaugauguggggaauguuagauaaacccaauauuuuauaguauugcaagauuauuuucuugucagauuaagaucaauauacaauguaguuuagugguuaagaguuuggcuuuugcagugauggcaggugugaauccuggcucuggacuuuccuuucugugaauauugggacaggaacuuaaccuuuuugagcuucagauuucucauuuaauaaugaugauaaucugugauuuagaauaagaauuucguuaguugauacaugaacacagcgcagccccuggcacauggaaaaugugaaguaaauuuuagauguucuuacuuuuauuuucagaauauuuuccaauguaguaggguuucccuccugaaaugauguucacuauuucuugaaaacauuuuuaauaaacauauuuuacuugaaaaauaaccaguuuuuaaauuuuuuacauuguuaaaaauuauuaauuauguuuauguauguggguauauucaugcgaguggagaugauuauggaggacaaaggcacucccuggaagcuggaguuagcagacaugagugcuggaaacugaacucugaucagcuggcaaagcaggaaguucaccuuaccacugcacaucgcuccagacccaguuaaaugguuuuuaauacuagaacuuaagcuagcuggguccacauacauuuuuauuguucuaaguaguuuuugaauaaaauuacuuugcugaagaauuuugccuaugugcuaguuuuaauuuuuuuaaaucuauucuuuuuaagaaccagcauucucaggaacucaguagauaguggaggaauauacagaacugggagaagaaaguagagucaccaaaaucuuugcugguucaucuauaguccaaguauuaucacauacguagguaaaaguauggcuauacucauacuaucuuuuggaguuaugguuauguuugucuuugaagucuuuuuuggcugucaacaucuccucuugccuugcgauaggaaaucauuacgagaggcaauuuagagugacugguguguuucacaugucuauucaucauucagucacaaacaaguuuccaaaucuguuccuucgaaccuaaguaaacagcaguuuaauccagccuugcacuagcaaaucaaaagccuaugaaacagcaaguauucaaggugucuagacacucauuuucuaauaccugcccaguuuucuuuggugcuguuucauuaauuuuaucaguuugucuuuguuuaagccuuguuuuucaaauaguaguguaaagcacaaacucaauguauauucugcucuaugaacaaaugaauuuguaauucacgucaauggccagaaaaaguauugaaggggaguuaaagucaagguguggcuuuagauuucacuauuuugcuaggucuuuuggaaguuagugugucauuuugucuuucuccuccuccuccucuucuucuuugguaaaauauaaaauucaccacugaagacauuugaaaguagaucguuuguuagcauuaaguccuuuugcuaugcucugcagucaucaccaagucuaauucuggggcugucccaccagccugaggagaaacucuguaccuuagauucagcuuccucuaccacuaauuuauugcgccucuauucuaaauuugucuauuccauauaguucauaaagauggacuguaucacgcuacuacauagguuugagugaucauaugguugcuguugucacuuucacaucauugguaguuguuuaaacuugauuauuugccuuuugagaguaggaugaguuaggugggcagaguucccagucauuaauugguauuaauaggcaucacauucaguaaucaaauuacuuaagaaugguucuuuucauaguuuguguaucuuaauaugcaacaucuagugaguacugggcauguacagaugaaugaagcagugucugucagauuuauagcugaguaguuacugccacaguuccuagaaaaauguuugcauauguguaugaucuuuuauuguguuuaccagggacucuuuggugucagucagaaguauuuuaugacuuccucucaagugugaacugaugaucaucuuuuauacuuccaauucuacugucuuucuguagauuaugcaaagaacugcaugcuguagucugcauaauguaaccauagccaugcugagugaguuacaugugaauaaaguuaccugcauuggaauguucuuuucugcauauagaucuuacuguccucuauuuauuucaauaggaacaacuuuccagcccaacagcaacuccuaugucaauccugaucacuugaacuauuuccgguuugcuggacagaucuugggguuagcuuugaaccacaggcagcuggucaauauuuacuucacacgaucauucuacaagcacauucucgguauggauguacccucacuucugaagacauuuacauugcuuuccuugcagcuuuuagagagaauggauuggauaagugccaguuuugccauuucuguugaaauaauuacugcucugauaagagaccaucuguguuccuaaaguaucugggggcuagagggagagaaaaaugcucuaccuuuuuuuaaaaucacuuuuuuuuuuuugcauuuccauuuuaguguguauguguuuauacaaagcauccauuuuuuuaugcauauaccuaaaguaauuggcaauucugaagcuuauaacagcuuccuaaauagcuguuucaaagaaagacagcauuguaaagaugaagaaggaacagcagcuuaauuuaauggacuucuaaauuuagaaauuagcauccauuuuaaacaugcugcaaauuugauuauauuuugugguuuuucagaguaucuguagagggcagcauuucaccauuaaaucaguaaagggaagucagaagugccuauauuguaacugcugucuuuucaauuuucuuuuuagguauuccuguaaauuaccaagauguagcaucuauugauccugaauaugccaaaaauuugcaauggauuuuagauaaugauauuagugacuugggucuagaauugacuuuuucuguugagacugauguauuuggagcuauggaagaggugccuuuaaagccuggggguggaaguauucuugugacacaaaauaacaaaguaaguauccagauuuuugccuuagucauucuucauaauggcccugaugccaguuucucuaaauuauuccagcauuugcuagaaaaacuuacuuugucauuugcaaguagaugaaaguacuuaaguuaagcaaacuagcauauuuaagacuugaguuagaaagaaucauuuuaguuuaguacuaugauguguugguuauuuacauaauuuagacuacuguuuagcugauuguauuaguuaagcauuugcauuuugaaaaaguugauuggaaauguauacuaagugaugguguuaucaucacuuaguuacucaguauuguauaguuuaaaaguuagauauucaccagaaacuuaggauacccaagauauaaguuaccauuugcaaaacacaugaaacucaagaagaaugaagaccaaaguguggacacuuugccccuucuuagaauugggaacaaaacacccaugaaaggaguuacagagacaaauuuuggagcugagacgaaaggauggaccaucuagagacugccauauccagggauccaucccauaauuagccuccaaacgcugacaccauuguauacacuagcaagcguuugcugaaaggacccagauauagcugucucuugugagacuaggccggggccuagcaaacacagaaguggaugcucacagucagcuauuggauggaucacgggcccccccaauggaggagcuagagaaauuacccaaggagcuaaagggaucugcaacccuauagguggaacaacauuaugaacuaaccaguaccccggagcucuugucucuagcugcauauguaucaaaagauagccuagccggccaucacuggaaagagaggcccauuggacuugcaaacuuuauaugccccaguacaggggaacgcuagagccaaaaagugggaguggguggauaggggaguaggggggaggguaugggggacuuuugggauagcauuggaaauguaaaugaggaaaauaccuaauuaaaaaaaaguuauucaaaauuuuuuuauuuguauguaugugauaucugcauguaugugaguaggcgugucuccaguguggaugcacauggaagccagguauuggcaauggguuauuuuucucaguuguuucuugaccuuuauggguaggggcauuuuagcaguauuuauugacacuuaguguaacuacauacuuuagugugacaguugucuuagaaacuuauccucuggggacacguguauaggugcagguguauguaaaaguucuccacagaaguggguguggucugagaagcagguuacauacugcaguugcugugugacaugcuuucuagaauaccuugcuaagugagagagugaguggccagggaaugugugaaguaagugcaaagcucuguggaggggcauuuacucacucauauuuacagacaccuacagacaggcccgcagugacacaggggagaucuucaacgagauccuuccugugucucuugagucauugacucaauccugguuuugcuuguucugccuuauuuuuccaugagaggcaggcaguaucucucaugaacaucauuuuguucuacacugccuggccagugauucccggggagucaucuaugugugucaccucaaaggcugggguuacagaggcacaccucuguucuugcccuucacguggguuccagagaucugaagcugauguaucaaacacguuacucccugaaucagcuucuccgcaccagguuagagagucuuaacacagaaaagaaaucucaguguuaaaacuuuguaugugcuuuuauguuccaguaaauccuaccucuugauuuccuauguauauaauacacacauauaugauuuguuuuuauuauuauguuauauauuugugguauuuguuuuaaaguugacuuaaaaaucaaugacauuuaauauuuuacauugcuguacauauuaaaaauguuacagacuauagauuuauuaaaauguguaauauuuguaaaaggcucaaagacauggucacauuuuuaaaaaguaccuuuauucuucgagaauuucauguggcauauuuugaucauauuuucucacucuauuccuuccagauccucagguuuuugcccccucuuguuuuuuaaauaguucacugagaucaauuuugccaucuauuuaguccuuuacuucaggguguagggccaucuaguggagugcggcccacccaucaggagccguauccuuacagaagacugauugcucccaccucacucccagcccccaaagccaucaagcuacaauagcuccucaguugggugguggcucauaagcccauuuucaucuguauuagaacauugguuggcuuggucuuauauaggucuucugcaggcagauacaacugcugugaauucaugaguauagugguccugucauauccuuaggaaauggguucgauuugauuauaccugcccuauggcucuuacaaucuuucugccuccugugauucugcaccuuaggaaggggugugauguagaugucccauuuuauggcugagcacuccacuuccacuagcugagcaccuucaccauuaugaaguuccauguuaaacaccagccccugaacaaagacuucucugaugaggcgucagagcugcacuagucuauggguagagagugauguggaaguuagagggaaguuugauacuguacccauuucgcaaaauaauguaauagguucauucguggggccugugagcuccccagugauggacucugccagauuuacagaaaccaggcguguguuuccuucuguggaguggacauuaauugcaagcagaaacugguugguugcccccaugacaucuguccuaguauugcaccugugagcagaucuugucaugcugguauuauuacaguuugcagcaagguucacaguugagaaacacugaaugacucuuaucccccaggaacaccuucuacuuagcaccuucuaguuuuguaaaagcuaaccagcaagagggagucagcauaaacuugauuucgcuguguccugugaucaauguguauagcaucuucagcucgggccuuagguaaaaccaagagcaauuaccauagccuguauugaaaacacaucucaagggcauauuugaccauaacuugaagggaaguauccaguuccuugcauugaacucuuuauuugucaauuauggccacauuuuaaaacucauugucuucaggauucuacgauagagaauuguuauuaacguuuuugcuaagugaaaaucauucaaaaugauuuuggaggggauuguagucuaaaaaguauguccuuaguuucacauaauuaugaauugaaaacuuuaagcuuuauguauuuuacuuacauagaaagaucauguucaguuauagguaauagaauggggagcugagguuguacuuauuuuuaucuuccauguggauuuauauacaagacauggaugccuaaagaaugaauggugaucagagugugaugccaugaacaugguggcugcagucggccaacucugggacauggugggcgauuggguaacucuggucagugccgggugagagaagcagcuguuucaguagugcucguacccacaauucaaggcagcuggccauuagggcaagugaaugccguagccauggcuuaccucuccgggauauggagcccacagaccccagccccaccagggcuuucaucauguaugugcugcuggcugggaugacucuggacauucagaaaagguucugauguggcugucaagggagguguggcccugcuucugggccuguaccuggccacuguaggcagugaacugaguaccuuccaccucuugaccuacagugguaacaggugggugggggugauccucagugugcucccagggcugcucuucagccuugaugccuauucuguggcccuggccuggacaccacccgugcuauguacuucauugugcauucguugcugacuacagccuuggacccugauagugugggaugggggcaguccucagcaacaucuucccuucucccugaccccagaacagccacuuuccagccccucaucauauacuggcugaccucccauuuggucuggugacccuggucacugacccgggcggcacugauuuuuccauauauugacgauuugguuuccuugguggguggguagguggggaaugaauggcaaacugguaccaaagucuaagccuccuaaguucugguucaguggccaucauccugugugcaacaggaaugauauugaagaagaacuuuaauuuuuaaaaauauaaugacucaaguccuguuaaucuauaagucaaauuaguaaagacaugaaaauaauaaacuacuuguauuuuuaaaucuauaugagcuuaaugauuuaaaaaauuaaauuuaccauuauuauugcuuaugugauguguguguaggaauguguaccuuccauggugcgucuguggaggucagaggacagcuuugcagaguugguucucuccuuacgcucugugugguucucagggaugucugguuugugcugcaagugccuuugcccucugagcccucugaauuguaggcuuguccaccucgcaucacguuacugcuuuaguucauacugaaggccuacacucaguaggacugaagcagagucuuugcuaaacgggugaggacauuucaacagaaccugcaggcauuaaccauagcucuuaaauacggacacugcaccugcugaguagguccaccgcuccuuucagauacauguaaugugacaaaguagacagauccuuucaugcagcucuaugcucuucagcucugggaaugugagcaucuucuaguagccccuuccacucauacaugaguuuuauuuagaguuccaaaauauuuauuuuauuauuuugcauuuaugucuuuugaucaaagugauacauuaaaugauaauauguucauguugagggggccauucauugggaaugugaaucuuauccaagguuggaauacugugguaauaaggaccucaaaacaauuuaacuaguuauuugguugcuuacagaauuuuggcaaaaugguaccaaagucuaagccuuugugauuaggauugggaaucgcuguuaauaacauagaucaaucauuaguauuaguauaaucuuuuuuuuuuuuuugagauagugucuuuucuuuuuuguugcugugaagagauuccauggucaaggcaauuuauuaaagaaagcauuuuaauugauggcuugcuuuuaauuucagaggguuagagucugugcaucauugcagggugauggcaucaggcagaaagcagguacaagaguaguaacuuagagcuugcagugugaugugcaguuggugugugugucugucuuugugugugccucugugugucugugucugucugucugucugucuguacuggggauagcuugggcuuuuggaacucaaggccuaucccugguaacauacuuccuccaacaggccauaccucuuaauuuguccuaaauaguuuuagcaacugcagacuaaacauuaaaauauaagagccuacgaggccaauucucauucaaaucaauuuucuggcguauaauaggcuagucuucaacuaaccgugauaguccugccuucccuuuuuucuguguuagcauuacaggugugugaugucacacuuggcugauauguaaaaucuuuaagguauaacacuucuuaaaggagucauuugccuuaaaauugauacuagcauucacaaagcaaagauuggaggcucaugaccuccaacuggaguguuagugugcagcaguaguggguguuugaaguaauaguugucaagaaauguugauuuuuacuauuuauucuguuugaaguuuuacuucuuauaaagagauaaggaaacauuucaaaacaguuuggaguuuuucuauuaaugcaguuucugucaaagcaauucaaaguuuguaaugcuagaauuuuauuauucuacugaaaaauaauugauacucaaauacuuuugacauuagugugaaaauuggcauaugaaggagcugauauuuacaaauuagcaucugguaauuauggucuggauacugaaauuaauguggaaaaucauaguagaaggaaaagaagaaacugugaggaaagaaugguauaacuacgagaaccaaguuaaacacugaauguguggggauagugcucuccugauauaucuggaauccagcuaaguaggcagaguccaauugagcagugcagaauaguuucaugucucccauuaagauuuuucuuguguacauguguauguauguauggauauugucuauguacaugcauaguguaggguaugugugcaugggagccuuagucccuggagacagcaucucuuacugaacaggagcuggcccuagugauccuuuuugguuacagggccagcuuuucauuagugugcugggaucagguccucauauuugcacagcaaacccuguuacccacugagcuacuacuuccauagcgugaaugcuuucuaauuugauaugguuucaaacaguaguuaucaaauaacacuuuuaagauaacaaaaucaaaaccuuaacaagaaaguaauucuugcuuaggagcgauaggauguuauauagcaucuuaagcauguuuuccucuuuuauuaauaaagauucuuuuuuauacauuauauuaugauuacagcuuucccucccucugcuccucccguuuccuucccacguccccucccuugcugacccacucccuuucugucucacauuagaaaagaacaggauucucagagguagcgacaaaacauaccaaauaaaauacaauaaaauaaaacaaaugccaucacaucaaauuuagacaaggcaaaccaacaaaaggaaaagagccccaaggcaggcacaagaaucagagacccacucauucacacucccagguggccuguaaaaaucuaaacugaaagcuauaguauaagugcagaggaccuggggcagacccaugcaggccuaguucuugcugcuucagucucugagcucacaugagcuuuguccaguucauuuagaggaccuuuuucucuuggcuucucaacucuggcucucacacucuuucagcuuccucuuucucaggguucccuguaccuuaagcauauuagugguauaaauaguaaaugagucuggagcaugguaaugcauucagugaacaguuugggugagaguagacaugaacuaaacgaugauuggaugcuaguaaggaauugacacuugugcuguugucacuggcagguguuagguagguaugugugugugcaugcuuuccuaggucaaauccuggagauuuagaauuuauuacuguuugauuguuaaauguuaaauaauggccugauuaguuccugaauaauaccuuugaguauuccuguguaauacuuugaguagcgggcaaguaggagucagggauauugguggauuggaaacagaaguggcuguuuuccuugugccagguuauagaaguugccaaaugugcucuaggaggaucaugaagaaccaaucuacucuugacauuucuguagccucagaguuauggaaaauucagaguauucagucuuguauuaacauacuggcucagugccuuugaaaguaucagauuagugccagaaaaacagaaggaaacuaaagcaaacauguuugcuuccucuuacugagguaaaaacucaaagaaacuugggagaugaaagguuuauuuuccucacaggccaucacugagggaaaucaggcaggagcuugaggcagaagcugaugcagaccacagaggaauacugccuccuggcuugcucagucugcuucuuauaaacccuaagucaguguucccagagcugguaccccucaagccucacagacauccuauuggccagucugagggcaguguuuucucagucagcuucccucuucccaggugacuugcuugugucaggcugacagaaaccuaaccacuauuagagcaggcuuucuuuauuuuguguguagagaaaucauuucugguuguugagaaguauauguaguauuugcaucauaauuuuaaacaaaaaaauugacuuagaagcauuuauuuaaagaacacauaaaugaccaaacaucugauacuuugugugcacauaugauaauuuuguaccaaacacauuuuuuaguacuugcugaauuuuaagugagucugcuuccugugaggaaaaugugguuuaaaauaaaaugcauuauaauucuaauguuuagaaaacuaaggcagaaagauuguagauuuaagaaaauccuaggcuacuuagugagaucuauuucagaaaaaaaaaagaaaauuaagaaacaauuuaaaaaguagauaaaauaagcuuuuuuguuuuguuuguuuuaauuuuggcuuuuaggacagggcuucacuguguaguccugggaaacugcucuguagaucagacuggccucgaacucagauuucuacuucccucugccucccugccucccugccucccugccucccugccucccugccucccugccucugccuccaggugcuaggauuaaaggaaugugccaguuuaagcuguuuuaacucagaaucgaguuggcuguaauuaaaauuaacuacacccagaguauuuugguggauguaugcguuuguuuuauaacauuuauugaacauaagguagcagcucuuuuuuuuuuuuuuuuuuuuuuugcacgugggacuauaugcugauaaaaccuuugccuucagagauguuacacucuaaugaaguauuuuggucaaaaagaacuggaaguuuaaagacauugaggccuaagcaggcuugcauuuagagauuagccauaaggccaaggaaauuaaauguugcuuugcuagcagcaaaggucgagggauuauuuaggacuuuagaacuagagguagauauauuaggaagucaggaacaaggguggaaugaccuuaaggucugugguguaaaaccucaaguccccuguggcugugcuguggagacagcaguucagagcuacagaugggaauagggacaacaugugccauaauccugguggugugugagagaggagaggcuguagcagggccagacagagagugugcaucaugcccccauacagggcacucaggaagucauggggauaguugcuaagauacgggcuggaugucaauguguuuacugguuugcugaggagugaguguugguguuagguuacuucuaauuuugucucuuaagaaacaaaugcauccauucuggcuuaacuguaugagauuuaaaauguaaucaucagaaaacauucuuuuuuauaggcggaguauguccagcucguuacugaacugcguaugacaagagccauucagccgcagaucaaugcguuuuuacaggguuuucauauguucaucccgccuucccucauacaacuguuugacgaguaugaauugguaaggaagagcauguucuuucucguacgccagagcgcaacuccaucugaggucauucagaagugcuuugagugcuaggaugcugcuuagucguggaacgcuugcuugccucacauuagcacacagaaggcccuggguuucaucccuaguaccguaaaaaauaaaagcagaauuacuaaauucuugaguacugaaugggauauuuuuaauaagacauuauuguuuagagcuaugcauagaaauuuguaagcagauauaugguuuuacuugucuuaaacugaguagccuuauuaagaguucccuuagugaaauguccauguaugauggagaaaaaugaaauagaguuuuuaauggcuuugacaugggagauguugaaguccugucuucccagaagcaauguauucuccauuguuucugaaauuguaacucguuacauggggguaaaggauacuuaugccuaaagaacuaggacaggcuuuucuuguuguauuuauguaucuucuccaguguuuguuuuaaugugugugugugugucugcuguauaauuuuuauaauucucuauuuccaugcuuuguguagucuacuuucuuuguugaagugcucagugaauguuugguuuuguccuucaauuugccugccuucuucugugaccuaacagaauuuauaauuuuauguuaaugucuauuuuuggcucuuuccuuuuucuugucauuaauaaauuauuuucaaacuucuugaucugucuaaaaccuuaauaagacacaguauuuuacuuuucuuauuucugugacaaguaccugacagaugggagcuuaagggaaaaaagguguauauaauuggaucgugguuugaagguguauguaguuagcucguuuugguggugaagguauagaggaggggcugcuccucacugugguaguaggaagauuaaggaaggaugcuugcucacaucuuggcaggccaggaaggaaaacaauuagugacagauugggcucaaaguaggggccuuauccaaaugcuaaagcuugcucccagcugcccaguuacuacagcugaacacuacuuuuuaaagguguggggaccaaaugugcaaacacaguuuguggagggcauuuuaaagucaaaccaaauugcuuuauuguguaaaaaauaauugaaaacaauucuagauaauggaaaaaauguaacauaguauagaauaacauuuuuuuuucccuuuugauaaagagguuuuauuuuuuuuuccauuuuuuauuagguauuuaacucauuuacauuuccaaugcuauaccaaaagucccccauauccacccacccccacuccucugcccacccacucccccuuuuuggcccugaaauuccccuguacuggggcauauaaaguuugcaaguccaaugggccucucuuuccagugauggccgacuaggccaucuguugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcaucuacuucuguguuugcugggccccggcauagucucacaagagacagcuacaucugcguccuuucaauaaaaucuugcuaguguaugcaauggugucagcguuuggaugcugauuaugggguggaucccuggauauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucugggucuucaauuguauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuaaugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuuuugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuggcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuacagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccugccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuaucuguagguuuggucuucucauuguguccuggauuaccuggauguuuugaguuaggauccuuuugcauuuuguauuuucuuuaacuguugugucgauguucucuauggaaucuucugcaccugagauucucucuuccauuucuuguauucuguugcugaugcucgcaucuaugguuccagaucucuuuccuaggguuucuaucuccagcguugccucacuuuggguuuucuuuauugugucuacuuccccuuuuaguucuaguaugguuuuguucauuuccaucaccuguuuggcuguguuuuccugcuuuucuuuaagagccuguaacucuuuaccagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauuggggcaggcacugugguccacucaccagaggucuuagggucccguggggagucccgugugggcccuugcggguguugggcaagacucugcuggcaagguagcccggggcucgagucucgagucgagcggaagggcuagaauaacauuuucuaauuaguguaauuuagaaguccauugugccucaguuuuauugaauuuaaguuuugaagguuuuuuuuuugucuuauuuuagcuauaagauuauuguuuucauuuaacauagauauuuuuucuuuguuuaguuuuaugucaucauuagcacuuaaaaacaaguaguuacuugagaggcagcagcagguuuaucucugagcuugaggcccgccugguuuacagagagagccucaggacaacaaaggcuacacagagaaacucugucucagaaacaaaacaaaacaaaaccagaaauaguuaagaauuguuuguggacaugacuggaaccugaauuuugauguauuauacuucaauuaaauuagcuuugugacauucaagacagaauguuaguuuuugugacuauguauaugaacaaaguaaauugcaauagcagaaauaauugacaaaauguugcuuggugauuugcugauauucauagaccaugaaagcuuccaauuuaauuauauauauguuaguaaauuaagaaauauaucaaaccagcagccagauuaagugauaaaaacccuaccacucuagauauuuuuuuuuugucuucuggucacugucccucauggagaagaauuacucucugaguacuauaaucauagcuuuaacuauuuguaaaagaaaauacuuauuagcauaguaauggguuucaucuuauuuccauacauguacauuguauauuuugaccaucucucccccccccccccccauuauccuuucuuauccccccacacuccuguuuuccccuuugucucuccaacuggccuuucuuuuuccuguuugguugguugguugguugguugauuuuuuuuuuuuuuuuuuuuuuggugacccaaaauuccuuaagacuguaugcaggugcuuaggcacuuauugguagcuacacccugcugcuaacugcagacacauuccaaguaagaagugggauugguuccaggagucuccacacuccaggacaggguuugggauggcccaaccauaugcaggucuugugaguuugacaguuaggucaugcccagagcuaagcaguccacaccacuacucacucuguucucuggcucuuauauacccucuaucccuuuuuucuuguuucccugggcauuggaagaggucauaaagauguacuguuuauggcuagacucacucaugcaauauucacccauggaucucugcagccauuguugaugagggcauaaggaagcuccucugacuaacacuggcaguagcacuaaucuuacaggcauaaacaucgguauuuagaaggcaggaugaugggcguaucccauccauuuacuaagcuggccacagucauuugucuccuagccacaguuggggauugguuuaauaguaccaaaugugaauuccuucuugaggcauggaccgaaaacccagucacaaauugguuagguguuccuguaggguccuugcuccucuuaggagguuuaugccacacuaucaguguagaggccagagggcaacuugugagauuugguuuucuccccaccuggcuggguuccagguuugaacucagguugucaugccuggcagcagguacuuugaucuguugagacaucuuucuagcccuugucauuuccuuacuuuguugugucuauguguuauuggccucagaaugauacagguuuguaaaguaaguugauagcaccucccccuuuacuguuuuauggaauaacuggagaaagguuggaauuagaucuuuaaagggugguagaauucuguaguguacccaucuggguguacacauuuuuuauuuggaagguuuuuacuuucuguuuucaucuuguuccuugugacauaucugcuauauucuuuaucucaucuuauuuuaacuuugguaugucauuugugucuagaaauuucucuacuucuucuagauuauccaauuuaguguacuauguuuucaagguaugucuaccauuuucuggauuuuauugguaacugcuauaaucccuucuuuucaacucugauuuuacagcuugaauauucucuuaguuuuaccaaagguuucuuuauuuuguugauauuuucaaagaauugacuguuuucuugauucuuuguauuuuuagaacuucuauuugaauaauuucugccaugauuagggaccuuauuuuuguauuauuauuuuuaacuuuaaaaauugugugugugugugugugugugugcauguauaccugugugucugcuugcuguagugugcaugugugugcauacagaggucagagauuuugugagaguucucuccauuuaccgugugggcuccugggacccacuuggauccuaaggugugguagcagaugccuuucccuccucugcuccuuucuuauggucaaauagaauacaaaaaauuauuucaguuuuguguguguguguguguugagacuugcuuuguguucuauauaugaucuaucuuagagaaaguucuguggacugcuggcaaaauguuaguuucaguguuuggaagucauccacuugaucuaggaugucaugcacuucugaugcuuuguucuguugauggccagugcugugcaaccggcccaaggggagaauuuuacuugcuuuucuacuauuggcugcugcccuuaauguggcuuuuuuuuccccuagcuguuuagaauguccuuugauuuuccaauaccucccuauacuccagcuuucccuagcuuauuuucuugagauuuuggcuaaguauaccugaauguugccaucuguguuggauuuggcagguuuaucuauuuugaaaauaaauguaaauagaaaacaaaguguuuugugguuaucauacauauugccgcacacaauuauaauucacuggcuaguacuuuacuaugucucuuuccuuuugucuuuuauacuccugaaccuugacgggggucuuuacaguucugggguacugaacuaguugugcuguaguuuuuccucaucaaaauaugugcguauguuuuauguauguggaguuauagaacagggauaugcuacaucaagaaaaaaacuuuuuacaauuuuguuuaugugaggaggagaaagcauauaguugcucaagaucugguaucaguuacuauggauagagagcuaaagcaguggccaagguuauccuaacauauauguaagcagugacacuuggaaggcuuagauguccaaguaguuaucaucucauugugugcugcaucugugaugcuggaauaccaaaacaccaagucauauggauucuaggcauucuaauuucugugacucugguuccauuaguguggccucuauguuuagauuaugugugcaucugcguauaucuacacauuuguaguuuuuauuuguguuuagagguagaguuccaugcagcccaagucggcugagcucagccgugcuguguagcugagggugacucugaacuccuuccuucugucaccucccagagcugagauuacagguaugggcacugugcccgauuguuuguuguaucuuaaaaguuuaguucuuuuaguauauuaagaauaaauuauugucuaguugugguaguacaugccuuuuaauaccaucccucaggaagcagaggcaggcacgucucugaguucaaggccaguuaggacuacacacagucagacccucucccaaugucaagaaauaaauuauuggaauuuaauaauauuuuugcuauauguacuuuuuauuuugaauuucccuuuuguuauuugucaucuuaauaacuuuucguuaguuauuauaggaauuuaaagaaaaaaaucauuaaauguuacggcucuaaugguggugguaccugggagaauggagcccauaaacgagguggacuaaaguuucauguaaaguuccauguuuauucagagcaccagacaguuuauacucugaggguuaaggcaugaguaaaguguacaacagaagggcaagucacacauggcagacaagccucaugugacaaaagguuuuuccauagagcuguauaaacaaauaacaauauccgguuguaaugaauaaucugaaauaaacucaacuccuuuccacuacaccugggaggagcauaaaaacacauuccauguaaacaauuuuuaaaacucagaacaguuuuguguuuuacaggaaacugaggucacaagacucuugccuugguuucuuggguuuuucucacaagcacucagaagucuccuuauacaacuccuuucugggucauguucugacaauaaaauaauaaccaguguuuauuaaguauguaaaacaaaaaacaacccccacaaagagguuugugggcacaugcuacccuuaguuuuuccauggaggcagaaguaaucacauuucugugaguucuaggccuguaguucaaaaaacaacaacaacaacaaaaaaaaaaaccaaaaaucauuuuuccuuuuuccuuaaauuauagaaaauaugauaauuauaaaauaguuaauuucugagagugcaguugcaauauuauuauuccuaauuguuaauuauggaauaauacuaaaagcuuaucuucacuuuaauauuaaaagcuuaucuuuagucugagaaggggauuaaccuggugaauugugagaaacguaaaauucacccaggugcucuuugguagaucugugucagaguucugcaagggagcaguuuucucaguugggucccguaaggaagccuuaacacagggaccauuaaagccguguuuauaaggaauaaagaagagcuggcuaacgugggaagccuuuguuguggcuacugcugaaagagacagcuugaagagauguagugaaggguccugugugagagagaagugucaaggagacgcucuguggacuccgcacuacagaacaacagcgcagaaaccugaagggagcagagcugugggcccugccugugcuucucaguggcucagaucuuaucuacaguuaguaagcaagaaagccagucugcagggagugcagagugugccaggggugcuagauaagaucaggaguuggccagucaugaggcuggcaaggacugggauaugcacaccagcaguucucaauuauaugaucuugggaugaucuccuucaaaacagucuuugcuuauauggguuaguauaccaauguauauuugcuguacuugaaauuaaauuagaagggaaaugugcuuuguaaauuauguuaauguaaaugacauuuagaaauaaaagcuaaucuaagaacagaacaaaaauaaugagaaaaaugacacaguuuuugcagauuugggaugccuggcuauauaucucauaucuagauucucauaucugcuucuguguaugaucaguuguacuucauuauuuggcugaaguauaugaagaaaauccaauuucauauggaaaauauggaaaaggccacucguacugaccuagugaauagacagagugcucagaccuuaccuagauugcuuuugcuagaacauaugcugcccuaguuagguauauauuaauaacagucguuguaagucauggccuugaaguauguucucagacccuguuaaaagacaugcgucauucauacccucaccgcacuguagggcuuccaucugugaaacgugggcugauucagggacacagacacgccuuuccuucucucuucccuggaaaccccugaugaugaacauuuuggcuuuccugauguaacuuuuagauauaugugauagauuucuguguuugaugaucuuggacaaaagcuagucauguauuuaggaguacuaacgauguugcucagugguugugugcuugccugguuauauacaaggccccuaggauccaugccuugcacugcagacagagucacuagaaaauagucuuguugguggugguuguuguuguuguuguuguuguuauuauuauuauugccuuggagaagauugacuucaaaagaucugaauuacuccaaaauagaauucauauuuuuaaaauaaagaaaaaaaugauuauuucuuaaugagcuuuucauuugcauaauauucaggcuuuuaugacauuuucauguugagaauaugaccuggugggauuuaacacauuuauagggaauauuaaaauaaaaauaaacugagccagagggaauacuuacagaauuguguacauagaaaccuuugcugcguaugguuaccaucaauacagacgcugucauucuuuuuauguuuuagaucgcaucaaaguggauccccauccccucaugccauauuugaaaugucacuguggcagguuccuccuuauguagcacuuauuauugaugauaauguagaaacugucacagacguaaaccagguuuauaugggauuaguuucuaauuaaggcaaauuuacuauuuaaauguaauggcuuuuuuuucccccaaggaagauuaaugaaauauuuuucuucuuccccaaaggagcuacugcuuucuggcaugccggaaauugauguaaaugauuggauaaaaaauacagaauacacaaguggcuaugaaagagaagauccaguuauucagguacaaucucucuggagccuagaaugaaguuaaguuugcuauuuaauuuuguaagcuuuucagcuuuauuggauggaagucuacauccauuaacaaaguaaagauuuugcauaaauucuucuuuggggauauugcauaugaaagccuuuugugaaaucaucuuugauaaaugaguuucagagaauaaaaugugcuuuaugaauauugcauggucugugguucuuauaagucuaugauuugcucugaaaugugagcuaaauuguuguuauucuugguagugguucugggaaguuguggaagacauuacucaagaagaaagaguucuucucuugcaguucguuacuggcagguaagaagagcuuuuaugauaacauuggaagaauuuauuguauuucauuucuaaugaccaagacaguaaaucacagagaaaaacaaacaaaaugaagagucauuguucugucuauauuuuagguauuaaacaaaugauuauuuagauguugaugacaaaauauuuauaguaguguuaaaucuuaauauauuuuagaaccugaauuuuuaauaucuuuuuuuuuuguuugguuuaacaguaaagccacucaguuuuuaugguuggacacacgcucucucucucucucucucucucucucucucucucucucucucacacacacacacacacacacacacacacacacacacacacgugugcgcacacauggucuuugucuaucacauaguuuuaguuuggguuucuguuuacaaugaccaaacagcaaguaugagaggaaagggucuauuugacuuacauguccaccuugugguccaucauugaaagaagucaaaacaggaacucaaacagggcaggagcugaugcagaggccaugacagggugcugcuuauuugcuugcuccccauggcuugcucauuuugccuucuuauagaacccaggaccaccagcccagagauagcaccacccacaaugugcugggcccucucacauuagucacuaacccuacaggugugucuacagcccaaacuuauggaggcauguucuuaauugaagguucccugcucucagaugacuuuagcuugugucaacacaugaauacacacacacacucaugugcacauuguuuguacauagcauuuuucucuuguucuuauugauuuuuaaaauguauucauagccuguauuuaugugguauaguuuuuauauauuuuagaauuccaguuauaugacaucaaaaauaauagaugauaguaaacuaguugacuuaagccuuuuuauuuuuauggaauauaucucaaaaauuuuuauaauacaauuucauuuauuucuuucuguuuaugaaaauguagaucaguuauuuucauuaugaauguaauguuuuuuucaaaagucaggaaacagaauauuacuccacuauuccaucaguaguagcuacuauauaaaauuuaauguauuuacuucuuuuuauuuuuuguguauuuaaaaauauuaugaguguuguauuaguuugcuuucuguuguugugauaaaacacugacaacaagcaaguugugggugaaaagguuuauuuggcuuccugguuauagucaaccaucaagaguacccaagagaacauggaugaaugcgcuuacugguuuguucuccauggcuugcuccgccuguucuccuguacaacccaggacuaccuugaacccccacagugggcaguguaugcccaugucagucacuaaucaagaaaauguccuuguugccuacaggccaauuugauggaggcauuuucucacccagccuuguaucauuagauuaauaaaauaucaaccaucacaagugugaauauauaucguauaaauuuaaaagagaccauuauuuucuuacuuuacaaguaauauacaacaauuuuaggcaauuugaaaaaugaagaacaugaaagaaaaugaagaucccauuagguaaucuccaacacccagaugugaccacucugauguguuuauucccugcuccaucuuuaagccauauaaaguaggaaaccaggugaagccauuuuucugaucaggauuuaaugaacuaguaagacaugacuauuaucagauuauagacugaagauauaaaagaaagccuuguuaaacuuguuuuugcaagagugcuaagaaauguucagggauuuaaauaauuuaauuaaaauaauuuauaauuaagcagcauuauauuuucuaaggcuagaucauuuauauagauuauauagccaaaaacagacaaaauaaacagccuaauacuccuaucucaaucucuuaagauagucagugaacaguuguauuauuacucucuauauguaaauuuuaauuuucaaauuuucuuuuauaacuucuugaauuuaguaguguuccuuuuauagauuuauucaguuuuaauagcuugucuguucuuagaucuuaacccuuauugguaaaguuuuccuguuugcauauaauguuguaagaauugaggaguuuuaaugcauguauucuucuggagcauuguauuuauccagaagccuauguuggacuggggauguaucugaaauguaguaggaauuuguccagugagugcauagaaacccccuccgaguuacaccuacagaaaacaaaaggaguguguuaauuauuauacccaggagucuaggcguucagaaagguaucaauauugauauugauggggaauaagaacgggccugcuuuuuuccauuggccaugcaggagauugaacuguuuuguuuuuguuuuccuccuccuccuccucuaccaccacuaccuccuccuccgccuccuuuucuuccuccuccucuuccuccuuuucuuccuccuccuccuguucuuccuucuccucuuccuccuuuucuuccuccuccuccuguucuuccuucuccucuuccuccuuuucuuccuccuccuccuguucuuccuucuccucuuccuccuuuucuuccuccuccuccuguucuuccuccuccucuuccuccuuuuuguuuguuugauuuuaagaacuugaucuguagaucaggcuggccucaaacucagagaucugccaggcucaacuuuuuuuuuuaaauuaaucagcauaaugcuugugcauuugaacuuuguuauaguguguacauuuuuguguaauuuaaauuuuuguccauucuagucauuuaaaagacuaauguuaagcacucuuuaauacauugauauuaauucuacauauauuuuuguuaguuuaucauuuuucuuuugaguuuaacauaaggaguuuuaaagaauuuaaauuuauaaacugaaaauacuaaauuacuguuagcaaauaaucaguauuuuauauagaucuuguauucugaagaaugcauuuacaaaugugcguguguguacauaugucuguguagugucugccugugaguuuuaugugcacucauuugugcagcacacuuucuggagaucaaaaguaagcaugaggcccgugcugucuccuauugcucuucacuuuagguuuugcacgugcuuucucagugagccgagugaggucacugguuggcacugagcucgggaccuuccuguuaggggauaggccacaguguuaggguaucuguuuagaaaaucaucaauuuccuuuagauuuuccaguuuuguacuuuugugauuuuccauuuccuuuagccuuugaaguaagaccuaauguuuuuuuuuuuuuuaauuuccugaguuucuguuguuaugucucccuuuucauuucugauuuuguuaauuuguauauugucucuaugccuuuuaguuacuuuagcuaaugauaaucuaucuuguugauuuucucagaaccagcucuugcuuuuguugauucuuuguauuguucucuuuauuuauaauugauugauaucagcacugaguuugaauauuuccugccaucuacuccucuugguuuuguuuguuucuuuuuguucuagagcauucauuuaugcuguuaaguugcuauaugagaucgcuccacuuucuuuaugaaggcaguuauugcuaugaacuuaacucuuagcacugcuuucauugugccuuauaaguuuggguauguugugccuucauuuucauugaauucuaaaaagucuuucauaucuuuauuucuuuaacgggguuauuuauauccugcaaaggccucuaucaucuucaugagaugagauugaagaucauagugauacucuuagguguguuaggauauccaggguuuguugugguagaagagcuggguucuccuggugucauacugcacuggcuucuguugauuauguucuugagcuugccuuuugccaucugguugucucugguauuggcuggccugauaguuccugggugucccggguuggagcaggccucccaggaggcaggcagagcuguugggugagaauggguaugcuuauucuggauugaagguggaaguguuggcuggaaagaagauggagcuccugucggguggaguagagcucagggaugcuggguuugccaggggccugggcaucucaccuguguguucugguugaaguaggccuccugguagguggguggagugggguggggaucagugugcagaucugcaguugccgguggaaguguggaaauuugauguuuucuagugcaugaaauuaacuugagucagggugagcccuaacuacaguuguucauggugcacaguagaguagggcuucggguugcuucaugcaguaaagccuaaagacagauuucagcuuagauguuagaaaugggagauccuuuggugcuuacuuauucccuuaugcaaggauuaaguucaggaguccucugugcucggcagaguccuacacugagcugcuuccucagccuguccuuucuguuuguuuaaccugcccuucaguuacgugaaggacauuacaguguuuauccagauacugaaacauuaugguacaguuuguggaaagguuggugacagcacuuauagucucaucuugucuuaauaaagucauagucagaauuuugucucaaugaauaaguaggauaauauaacuucuuauuccuggucacuuuguuaauuuuauagauaaaaacgaaaauacauagacuaauaaauuuuacaaauagauacauuccuggccuuuguuuuuggugguggacuuuguuuuguuuuuguuuguuuguuuuguuauccucaugcauuuaugauuuauugaaaagauucagaauuuuuguuuccugaaugacuggagauugaaucuagggcuggccacaugugugguaggccuagugcauuaccacagagccacauccuuuuacuguaucuuuuuuuuaaauugaaaauauauauuuuuuuaauaauguauucuaacuauaguuucccuuccuccagcucuuccuagauccuauccaucuaccaaguccacaccuuuuauuucuaucauuagaaaacaaaguggcaucucaaaaagaaagaauauaagauuaaaaaaaauaacugaaauaggacaaaacuaguaaauggaaaggaaaaaggaagugccaaagaaaaggcauaggaaacauaggcacagagacauucacaucccacacacagaaaauccaucaaagcaaaauugggaacuguaauauauacgaaaggaccugaacaguuaaaaccaaauuaaacuaaauaccugaugacauaagagacagagccuacaaauaccauugagcugaguaugggauauaccuuaaguguggcuuuuauagccagugagacuccauuagagaaaacuaauuuuuuucucugugagugguugugaauuggagguggcuucuggguuggagaugggguaucaugucuacuuccucccucagcacugggaccccaucuggcuuaaaccugugcagaccuugugcaugcagcaacagucucugugagguaauaugucuguugguggaaguucuuuguccuuaacuguucuuaaucccaagagguuuuccucuauauuuucuucacauguuuuauaguucuaaucauagugauguuuuaagucuuuugaucuguuuuuaguuuaucuuucuauaugguauaagguaaugguccaacuucauuagaaauuuuauaacaaauaauccagcugucccaacacaucuuguugaaugacugagugcuuuuccccauugaaauuuuuuggguugggaaugggguauggggcaaugagacaagcucucaugaagaccaggcugccuuugaccucacucuguagcuaaggaugaccuuggauuuucugguucucuucucucuacacccagagaacugggauuuuaggcaugguuuacuaugccugguuauauacaguacugaggcuuaaacaagggucuccuacaugcuaggcugccauuugaacuauaucuccagcacccuguuacauguucuuggcacucuuucaaaaacaacuagacaauguuuggagggacguauuucuggguuguuuuauuuauugcucuguaugucugucauaacucuuaugauuauauuuccauaauaaauguaaaauuaaacggugugcuucuucacacccuucccaggauuguuucagguauuguaaugaacauuuuuucaaaguguguugaguuacauuggugccuguaguccagacugaucuugaacuuaagucuucuaugccugugcuccuggagggaagagucagcagcacucacaaccaccugcaugcugugauuuauggagcagaaaaccuuuuaauucuggucacacuuggcccaucuuaaauuuccauuaaaaauuaaucugaaaauuauguauguaugugugucuaaaaugaaauuuuacucaacugcaaagaauggaaauaagccagagucagaaugaaaauaacccaugacucuucccaugcagaaucuagauuaaaauuuauguauaaacaugcauguauguuggccaugagaguaagcagaguacacgggaggggaggaggucugcaaggagggggcauggaagcaaaagaaagaaggcaaucagauuuauagguaacaugaaaaugggaggaagggcuguuggaaacaugagggaucugcagggaagagagguacacagggccaccuguggggagaaagaggaagaacaaagcagagugaaugugccugaaaagucuguaaugaagcccagcuacucugcaugauagcaaugaagagauguggaaaaguauacauuuaguauuugugcauuaaaugugugucagaauucuaauauauccuagagacacuauagcaugucacuguaauguagucuuuuuccuauuauuuuuuguggugggcucaaacucuugugccuacuaagcaaguauacuugcauugggcuacauccccugcucacuacaauauauuucccccccaggauuuguuuaaucaugacacauacucggacuaauuugaaauauuaauuuaaaauguauagaacuugaaaaguugugguuauauuuucuauagcuauguaccuggaauuaaaauguuuaguuaaugcauuauguauugaauuuuagccuucuuguggucuuaauuuguuuacacaacaguuaaaaaugauauuugaggaagcuagcuugcaguaacuauuugcuguguaagugugagcagcugaguugggcuucccagaaauuauguaaaagcuagguaugcuagugugcgcauauaaccuuaauaccaguggacagaggaggccauuguaaagaaagcgaggagcuuccaauugauucagugagagacacugucucaaaaagcaaggucgcgaacaauagaggaguugccugaagucaccgcuacacaugcaugcacaagguaaaccacagacgaaauguuugcuauucuccauaucccgaaagauacggguaaauacugcucauuguuguuuucucacugaagaacaaaauagagaaaaaaggguuucugccaagaaauuuucacaaagaacgaaaugauuggauuacaacacacaaggagaaaggcuguauagugucucacaguuccagggcagaugacauccaucauggugugcauggcagcacacaggcauuacuugaacaggagcaggaaggaaggccagguuauaaccaucaugacugacccucauugacauacucagugaggcuccaccuccuaacagagguucucaaccuuccuuaaugcugcaacccuuuaauacagucccucauauuguagugaccccuaaauacacaauuuucauugcugcuacuucauaacuguaauuuugcuacuauuaugaaucauaauguaaauaucuauguuuuccaguggucuuaggugaccccuguuaaaaggucauuugaccccccccccccaaaaggauguugacccacagguugagaaccacuguccuaaagguuuuacaacccuccaaaacagggaccauacaggggccaaguauucaaacacaugaguuuauggaggguauccccacuguaacaaccacugucuauuuauucaacaaacauuuaacagcuguaguugucaagugguuuugcuaaucccaaggauagacaucccaguguuacaaacguaaaauaggacauguucaagaauccuacuuuaauagagaggcacacaguugucuuaggguuuuuauugcugugacaaaucaccaugaccuuauauaacuaggagggggaaaagguuuuugauuacacuuccacagcaaagaauucagggcaggaaccuagagacaagagcgaaugcagaggccacagaggaacacuacuugcuuagccugcuuucauacagcacccaguaccuccagccacuucccacaguacugugcuggacccucccacaucaaucgucagucaagaaaaugcaccacaggcuuacuacaggccaguaugguggucucaagauucuucuuuccaaaaaaccagcugugucaaguugacacaagacuagccagcacauuguaaacacaucauguggccaguuaaaaguauugcuagcugaggaagcacagagagguuucuccugggaagcuugcuaacugaacaugaagcaacagacaggaaugaguugggagguucagacucagaaaugcccuucugucguuuuagaguugaauauauuuuuauccuaacuuagaacuuaaaaugugucugucagacugagauuuucuuuccugaucacagcugaugauacaaacucuuaguuccagggucccgcaugguggcuuugccaauauuauggguggaagugguuugcaaaacuuuacaauugcugcugugccauauacuccaaaucuuuuaccaacuuccagcacaugguaaguuaaacuagcuuauucaaaugaauuauagaauauuuuuauucauuuuaaaucaucagaaguaauugcuauauuuccuuuuugauaguuaaaaugucaaauuuauguauauuuuauuauaauagggaagaagaaauaaccaacgccuucaguaauugcauuccauugcucuguuaugguguuauuaucuuugagaagguauuuuuuuuguuaaauaccuucauuaaaauacagaauacauaauuucucuauuccucuguggccuauuccucccauauauucuuccuucccuuccaaauucauggagccuucuuuaauguuguuauauacacauaucaaugaguucauauaagacuauaacucccuauugggucuuuucaguauagauuuuauguaugucaguagggugccuauugguaguggaaaugagucaggaagcucagcccagggaaagaccagcacuccuuuucucagcugcugucgcucauagcuccucagcuagaggucaggcccugagagauuuccccauccacuuugggaugccaacuauuguuggauuguucagguccuguguagggacccauauuguuggaauuuuaugacaggcuccuucccuguuauauauagcuagaugucacagucucacagcagacuuccuggucgucugucucagaaaaucuuuucaucccucuuguugaugcccccugaaucuuacaugcaggaguuguguaguagauauauccaucacuggagaggagcaucccauagucaguugucuucugcacugugacuaguagcuuucuguaaaaagcagcuucuuugaugaggguugaaguguacugcacaguuaccuaggucugugccaagagaccuuguguuggcugugguuccugguaggaaaaaaggucuacaguugaagugagacccaaaggaagggagaugggauaagagggccugauguuggcagugguccagaacaacuggaacccugucugccugacaguuguggucugcgguguuucuguaaugaaaccauaaucaaccauaaucucuccucagaauuucagaacuacaaaugaauuagugguuuagguuugagucaucuaguagggagaaccuugaagaaggcacaaaccaccuaaaacuuaauugguucucacuaauguuaaaaugccggugucauucaguugcaucgacacuuucaucuguaucacccuguuacuuguuuuuaaucuggaaauuuauuucauccgcucauuugcauucugggaggagcugcaguucuucuuaaacaucacuugaggguuuuccaauuucaaugcaaauuugagagaaugguuuuauguuaauuauaagcaguguuuuuacugcuagauaaaacaaggaauuucagagauucucuguuuaauggugguuuauuuuauuuuuuuuuaaagcaucaacaugcucaaguuaccugaauacccaaguaaagaaauacucaaggacagacuccuuguagcacugcauuguggcagcuaugguuauacaauggcauaaugaagccuggaagacucaucugcgacugaugcacaauccagagugacagaaguaauuuaggcagcugucagaaaggcagccucgccucgacccacaggcagagagugccugcuuaaaauucauaacgaaucagguuuucuauuuuacauuucuuuuccauguuuuguuuuucuauguuugugauacaauuagaaaauauaaaaucauaguagacuucauuuuuuaaaaugcuaauuggaaguagacacuuuuuuuuuuagguuucuuuaaucuuaucuaaaacucuuaagacaaacucuuuuccugcauuccaccucugcugugacgcugucuaguugaaagggcauuugcuguaaauuauaugaggacauccagcugguguguucuaucgcauguaaaguaccauuuauauuuuggaaaaauguaaagaauggauuaauuuagauuguguaaagccauaaauauguauuuucccacguuauacuuauauugcaauggguuuuauuuuuuuguuguuguuuagcuuuuuaguauuuugauacaugguauaaaguuuagacugguaugccgaacaacggauaaagugauauauaauuuauauauuaaagcuuacacuauaugaauuauuugcaucuuucugugcucaguuucauguguguguauauauucuguguggucucaguuuuucuuaugccuuaauuuauacugaaaauaaaauuaaaauauauuuaucuuauauuucuuuauuugaucuaagcuugaugacacacuugaaguaauauaaucugcagauuaaaacuuaaauaugua

SEQ ID NO: 5491 - RNA, 815 nt, Mus musculus
uguguaucuuucuuuuuuuuuuuuuuuuuuuuuuucacauuucuacauuuuauucccacaaggcagccagggugaagcucgagcccagggccacaggccucuggaccuuccuccggcagggaugcacgccagguccucaggacugccccaccagcaggcugguuuucaggcagaccuucaugagugccgggguggaaggcuccaggggucacagggcaggggggcucgguguaggggcacacacuuguagggcuagcuagagauagcacggcagguccuucucuaucaccuggggcuccuccaugggaccauagcgcuucaccacgcagccauucuuaucaaugagaaacuugguaaaguuccauuugauggcauuucccagcaugccccugcccuugggcuggacuuucauccauuuccacagugggugggcaucguccccauuuacacagaucuugcuguacaugucaaacuugacguuguagccggcugcaaacuccuugauuucuugauuacuuccuggcuccugccucccaaacugguugcaggggaaggccaggauucguaaaccacacucagcauaucgggcaugcagaucgacuagcugaguguaguuuacgucaguuuugccucauugcgaggccacauuggugacgaugcacacgaaaccccuguacuuauccaggcagaccaugugcccgucgauguccuuggcugagaauucgugcauggagcgcgcacagcgccaaucaucgcgggaugcacacauggugccugccagaccaggcgcagccagagccccgcacagcagucuu

SEQ ID NO: 5492 - RNA, 741 nt, Mus musculus
gaugaccaacgaagaaccucuuccuaaaaagguccgacugagugaaacagauuucaacauuauggcacgggaugaguuaauucuaaguuggaaacaauaugaaacauauguucaagcuuuggagggaaaguacacagaucuuaauucaaacgaugugucugguuuaagagaaucugaagaaaaacuaaagcagcaaagcaggagucugcacacagggggaacauucuugucauguagcuagcaaccaaggagcagaagaugcaagagugcacuacucaaauccaguaccucaaucaaguuccacagccaagugugacccaacugagaucaacaaugguagacccagcgaucaacuuguuuuuccuaaacaugaaaggugaacuggaacagacuaaagacaaacugggacaagcccaaaaugaacugagugccuggaaguuuacuccugauagguaaacaaaucauauuccccagucaugacuucccugacagucccaccucaagaaagcuguugugggacagcccacuacucguuuguacaccaagacucagacguuuugagcaaaaaaaaaaaaaaaagacacauucuuauucuguccagcuuguaaugguuaauguaauacuuacaggaugaaccuuguuuuucagcuucuuucucuuucccuuucacuuguuucagaggccugaugccuucgaacuauucugaagaagaggccaacucugaaaaauucccuuucuagg

SEQ ID NO: 5493 - RNA, 1343 nt, Mus musculus
uuccucuccucuugcuuuaaaggcgccgcgcuucuuuccccgcugcuguuacuagcuccagggcacccaggcccacccaagagcacggugcacucuuuauuucaagaacuccagggagagaauuccggguacugaccaccuagugcuuccggaacccucggcccugauuucgucuccugcaagcaagcacauccacauccaggcauaggggaacagggacagagaugcucugaaugacaguggguaaggcaaaagggacaaggauugauuuugccugcucugagaagcuacacugaguauaaggacucauagcuucugcuucuggguggcugcuuuuuugcugcuccugaaaccauggcaacgagacuucuauguugccagcaucuggggagcagcugguugucuccaaagugacccuuuugguucaacuacugcauuucccauucagguuggugaggaucaucuugguuucugcaucuucuacuucuauccugcuucucaagcuagauggguuuuggucucuccugguguccaguagcaaaagaaauggacuuucaacaucaagaagcuggcaggaaaucucagcacaggucuagccccuuuauaucugauuuuguucuucaagcuaggucccugaacucugagggaauuugaggccuggcaagcacagaaccuggaguccuagcugucaugguugggaaaaugagcauauagaaguacuuaaauaugagauauugaaagauguuuuuaaggagaagugggaggaggagggugccuaaguccuagggucuucccaaggguugcuuccuggagucagggguggggacaggaggcagagagcacaccagacuccucaggcuucucuggaggagcgauuagcuucugcaaacaaucccggauuugcucuccucugggucagaaaagucaacauguauucaauaccuuugcuacuuuauccucagcccugcaauauuaacuagaguggagacuuagcaguuccccccagaguacauuggugagcuacuauucucgaggagguuuaagagaggccaagcuugaacaggcuuggcagaccagcccaggagacaaauuucaaagggauuguaauaggaagcaggccagguggaauuccuaagcucaguggagccuagaggcaacugcagucccaggagcacuccagucuaauucugaagggcuggaagcagaggcuccuguucacccuacagcagaccaacaggccgcagagaagcguuuguucuuuugcuguauuuuguuuguuuguuuguuuuguuuuaccugcagccauugcuaucccagaagaguaaaaacuuuccugaaccugu

SEQ ID NO: 5494 - RNA, 2668 nt, Mus musculus
gggucuuccucuucauguugaaacugguguaauaaaguugcugcagaaggauccgguuucucacgcagucagguugguuuuuuaagguucugagaggcauguuugguucuggucuuucucuacaaauagaaggggcaauggaagccuuuguaauuguuuuugcagcacuuauccuuuuccuuauagugaaagcagaacagggagugcuggaggcgguucaagacagcaugucagaaacagagcgggguaaaagauugggagcucaaaggaaaaaagguauaccuaagaaacaaggcccuuccaaggauucuggauccgaggaagagagagaaaagggaaagggcgcccuggagagaaaagggagaagggagagagaaagaggaggagagauaaaggaaaaaggaaaggaaagggaaauggaaaaaggaaaggaaaggaauauggaaaaaggaaaggaaaauggaagaaggaaaggaaggaagaaggaaaggaagaaaggaaaggaaggaaagaaagaaaggaaagaaagaaaggaaauaaaagauugagacgauaagguucucggguaaaugggacaaguuaagguuccuggcuuugggacaaguuaagguucccggcuuugggacaaguugcaccaagcaccauggggacuugagguuugcagaggaacagaggauuuuacuaaaagggguuuuguuggucuggaaguuagugagaaauuacauagaagauagagaaagauguggcuuagaacuccagagagguaaugaggcgcugaaucaggugagagaggagcacucucaauggguuuggaggagcgggucuguuuguguuuccucaggaucaucgacaacagcuucagguuccaacgcaacugacaaggaccgugaaagagcaagaugaaccccaagaugacccucuugcuccugaugauugagaccaggauaaguauaccucugugggccauaguaagaucauggccaguaccuuuaccgguacauuccaauucuuuuaccuugccuuuguuuuuugcaaagggauauuuuuuggaugugccuuaugcacgacaaacuccucaagagccacagguguauaagaguagauuaucuuuaauugggcagcauuacuccuguuagguauauuaaugauucuuuuauuaagaguacagaccuaucaaaucaccugaaggggaacuggucgcaggagcuggaaagguugcagucgaggcugcagauacagauccugaaccucagugggaccagaguggaaccagugacccuuggagauuuuaccucuuggcuugucucuguauuuuauuauuuuaaggagugggugggggcuauaauguuuggugcagccuuauguugugguauaguguuuaugcuaugguugguuugcaaacucagaucucaacagaaacgugacaaggucguuaucacucaagcacuuguggccauugaacaaggggccuccacugaaauuugguucggcaucugaguucucugcucuuggaucugcuccaccccauggaucugcggauccauugcacugggaugagagagacucaaugaucauugaucagcccuugcacaucacugagguuuccucauuguacaugacagggugaucaugauuucuccacuaaaauuuuuccuuaaaaccuggcuggccuugcucauagaguucacccuaggccaucuagcaguuauugucacacagcacugugguauccagagacgggcaacuuuccucgugcacagaccaaccuauaaugcuguguuaugccauggguugcaaggcuaagcacugcacagaugauagcuugcuguuggcauccuguggaaggcacgucugauugcaugaagguucaguguccuaguuuucuucccccaggaaaaaacgacacgggagcuggccaagaccucucuggaugaugagcccaagggaugguuuuguguagggccccuaugcuugcacacuggggaucagacuucuaccuucacccaugaggcuuguuugcagcaaucaaaaucuggccauagauuaaucaacauccuggccuuuugaugaaccugccacaugcagacaggagagcugcgcaaguguauagguaaggcugugacauuagaggaacuaccuaaaacaggggccacagcagaugggcauaacugcagaggccuagaccagccucguuuuaauaaaacaaaaaggggagaugugggaagcaguuucugcugugccuguguggcuuaauugguaaacaagcaaugugcgcaugugcgagaguguuuucaugccaagucauggcccaucccgggacgugguaaugaggcucugggagagcagccaaucagguguggacacgccacacuaaggugucuguaauaaaguugcugcagaaggaucugguuucucacacguguguucuugcuggugagacaauagcgcgugugagaauuugggguguuaccucuccugagucagaacguuguggucuuucaacacacacacacucagucguauguaucaauuuucuuaaaacaaauaagaauacagaccuuugagaucuguuauauguuuuauaccccuugagacaaagaaguaauuaauaucaccaugccuuacagagcucugaugucugagugcacuaaauaugaacauauugcca

SEQ ID NO: 5495 - RNA, 1523 nt, Mus musculus
cauggagacuagcuccgaggcagguguucugcagaagcugcuggaucgccuuugccaggagaccgacccaggaaaaaucuacaaaacgcugaagaaaaugucuucucuuccuucucugugugacugccuugcagagauuggcuucagacagaccaucaaguccuugaagaaacagcaacuccucgugcccuuuguaaaggacuuaguggcccaguggucuacuggguuccugcuuggaccccagccugagcaggcccggcaggacuuuggcuuggagaagggccucacaacggagggccggagcaccuccccagaagagaagccccaggagcaagcaucccaggaaguccgcggacaugggagagagguuuuccuugggcuuugcagcugcugcccaggcagcagcucuugccuaagccagagccgaaaaucgcaccaaagguccaaccguagggcaccucacauucgaagcccgcauccaggagaaaacuggagcccugagcugcagcaagauguccagaaccuggugcaccuaggaacguccagggcgagccuggaggagccuuggcagcaggaaggggccaagccccucucuagaaagccaggggcugggccacaggagcccacugggcuuguguuuggugggcacagaaagugccagccaccaggcaacugggagcaggaggaagccccuggagcugguuccucgugggcuugccucaauggggagugcugcucuccuuccucuucggagcguccacggggcaagaggcagaggugggaacccccguguccagccgaggcccagaguccuccugcaaaggugccucgagaugagucuggaagcuccauggaucugagucccauugcugccagcaccauuccagagacucccuccaguggcaaagccugguucgaaugggaucuugcccaggagacauuuuccucucagcaggaucaagaagccucagcuugggggugggagcucaggaagcagcacagaacccaagucuauucagguugcaggccugcagcaggaccccagcagaagcgcucuggaaccagggaugguggucacugccaggcuggcaaggacaaaguugggcuugggcagccagaagagaaguccuggccccagggccgcaggugcaaggaauccuacagccagccugaggcccccacagcccugcaguuucaggggccccaagaggagaggcugcaaaccgucauaggccgccuccaaagcacaagagccaagaggccucaacccagacagacgaugauggucuccuucaucaccgagcucaagagccccagccaacaaggacagccaggacccacuggggcugccucugcccaaaauccgcacagucuuccugaggcuccugcccauccuccagcccagagggcuuccugccuucuccuuggagaaagaggcaccaaaaagggcccugcuaaaagaccugcuccucucauggccaaggcccugaaggacuacagaaagugcuucuauaaaaggugaa

SEQ ID NO: 5496 - RNA, 762 nt, Mus musculus
agggaugguuacugagcggcauggcagcgccugccgcaagaguggacugcagucuagggaaggggccagcugaaaagauguaacuaacaggcaggcaguuaaauagcguggaucugaaugagaccagcguggucguuggcggcgugguggaauuagccucgagagcucuguuagagccuagcauggccaucuucugaaaggcccaacaagcagccgacugaggcagacacagauacacccuaccaauggacugaagucugggaucccugugguugaauuagggaaaggcuggaagaagcugaggaggagcgugagcccaggagggagaccaguagucucaacuaaccuggaccccugagaucuacagcagaagacugccuguucuggccucagugagagaagaagcaucuaacccuugagagcaagagacuugaggcccccagggaauggggagaccagguggagugggguuggguggggggcaucuucuuggagacgggggagaggaggaaugggaugaggaacugugggagagcagacugggacuguguaaugacuggaauguaaauaaauaaaaguaauuuagaaaauggacaacuaaauaauuaaugcaugcaaaucucuuucugagcacuguuuuuguuaugccuuuucauaaaccauagaaacucauccaugugacccggaaagugccuuaaacucagaccauugccgacugcauguguauguuuccugcucagagcuaugcaaaacuacaaggcc

SEQ ID NO: 5497 - RNA, 12267 nt, Mus musculus
auuuuuuuuuuuucaaaucguuuuaguagucagguuuuauuuuuaaaaucuaugaacuggguaauggucaauacuguaauaaccuggagucuuaaauuucaaaguuuaacauuuaacaagacuugguugcacaaauuuaccuuuuaaaauagcaagaaauauauacaacuuaaaagagucuguuuagacaaaugcccuuuccuuuuccucagacuguuuugaaaagugcaguauaaaagcuuagaugugaaggcaccgcauaaccugcaucccauggcucuccugugcaucaucaccauaaucaaaugaaaauacuguacuguaaauguaauggaucagaacuuugaggaaguauuuacuucucauuaaagaaaauacacuuuuggcccauuuauccuuucuaaaacugcucuucagaaagaaaaaaagaagucuggaaaaguuauguagauuaugucaacuacagaaaauacccugaucuuacacguuaaugagagccagaggauaugggguaauacaacugcaaaugguaagacaugcuucguaaaguagcuagccagaauaaagcuaaccaggccuuucuaaauuacccuuguaaguucggcauuucuguaaacugaaagaaagagcagaucugaaccauuuuaauguaaucuuacacuuuagagaacuuguauuugcucuugccauguugaaaucucuggacaaugauuuauggucgugguuucccaguuuuagauguaaggaagcauacaccauagucagagggacuucaaaggcagcugcauuuguuauauaaaaacuagaagucugguguaacacaaguugugguaagaugcacugggguggccuagaaaaacccugguggcauauaauugacuucaaaucccauuuuaaugugaucuuuuuuacuacagaauggaaguuuucuccucaaauuaaaaggacacuaucuucacaggaauaaaucauuuuaguugaaguaaacuuuguuuuuuuaaaagcuaguaaaucuuauuguccaagaggcuaaaacaacaccuuuacaaccuggucuaauaauuugauauaagugcuuuaauuacauauaaaagagaagaaaauaauauauaugcuuuaaucagauuaguuucaugaacaaauaaaauaacacauuagagaaaaaaguacuuaaaaauaguuguauuuauaauccacaauuugcucaaauacugguuuuucuuauaaacuuucuacaggauguuuuuaaacaaauucuucacauuucacguugacuauguacuuacggaacuucagggaaauaguucuguuuuuaauagcuuaaucuguacuaaugggauggcacguggucacaugcaguccaugugggauucuaacauaacauugagugaguuuucugacguggaccaucccuuugacgcugacgguaaugcaucuguugaaagaagggacuguagauuuggguuacugcucucugcaucuuccaguuuuucuguauuaucuucccaguuaauguggaaucuugugacucugggauuagaugccaaaauauuccuuugaagcuagaaagagaaacauuuaagugguaagcacuaagggaguuagauuacccugugcaaacugggugguucucuuuaucuuucuagaagacuaaauucauaugcaaaggcaucaacaagugaagcacuuacacauaacuaauaaguaaggaccacaauagcaaagggcuaaagaacuauuagccuucagaaacaagguaaagggaagugagggguggggaacauauuucaccccccaacaaaguaccugcucuuauacuucugcuaccuaaagaauacauacgggagggaaagguccuuucguaucccuguuagagguaguuaaauaagugugucuuuagccugguguauuuucagguugggaauaucgcucacugccuuggccauacucuggaaaagucccuagguucaaugcuaagcacuaagaaauaaaauacaauaaccagacuucaaaugaacaauuuuccccaaacaaaaccccuaauuauugggaucuuagcaguaauauauuaaaucucaguuuccgaaacaguaauauguucuagucucuuuuacugccauacaaagguucuacaaagaguaauccuggaucaacagaucuucagacuaugaaaagcaucccacccucaccugcagaaaggagaacuaacucuagucuaugguaaggccuagcagauagaguacuuuaguuagucaccaguaacuaaaccucuuaaccauucccaguggaaaaucuaaagguuuuuaagaaguguuuuuauaagacuauugaaucagauuuuaaugucucagaauuuaacuuguuauuaucagaaauacuuaagaacuuuaguuuaaccuuuaagaauagcaggguaacuauauagucauccuaaauauuaaugaaaauaaccacaagcuggacaugguggcaacuguaauccuguggacaucugagggaggaaguaugccacaguucaaagacagcuugagccucaacagccucaaaaucugucaaagaaauaaacacaaccagucuaaucuugcccaugauuuggggaagagucauaggcaaaacuauuuuuaaucaggucacuacaaacguuaauaccucacauguccuugguugaaaugaaaucccuaacgauauagagaaacaaagggcugcuuuugcaggaagcccuuccauuuuacuaaaccaucagacucaagguacccaccuaacagcaacuccuggggagacagggugggagccaucaaugcaaaugguacaaugauuaguuuguuaaagugcuacaaaacuucagaucugcuuuaaggccacguucaugauauacuaugaaacagcaaccccuaaaaacgggauaguacaaguaauuaaaagagaagaguaaaaacauuaccuuagaaaagucugguuuuacugguggguuuucccuuaauucuguuucaguguauucauuauuuacauaguagccaacucuaauaaauucuugaccucgguaggugcaaguaaucagaacaacuguuacccccacugcaucugcaucugggaugaguccugcauucggugcaucagccuagaguaauucagaaagaaacacaaaauggcuguuagugcagcuauagcagcaaaugagcacuaauuaccuuagcacuacuugaaaccauauuaguggggagaauguuuuuacaauuuauuucuggcuuuuagaggcagaguucugcucuagccuuggcuggccucagauucacucuguucugccuccugggugcuagaguuacaaguggacaccaccacacccacccaacaaaugaacuuuggugggauuugguuuauaccuagaaaauaguuuauaccuagaaaaugucucucuguaguaguacugguuacuugcagguauaauuauagcuaaagaaagaaagaacucuggcuuuacuguaugugauuaauuacauacuauucauuauaaauuccauucuuuauaaccaagucaaucauuguagugauccuaaccuuuuacaguccuaauuuucagucccaaauuacuauguaccaaauuaaguuucauagucuauucuaguaaguguuuauucuauuaguucccucuucuauccaagacacguaaguucuucaguaguaaccccucuaaacugacagcagaggucagcaacguagcucaguucaaucccagcaccagcaacuaagaaguacauauaaauaaacagugaauacaaaugacaauggaucugaaaaacucuacagcaaaguuugaaaaaaaaaugaaaauccuauuguauuugagccauauacauuguggauauucagugcagucaaaagacuguuucaguagauuacaccaaggaccaugguuuaaaucauaaugaaccuaaaggaauuaagaaagugaaacaacaaaacuagaagacauuaaaaaugccagaaaaggcuaggguuguguccacaguccucaucagcaagacuucugagacagacagacagacagugaugacugaggcaugcaaguacaaccugaagcauaacucugcauagcaaacaaaauaaauucuagcaucauauccuuugcauaugaacacuucaguaaaugcuuuuagcuuggaaacuuuuaagacauguuuauuguauauauagcacauagcugacacuaaaagccauaaaaaucaaccaagacuaucagucaccuucagcuuuucuuauucucuucccuugucacucucaacaucucaugucuaaagguuggguguuccuucaucuguuaagcagaacgcugcuaacuuccauuucuuacuccucucgguuuccagccugcuguuuauaucgcugccaucuaaacaucauccauuucuagcccuuuggcagguuuuaaaccuuagaugcuuuuuaguuccuuaggcucguuacagcuuuguaauucucgugugugugugugugugugugugugugugaagcauaaguucuguaagaugagcuggaaaucuuucaagucucugugcuucaaugucuugacaucuucaucaaaccgacuuuccaaacaaaguccuuucugauucacaagguagcaguuucccuuuuuauguguuugucauuugacacaaauuuccuaaucuaugucuuaaucuaaaugcagcuauaagaauuuauuauuuuagaaauuucucauuacucacuuccuguccugaugaggguauaugaucccuguggaccaaguguggggacauagacccugcuguaguauauacaguauguccuacaaaucaacaucgcagggugacuuucagggacacucauauacccagaaaugggugaggauggaggaguucaguugcuaccacccagugaacuaguaggaaguucaucuauguuaaaaauguuguuugccaaaggauuuaauugagcaaauuugggugaagaaacgugcauagcucucagguuauuaaggcuggaaaagugauggggauuacuuuuguugacccaauccaaucaguacugggcaggugucuggacaucucugcuagucuuagacccauuccuaaggcagucagucauauuugauuauacuacgcaaaauggcagaccagaaaaauaagacacuuugcucauaacacaaaacaaaaacugccuuaguuucauuuuguuaguaacugucagacuuugaaaacuucacagucuaacacaugaccuaaaucacagugcuuucucuguucuuuuugguaacauuuacacugauagcaacaaaaagcugcauacuucuaugauauuuaccucacagcauugcaagucaaaaaggcucacuuuaaaaccaugauguacaacauuuuacagcaauacaaagugucuauauauggcuacacauuaagcugaccuucuuuuacuacaucaugaauuaccagugcaguauguaguccccaggauuuugggugcaagggaauccuggcucuuuacauaaugagaauaaauuaauaguuuaauuaauuauagauauagcuaguuuugucaguaauuugcugauugccuuauuccucauaauacucauaugcgguaggucauuagugggguccuggaucuuagugagcagaggcaucaggcugccugagacugcgggacuuccuuaggcagucuguguugcuacggcuuucacaagguuacgcacacacacaacucaguuugauggcacuuuuaauuaaaguauugaagccuuuaaauuacuauagcugagccuuucuuagccauuuguuuauauauacuaaauaauuugggguuuccugcuagaaaacacucaggcccagauucaguucuguauuuaaaaggcagcaucucuaacaauguucucuuaagcaaaucuucacccauucuaaugggauuauuucaaagaaacuaugcauugaaauuguccugggugugaagggaguaagagaggccaagcacaggaagaaguagauuuuucuccuggauuaugccugcagugagauuugguuaagcagaaauaccucuaacaaagauuaaugguucuuuaaaagcuagcucauuacucccugcaguauuauaaauaucucccuuaagaagcauggauaauugaaaaaagucacuaguuuuauauagcaacuuaauaaagcaggagaaauaacacucuuugacagaagauaaugucuaaagcuugggcacagaccuaaacacugucagagguaucugagaacauaauuuauacuaugaguauuucaacucacaaguucuaacaggguaauggauuugucacagugguccucuauaaaaaccuagauaagaagcuuugaugaaguauuagaccgucauuccaauggcucaagucacaugucucuaucugcuaauguugcaguuacuauacuaaagugagguuguugcuaucauaucagcagaugcaugcauguuacugaccagcauuugaauacauguuuggggaugcuuucaucuugagagacaguccauaggacaaacccaaccuuguaugcacaguauacuuguagucugucuaguuccugaaaguaaacucaauaucccugcauauaaucguaaauauaaauccuuuaugauagacacugccugaaaugacagcagacuaaaagugagaauagauaaagcaauuaguuaacacagaaaggguagggcucugagguaguuuagucuauuagaaacauccuugucauauuuaucugaagauuaaucuuaccugaaacacaaacauaugccuuccugcaggaacgggacccacuaaaacagagucuaaaacuugaucguauucuucacuuucugcagagcccacauagauuauuuuccacuccaagucuaggguaaaagaacgaaaaucauuauuucauagcagcaauuauauauuaacauaauaaagucccuuuuguugaccacuuaacugcuaaauggcuucuuaccagagagauauagaaauauuacuuauauauuucucaccagaauucauauuucaucccaauaacuucuccaaauguuucauaaagcacuggucccuggaguguuccucacaaguaaaacaugaacaaaaauuggggaaacauuaaauguuugcuauagguacucauaaagcgaaguucucagagaccuccuuuaggaaagaacacugggagcgauaaucccaucgcccaggcucacggacuaugcaaucccccagccucuuuuugagcuccauuuuuaacuucaccccuguaaaaaagcugcucuaugaaacagaaaucaucccagaaucuaaaguggaaaaaucauuagcaaaccuuccuugugguucagaaguuucagcucaucuccugacauaaaugugucaaucuguuaccugaccacucuuacuaacuaacagacuaacuguguacuuaccacuguauuaaacaccaugccaacuggaucccaaccagacacaguggugcucuuccugccugguauuccuuucugccauacauucuuaaaacuagaggaaaccaagcuccuauaccucuucuuauagcagaguacuuacauagcaaacaggcaaggacaugauacacucaagcacaaccuaagacuugccuuguaauucaaccuagauuucauuaaguacccuuuuagaaaacucuauggagaacugagaagauuaaaaccauugcucuuugaaggaauguaggaaucugcucuuuaaacauaggaagacgaugacagacaaucuccuauagugugaucuaugcuuagcuucguuauagaaagacuauacuaagcacucccaaggggcugaaucucuaguucacucuggagaacgugcacaaauccuuccuguguagcuguguagguaucuccuagaucuguaagaguaccggcacuccuuauacuauacguguaaaaucaaacuuguuaaauugcaacuucccuguuuauuuguaauguuuuaaaagccaguaguuacuauuauguccuggcuccaucauagacuaaggcuauuuguauuuucagcuuucaguacauuucagauucaggguucuacaccugggaucucaucaggucacuuauuugcuguuggaucuaggaagaaacuauaauauuuucugacuagaaagaccagcaaaaacagccacaaauguaaaaaaccugcuugguguguucaagaauaagccaagaagcugggauuuuggaacagagagaagcuacccaauccugaggcugggguggggagcaacacacucacaucauaccaggccugaugaccaccauuaaggauucuggcuuaacacucagcagcaccauuuuguuguugugcugggcaucaaacccagaacuuucacacauucuaggcacccacuuuaaucaccaagcuacagccccagcugugacccuguaaaaguuccucaagguguggugacuauccaaccauagaguuauuuuguuucuacuucauaacuacaauuuugcuauuguuauguagcaaaugaacuguaacauaaacaucuguguuuuucagauguguagucuucugggagucauaacccacaaguugagaaacacugcccugaagguuuugagcagagaaguacaggaauccuccuuuuaucuuuaaggauaauuuuacuuacugugcuuguguaagcuguaugagggcaggagaacaagagauuguuucaacuauucaguacagaaagcaugauggugugagugaguuaugguggccauagggcugguguaaagcauucacauccuagauaaaguuuggaaauagaagcagcaguagccacuuuggggggagagggucuguguaaagaacaaaauaaucaggaguuaguuuuauacgugucuaagaugccuauuagguguuuaauuauaaacacaaaaaggucaaauuuuuaaaaauugaacuuuggcaauaaaccauaaugacaaggauaggaauggaaccaaggagugaaaugagccuuccucaacacuaaaguuggaaggcaagccaggaagaggaugaaucauuaaagucguuuagaaagcuagcacccaaugaaggaagugacccaaaagccaaaugaagacacagcuaaggagaggguauaugaaagcuacugacuuaucuaaaguaaacauuuuaucauacaguuagaauuauucaagcacauauauauuuuguguuugugugugcacacuaauaaaaacaagaaagcugagacugggcgaagguaaguaaucuaaaauucaguuaaagauggguugcugcuacucaaaaaucauggcuuuuaagccuugcucuuucuagcuuucaaguaauagguuucaagaguauagaagagaguggauaaggacagguaauggagaguggguuaauccagccuuacuaagaacaagggacgggcacagguugagucugagugcgaugccaugcuuauuuaucaauguguuuagaagccgguuucucuuuucuaugccucuguauucuaugaguuauggugaagggcuguggcucuacaagaguuucaaucugaaaauuauccauuuauuuuaaaaguuaacuuuuccauuuacucaugguaaucccagccagaaaauaucuccauaugugguggaagggauacuaccaaggaaauuuuaaguuaauuacauuguugggaaaaucuguggucuaguagaaaauauacagucuuugcaaucagaacaggccugaacuuucaaaguauaaagccacagggucaauuuugaugcacugcaaguauuaagccuuagaaacugaaggagggccaauuaaacguauaggcuuagugaucaagcauaauaaagccccuacuuaaagucucuuuaaaaauguuuaaguguguuucuguauauauggguacugauguggaggucagaggacaacugguuggagucaguucucuccuucuaccaaguggauuccugacaauaaggaggcuaauugguacguuggagguagacacaaaucauaaacucaaaauuaccuguagaggaauuucuacguugaucaguaacuuaacaagucacaguacaacaaaaguaugggcccuagaaacgagcuucugcaggguaaaucaacgcccaucuccuugcuccacagagccucuagauggaguagacaggaauggcaccuuugucaaggguuccucugcagcuuuggaaugacucagcuuaaaauaccuuaaaauaauggugcgcugguuuugaauuguacuagaggaaggcauauucuugacuugaguaauaacacuguugugaaaggaucccuguuuaacauggaacccuguuugguuucuguggguggcugguuucgaacuauccaguguaaugacucuguaacaauauccuagagccuaucuuccucauacaauguggaccuaaaauggaagccaucauaugagaaacaccuguaguguaaagaacuucuaaugccucgaacacugcacugaguuaggauggacucagccaugaucuuacuuuauauuugaucauuuguauauaaauuggcaguuugaaaaagaaaauuaaaaucaguguugggguuggaaauaggucugauguggaaaugcuguuacauuucaaauggaaaacacccuuacacuuacauuaaucaucacagucuauucagagacuacuauauuuuaauguuuagucaaucuucaaaauaugucccacucacuaaauguaugcacguuauaauuuacauacguauuaaaaacagcaggguacguuuuaagugaugguuagccaaaggagugaagagaaggggcugugacuuccuuuuuacaauuuuuaaagguuuauugcaaugguuuuuauaauuaaaguuaacauucuacaugaaguacauugaagagauuauaaacuuuuaaauuaaaagagaaauucuuuucgucaugauuaggauaauacaaggcauuuugucgaaauacuuucaagucccaagauguccuccuaguuaacuaaaauuuaacaccaaugaaguuaaacuuuuuguuucaaauguugaaaaugaagcauugauuuuaauaaaaucuaagaaaagcguuaagaagccauauuuuagcuuucuaaguucuguauuaccucacuauuucgcauuuuuuaaaccguaaaauguacuucagaaaggauuuugccuucuaucucccagcuaacguuugcauuuucuccaucugcuuggacguggaguuauuuuaauugcuucuucuucacacguucuggagaaagucuuucagacuuucuaaacgccagagaagugccuggaauugguuaagcacccugcuucugcucuagggugccauggaacuucccagccccucaccauuucucuccgagaggucucuguccccggggagaggcggcgcacagcaucccgggcgcccgcggagagcacggccgccccccgggagccaggcgccgaggggccgagcccagcgcccgccuuccgcgcugguugguggagggagccggagagcggcgcgaggacagccucggcggggcucgggcgggaaggcgcgggcccgcucgcccccggcgguccggagcaggcgucgugccgccggguaagauggcuccgcuucccaccggcccagcuugcuccccaccgggccguggggcccuggggccgccgaggccgcacgaccccccgccagcgccgcgcgagccgggggccgccgagcgccgcccgccgcagacaaagcugacaacauggcucccuccgcccggcaaguugcucgcaaguugcggcgcggccggcgucccucaacuucaaguuucccucgcauggccgcccucccgccggccgccggccgcggcccaccccgcgcgaggccgggccgggaaacuuuaacguccgccgccgcaacugacagcccggcgccacucgcucaccuucagacagguccucgaugcacucgaaggugaucucgaacuggaacggguuguagaaaggcgacggguuauccagcaccacuacauuguucaccugaaccuuugccauauuuugaagaaaacacaaacaauggggccggggcuggcggcaccaccgagucccgcgcgcggccgcuccgagagcgcagacccccgccccggcgcggcgcggcccgacgucgugcagcugcgacuugagaaacuuuuuuuuccuuuuuauuuacacggcggcacuccacgguguuuugcagcuuuccuauuucacuaaacuacagcccauucugcccugauaacuagcag

SEQ ID NO: 5498 - RNA, 3466 nt, Mus musculus
gauuaaagcuauccauacaagucauauaaggcuuuauucuauuuuuuaaaguacuuauaaauguugaggauuuuuaaaagugguuuauauauaucaagccaugauuauauuaacugaauaaaagcauuuuuucauuuauguaaauuucaauggcuuaguggaauaucuaccuuaaaaugaccauguacucaaauuuuacacuuaauagaaauggacacaugccuguccuaagguagguauuuucacuggacagacaaauuucuuuaguaauaaguauuuccuaaauacauucuuuaagcucagcauugaguaaagugccuugcagauagcagaugacggaaacacaguuucuaaagugcuucuguuuauuugcuucuguacucugugguuuuagagcuguacuacuagcauggcuuagaguaucaguauuuuaguguguggguucacugguuaacagcucuguguguguccugcuugcugcacaggagcuuugugccauccagauaguguugcacgcuugaagcagucugugcuucaagugugaccuacagcaguaacuccuggcagauggcauauuugcugucuaccagcaggagaaucagcaggcagaugacugcauagcaguugacagucacagauggaaaccagcuuggagacauuaagacacacacacacucucucucccuuucccuccaagagagcuaauuaggcuuguaguauauaaccacugaaaaacuagugauuucuuucaucuuucuagaauuagagaaaguagccucugauaaauauggauauagacuaaguaugaaaaacccaauuagaaacuacauuuagaaaauagcucuagaggcagcuuuuaaaauuaauuucuugaaguuacuauccuaaguaauagguuuuauuuggucauuuucaaaccuuugccauuuuaacucacccuccaacaagcaggugagggccucccuugcccucuacauguucguauuucucagaauguaucaguagguacugaccucuaacccugguuccugcagcaucaguucuuugaauuccaccagccaguaccauggccacagcaagcuucacuagauacaucccaaaaacuugaggacacaagcuggccaauauuucauuccucccugggaagugagaaaggucagaaguuaucauuuucuaggaccucaaccugaaaucucccuggccuguagccauuuucuuaauaagcacacuauuuguuccaaucuaagaugauaaagaaggccaagucaagugagaaaagagaaagaggagcuuuguuuagauucggcuuuucuuuuucaguuugguuuuugagaugguccugcaagguagccaaaggugguuucaauccuguaccagucucccaaguguugggacuacaggucuaugccaccgugcugcacugauccuguuuagguuucaaauuuagaaucuuuucaguuucuauaaauuugucaugcugaauaaaaaaggggggcuucuuuuucucuuucaacuuguagcuaucaagccagcacuauuccuuaacacaaugcagccucguuuucuggaaaugucacuaucaccccacuacuuagguaaagaaaaauagccucagaaaugaggcacuguaauaacuagugucuucuauagaggugagcuggggcuugcggagcuucugaaagaaguaaaauuaauucaccuugcaaguugacuuggcauguguucuugauugagaaauugguuguuuuuuggaauaaguuacugugguaucaguacauuaagaucacugcaaaauagaacuccaauaaucccaggugaaguucuugaaguccaauuguguguuuuaaauaaaagcaacaaauuugggaaucauuuuaguguauucauaaagaaagcauuucauccauucacuggucucaucaguuaacaagauucuagugaguuuucccugagccuguccaugcuuuauguacaaagacuauuuuuaaugagucaaucuuuuaguuugggaaauagaaccaacaacugagcuacuuccuauccuguaguggcucaacaaugacucaguggcaaguaccugauggugaugagcccuagaacagcaggaauagcaaaccccuugauuaaaaggaaaccagaaggaugauguagaaaauguugaagguguguuacuaguagaaggacucuccuuuucuagacagaaagcugagagaaaagaggucagggcucuaagccaagaagacuugagauucugauuaaaauccaaggguuacacauuaaaaacagaauggaccuaagaaccaaguuuaagaguauguaaggugagccagaacuaucuaucacaugcuggcagaagccacacuccagugguaaagggcacagggucagaaucuagccuagacacacgucccagugcuuaucuugagcaagagccucuacuuuucugcuuuacugucucucucccuucuccauggcuuuguaauggaacaugaugcauucaaucccuuccaaauuucuaguuucagacuauguucuuauagugucuguggccaagauuccucuuuaccguuaccuugcagaaaaccuuucugguauaagauaaucaaaucagcacaguaugaguucaaaugauccagcagacccaaguacuaugcuuggggucccaucagucuccaguuucaggagacaaaucaaaccccaagagaagcaacacugccugcaauagagagacgcccuuuggauucagcuucucuucuccacuccagcaagaugcacauacaacuucaaaauggucaaauauacaauaucccaaccaguaucuacgaccauaagaggggaguucauucauacuaagaaauguugccugaauuucacagugucuuccuaacuuauaagguuauuuuauguaauucauucuuuaucugacaaaugaguugcauagcuacaacuuccuaauuacaggacagaucuucagucaucagcacagggacuugggaauauccagggcagagugcgguguaaugaaggcagaugagcuguggcacuguaauggauaaggaaugaacccgaccugaaccuaacaacaguucaguuaaaaacuacacugaaaaauggaugauuuuaaaaguaauugcuauguaaagccauagcuuagagaacuuugggcuccuuuuuauacugauuacauaaaaggaagaucagagaauucuacguauguauuguacguggaagauuuaaaagaaaaucccacaaaauaaaagcaaacuguccuauagaugaguggaagcuuuacuuuguaaaauaagugucuaguuuggcuugugacuugagaauaaaauaauauacauuagaauggagauauaaguuuauuuuuuuugaaacauucaaagaagaaugaaaacaaaauuuaauucauguuuuauauauguggggcuuuuuuucaauaaaaaauaauacuuucuaaacu

SEQ ID NO: 5499 - RNA, 2251 nt, Mus musculus
cacagcaguuucugucacuaugaaagcuggagugaaacuuccuggugaguaccagcuugauuuuccaucgcccuacagcucaagcuugugaugucuuuaacgcaggaucuuaucaucaaguucuggaacacaacuaagaccaauaguaaugacagcaggaguuuuaggaguuuacuguggugguuugaauagguuuggaccccauagacucauguguuugaaugcuuggcccauagggaggggcacauuaggagguguagcuuuguuggaguaggaguggcuauguuggaggaaagaugucauuguugagguggagaguggggguuuugagguguccuauacuuaaucuaugccugguguggcacaaucuuuccccugcugccugcagaacucucagcuccaucucuagcacugugcaggccuguaugcugcccugcuccucaccaugagggaaauggacuaaauuucugaaacuuaagccaauccuaauaaaauguuauccauuaaaagagucacuguggucauagugucucuucgcagcaaugaaaccuuaacuaaggcaguaaccaauugcuaucugauugaauuuaagaccuguuucacaagacagaauuguuaguguucuggcagaaugucugugagugucaucuggguuaaaauccuaugguuggguggaucauaggcccuaggggaaaaccuacugucauucuguucaauuaacaacguauuaaacugucccccaugcacuucgacgugucaguaucugcggcuuucaauucucagcagugaagcuucauuuaugcaguagaugggauuacuacagagacucacaucuggucagagugcagagaauaagaagcuauagaguguucaacuuaaaugggacgucuguaccacacuccuuagccacaggcacaggaauggacucagaagaagggucagaaagauggcaagagcuaaggguguaagacugcuuugaugcaaguguuuuauggccauuauaggaccacugcaaaugugaacucacagugggccaugccagaugaacaagaccugcacaagaccaagccagucaaagucccagcauaaauggagcucacagaaauccuaccucuggcaacuaauggcugcuaaggggaaaagaggcaguauucuugggguuucguucucacuaggcugcccaaguuacacugggcggcccaacacccauacauguacuggaagccucgguacucaguggguuuaaauacagcucaugaauuugggagggaauagauauaugagaaaggcuugaucaaagcacauuauaacacauucaugugugagauucucuaacaauaaucauuuuuauugcuaggaaaaucucuaccgcugagaguggcggugguauaaacaguacaagucugaugacgcaccaggucuccugauaacgacagacuggggacugaggcaaacccagcuucgauggcacagggguaagagaagguagcaucaggugaagagugagcgggaaugagcagaaagcagcagcagauacuucuaacuauauuuaaacauugauaggaaaagggagaggauaacccaaacccacuuguuuggugggagaaacaaucccugggguucuaugaaacugcccauaaacaagcugaagcuguggccaacccaaugcugcuguaagaauuuucacaacuugauuggagucaucuuuucacuuuuguaaaaauucccuaggauccagacaccauacuauaguccuguggucuuagcuaccggggaggcuggcauagaggguuacaaguucagggacagccuuaguggagacguaaagaacccugucucacaauacagagugagaaggaccuggggauagagcccagaggcagagcauuuccccagcacagguaaggcccaggguugcaggcauuuaaaaaaaaaaaaagcccaaaaaacaaaaccaaaaacuuaaaccagaaaggaaggaaggaaggaaggaaggaagaaaggacagagaaggaaauagagaaggguaagggagagaaagaaaaaaauuccuaggaguauaugaaauaacauauuucauuuauguaaaaaguguguucagugugaucuauaauaaaauauauaucccauucaauuucugguuugaaauaaauagaauuucuuagacuuuuuuauaauauagauuauuacccaaauauuuugaaugcauacauaaaauugcauagccuaccuuuaaacucauuuccucaaa

SEQ ID NO: 5500 - RNA, 2251 nt, Mus musculus
uuugaggaaaugaguuuaaagguaggcuaugcaauuuuauguaugcauucaaaauauuuggguaauaaucuauauuauaaaaaagucuaagaaauucuauuuauuucaaaccagaaauugaaugggauauauauuuuauuauagaucacacugaacacacuuuuuacauaaaugaaauauguuauuucauauacuccuaggaauuuuuuucuuucucucccuuacccuucucuauuuccuucucuguccuuucuuccuuccuuccuuccuuccuuccuuucugguuuaaguuuuugguuuuguuuuuugggcuuuuuuuuuuuuuaaaugccugcaacccugggccuuaccugugcuggggaaaugcucugccucugggcucuauccccagguccuucucacucuguauugugagacaggguucuuuacgucuccacuaaggcugucccugaacuuguaacccucuaugccagccuccccgguagcuaagaccacaggacuauaguauggugucuggauccuagggaauuuuuacaaaagugaaaagaugacuccaaucaaguugugaaaauucuuacagcagcauuggguuggccacagcuucagcuuguuuaugggcaguuucauagaaccccagggauuguuucucccaccaaacaaguggguuuggguuauccucucccuuuuccuaucaauguuuaaauauaguuagaaguaucugcugcugcuuucugcucauucccgcucacucuucaccugaugcuaccuucucuuaccccugugccaucgaagcuggguuugccucaguccccagucugucguuaucaggagaccuggugcgucaucagacuuguacuguuuauaccaccgccacucucagcgguagagauuuuccuagcaauaaaaaugauuauuguuagagaaucucacacaugaauguguuauaaugugcuuugaucaagccuuucucauauaucuauucccucccaaauucaugagcuguauuuaaacccacugaguaccgaggcuuccaguacauguauggguguugggccgcccaguguaacuugggcagccuagugagaacgaaaccccaagaauacugccucuuuuccccuuagcagccauuaguugccagagguaggauuucugugagcuccauuuaugcugggacuuugacuggcuuggucuugugcaggucuuguucaucuggcauggcccacugugaguucacauuugcagugguccuauaauggccauaaaacacuugcaucaaagcagucuuacacccuuagcucuugccaucuuucugacccuucuucugaguccauuccugugccuguggcuaaggagugugguacagacgucccauuuaaguugaacacucuauagcuucuuauucucugcacucugaccagaugugagucucuguaguaaucccaucuacugcauaaaugaagcuucacugcugagaauugaaagccgcagauacugacacgucgaagugcaugggggacaguuuaauacguuguuaauugaacagaaugacaguagguuuuccccuagggccuaugauccacccaaccauaggauuuuaacccagaugacacucacagacauucugccagaacacuaacaauucugucuugugaaacaggucuuaaauucaaucagauagcaauugguuacugccuuaguuaagguuucauugcugcgaagagacacuaugaccacagugacucuuuuaauggauaacauuuuauuaggauuggcuuaaguuucagaaauuuaguccauuucccucauggugaggagcagggcagcauacaggccugcacagugcuagagauggagcugagaguucugcaggcagcaggggaaagauugugccacaccaggcauagauuaaguauaggacaccucaaaacccccacucuccaccucaacaaugacaucuuuccuccaacauagccacuccuacuccaacaaagcuacaccuccuaaugugccccucccuaugggccaagcauucaaacacaugagucuaugggguccaaaccuauucaaaccaccacaguaaacuccuaaaacuccugcugucauuacuauuggucuuaguuguguuccagaacuugaugauaagauccugcguuaaagacaucacaagcuugagcuguagggcgauggaaaaucaagcugguacucaccaggaaguuucacuccagcuuucauagugacagaaacugcugug

SEQ ID NO: 5501 - RNA, 10665 nt, Mus musculus
cuccugggcuucaaaagcagucgaaaacugcggggugagaaaggauugcacgguuggcuaggauucccacagcgagcaguucgguugcaguuuuccugaauccccaccuugaugagguaagcuuuucagagaugcagcugcuuuugagcuucccugaccccacugaccagcacuggauucuggauuuccaucccauaauuaguugucaaugcccucucugggcuaagcagacauagacugugguucucuaaauacgucucaugggacaaagugucuggagagguauucuagaggcauauguuagagguauuuugccacauuuccacaucucauagcacugaacaauaagggaauuguuggcuauagggaacuaugccaccaagaguaagcuagggucuagagaacccccuuagcaaguccugagaacacccaucuagcacccaaaaccaacacaagauuaaugcagcauaguggggggcucaaaccccacaaaauacagccuuagacacagaagccuauaagcagcugagacugaauaggaaacaaaaguagauauaauguagggaaguuaaagauaccaguucaaacuucacaguagacgggagaauuuuccagcugggcuggagagauggcucagugguuaagagcacuggcugcucuuccagagguccggaguucaguucccagcaaccacaugguggcucacaaccaucuguaauauaauuugauucucucuucuggugugaaugaaauaaauaaacaaacaaaucuuaaccaauaauaguaguaguaguaauaauaaugauagauaauuguaccaggcaugcuugucucuguaaaguauaaacucuauaauaaucauuagauuuuuuugccaucuguacuuccuuucucaucuaagguacuuacugauuuugugauuuagacuacauguuuacauauaggaagagauuacaagugaacuugggaaaaacuggaauucaccagcuaugggacaacaguuaaagacuuuuugauaaacuacuuacuuaaacuguaggugagacaguguuucauuggaggauuuuaguucucucaggcuuacaagacuaaagcuaaaguacuuggugaugccugacaagaauuacuguaaauauuagacauuacuauuaaagauacuauaucuuugugacaauacucuugauacaaauuauuuccagaccccauuugaaaaaacuaagcaaagaagugauuuuaggaauucuagaaaaaauaaauaugggagggaaaagaaaucacucuauaguuuugagaauccuuaccucaguauuucucaaaagugagcuugccaaacuguggaaguccacagcugccaggcugagguagaggcuucagggacucugaagacaaacuaacaaggauugaacugauuucaaugcagcuucuuguugagaggucucuaaucuuuaguauuccuauacucuuguaaauccaaaaaguuauguaugagugcuccccuaccaccccacuaaagugcuaaugcauuuaucuuuagggccuuucuuaucuagaaaauggcuccaucaaagcaacagagggauccaggaaauaggacaguagcuaugcuaugguaguuaaguugacuaugaaugcaacagguuccaaaaacacauaggagacaaacuucuggacgggucuauaaaggauuuuugagacuggcuugggugggaaaacccaccugaaauguagacugugcgguuccuuagauuagauuccaacacuaccuaaaaaaguagacaggaacugaauagagucuccaucacuuugcuuccagagugcugaagcaauguaagcagcuaccacugugccacaguccugcugccaugccuucuccaccacggcaggcugccuucaaacugggccagccuaaacccuuuacuucuauuagguguuuguuaugucauucaaugagaacagucauuaauacaguggugugugggguguguguguguauguguguaaccuggauaaugguauguggaaccucggcaaugaaugcauuaggcauuguagucucuggaaucaaagagaccagauucaaauuccagcuguacaaauuacuaauaucugaagucaauagcuuacuuugugcccuauuuacauuagcuauuuucuaaaggauccugaaaauaacuaccuuaggggauuguuccaaaaugacaucauuuaaauuagaaccagugcacagcuccuagaacuucauggcacugaguaaacgugauaugguaugggggaaggaaugguuuauauuuggggauauucucaagaaaccuuagaagauacaaacaaaauaaggcaccuacaaaaccauacagguauugaagaaaaaaaaucaaguuaugggaagaauaauguagccauacuguacuguuacugaacacaucaaugaauaagauuuauauaaacauaaugauguaaggcuucaaggaugaucccaucaagaacaugguaaaaacuggagggaggaagggagagaggggaaaaguaaguucuaaccauccagauaccuagagaugagagacaagaaguccaacuuggaaacaucaagacaguguuaaacauacauucaguuacuuaaagaccuaaauauaacccaaucacaaaagaacucacaugauauguacucacugauaaguggauauuagcccagaaacauagaauacccaagauacaagauacaauuugcaaaacacauggaacucaagaagaaugaagaccaaaguguagacacuuucccccuucuuagaauugggaacaaaacacccacggaaggacuuacauagacaaaguuuggagcuaagacaaaaggauggaccaucuagagacugccauacccggggauccaucccauaauuagccuccaaacgcugacaccauugcauacacuagcaagauuuugcugauaggacacugauauagcugucucuugugaggcuaugccagggccgagcaaacacagaaguggauguucacagucagcuauuggauggaucacagggcccccaauggaggagcuagagaaaguacccaaggagcuaaagggaucugcaacccuauagguggaacaacauuaugaacuauccaguacccccgagcucuugacucuaacugcauauguaucaaaagauggcuuaguuggccaucacuggaaagagagacccauuggucuugcaaacuuuauaugucccaguacagggcaaugccagggccaagaaaugggagugaguggguaggggaguguguguggggggggggguaugggggacuuuugggauagcauuggaaauguaaaugaagaaaauaccuaaaaaaaaaagacuuaaauauaaauuccaaaggaaauaauucaguuacuggacagcaggagccucucuggggugggcuaagggaguaggaagggaaacgugaagaauuacucuucaccuuaaaagcuuucccaaacuaguugacuuuuuaaacuauuuaaauuauuauguaaugaaaauaaaugaaaaacaccauuuggaggugucaucuggcccagagguuuuccaccuuccuaaugcugagacccuuuaauacaguuuguguuguggugacccccagccacaaaaguauuuucuguugcaaccuugaaacuauaauuuggcuacuguuaugaauuguaauguaaauauuuuuagacuucacgguaugccaaaggggucacgacccacagauugagaacugcugauacagacaaugaaaucauauuuucucuguguucugucaaccagaacaggcucugcagggaggaaaaugucagucuauccacagaaggccuuugcuuuugcucagauugaacaaauaaacaaauuuaugcucuaaacucuagauuauaucuuaauuuuuugcuucuuccugauuauuuucucuaaugugauacugaauauguugauuuuuguuugagauggucugcaaguggacagacaguaauccacagucacaaagcuguuagucaccccaaaugaguuuguuuuguuuauauuacaaaccugaaauaaaauucuuccugggugaaagacugacaaucuuggaaacuggacugucuuacuuaggguuuuacuacugugaacagacaccaugaccaaggcgacucuuauucguacaacauuuaauuggggcuggcuuacagguucagagguucaguccauuaucaucaaccaacauggcaggauccagacagucauggugcaggcagagcugagccuucaucugaaggcugcuagcagaauacuggcuuccaggcagcuacgaugagggucuuaaaguccacacacacacagugauucaccuacuccaacagggccacaccuuuuaauacugccacucccugggccaacauauacaaacccaucacagggaccuaugaaaguaaaggugcucucagaaacaacucaaaauauacugucagaaauuuagggcaaagaaccagacccagauuaaguccagauuccuaaaacuuucuggauuaccuuguuaaacauuaagacuuccagugagacuguaauugaguccugcuagaaaauaauauucauaaauauucuauuauauauauauauuaguuacauuaaacugaugacauuuugugauucauguuacauauguauauuaaaaucauagauaagagguuuuauguagacaauaaaaacauguucuuaacauguuucauuugauaacuccaguaauuuagaagcaucuuggcuuuccaguauagcccugcauacagagaaagaacaaucccagugcuuaucagcagguaucacuauuucucugugugugcucugauaguuuagcacagccuaccuaugaucaaagcaaaucccaguuagcauagucuaccuaugaucaaaacaauagccuaagaggagauugucucaguguggcuggcaugugaggcacaucagcucacacugacuaugcuuuaagucccuaugaugccaacuccagaagccuggugugcacuaacuaggcgagcuccagugauaaugucugccucauuugcaaauggaaccuacuagacuggcauaggaaacacugaaauuuaagacuaguacacauuaucuaguucucuuucuagagauguaguauacucgcuauugcacauccacccacauucccuucacuucauccuacauuaucuuacaauuugcgaaauuaaacauccccccaaaggacucccgugugcuacaaacguggucuccagugcaacguguagagguggacuuuuuggaacugacuggccauaagggugcuggccuacucaauggauuuccuuucauggauucuuccuugagugaauaacuaugggacaguaggaauuggaaggggagccuaaucugaggagguaggaugucacagaugugccugugaugguucaugucaccaacaccuccucuccugugaucuuccuaagugucauuagguaaggagcuucaccucacccugcccuuccucccaaggacuguggaugcucaaagcugcuggccaugggcugaaaucuaugaaaucgggagucaaagcaugucccuccuggcguccucccucugcucugccuucauucccuccucuccuacucuucuuucacauccuucccuccucuucugcccuuguuccauccuuccuucucauauuccuucccucuccuaucccacucccucuccccuuuccucauucacuacuagaaauaaaaauuacuucaaugugaaauaucugaggucuuugaauaaagugugugauauuauaggcccuuuuacuugcuuuauaaugcaugcuuuaacauaguggaucccuuacaauggcuuucaaccuuccuaaugcugcgaccuuuuaauucauuucuucauguauuuuaaccauauacuuauauucaaaacuaugauuuugcuacuguuaucaauuguaauguaagugucugauauuucugguggucuuaggcuacuuugugaaaggucacaacccacagguugacaauuacugccugaaaaacuugcacaacccaaacuaaaucuaccuuuauuuaauagaaauacuguacgcuucuuuacagcauugcauagcacuagugaggaggguacaggaaugacuguguaaauaggacuuggauaccauagucuccacuugaagacauuucacucucgauuuaguuccuucccacaggcacaagcccuucucucucucucugccacuucucuucugcugcuaaauuagugcauuaaauaaaaaugaaguacauuucauuuuuaacaauacuuuaaaucaauuugugcaccaucucauaaauucuagagaauaggccuuuacaaacucuaaucauacagaauguauguuucacauaaauuugcuuuuguauaucuccuguauucacauauuuggcuauaucuuacuuaacuacauucauuucuuugauauaaaaguuuuccucccacaggguuagagaaaacuuccugccugauagucaaaacccaaaaauggggacacaauuuauacaaaaccguagauaugcacaccaagugugcacaugaauaugaagcuucaaguuuucaauauuuacagauuuguaaaagaaagaacagggacagagccaguuugccaccaggucucugaaugaacacugaaggaagaaugaauggaaauuuugacuaggcuuuccgccuugcccuaaucugaucugagcugcagaaaggaucugggaccuccugcagcuucaguuuaguuugggcuuuuguaaauacaaagcuuugcaaauauauauaaagacaaaguauggacuagaagcacacugaauauacacauuuuguuauauauacauacuggugaauuuauauauuuugcaaaucugaaugcuuaauagaagcugugucugugcucaaugcaaugcuuuacacuugguuaccaagacagggcuaauacagacuaaucacuggcaggugaguuagaacucaucugcaaugcccagcaucuggcaugaaacaaacagacauaaaaacaaacaaaacccuagaacuacuacucauggaagucacuagccacgguagaaagaauugacaaaggacuacacuuaugucuaaaaaacuuuucuaagucuggugugggggugcauagaugcacccugaggaggaaaaaaauuagcaaaguggaaaaaaaaaugaauucccaaauaaaaagaaugcaaaagacacacaaguaacacacacacaaagaauagcuaauagagcauagugcuugcugggaacuuaaauauuuucugaccgagugaacaacugaauagaagaaauagauuccaucaaauuggcagaauggagaaagccacaaccuaugagacaugcaaaaaggguagauagaaauguauaauuugaaaaugugccaauucuuuaacaucgcuaacaccacuuauaagaauuuguuguaaaaaaaaaaaaaaaaguauagcuguccacagauuuaucuaucgguuuuaaauuaaaauguucaugaauccuaauuuuauaaacacuggacagucuacauguacaauaaaacauuaguugcugauugaacaauuagcaacagaugaucauuuaaauuaauacaaagaauagaaaguacuggauauguauauggguauuugugauugugugcacguacauaaauuuuuaaaaugaggaauuuguaaucaagguuauauucuaauuuaugauauuaaauauuuccauaauguaauuuuaacugucucauuacuaaaguuaaucagauuuaacuaguaacuggguuacuaagaauaaguagguuauuugguauaauggaauauuaacgaacacucaacuguguuuuauuacguuaaaaugaccaauuuccaaucuaaauuuauuucuaaaauugguguuauucuuuuucuccuaaaguccuacagaggcugguccuuaagaaaaaacaacaacugaauuucaauucgacucaggaagugcugcgcuuccagcuugaccacugccgcgggcucgagugcugugcagcgcugagaucgucacacgguugcuggggaaaaaaacuggcagaaaguuccagacucugaucuauuugaauggcugagaugggaggugacagcccgagaccucuggcucugugaagacucaugaagucucagguuacagugugagccugccaggaaaacagcagcccgccagaggagcccaggccggaggggcgagagcggcgcguugccagugacgaccauggccacccucggcugcgcaccuaaggaugacggugaggggaaggaugaaggagggagugaucgaggugauggcgacucaaagccuaaaggcaagaaagaaguggaaccccacacaagacgggaagcggacgagcgggccaugcgcauccccaucccggaagugcuccagcagcggcuggcggacgacuguuacuacaucaaccgcaggcggcgguuggugaggcugccuugccagaccaaugugggcgccauccuugagugcuacgugcgccacuucucggcgagcgugcuggccuugggggaccgccggccgcagccccagcgcgcugcgcccgagaggagcgugggccugugccgggagauggcggacgggcugcgcaucaccuucgaccacgcgcuccccuuggugcugcucuacccucaggaacaggcucaguacgaaauggucaccuccuccaccuuuuucuuccccacugaggagcgagccagcgaugcuggcaggagccaggaggcgcccuggccgggcccgucgcccccgcagcccucggagagccaggccguggcggggccagcugcccccaagaggcgcagggcagaggccgaggcaacgcgggcucccaggcgauccacccgccacagcacccacugccacuggcaggcugaggaccgggccucgccccaggccaagcgcagugugcccaagcuguucccgcacuugcaaaagacaccugugcacagcgcagcaccgucccccaucgcucugacuccuggcaaggaagggagugccauguuugcuggcuuugaagggacaacugaggaaauaaaugagauccucuccuggaagcuugugccagacaacuacccuccaggacaccaaccgccuccucccuccuacauuuauggcgcgcagcauuuacugcgacuguuuguaaaacuuccagagauucuuggaaagauguccuucucugagaagaaucugaaggcacuacuuaagcacuuggaucucuuucuaagguucuuagcagaauaccaggcugacuucuuccuggagucagcuuaugucucugccugugaggcgcacuauagcagcaagaaccccaggacacuguguuaaaguuuuaaugucucuguaagcauagcugcuccaccuggcuuuguguucaguguucuagguuggcccaccuugggggagaggggacaggcuuggauauuugaguuccucacauacugcaguuauuuuuguuaacaaccaauuacuuccuugcuuuguuuuguugccuugccuguagggagguaaaguugcuuaauuaguuaauguauaaaaauacaugccauugcacaggcugcgugugacagcaggaagcagccucuccuauguucagagggaauauuccaaacuauacauagguucugcucuucugguagacaucacacaggcuguuaacaagaauuacgguguuuaguuuucuuagcaucaagcaaaauauuuuugaagacucuucuaaugugaugagauuggaggacucuguucagaauauaugaguucauauuuggacacauggcaaucugaaauaacuucuggggaaaacaaacauugacagcaaaagagaauuuccagcucuauaauuuguaaaauucccuuucugugaaacauuuucuuugguuaucuaaauaaagcauuuuugucugacaaaauuauuuauaaagcuucucuauucuuauacaacguuuacuauuuaugccuaaauguaaaguaaaaagaaaaccaacauuucacaaagcagaaagcuguugcacaaaguagauucccuaauuuuguuuuggagaaaacugacaauaauuuuauaugagauacgauacggccucaaugagagcaaaggaaacugaauuuagggggcuuauauuaaaacacuuuacguuugaauguauacuuaagaauuauuauauaagauaugaaucuaaaaggcacguugacagacuagaacuugcuuuccugucugauacaaugaaaacaauaccggaugaugcuguuacuucaucuuuaccaugaaauacgcaguuuuuaauguugaaauaaaacauccuaagaaaaauauuucucuaaauacuuuagauggcuaggaacagcaagccgcuaaaucuugggaaagaugaaagaguucaggcaaaucuuuuaauggacaaauuuugcaaauguuuuuaaaaggugcugaauagcaggguagguacggaaaguucagaaugacucaaucugugggagcaaccuucacugcaaaggucacacugggaaggggcuagggaucugcuggcggggacagagcaagcuuugcccuugaggacaggcuguuuuuguguguggagggaaaagugugcuaaaggccuggaggcaguaagga

SEQ ID NO: 5502 - RNA, 2900 nt, Mus musculus
agaaagggguaggcauguucuguagcccaaggcgccuaacugguagguagugggcgggacuaccugagcagaggcagagguauuuaaggggcaguggucacagccacucugcuggcaguuguugcagcuuguguuuguucugaagcuguccugagucgagucucccaaggugaggacuccugggaggccgucauuggcaccauggcagaagcuggcagcccuguugguggcagugguguggcacgggaaucccggcggcgcaggaagaugguuuggcaggccuggcaagagcaggcccugcuaucaacuuuuaaggagaagagauaccugagcuucaaggagaggaaggagcuggccaagggaaugggggucucagauugccgcauccgcgugugguuucagaaccgcaggaaucgcaguggagaggaggggcaugccucaaagagguccaucagaggcuccaggcggcuagccucgccacagcuccaggaagagcuuggauccaggccacaggguagaggcaugcgcucaucuggcagaaggccucgcacucgacucaccucgcuacagcgcaggauccuagggcaagccuuugagaggaacccacgaccaggcuuugcuaccagggaggagcuggcgcgugacacaggguugcccgaggacacgauccacauaugguuucaaaaccgaagagcucgguggcgccacaggaggggcaggcccacagcucaagaucaagacuugcuggcgucacaagggucggauggggccccugcagguccggaaggcagagagcgugaaggugcccaggagagcuuguugccacaggaagaagcaggaaguacgggcauggauaccucgagcccuagcgacuugcccuccuccugcggagagucccagccuuuccaaguggcacagccccguggagcaguccaacaagaggcccccacucaagcaggcaacgcaggcucuauggaaccccuccuugaucagcugcuggaugaaguccaaguagaagagccugcuccagccccucugaauuuggauggagacccugguggcagggugcaugaagguucccaggagagcuuuuggccacaggaagaagcaggaaguacaggccuggauacuucaagccccagcgacucaaacuccuucugcagagagucccagccuucccaaguggcacagccccguggagcgggccaagaagaugcccgcacucaagcagacagcacaggcccucuggaacuccuccuccuugaucaacugcuggacgaaguccaaaaggaagagcaugugccagccccacuggauucggguagaaauucuggcagcugggagcaugaagguucccaggauagcuuacugccccuggaggaagcagcaaauucgggcauggauaccucgaucccuagcaucuggccaaccuucugcagagaaucccagccuccccaaguggcacagcccucuggaccaggccaagcacaggcccccacucaaggugggaacacggacccccuggagcucuugcucuaucaacuguuggaugaaguccaauuagaagagcaugcuccagccccucugaauuggaauguagauccugguggcagagugcaugaagguucaagggagagcguuuggccacaggaagaagcaggaaguacaggccuggauacuucaagccccagcgacucaaacuccuucugcagagagucucagccuucccaaguggcacagcccuguggagugggccaagaagaugcccgcacucaagcagacagcacaggcccucuggaacuccuccuccuugaucaacugcuggacgaaguccaaaaggaagagcaugugccagccccacuggauugggguagaaauccuggcagcagggagcaugaagguucccaggacagcuuacugccccuggaggaagcagcaaauucgggcauggauaccucgaucccuagcaucuggccaaccuucugcagagaaucccagccuccccaaguggcacagcccucuggaccaggccaagcacaggcccccacucaaggugggaacacggacccucuggagcucuuccuugaucaacuguugaccgaaguccaacuugaggagcaggggccugccccugugaauguggaggaaacaugggagcaaauggacacaacaccugaucugccucucacuccagaagaauaucagacucuucuagauaugcucugacuccccgacaguaccucuugcuucuagaaacccgagaggccaaaguccugaagagacccgauuuggaacuggagaagugacccaucccagcaaggaugugcaucaaaaacccaacuccagugacuucccggaaugcaaggugucucgcuaacuauaaggauugauugcagguggggauaauaaugaagugccuucuccagggcccggggauuaggaaaucagcccugaaagugagagacucugcuacagggacagauggagaggccaauagugacuccucaacaacaaggagccuaaagauaaccccaaaagaagggucacaccaagugacuggcuccaguggaccccaggaaaucccacgggacacuaggacuaggcuucacuacagaggacacacacucccugagggcaauggggagaguggacuccuuccuuggcuuauauggacugcucuuauccuuacagaugguucgugcagagcugugcaagguuuuacaggccagucuuuuaauaucuacuacccauaggucuuuuguuuguuuucuuuuucuuuuucacuuucuuuuucauuuuuuuuucuuuuucuucuuuuuagggguggguuggcuuuguugggguugguuugguuuuguguaguuuguuuccauugcuuucaauaaaguuuauugauuuua

SEQ ID NO: 5503 - RNA, 2027 nt, Mus musculus
cauggcagaagcuggcagcccuguugguggcagugguguggcacgggaaucccggcggcgcaggaagaugguuuggcaggccuggcaagagcaggcccugcuaucaacuuuuaaggagaagagauaccugagcuucaaggagaggaaggagcuggccaagcgaaugggggucucagauugccgcauccgcgugugguuucagaaccgcaggaaucgcaguggagaggaggggcaugccucaaagagguccaucagaggcuccaggcggcuagccucgccacagcuccaggaagagcuuggauccaggccacaggguagaggccugcgcucaucuggcagaaggccucgcacucgacucaccucgcuacagcgcaggauccuagggcaagccuuugagaggaacccacgaccaggcuuugcuaccagggaggagcuggcgcgugacacaggguugcccgaggacacgauccacauaugguuucaaaaccgaagagcucggcggcgccacaggaggggcaggcccacagcucaagaucaagacuugcuggcgucacaagggucggauggggccccuacagguccggaaggcagagagcgugaaggugcccaggagagcuuguugccacaggaagaagcaggaaguacgggcauggauaccucgagcccuagcgacuugcccuccuucugcagagagucccagccuuuccaaguggcacagccccguggagcaggccaacaagaggcccccacucaagcaggcaacgcaggcucucuggaaccccuccuugaucagcugcuggaugaaguccaaguagaagagccugcuccagccccucugaauuuggauggagacccugguggcagggugcaugaagguucccagaagagcuuuuggccacaggaagaagcaggaaguacaggcauggauacuucaagccccagcgacucaaacuccuucugcagagaguccuuuccuucccaaguggcacagcccuguggaucgggccaagaagaugcccgcacucaagcagacagcacaggcccucuggaacuccuccuccuugaucaacugcuggacgaaguccaaaaggaagagcaugugccagucccacuggauugggguagaaauccuggcagcagggagcaugaagguucccaggacagcuuacugccccuggaggaagcagcaaauucgggcauggauaccucgaucccuagcaucuggccaaccuucugcagagaaucccagccuccccaaguggcacagcccucuggaccaggccaagcacaggcccccacucaaggugggaacacggacccccuggagcucuugcucuaucaacuguuggaugaaguccaaguagaagagcaugcuccagccccucugaauugggauguagauccugguggcagggugcaugaagguucgugggagagcuuuuggccacagagagaagcaggaaguacaggccuggauacuucaagccccagcgacucaaacuccuucugcagagagucccagacuucccaaguggcacagcccuguggaucgggccaagaagaugcccgcacucaagcaaacagcacaggcccucuggaacuccuccuccuugaucaacugcuggacgaaguccaaaaggaagagcaugugccagccccacuggauugggguagaaauccuggcagcagggagcaugaagguucccaggacagcuuacugccccuggaggaagcagcaaauucgggcauggauaccucgaucccuagcaucuggccaaccuucugcagagaaucccagccuccccaaguggcacagcccucuggaccaggcaaagcacaggccccgacucaaggugggaacacggacccucuggagcucuuccuugaucaacugcugaccgaaguccaacuugaggagcaggggccuuccccugugaauguggaggaaacaugggagcaaauggacacaacaccugaucugccucucacuccagaagaauaucagacucuucuagauaugcucugac

SEQ ID NO: 5504 - RNA, 1469 nt, Mus musculus
aagggguaggcauguucuguagcccaaggcgccuaacugguagguagugggcgggacuaccugagcagaggcagagguauuuaaggggcaguggucacagccacucugcuggcaguugcugcagcuuguguuuguucugaagcuguccugagucgagucucccaagguaaggacuccugggaggccgucauuggcaccauggcagaagcuggcagcccuguugguggcagugguguggcacgggaaucccggcggcgcaggaagaugguuuggcaggccuggcaagagcaggcccugcuaucaacuuuuaaggagaagagauaccugagcuucaaggagaggaaggagcuggccaagcgaaugggggucucagauugccgcauccgcgugugguuucagaaccgcaggaaucgcaguggagaggaggggcaugccucaaagagguccaucagaggcuccaggcggcuagccucgccacagcuccaggaagagcuuggauccaggccacaggguagaggccugcgcucaucuggcagaaggccucgcacucgacucaccucgcuacagcgcaggauccuagggcaagccuuugagaggaacccacgaccaggcuuugcuaccagggaggagcuggcgcgugacacaggguugcccgaggacacgauccacauaugguuucaaaaccgaagagcucggcggcgccacaggaggggcaggcccacagcucaagaucaagacuugcuggcgucacaagggucggauggggccccuacagguccggaaggcagagagcgugaaggugcccaggagagcuuguugccacaggaagaagcaggaaguacgggcauggauaccucgagcccuagcgacuugcccuccuucugcagagagucccagccuuuccaaguggcacagccccguggagcaggccaacaagaggcccccacucaagcaggcaacgcaggcucucuggaaccccuccuugaucagcugcuggaugaaguccaaguagaagagccugcuccagccccucugaauuuggauggagacccugguggcagggugcaugaagguucccagaagagcuuuuggccacaggaagaagcaggaaguacaggcauggauacuucaagccccagcgacucaaacuccuucugcagagaguccuuuccuucccaaguggcacagcccuguggaucgggccaagaagaugcccgcacucaagcagacagcacaggcccucuggaacuccuccuccuugaucaacugcuggacgaaguccaaaaggaagagcaugugccagucccacuggauugggguagaaauccuggcagcagggagcaugaagguucccaggacagcuuacugccccuggaggaagcagcaaauucgggcauggauaccucgaucccuagcaucuggccaaccuucugcagagaaucccagccuccccaaguggcacagcccuc

SEQ ID NO: 5505 - RNA, 101242 nt, Mus musculus
cucuucggggcguggucaacgccgccauuugcgggccacuaccagcuaguggccgcggggccgccucgucccgcccccuuccugccugggaccggcccucaaaucgacugcucgccgccgcagcgagggaagagggugcggccgccgcggcggggacugaggcacagacugacccggcguggaccgcggagaugcugggcguggcggccggaaugaccaacagguacgggcgcgcgcgcgcucugcgacccgccgcugcccgagccuccucugggcccggcccggcgggcgggcaaccuucgccuccgcgcggccugcggcuggcgagaggcccggacacacaccgcccaagcccgaggcgggagaggccuucaugguccugcugagcuguccugugcggccuagggguguaagggcagaugcugucccagaguuuggcuaauaguacuuuacauucuaccgacaagaagaauggaucagagggucucagggucacgcaguccaauacauuuguuauauuagaaaugaaaacggacguguaaaauguuuauucguugaaugauacgugaucuauuaacaugcauaacaauugaaugaaaauagcauacccuaaacagaaaaguuaagacgaacagccugauacauguuuguuuuacagauccuuuccacgucuggcuuaauagaaaaagcagcuggguuccccuuuugcauugucuuuugugauguguuuugaaugaacuauuuaaaagaaauucgauuuuaaguagaugaagagaaauauucgaauggcuuuuccaaauacuuguggguauucuuuaugauucugccagaaguucagaagauguuucuucaaagacuaguuuuaauaugaaacccgagcucacaguuauaugaaaauuccucagacugucuuguauuugaauggaacuguuacucauaauggauuuuuauuggcuuacccuauuaaggaagauucuggaugcuaacacaggguauuaaugucucuaagugagcuucguuaacaucaccaccgguuucauucaguucuuaacuauucaggaagcugucagacucgacaggcuucacacuccagcauugcaauuuucaguggaaaucgcgaagcuuuucucauuaucaacaaaauauugucaguuguccccaaaauuuaguuucaaggaaauguuugcuaagucacuguugguuuuuuuuuuuuuuuuuuuuugauguuccuucagaacaaauaguauuucaagaaaaaaugcuucuaacucagcccaguguuuaacauaauaaugugcucaagcucuauugcuuugggauguagcaggggcacuguccgcacacuuaccauuggguuccaggcaccuaggaagaggaucaagagcuaagaauuuguacaaccacuguacucaucagaagcaauuauuguauuggccauggacauuguccaccuggauaaaggauguguggaauauugauugcagggguuacagaugugaccaccaugugcgccccgcccccauuuuuaugcauuaaguacauccauauugguacacuacuguugcccucagacaucuacaaaacugaagcuguuguacacagugaacaguucuccauuccuuguucccccagcuccuggcaacugccauuuuucuugcuuguuuuaacuuuucaguaucccggauaaguggaguuacacagucuuccuuuccugugccauaguuugcugagugauaacauggauguacagcaguuuguuguacucuucaccugaaagacauuuggguguuugccuuuuuuuuuuuuuuuuuuuuuuuuaagaaauuaaaaauaaaguuaguguggguguucauguacagguuuuagugugaacaugaucauguuuuuccuuucuguaaaauaaaugucuaaauguauaaacuugccagacugugcaguaauuuuacguuuaccuuuuaaagaaauggauggaauguuuucucagagugacuguauuauuuauuucaucagacacuuaaaggagaaauugacauucuuauccuguauguaaagaauucgguaaagcuaucguggccuucccaguauuucuuuuuuuuuuuucuuuuuaacgauauguauguuugugggcaugagcauguaagugcagguaccuacagaggccagaggaugccccuaagucuggaguuacaggggguuugugaggugacugaauugggagcuaggaauggaacgagggucuucuguaauauucauguuuucacccaccgagccaucucucucuucagccccaaaauaguucuugaaugagagcuguaguauggacuuuucauucauagggaguuuguuugguugaguuuuuugagacaggauuuugacuugauuauuaggacuuaaugacaaagagcaacccuggguccuaaaguuccuguaaggcagugccaucaugaacagggaaacucugauggcacuuucuaaaugugccauguccuaugucugcuucugaaguagggaaaucgccuugugggauguuuugcuuuguuuguguuuuuguuuuaagucugggucucauagucuaggccagccuugaacuuacuauuguagccauaguaaccaagaacguaaagcaaccgaggaucuaaaguaaguaagccaagggugauuuuuuaauuucucauccuccucuugaaugcuagaauaaaggcaugucucacccguuuuucauggguuucugcagagcugggggucaaguccauggcuuuauguauguaagggaaguacucuauccccugagguaauauccccagcccugaaauaccuuaguucuuuagcuguucugugcucuacagugugcucuacagucuuggagaaaaaaaguccaucaggauugugcccuuacuugcuuguuuguuuauuaugagauugcacuauauugauuuuagcauuugcauucucucucuuugugugagccaaguggcucuucuccuugguaguucuuuaugaugcuaagugcggguucuggaaaugagcuuucucuccuucccugggagggcucagccucuccuucggguggagaaacucagcaaccuuagaaagccauaaugggagagcagagccuaauucuccaaguauauuuucaguaacacauuuguucuugagacgauccuuuaaguaugccucaguucagaccauaucauugaguaggguugcauuaaaauagcaggaaaaacgugucaaaccacuuguugauuuuacaguucuuacaaccgcucuaagcuaugguuucuuaauucaggaagaccauuuacauugccuacagaaccuuaauguauuccagaggacucagagcuuaaugccuuaagcuauuuaaagcaagaauuauacaaccuguuuucuaaugcuaaaccuucuccaguggugggugguugugguaguuguuguucuuaauuuugugcauaguuguuuugcuugcauguauguguauggacgcugugagugcaguucccucagagagcucuggguucccaggaacuggagcuucagaaguugugagcuagugcuccugauggaugaaccaucuuuccagccuccagcaguaggaguuuuauguccccucaucgugauguuauuuauuucauuugacagcaucagguauuuccacagugaagcuuagugugugugugugggcacauacaugagaggacuauauauauuuuuccugcuucuuuuuucauguugaaguacauuuuggagcuuuaaugagucuaccaacucuuuaaaaaaaaauguauacggguguuuugccugcauauaggucuguguaucacgugcuugcagugcagaagguguggcaaugcaguugguuguaaaccaccuugugcuaggacucaaaccugaguccucuggaagagcagccagugcucuugaccccugggguaucucuccagccucaagcagacuuuuaauauggggacaggaaguuguagauagaguaagcuuugagcaaugaacucuaaauaauguuggcauugguaauuagugcuggccaguuaguaaaauggaagaggcuaggaaacugugauugcugucacaaugugguggacagaaggagagccaggauccuaggacaccuaggagucuagggccuuucuaggauauacaaagaugaguaagauaaaaugaccuacagaacaaaaacauuagccacaucucaaaaggguuuaggaaaucuaggaugagagcagguuuucuguuuuuuuguuuuguuugguuugguuugguauugcuuuuuuuuuuuaacugauuuuuuugaguuaauuaaauuuuaaguuuuuauuauuuauuuauuuaucuauuuaucuauuuauuuauuuauuuauuuauuuauuuauuugguuuuucgagacagaguuucucuguguagcccuggcuguccuggaacucacuuuguagaccaggcuguccuugaacccaaaaauccgccugccucugccucccgagugcugggauuaaaggugugcaccaccacugcccggcaaguuuuuauuuuuauuuuauguguaugguguguguguauguaaguguaccauugccguguauugcccucagaagccagaagagaacguuagauucccuuggaacugcaguuacauguaguuaugaaccuccaugugggugcuggaaauugaacacagauccucuggaagagcagccagugcucuuaaccacugaacuaccucuccaaccccuggguuuuuuguuuguuuguuuguuuguuuacuugcuugcuuguuuuuguauuuuaaugcaaauugguccacuugcaccugaugagaucuaaaauacaggagcuguugucuuuguugcugaguuugaauguuuaucauucauguuguuuguagauauucuuaaaauacuguugggguccuauuacuucauuguguuugaaauauuagaaaaugucucucuuuuuuucucuucuuuucuucuuucuuucucucuuucuuucucuuucuuccuuccuuccuuucuuucuuucuuucuuucuuucuuucuuucuuucuuucuuuuugguuuuuuugagacagaguuucucuguguagcccuggcuguccuggaacucacucuguagaccaggcuguccuuaaacccagaaauccgccugccucugccucccaaguccugggauuaaaggcgugcgccaccacuauccggcauuuuuuuuuuuuuuuuuuuuuuuuuuuuugagacaagagucuuaugcagcccaggcugaggucuccacauaacaaagggguuugagggaaaccaaguccuucagaaacuuuccaaaagcuuuuuucagugcagcuuuacuagaucugggcuugccuguguuggauccauaggcuguacuaguguaacagaguccaguucagccacagucaucugggcgcucgcucggcaugcuuucucaccaguaacauggaggacuucgugugggcacuggaggggaaaguccacucaccacacuagcagauguuuucagcacugugagcuguacagucuauaguuaacuacuuguuuguuguagccuaacagcaaaacaggaauuaagaaaugagauugggugcaguccaauaaaauuuuaaagucucagggaaccauggaacuguuuaaagaaagaggucuaacauuucuguuacuguaaccccagaucagggaagaaaaagccuauuagugggcuaaagacacuaauuaagacacagauuuugauuauguagauuuuaagaaaugacccaaauauauacuuuguacgagaaauucaucuuguauauauaacaguauaggcaaauugaaaguaaaaagauggggaaaaauacauuaugauaauagcaauuaaaauaacuugugggauacuuuauuaauaccaaucauugaagugucagguaaaauagaccucaggacaaaguaaacaacagacacugcagucaacacaaguagaagauaccuucucguucucaacauggaauauguauguauguauguguguguguguguguguguguguauauauauauauauauacagauacauacauacauacauacacacacacauacacagauacauacauacauacauacauacauacauacucuggccuucaucaugguaauggccucccaggaacaaauccagcauucacauccagacuucugaaggaaugaccaaagaugugaccaacauuuauaaaccaaccccuucaagauugcugaguaucagugaugugaccuugcaaaagacugucccaagguaacaauagcuuuucagccugaccccugaagaaccacccugaugugugaccagcauuugugacucagcccaggaaagauugauaggacuaguuaguaucuaugaccagaucucacaaaagauugccuagggauguguuaguauuugagcccauaaaggaaagccaagagaguggaugcuggaaccagcuugcaggugagacuacacuuagacuuuauaacuguauccaugcagcucucucccacucacauauauuccuucuuugcuuaauaaccuauauuaauuugacaggccaccuauaucccagacuuuuauucuguuuuuaauucuuccuuuguaucuuuuuuguaucuuuuuuuuuuuuuuacaagcuaaagcagagaccauggaguaacacugcuuacugacuuguuccucuugucuugcucagcuagcuuucuuauauauucuaggacagccugcccagagauugcauuacccccacuaggccaggcccuucuauaccaaucacaggcaugccugcaggucaucugaugguagcauuuucucaacucucuucagaugacuaccuugugucaaguugacaaaaacaaucgacacaguaugugcggacauguggugcugguguggaagggagaggcugauuuguaggagucagcucucuccuucacuuuaugcaucccggggaaucaaacucaguucaccaggcuuggaugcaagcuccuguaagcacugacccaucuugccaccaaggccaccaucacugccccucuuccucuucuccccuuccuuuuaugcuuuuuugcuuuccuuuugauagguuuuccaaagagcauagucugaguggguuuauggagucuccauaguucagccuccugauacaugagacuuuuaucugcuagcauauuuuuuaacuuucucuccuuauuuuauuuuaugauaaagucucauguaucccacauuggccucagauuugcuguguggcugaggaggaccuugaacuccugccucuaccucccaaggucucucaggucauaggagugcacugucauacuugacuuguacaguacuagggauugaaaccagggcccugaaugcuaugugagcacugugccaacuagggugugucuccagcuaccacacucuuuccauucuaucuuugccuuccuuaugcccuccugucccuccuguuccccacuccucuuuacucuuugcucuacuuuguuucuaccaacucacugcuaaucaugggccuuacuuucuuuccuuuuuccuccacucgaauuuguaguaguagauuguugcauacuauacuauuguuucuuuacuuccuaaaaggaguguguuuacugggugauuuuuuuuuuuuuugauuguuacuuuauuuucauagugggacuauccuuuaacaaugauugaguucaauaacaauuuucuguucuuggggaauguugagaauugagcuugguugccccaacacuguuguaagagagaaacauuauaucugaacuuuacuauauagcuuaguccuucuuaaauauuauaaacacuuuuguugggaggggaagauuauuuaaggaaaaaaauucagcagccuaaccccauauauacaaaucucacauaaaagcaaaacaaaaaccaugagaagccuaaaauccaaggcagcaugacuccuccaagaucugcuaaucuuuugcaauucccugcaaugacaguaaauuagaugaaaucccauucaaagacuuagaaagugugauaaguauguuuaaagagaaagaagauauuaauaacccccugaaugaauugcaaaaauaaaagacagcuuuauaaauguggggcaggggcaauacagaaaaugagauuggaccucaguaaagggauauaaguacugaaaacaaaaaguaaaaaaagcaaaacaaaaauacuggaagucguauuuacuaaguugaauaaaaacuuuguggaugccucaagaauagaauggaucagagggaugacagaauauauuggcuuggagauaagguggaauuggaauauucaguuguggccauagaaggagaauuuccugcuaaagauuuagggaaacauuuuacuuacaggaauauggguaaagaguuacuuacaggagcagaaaugacucauaaccaccacccuaccaugguuagaaacaugagcacagagcuagaaaccuagagcacauugcacagccugcaggcagcuccacaggguggagagugucccuuccaaaugauucagggagccuaaagcucuucuaggcagcuugucucugcuuucuuuaggcaguugguuugcugucagagucuuuagggaaacauuuucaguaagaucauagcaggcaguuccacaaaucuaugaaaauaaaugugcauauagguacaagauacauugauugcuagcaccaaacagacagaugcaaaaaagaaccuccucccaauguuauguuauaguuaaaacacuacauauccagaacaauaaaguucguuagaagcuagaagagagaaauauaacagaaacuauaggaggacuugaaaugauauauuucaagacagcagcugccaauucaaucuacuauauugcauaaacuauuugucaguauggaaggagaaaaaaauucacaauaaaagcauucuaaaggaauuaaacucuauagaagauacuuguagaauucuucagacuaaagagaaggacaaacacugaaaagaauuaacaguaauuaagccaacaggacagcaaguaguauuaagucgacagaauagcaggaauuaaugcacgucuuucaauaguaaccgaauauugauagucucaguuaccuaaucaaaaaacacguaauaccauauuucuuuuaaagcauuaucugucuauuuccauuugucagaaaaguccaucuuccaaaaugauacaggccaguaccauugccccuucuagaauuuaaagguaagccccuauugcuggacagacaccaugcacucgggacauaagccucaaaggauuugaacugaaucugacuuggaagccuccuucaugaggacuagcuuucauaggaauggggagugcuauacaagcugccaaaggagagaagcaaccaucuacaccauaagacauaucuuaaaauuuuauaucccaauacguuagaaaacucaaaaguggaugaauuuuacagaugcauaucaccuagcaaaauuaaaacaaaaugagacaaaguaauucaaacagcuccaaaacaaggaacaaaaucgaaucuguaauaauaauaauaaaauguuccaacuacaaaauuccaggucuagauggauuuauuacugaauucuacaagaccuauaaacagcaaacacuuuucaaauuagccaauaaaacaaacaaggaagaaauguuaccagauucuuuuuacaaagccaguauuauucuguuaccaaaaccagauaaagacacagcaaaaaaacaaaauuaggcauuauucucugaugaauauaaguaucugaaaauguaauucaagaacauuaaaaaggucauuagccaagguggguguagugaugcacaccuuuagucccaucacuugggaggcagaggcaggcagaucucugugaguucaaagccagccuggucuacagagugaguuccagaacagccagggcuacacagagaaacccugucugggggugggaguuguuguauaaaugagaagaccagaguuugcaugacauaaaaagguggacuggcuccacuuguagcccuagugcuaugaggugggguggagauggggaucaguggggcuuguaaaauuguggcuguaugacuuauaucugugucaugagucaugugauuuagucuuugaaguuguacugguauaccagaguuuguaccagccguugcgaaacgaguaagcagaauccuuacacuccuuaacccauacagucugggaagcuaacugacuaacauucuaaaagacaugcuuuccuccagccaucuccaguuagccuacuugauagagaaucgacaccgccacacagugaggucugagguuaucuugccccucuggucggguggucaguccugugucugguaugcaugguguuggugcuucucuucuucugccuccugcauuuuucacaugucuguagagggcuggauugcuuauaguauuuugcagacagauuccuuucuacaagaugaaguacaaauguacuuuuauaguguagaauauaagagccuuauuugucuucuguucucuaucaugacugaaauuuagggcuggauagauggcucagagguuuaagaacacuuacucuuccagaggaccugaauucagauucucacacucauaccgcagcucccagucaucuguaacuccagccccagcacauuugacaccaucuucuggccuccgugagcaucugcauaacauguaccuaaguagacaggaacauacacauaaauacaaauagaucaauucugaauucauucuaaaauagaaaaaaugaugauguucauuagggauuguuguauaaaguuagauuuaauguagaucaugguaaauguagaucacgguagcauuuuuuuuguuuuuguguuuugagauagucucauucuguagcucaugcuggcauggaacucacuaugugaccccagcuggccuagaacucuaaaugauccuccugucucagacuccccagugcugauauuacagaugagauaggcacaaauggaggcagagauaccaggcuucauccuuauuuuuaucugaugagcuuagguaagaagucaauuucuuuuagcaaaagcaacuucuaagugucuauuauaucuccagcacagacgaacuugcuggcuggcuccaaggcacuggguacuucccuggguagcuacucuuucuaaaaaacagaaacagaguuucauaaaagugauauguguuaagccuguaauuaacuaauaggggaccuuugggaauuugauuuaugccuucccucuagcucaguuucuucuuuguguguuucagagccuguaaagcuaaccuuccuuaaccuugggcuugaguugaauaccaguuauccucgugcagaguuuuagaaaacaaaaaucaaauauucauucauuucuucaguuuucucauucagagacuuuuuaaggacaugaugccuagaccaucagaguugcaggccauuaccuguaauggaauauuggaggauuuuuugggaggguugguagugcuuagaaggcuaucagcauaguucuuguuuuggaaugcaauauagacugguccagugaaggguauggucuuucuuggauucugagauggacucauucguaugagcagucuuguuugaggaguguagauagugguucauuggugaagucacaacgguggggcaggauaaaaagcuagggaagauuuugaggaugugggaaaagaaaagaucucugacuggagccuuuuagcaacugagaauuaagaauucuaguguaauaaagucaagacaggaucuuaugcuuuuaauuccaguacucugaaggcagaagccgucuacuugaucuacaauagugaguuccaggcugccagagcuacauaguagacuaacuuucagagaaaaaacguuaguacaauuaaaaauauuugcugugaagauuaccaacaucgggauaauaccacuuuaaaaagaucuuuuuguuauuuauuuuauguauauggguguuuugccugcauguauaucuguacuaugugcauaccuggcauccaaggaggccauaagaagaauccucugggacuaaaguuagaaaacguuguggauacuaggaauugaacauggguccucugaaagagcagccaauggucucuccagcccaagauaauauucccuuuaaauagagguauuucaugcuaaaauagcaaugaaaccugguuaaggccuaagauuuuauguuucucaaguauagccuuacucucuauacacgcagagaauauagaaaaacaacaacaacaacaacaaguguuaacuuccccuguaaccuuugcaaccuagguuuuacccuauuagcuauaaucuaugcaccuugggaaccaccuucugauucacuuaggcuccuuagcagggauuuaagguguaaggucagaauccaccuaaagcagugugcauggcugcugucaagacacuugagaugcccacaccacucucucggcuuccuuccuuccuuccuuccuuccuuccuuccuuccuuccuuccuuccuaaguugcuuuagacaugguguuuuaucacagcaaaaguaacuaagacaugcucucuauuagucacuuaacugaaauccugggagauugagguuugggcuguaaggcuucuguuguacuuuuuaaagcuuaguacuguacacguagguacacaagugcuucuguugucucuagcacuccauugucugcugucccuuguccugacuguaaacaacagaagacaauuuuucauaacauaaacuaagaaaggaacuuaguaaaaagcuguagguuaggacaaaagaaagacuagggcucuuaguugucucacuugagucagcgccagcugugcuucaugcuucuuauuugucuuaagauucccauauugggagcagaaaagucugucuaaccuuauuuggacauguaugugcucagccuuugucucugaagucagggcuuucccccuccuauuuauuaaacuuucuuccauuuguuuauuuguuuuccaguguuagagauugaaccugggggcacugugcuuggcagggaaguaauucaccacuaggaaauauccucaacucucaggguuuccauauuugcucuuaccuaaggagaaauagggaaauggauuacagaacguagugacuguccacuacaaggauuuuaccuaauuugggacugauccuuaaacaagcaagcuagggucuuagagugucauuuagugguaagauguguguuuagcuuacacaaggccuuagguucaaucccaaucccgagcauaucacacacagacacagacacacacacacacacacacacacacacacacacacacaaaccucauuaguugaagaagcuacuacucacgaggguguaccccaucuaucaugcaggauuuuucaagcguuacuguuauuguguaugugcaugauguguuucuggauguguguagcaugguucaugugcacaggucagggacagcuuugcagagcugcuucucucuauuuuuccccccacuuuuaguuagauuccagggaucaaacucagguugccagcuuugugcagcaaaugccuuuacccacuaagcccgcucacuggaccuuaagcagguuuuuaagcguguuagaaaaaaagaaaaaacaaaaacaaaaaaacaaagaagauaggcaauguggugcuuuuccguaauccuaucagugaagaaacugaaacaggagaauuaugaguugaaggccaaccugggcucucuaaagaguucaaaggugggggcuggugagauggcucagugaguaagagcacucgacugcucuuccaaagguccugaguucaaaucccaccaaucacaugguggcucacaaccaucuguaaugagaucugacucccucuucuggagugucugaagacaucuuuuaaaaaaaaagaguuuaaaggcaucuuggauuacauaaagaggccaugucuugugaaugggacgcagacagacacaguggugggaagaugaaagaagagaauuuuucagccaaauugagcuauaguaggauuuucuggggguuguccaugugagacugaaaaaauauugucugaaagaaacagaauaguaaagcuauucaaguuuauaugguaaagauuagaagagacaucaguggcuagguaagguggcauauaacugcaguucaggcacuugggggacucuaaacuggaggcuaguuaggccauauagugaguucccugcugaaagaagggagagaaaggaacagacugacagacucagggcagguccucauacugcaggaugcuacaagccaccuaacuauggggagguaucacauuaaugcagugcugaucaaauuuacuccauuguaacuuaacuguaaauaacaaaaagguauagagauagguugagguaggacgaggauuuuucauaugagaccccugugucauggucauaucuaauaaacuaacguagaucuugacagguaucagcaucagaaaucacugcugggaauuguaagcuguuaaggagagacccauaaagaauuagaauuuaugugugagagcccauccuccugugagaacaugcuguaccuucuggagaccgucucguccuagagcaauuuguaaggaucauuuucuugucagccccauucaaggcaggcacauccuuuuggaucacagaguuauucucuucuaggacuauucugcuguuugaguauuuuuaacauuugguucucuucucccaccccauccccaacccccacuugguuuuuuugagacuggguuucccuguguggcccuggcuguccuggaacucacucuauagacuagacuggccucaaacucaaucugcgugccuccgccucccuaaaugcugggauuaaagguggguacuaccauaccccacucucagcuugguguucuuaaagaauuguugcuguuugguugcugcaaauggcuuuugccacugcuguguaguuacagagccagcuaagaacuggcucacacuuggcaggaucuaaagaagucaugauaauggagccuuuguaaaagcacuaucugggcuaaaaucucugaggcaaggcucaggaucauggaaucuuaaguggagguuuuagaaaguggcccuguugucuucuguuagaaaugaugguggcagggauugaaggaacaauuuggggcuauucuuguaguuuaggaagaauuguuuauuguguaaacuauccugguacauuucauaaacugcuaaggaauaugagauuucaagugcagaguggcuucuguagaucuaagccagcuuucccagagucucuggggaccugcucuuguguccacaccacagcuacugcuguggauucugauacacgucaucacaugaggaggagcuguggggccugagucucaauugaauguguacaauuuguuagaauuacagcaaucucuggacuauaggcaaaccuaagaucacucagccuccaguuagagaaucuugaacacuggcaaauauuuggauaucuuucauuagauuuuucuccugugccauguuauuuaaucuccacagcuuuuguagaaaaagcaagcuauuuuucucuuccuuuuuuuuucgaagaaccauuugaaaccagaagacccuuaucuccuuacaaauuagccaguggcugguaaggugaaaaggagaccuggauccuaacacuucaaaucucauguguuucuguggcauuaaacugccucugagaaaacuguuuaguaaugaggagcaaaguauuuaagcugguuauucugguggggcauagugguucacaucuuuaaucccagcacuugugaggcagaggcagacucucugaguuagaggccagccuggcuuagaguuccaggauagccagagcuacauauugagacccuguuuugaaaauaaaauaaaaaccuuguuauucugaaaugaagcaaacugccagauguuuuaccaaguucuaccaauuaagcuacuggggugcaaaagguuggagaggguagggggcugguggcacucuugcuuaguaccuuucaaggguagccuuucucugugugucugcgcuauuuguagagacuuuccugccacuagagauaaagcacaguguuuugccucuguuguuaucuguucuucagguauucuguacccucuuuuguaagucagagucgcauuagccuauggcuugcugacuggacagugaaccccaggacucugccuccugcaaguaugugccaccauauugguucuuuuuuauguggguuuggggugucagacuuagguucucauguuuauacaaucaacacuuuacugacugaaccauuuucccaugucuucauuauuuuucuuuugcugugaagagauaccauaauaaaggaaacuucuuuaaaaagcauuuaauugggggcuuguuuacaguuucagagggugaguccauuaagaagaauggcaguaggcaggcaggcaggcugcuggagcauuagcuaagagcuuauaucugauccacaagccguaggcagagagagagagacuaggccugacauggacuuuugaaaccuccaagccuacccccaauacuauaccuucucuaacaaggccacaccuacuaguccuuccuaaacaguucaccaccuaggagccaaagagucuaccauaugagccuaugagggccauucaccuucaaaccaccacaugagaacuacagaaguuuguuuugauuuguugcuuagucugaauuuauuuuaauuguccaaaauaggcaauuacuuauauuccauaaagaauuuuaaaaauaaucuuuuugaauugucucauaaucaguuuuaauaacuuccccaaauuauugcuuuuauuuuauauuacagcauuaguuuugaauuauguuaggaauuuucauaaauaugaaacgagcuuaauaaggauuaacuuuuuaaaaugaggcagugguuacacacgccuuuaauccuagcacuggagaggcagaggcaggcagaucucugugaguuuaaggacaguauugucuauagagugaguuccaaggcagccagagcuacaccgaaaaacccugucucagggaaaaacacacacacacacacacacacacacacacacacacacacacacacacaauuaacuuuuauuuaacauucuuuacguucaaaaauuuguuucuucauguuuuaaaacaugccuuuaccuucuaucuucagcugacacuuguauaagauuagguagacauaucccuugauuguuauggaauauggggucuuuuuaauugaaaaucauuuuuuuguacacuauauucugaucacaguuuacgcucccacaacuguucccagaccuuccccaccucuucacuugcccaacuccacaccuuucccucucuuuagaggauaaaugaaaauaaauaaaggaaaaaccacaagaaacacauauaaaaauauauaaacaaaaccuaacccccccacaaaaucagaaacgacaaccuucaacuaaaagaucaguaaaccaauuuuucacuuauuaaauguacuucaaagucuuuucaucagugcauauaaguuacaauguaaaaaaaggcacaaaguuuaaguacacagguuggugauuauuuuuaugaauugugaacacauagagcaaugacuuugcauauuauugauguuaaaauacagccagugucauaugcuuagagccucuugcuuccaaguuuguuuuauuauuucuauguauguguauauaugguguagggagugucgaguauauguagggaauacuuuaucccuugagacaaggccuuucuuggggccugugguuugcucauuugucuagacugacuaaccagcaaguccuggggauccaccuguaccuccccacugcugggauuauaagcguaggcugucaugcugaccuuuuucuguggaugucagggaucagacucagguccacugcuuguacagcuggguguuccuaagucaucuccccagcucccuauuuacuuagaagucugagacagccuggccuggaaccugcuaguuauaccaggcuggcuuugaacuugauccuugcugcuucuaaaugcuggaauuauguguauggugguacauaccacuauauuuacuuuuaaaacuuuguuaaacuacugugaauacuaauuugagugaugugaguuucuaauuuuguuuguuccuuugagauguauucguggagaaccagucucugcuaggcaugaguaaagauauugauauuacguguaacauuuacuacuuauaguaacuuguacuuggggcuagguuacugaggaauaaggcagaucccucugggaaacuacacaggaaauaacaucuagacugagcccucagugugaguagaaauuauccaaacaggccauuuagggaggaagagcugaaggcaggaggccaagaggaacaagaaagcaggauguggagaucagcacagcugcuuuggugcugcccuggagccugagaaucugggagggggagccgugggggugcugaagcagggcagaggacaguguuacugcuacuuaaguuuccuugugacagauaacaggacucuauugcaaacaacacuaaggaagaauuuuguggaaaauagugggaugguucccagaauugaagaaagagcugaauuccaaaacuuugaagaaagcaaacaaccaaggcaacuccuggucuuucugaaguucuuguggaauuuuucuacagggccuuaguuaauuuggucuggcugcagagucuuguuugccacuuagauauccaggguuugagaaauagucugaguaaguuaaauuagauucacugaccaaaaugagcagucauguaaccagaagacggcaucagacucuguaucuguguugacuaaguugcuguuuguugugugaucaagacagcaagauuuguuaccugacacauuugaggcccagccuagaagucaguguguggaggcuuagaaagccauaaguagguggggugauggagcuucagaagccaggaagccuguuucauuaauccaaacaagagaugauaugccaacaguaaugccuucuguagggagggaagaaagcacaucgauucugagacucuuaaaaggaauaauagacuucacuuuggagguuaguuagaaacauuaaggcacugaacagagucccauguuucuggcuugggcuagaacuauuaaguaaacagugcugucuuccacaaagagcuccuuuuuaauuuuuuuuuccuuuugguuuuucgagacaggguuucucuguguagcccuggcuguccuggaacucacuuuguagaccaggcuggccucgaacucagaaauccgccugccucugccucccaagugcugggauuaaaggugugcgccaccauguccggcuuaagagcuacuuuuuaaaagaguacuuucguucaguuucaaaguauugaguuagaauacauuuaaguuaagaacauuuggguuagaguuguucugcuaugaaguauugcuggaagucagagagcccucagagccauuaccaaugggcucuugucaggucccaaagaaauucaggauaaaaggcuaacuaaagugccuauuagcauaacgaagugugcacuggccuccgagcucacuuuguaccuguggcuccucucugcucuuccgcacucccucccccuacccuaaaccucucuagcucaggggcuuuauuccuccaguuucagauucuuuaaaaaccugccauuucagccgugugcuuucuugggucucuuuuggucccaucucuucuuccucucgugcucuuccccgaucucuccccucucauggcccagucuauucugcuggucauguucaaucugccacuuucugucuuugcucuggauucuucaagucaaucuaggauuuagcucuggaaguacaagagggaggggguacuuagggccagggcaagcagcagagauccaccacacagcagaacucaugcaagagauuuauugggguggaaaguaaaagaccaucugguggagggguugaggguggaugcagauagacagagagaaagagacagugagagaacaugagagagaaaaacucaagaagagucagagcaagucucugcccuuaaaggaacuccaugggaaaacaaagaacuucuaaguguggaaauuuuccacccaugauugcaggaaagccccugaaacuucagugcuccuucagaaagagaauucuucuccguaaggcaacggccuccucaccuguuuccugagcuuaucuccuccaucaguuaugucuucugcuuuagaacaaaacaaauuaggaaguaggaccuucaacacagacuggggauguccuugauuaaaaagcuaaauuguaguuugaauguuuuggcuaugacuaguaaugagaagcuguuaucuuguuaaaugaguuaauucggauccuaacuaagggguuccuuuagauauuuuggucagugcuuuugccauuagguagcuuaauagucuuaaaaguccucuggucucaguagugguauuagacauauguucgggucacaaagaaagagaccaccacuccaacugaagugucauacacuuuacaaggcaaacuuuacucuugaucaagagaguguguugggaacaccaagauaguaagcaaagguuucauugggugggaaggauuuaaauaguuuccuaaaauucuuacaaaguaggagagauaaaaauauuuuaguucuuugucuuaaacacaaguuuuauaguauuugauaaaaaaaaaauucacauuugcuauuuauuacagugguaccagaacuguuucuuuaaggagaaggcagaaacuuuugggagcaguauuuggacaccauaaccauuaaguaggcuaaggccagaggcacugaaugucaugccuagggcuuuuggaaugguuaaaaauaaaaagacaggaaagaaaagggaaggggaauaaaaggaagccauauaauuaccugagcaaauuaucugagcguagacccuaacaguaaucauaaaguacucuuuuacagugucaggaaaacuugcuucuuccaaaauaccauggaauuauagaucgacugaaugagcucuguuugaaacuuuaagucuuuacguuuguguguguguguguguguguguguguguguguguguguguguguguuuuggcauauaugugccacagcauggaauggggucagagacaguuugggaccuuuuauggguuuuaaggaucagacucagguugucaugcuuguagggcaagucuuuuaccuggugagccaccucccccaucccccucuccuuguauuuauggaugaugccccuucaagaaagcccuuuauuauuuuuauacuggugauacaacccagggccuuguguaugcuaagcacacacuuaccauuuggccauuauuuuauccuuauuuuuuuuuccuuuuucuuguuuagaaaaucaaguccuuuaagauaaugguuaggauauauuacuaaguuuuuuauuuuguuuuaaauugaagaguaaugaacuuguuaugggaagccugcuagagaagaccacucagacacagucuauagccaauugaaaaaucuuuauuccaacuggcugaggcuacacuuagguauuugggacccaaguguagugcugaacauuuagaguuguguuuuuaaaagcaaaaaucuuguucugguaucucacucagcaguugcagcguggcagguaguuuagggugggagaaguuugcacaagcaagcaguuuaacagaagcuagauaagcaauuagcugggguggcagggguuggggggacguuuguuuacauaagcagaccaauuaccagaaacuaagguaaguuagcugggcaucuugaccucaggauccuaaaauagaguuggauaauuuuccauagggcuucucaucaaaggagaucaaauccuaauuaaaccuaaaauggccucagcaagaauaacaagaugaaggaaccucugcacugucuugcccugucacaaauuaaauuaacauuuucucaggugauguagggcaggacgaggaaaagggugcacaagaugcagggacaauuaagauaaaguuguuggguucuaaggaugaggaucaaagagaagaguacaucuaacguagggaugaaugucagugguagguguuuguuugccuaggaagugaaagacucugcugaguucaggagaagcaaggaaaggaagauuaggugaguuacugaauguuguauagcagcugaguuuuucuugggugacuuuaaagccauauaacuucccucucugcuuuguuuuccucuucaaggaaaaacagcaacuucagccuaucuaagcuuuauuauauuuauuauauacacuaggcauagguuguaagggucuuugauucacagaagaaugauaacccgggcuaaaauaguauguaaaugcaaagaguguuuuauuuugcauaaguccagcauucuggggucucccacuaccaagagagaccccccugaaaugaacuugcaggcccaguuuguagcacauuaggggaauuccagguaggugguccauuacagaggcaugggggcuggcuggaaacuccugacccauuguccuuguuucaggccaagugguggggcaguuucugauuagcuaccugaagcuuggguuuuuaggccuuaucuccuaaacugccaaucggaagucugucaucagccuagccuucucaagguguaacagaaacaugaguaggacucuaguucugcccccaaggaaguuagaaaagcauuaccagagccaaucuaaacaggccugggcaggaaugggacaaguuuucugaaauccugauaucccagcuauguugacaugagauguuagcaaaaggaagaugagagaucuuucaaugaggacggaaacaggagcuuugagaugagggccuguauacuuguagaugaggucuuagggaacaggguagagccagguaauauuguuagcauuauuucugcuuuaucuucagugggugagccauuggaagacuuagcaggauaaugacaccagguugcuuagaaagaaaucauuugugguugaaucuguuagauuuaaccaaagggucuagaggugggggaauacaucugugaagcucuggcagcagauaaugaagguuggaccauggcaggaguuaagugggagugacagggacaaaucugagagcuagcagcagaugauauaaugacaagaagucacgagucauugugggaauuucuagcaggggugauugguuaaguaaugcuaccauguuugagagaagacacacuaaaagaaagaauuguauuuaagauaaugagagggugaauggcuuauuuuaagcaucaggaccuugauuuaucuuugagaagaauugaauuauuugcauuauguggugguguaagugaaaauggcuccccauaggcucuuguauuugaauacuuuguccccaguugguguaaauguuggggaaggccuaggauguguggccuuauuggaggaggugugucacugggguuggauuuugagguuucaaaaaguccaagccauucugccuuguacuuauugaucagauauaagcucucagcuacuguuccgaugccaugccugugauagauuucugagguagcauaaagagacaggagguuuaaaaagacacgagccuauucuuugacagucaggacuauauuuauuaguguacacaaugagggccugacucuccugccagaaacuggcggggggggggggggggaagggaggggcgggggggggggaauggcugcaacucuuauggggcaggguaagggguggaagugguugcagcaagugacacauguuucucuccuuccugaaguuguuugucaaggugauacaggcuaccaaauagaugcuccuugccagggugaccaacuaaggccgggcaugauuaucuguaaccuuguaggaaugccauuuaacagaugaggcacucugucagccugccugcugccugcugcuuugcucccugccauggugauaauggacucacucucagaacuggaagccccacauucaaugcuuuugguuuguuuuuuuucucucucucucuuuuuuuuuuuuuauuacguauuuuccucaauuacuuuuccaaugcuaucccaaaagccucccacacccucccccccacuccccuacccacccauucccauuuuuuggcccuggcguuccccuguacugaggcauauaaaguuugccuguccagugggucucucuuuccagugaugacggguuuagugcagaguucuaucagaccuucagagaagaucuaauuccaguucugcacaaacuauuucacaaaauagaaguagaagguacucuacccaacucauuuuaugaagccacaauuacucugauaccuaaaccacagaaagauccaacaaagauagagaacuucagaccaauuucucuuaugaauaucgaugcaaaaauacucaauaaaauucucacuaaccaaauccaagaacacauuaaagcaaucauccauccugaccaaguagguuuuauuccagggaugcagagaugguuuaauauacgaaaaucaaugcuuuuguauacguugccuuaaucauggucuuuucacagcaguauagacaaaugccuacauaaaagcguuucacagagcuauuugagugugaaauuaaauauggucuaacuaguacuauuaaugugaaaguaguuugguuugguuugguuuugacauagguuuucucuauuauguagcuccagguguccuguaauuugcuguguagaccaggcuggccuaaaaacucacagagaucugccugccucugccaccugagugcugggguuaaagguguucaccacaaggaccugcuugguguggaaguacuuagucuagggaaaucguuaaucaucagagagaaugugccugagagagaggcagagaugcaacguuuggaucugggcauauguaaaggcaggcaagaaagagaagguuaaaaaaugauggucuggaagcuaagagauuggggcuucccaggaaagccucauuuaaaagugucaacuggggccaggcagagugguccacaccuuuaauacaaauacuugggaggcagaagcaggaggaucucuguagaguuuuaagaccagccugcuguacaugcugaguuccaggccaaccagaacuacauagugagaccuugucucaaaguuaaauauacuccggcauggagguguacaccugcaguggaugggagacuggaaaaucccaaguuugaggccagccuggguuauauagcaauaaccuguaucaacacauacuuaaaaagaaaaagaagccagugugguggcacacgccuuuaaugccagcacccgggaggcagaggcagaggcagaggcagaggcagaggcagaggcagaggcagaggcagaggcagaggcagaggcagaggcgcagagaggcagagaggcagagaggcgcagagaggcgcagagagggacagagaggcgcagagaggcagagagaggcagagagaggcagagagagggaggcagagaggcagagaggcagagaggcagagagagaggcagagagagaggcagagaggcauagaggcagaggcagaggcagaggcaggugaauaucugaguuccaggacagccagggcuacacagagaaacccugucucaacaaacaaacaaaacaacaaaaaaaaagaaaaaagaaaaaaagaaaugaggggagaggaagcagaggggcaggggaagaagaaagagugagaaggugggccagagagacugacuggccuagagaaagucaaagguaagaugaagaccaaacgcaguguugagcguggcccucuuaauuguuuuuguuuuuauuuuuugagacaaggucauacuguagaccucuugccucauuuuccccaguccugggauuauaagaauaugcuaacaugccuagaaagacuugguuuuuaagguaagacuguuuuuuuuuuuuuuuuuuuaaauaugggacacuucaugaauuuacaugucauccuugugcaggggccaugcuaaucuucucuguaugauucuaaguuuaguauaugggcuacaugagcgagcacaaacuguucuuaaugagagaugguucuagauuguaguggguugaaaauaaauaugagguaggccuacucuuaggaaaauuuguguaaagaguagagagggucaugguaaugacuaaagacugauuccaaugaguucauuuuaagggaggagaaaaugaagcuuauuuauaaaauucccgaugggcaaauuauucagaaaaggagaguagcugacugguucugaguaucuggauuggccucaaucagauuagcagcuaagauuggaauauugacaggguagaggaaaaucauugaaagaaaaccuuccagaagaucucucucuuuuuuuuaaagauuuauuuauuuauuauauguaaguacacuguagcuaucuucagacacaccagaagagggagucauaucuuuuuauggaugguugugagcuaccaugugguugcugggauuugaacucaggaccuucggaagaacagucagugcucuuaaccacugagccaucucaccagcucccagaagaucucuugaaugaaugaaugaaugaaugaauaagcaaggaagcaggcaaauaaauaagcgaaugaaugaaugaauggcugaguagauggcucaaugauuuagagcacguuuuguuuuugcauaggacuggguuugauuccuagcauucaugugguggcuuacaaccaucgguaagagacuucaaugccuucuucugacuucugcagacaccuuuguacccucuguauguacauggcacacauacaaugcaggcaaaacacuccuacauauaaauuuaaaagugugugugugugugugagagagagagagagagagagagagagagagagagagagacaugaugcugaugcugauaagacccuugaggauggugaagcaggucguucggaaugggaaacguacuugucuuccagaugaagacugacagggccuacucaaaaguagagaagaaaacaaugccagucauuucagcgugcucaugcuguggagcacuacacagcuguaggaaucggcugcuuagaaguagacuccaaccuaaaugaugaacgaaaagggaaggaggccugaggaaguagggcuucccauuguaagagccaguaguagaaauaagaugcgaaaugguaugugggggcagagacuucacagcuguguugcuaguugguaggaagcucucucuggguguuuaaucucugaggauuauaaagagaaaggaggagcuaaugacaccugugaugacauauguagaggccaaggaguucucuucauggcacacagcugucucugguggaaacuggggugauggugguagcagugggggguggggguggggaagcugugcuuuuuacuucucacuuuucugccuucuguagucugcuguuagaauuggguuuuacaccauaaaaaugaagcccguuuaugugucuccccaggaauacugacagagccuagaguucuggaacuuacucugccuaagccugccugacgugagucugccuguccgagcacugggcucuucccuggaagagggacugcccaccacaucuuucaauucuccucguuugcuucauaccaguucuaaagauugccagcaucuagugucugaauguuggguagaaaaaaaagcaaugaauugcuuuccuauucuuuugagauuaaccccaggccuuacaacuuagaaagcaccauccuaaaagcaacuucuuuauaauaaaggccaaagaauuucuuguuguauucccaguauaucaagacauuaaugcaagaggaaggcaggcuacauuucuccuguuuucccucagccucaacaaaagauccccuauucuucaguggaaacuuagcgucaaggggucucgagagaugacugagucaggcuagugaguccugaacacucugaccugcuacucuuuugugcuguguuugucuagggugucugcaguaggaagaaaaaaaacaaaaacaguuucuguuguugagcuagccugugcccagcauccuggucucuaagcuacagguggcacugauagaguugucaugagcauccaaccucaccugugcugauuaguuacugaccguuguuuuaaaauauuugccuccacauuacaagugguuaaauguuaacuucuuaagaauacaagauagcuccgcaggauaugaguuaugacauuuaggguguugacuuauugcuucagaacuguggaguuuuugaguaauacaccauguuacaugauuugacuaaaaaaaaaaaagccucaaguugguuucauuggcuuaaauauaguucaaagcaguagacacagagcucagaugaggaagugcuguacaaucaaggaaguaagaggcuuuaaagauaauuugcuuucauggacauggcuguccaaguucugauagaugacuugaaauaagaguagaaguacuggaauagagauccucuauucuaaauuaggagaggaguguggggacccugaaugugacaaccucuaagucucugcugacuuugcagaggugggcuuguguggguaaagugacggacggacagacggagaagaaaaggaccugacaccacgaacuagcaccauacgggguauuguuuuauuucugcauuuguuuucuguuucaucugucuuucucagguauuuaaaauauaaaagauauuuguuuaaauucucauaaguucucaaggaccuuuuugucuuugcuguguuuggaaagaugccaugauaacuagucaaaagaauuguucuuauuuauuaaccuguaacuuaaaagaaaauaggaggccauucuuugguuugguuuuauuuuucauuuuagggaaaggaucuuaaguaagucgcaaccuuuaacugugcuaauuaaaaucucccuucagcagagagcagugguuuugagucucuuuauagauaugugucuaauuauugacugcauuugaaaguaacuuaaugguccugugguuucagagugaagggcauuguaaaaaggcagcugugcucuggguuuggcaucauucaugcauuuuagguccggugcagaauuacacugggaaagacuugagucaugcuuuuuugguauuguguuauauuaauuuuuuguuuguuuguuuugauuuucaaaacacaguuucucuauguggcucuggcugucccggaccuggcucuauaaaccagguucgccucaaaaucagagaucgccugccucuggcuccugaauguuagaaguaaacgcuugugcagucauacccaucauguuaaauuaguguuuagccauaaauucugccugugaucuuugaaaagagaaauguacuguuuuuauauuuaguccuugcugucuacaacuaaucaaagaauuguucucuauucauuaaccuguaaaacuguuuaaaagaaaaaaguagaccauuauuuuguuuuguuuugcuugucuuuuguuuuguuugguuuuuuucuuucuuuuuuuuuuuuuuuuuuguuucguuuuguuuguuuuuuuucaagacaggguuucucuguauagcccuggcuguccuggaacucacuuuauagaccaggcuggucuggaacucagaaauccaccugccucugccucccaagugcugggauuaaaggugugcgccaccauuguccagcgucuuuuuuacuuuugagacaaagucuauguagguccugaaacuggcuguguagaauaggcugaccuugaacucacaaaucugccugccucggucuccugagugcuaggauuaaagauguacaccaccaugcccagccuauucauuuuucucuaucacugagcuauaacuccugacguggccauuuuuaaauuugggaauuagcacugagcuauuaguaauagacuugagaaaauguguagcagccauauuuuuucccucuuugagucaaggucuuauguagcccaggcugccucagauuuguuaauggagcugagaaugaccuugaucuucugcccuuaccucucaagugcugggguuacagcugggugccacugcaacuaugucaugagugcagggcuucguguaugcuagggaagcaugcuucaacagagucauagcuccauuccaguugucauaauuugcaaguuauuauucacuaaugcauagacccaaguguguguguguaucugaaagggaugugauagguggugguauggauaaauaagacaacuaugggagugaugauaaguuugcuuaggaggaauacccuggccucccuuugagugaauuauuuggaaacaguuugaguggagaagaaggaaaaaggauuggaauccaauccuauaacaugaucccaagaucacuaaguuagcuacugaaacauacacacagaaaucaagaacacacuugcuaaaugcuguuuuaggccuuaaaagccuaagagggggauuuccuuuggccacguuacagaugaagcauuuugaccuccaagugaagaaacuugucaggcuaacaagagaccaggcuagaauucugaucuaggcagccuccccaccccuuugcugcaugauaagaagugaaaagaugggaggauuccuuucucugaacuuguauguggucagcugaguuuccagugccuauuccaaguccauucaguaaauggggcuuguuaacuacauaucaagagugauguagcacgagccccauaugcacuucaaguuuuuuaguagcaguauucaaaaugcaaagaaaagggguaggugaaauaauuuucauaauauacuuauuuagcucagaaugucaaacugucaagcuauauagauggguaaguggccaauaauaaguauuuuuaaauuauuaagauagucugaucuauauucuuauacuacagcacaucucaauucagauuagcuacauuuuaaguugaacugugguauguggcuacaaauuaaaaaacagaacuccaagaaaaggacagucauccuacaacagagagccagcuuuaaagccucugugacuaugggagcagcuuuaccuaacuugauagcucuggaggaaagguccccuaccgagaaggcugggcugcucuguaaggaaagaguuugaccauaucaaacagacaauagaccuuccgccugaggacuauuuauagagagcaaagucugaaccccuuuaucacccccaccagaaacaaccucaggaaaaccacgcuguuggcucuuagauacugaacuauauuugggguagcagagugugugugcuggagagucugcuagcugaguccagucaagacuggaaaccacagccuuugaugcauguggcaguguuguugccuaagguuuuccuccuccugcuguuuugagauggaaacaguaaugucugccuaaaaagagaaaugugaacaaacuacuguauaaggaaauguccagcccuuacucugccuggagcgauguaaaugacaguuucaagccaucuccguccagagaucaucuugcauauauaaguucuccaguccagccauguuuuuuacucuaagaaagguuggcauuucucguucaucuucuugcuccuguggcucuuguuccuuugucuuugacucaaugaaccucucucuuuuccaauuauauuugcuguuugggguuugguuuuuuuuguugcuuuguaguauugguacacaaacaaacaaacaaaauccaucucucaccuuaaaggaaagaaagauagcucuuuuuuuuuuuuuccuggaguguuuuaagugaccauagcuugggaaaacagauuuagguuacuguaguuuuauacuuuuaaaaaacaaagaaaauuauaaaucagggcaaggggguugcaacaugaugagggaagcuugucuauaggccuaagauucugaugacauucuuagcuuuugagucagagggugauagcagucugcuaaauuaauagauuccaagaguuuuuuuuuuuuuuuuuuuaaucuguuagucacaagauguuaguucugaaauagaggcaggucaggaaugguuguugggagauggagggagaccuaaagcuagcccaagauaagguaauuauuucuuggaccaucagucagucagucuuuaaaggcagcuucuuucccagaguucuuauucacaguaguaagcuaucugcgaagagcuugagucuugcuuaugcuucucuuaagagugggacguguaacugugguuaaaagcgugacgagaucagguggggugguucagaaguucuagguaaaccuagcaaagguuggcggugggggcucagauaacauacaaggaaaguauaugaagcuccuagugguuauaugagcaauaaauaguugcugagggagcaaagacucuuugguggauguugccugugccccagacagcucuucgcccaacccuacuuuuccuuggggguugggggugaguuggcgcagagucaaggacgcagacucugggaucaggugagaaugcugcagcaagcuccuuuaauaccuuccacucacucccccauuagucccaagaaagccucucuucuaaacagcaguuccugauuggcuggcauuguuugcaucagcaaaccuugcucucucaggcaguccucaauuuaagcccuccugcaggagaugcuuuugcagcugcagagcccccccccccccccccccccgugcuuacauagaggcagccccgcucuuccugcuacagguggaacauccaguaauacagcuuuaguccauuucacgaacacuuuguagacagcuccaauaaacucuuguugagccacuuuggucuaucuugaguaccuauuuggaguaaauucuguaguuugccauuugaaguuuacuuuuacuuuaacacacaugauguguguuugauacccauggaaggcagaagaggguguugcauccccuggcacugaaguuacagacaguugugagcugucauguggcuacuagaaauccauccuggaccucuguuggggacaguagcugagccaucuccucugcucccaugggaaugauguguaaguucaggaauaguaaguaagcagacucacgcuguuguacagcucuccucagcaugcuucuccagcgcuccucagcuucccacacucagccacugcuugggacugaaagucuugagaguugcugaguagucauuuucaauucccuaccccacaccccugucccugauacaccuaccuuuuaucuuuauguauuugguuauaauagauaccucuagaaaguggaaacauguaguauuuaucccguaguaaccugguuuggguuuuuguuuuuaauuugguggagaaaggucuucaagguccacccaugaaucacaugugagaauuuccuuucuuacaggcagucauauuccaucauuuuucuguagcacaucuuacuuauucauucuuacguuguuggaaccuuuuagauuuuuuuuccuuccugagacagaucuuaaguguaaacugcucuugaacucacuguaacccaggcuggcuucacacucagaauccccucacccacacuucagcuuucugagugcugagaguacaggugugugacuuuuagcuauugaauuguucucaccuuagugauucuuugaguaaauucuaauuucagcuuuugugaaugaugcucccuggggaaaauggcgggcaacuaucucuaagaacucuggaguauuauccagagguagaaucccugagaacaguggucgauuuucuguuucguuuuguuugauaaugagugggauuaauaucucauuauaguuuuguuuuucuaggaaaaauacagaauaucauuaucugcaccuguuucuuuuuugguuuuuggagacagaguuucucugugucgcccuggcuguccuggaacucacucuguagaccagacuggccucgaacucagaaaucugccugccucugccuccugagugcugggauuaaaggugugcgccgccacugccuggcuucugcaccuguuucuuguccuguuaagaagcuaagcucauuuuguuuagaucuuuugcccauuuuuuuuguuguuguuauugucuaucugguuguugguguagaauguguguauucuagguagcaaucccuucuaauauauaugacuuucagauacgucuuccaagccuauugguugucagugcugggaauugagcagggcccaggaagagcucucaacugcucaacccucucuagcccuuaaaaaauuguuuuaaauguauugauaacggauacagaugaacgaguugccuugugauaccuugugauuuauguauacaguuuuauguacaaaucagguugacaucagucuccucagucuccucaucgcuuccuuauuuucacuggguuuucauuaccacacagagugauggauuuuauuguggcguuuucauucauacuuuguuuuguugacccucuguucacccccuucccuugugaucuucccucaugcacguucacuuucccaguaaccuugucucugcuuggacgucucauguauaucauauguauucuguuuuccuccuuuccccacuaccuuucccuuccuccugucuaggacguaguuaaccucuucaaacgaaaguuuuccuguaguguuuuuuguagagcugaauuuguagauagacauugcuuacauguauucucauguaauauuuuucuuuuuuuuuuuuuuuuuaucaguugugauugauggccuuucugguuauagaagucucccagcacccacaugguggcucacaacgcucuauaauaacuccaguaccaaagaaucuaacgcccucuuuuggccucugcaggcagcagucaugcgcaugguuuaugcgcauauacacagacaaacaaauacacacacaaaaagaaaaaacuuaaaaaggcauaaaggggauaaagacagggacagggcagggcugagaggugaggaggaaggggaaacuggaugcaaaguuaguugauugauuaauuaauuaguaaaaauaaucaaagacauauaggaacuucacagaaaauacguacaaaaagaaaaucucuccaaacgugggagagaguaugcauuuguguguauaucugugaaauggauagaggccagcauuuaguaucugguauucccccuguaauuguaugccuuauuuuuucagaagugucuuucacugaaucuggaguuugcaguuuccuagacgaccuggccagcacaucccucugucucuaucucuaacuccuccucggugcucgaacuaacagcugugugcuggcacauccagcuucuacaauggcuauuaggaauccauacugagaucuuuuuugcuguuguuuguuuguucguuugguuuuuugagacaggguuucucuggcugcccugaaacuccaucuguagacaggcagggcucaagcucagagguccauacucagaucuuaaugcuugaacagcaagcacuuuuccuauugagccaucuuccuagaucuaugaugauugcacuucuuauuuuuuacauuaaauuuauuuauuuguaugugggagggggacauaaggggcacagcaugaguguagagaucagagaaguaucucuccuuccagcauaugaauucugacauuaaacaacagucaccagaccuagaaguauguaccuuuugcacacugagcugucucgcugaaguucuuuucuauaaagccuucuauuaaauggaacacuuaaaauguuauaucuugaucauugaaaaguagcagauucacaaacaggcaccagagggugcuguuuccuaucauugacugggcuaaguacuugcuugguuguguuugccuuuacacaaacaguuccuuuccuacauuacugaauguuuuuguacacuuuuuggguuuuuuuuuuucuguccauaaugcaaagaaauguuguuugaauccucacauaaauucuguaaauugcaaguuaacguauuuuuagguuuuguuuguuuguuuguuuguuuuuaauguccauugguauuuugccugcauauaugucugugugaggaucuuagaucccuuagguccccuggagcuggaguggcagacaguuguaagcugccaugugcuugcugggaauugaaccuagguucuuauuggaagagcugccagugcucuuaacugcuaagccauaucuccagcccacagauuaacuucuaaguaguccuuugguauucuuauuuacugucaguuguuuguuuguuuguuuuuuaucaucaucauaccuacucauugguaucugcucuauaaaagucaguguacugggaaucuuacaaauguugaauuuuuuuuuuuuuuuuuuuuuuuguaauuuuguaauuuuguucuagccaggcacaacacaccuuuauucccaccacucaggagacagagccaggaggaguuccagaccagccaaguucguuucaaaauaaauaaaucaaacaggguuuuacuacauaggcccagacuagucuccaguucugauucguggccuccgagugcuggaguuauaugugaacaacaccacacccuguuagauguguuuuagaccaagagauuugagcgguuuuguuguugcuuugaagcacagucuucaagguugcccagcuggucuugccacugaacuucaccuuuuaccucugcaguaguccucggaggugcaccaguguacagagcacacuacacagguagguagcugccgcaagcuccuccugccagucagucugccaguguacaguucauggaaaacuaaauuagauaaugacuuucgccauucaguagauuguaaaguaaccucccucaggugggucauggaugugauuugaaagucuuagaaagcucuuucuaccccaaaauaaauuuuaccgugguucaguuucuuuguuucuagucacaauaugacuaccaagugaagauguuuugugaggaauuuguaguuuuaaaaauuaauacuuuuuauguuaaauuacuuuaugguuugugggggguugguuuuguuuuguuagguauuuuuauuuuuugccaaacuuuaguagaauagaaguuacuguuuuauguccuagaaagaaaauaagcuuaauuugugcuguguuugggaggagagauugaagcugaggucucuagauacugaacauuccaugucagauaacacugcuaguuuggaaauuuauuuaggauuaauuaagccuugcucacuggauaccagaagccuggggagguaugacucauuuaaggaaaaggaggaaguuuauauucuccaagaggaguaggcuuuuuuuuuuuuuugguugguuguguuuuggguuguugucguccuacucagcuguauggcuuguagugcuaucuacuaaguagugaggcuccuuggccuggguacucaucagcccgccuguuucuucucuuauguuuguaccagugcagguguaggugaggcugaggaccaguuuuucuuuucauaaaccuagcccugggucuuucaagcauuaaaugacuguguggucuuugggacauuccuucucuaagugugguauccaguguuuacaucugcuaaagaaaagaaaaaaaaaucugauaacuggaugcacuuaaaauauuuagcauccagaguuuuccaaaaguuugguaacccuugccauaggaaacacugaaaacuaaagugagacagcccgugauuuggaaggagaggaaggacugugcucggagaagaaggccagacucauacaggccuagagggcuguugucacauauagaguggaguggcuuugguauguccuaaggcuucaugcugagcaucagcaacuccaggucuugacaggccuguauaccuggaaucccugcauucaagagugagacaagaggagaaaaagaggcaaagcaaaaagagauggagaccacagucuacauuuuuaagaaguucacugaaguaagacucuauaggaagucagccaccuugucuggcagauugugucuuugugaaccaagggcccuguuuuguaaguuucaguuacaguauggacaugugcugguauauaucuguagacauaacuaaaauaagccucacaaucuaaauuccuccucguguuucuaugaaguuccugaacuugaguuacccagcaaauacuuguugucuacaagcuguuugccacacucuagggaucauugaggaaaauggccccucagugagcaucguauggugggacaaauguaaggguguuuccugugacguucagugaaaucucagccaagagcucccacugccucauugggaaggcuccagagaaugggaacagcaugaaccgugaguucauuuggauagagaauagcagagucaauagcugugcugaucugggguacagugaggaagaagccaguuaguuguuggaagaagcagguaaaucucugaguucaagaccagcuuugucuauauagugauuuucaggccaagaccacauagugauaccuugucuccaaaaaaaaaaaaaaaaaaaagguauuaaguuucagggaaaagaggggaauacuaaaauuuacauguggauuaguaauacugugcacaaaguuucuauauucuuuuguuguuguuuguuuuguuuuauuuuucgagacaagguuucucuguuucucuguguagcccuggcuguccuggaacucacucuguagaccaggcuggccucgaacucagaaauccgccugcuucugccucccaagugccgggauuaaaggcaugccaccaccacugcccaacuucuauauucuuuucauauuauuuacuuacugguuuuaaaguguguauguaagcccuuauuuacuacuuaguuaugcuuaaaagcaaggcuucccuuuuguucuuacuuguuuuguuuguuuguuuuuccagacaguguuucucaguguagcucuggcugucuuagaacucaccuaguaaguacaucucacucagaggucugccuaccuuggccucccgaauacugggauuaaagacaugcgcuacuaccacccagcuucucacguugauuuuuuucauuuuauacugcccaauaaguuucauauuacuguuccuuuacaugaguuccuuauuuaaaucuucuguuuggaaguugcauaguuggaaauuaauaggcuaacuggaugauggugguguuuucagugcugagccuugguaugguuagcaagcacucuaagauacaccccuaccccaaaauauguuuuuagaauugauuauguaucaaaugguggcucuuuguguuucuacucaugcaguaauaauuugaacauuaacauaacagugcugguuuucugaaaagugugugcuuguacuaucugugggagccacaugguggcagaaagaacacuuagaaauggaagccuugcauaggcuugacuuuguguguuuauuuuggcucgcucuaguauagagacucacagggucucacucuaguccaggcuggccucaaaaucacuguguaguccaggcuggcuucaaauucuggugauccucuugucauagcacccauagugucagagcuauaggcaggagccaccaggcugguuucauuucuuugcaauagaaguuaauaaaaaauaacuucuaagcauucuuaagaugcaucagccaucuuaaguaaaauaucacaaauguacuugaaagcucuuugcauacuuucuucuauuuagcuggucucccugugcuuuuccuccaggagacaacucuauugaauuuagccugucaccucuaugcaugccuuuaugguuuuguuacauauuuauauuuuuaaauaguaacauagguuguuucuuuauuaugauuuuauauacuguauacuuuuguguuaauaagcaagcugcagugaauuaguuuguuguuguugcuauuugauacuauguugaagaaacuauaaccuuuaaaauuaaguuccuuauuuugagagaggcaacauggugcugugguuauaaauaaggccucugugcccauucagauccugcuacuaucacauggcaguuuuaggccuuauuccugcuuauacaaaauaggauaccacucaggauuaaaucaacuaaaguguaaagcauuaacaucaugauuguugcgaucugcugucuuuaauaccacaguucuauaaacuuagcauggaguggauuuuguguuguuuacugagccccaguggaauagaggucaucuugcaguacaagaauagugaguagugggaaauaggccuugagggcaguuguggugguuaccuucggaagauggauacuuucucuacaguagaaggggucaucuacuaagaguggaaaaucagggugugacaggaauggaggauuggggagagcuguucaggauucgaaguguucuuguucaggacaugauucagcuagaagcagguaaaggaaucacccauguaaguguaugugcuauucuugauuguguggauuuauucuuagcaacauguugcccugaaaaagccugaacccugcuccaaucccaacacacacacacacacacacacacacacugaaugccucuauucugcuccuguagcuuauacuguugugugaaggaccaucaaauucugcaucuccacguuuauaauccuuuccauccugaauucacacucuuuauagcuuuuuuccacaugacauguaaaucauguggucuagagucaaaauagaauucugaacuccccaguuuaugagucuccgcaccugcucuuuauucccugaggcacuccuuacuccuccacuuagaaggaucucuccucuuucuuagugaccuccuuuuggaauuuagcauguccuugaauguacuaugucugaucuuagucaagauaugugccauuguguugagaguuaacauccucagaggccucauuagagaaagcuguuaagaaaauauuguaauacaaacaagaaauggcucuucugcacucucacugccugcaugucguugcucuguggcugaacuuguuucacauucuuuuucuucuuuuaauuaaauauuuagaagcagaagcagauaucagguacugucuugguauguaucagaguuggacucugagauggaugcuuuauuauaaaaccacauacugcuguccugccugacaaaaagagcagagaugccucagcauuauuuaaugccugcuuuguaaucacaucccccacuuguuuuaagaauaugcuucuauuguuggcuuguuuaaacugguaucuaaacagacuauauuaguuuaauaauauauuugauugcuaggacccuaucucaaaaacaagugaauauaucaaaggaaagagcacucuagggaucaaacccgguuccuuauacuugcaagguaaugaaugcuuagcccucugagucaucucugugccucaaccacaccuugugagacagggucugaccuagccgggcugaccuggcacucagccaugcaccaaggaugauuuugaacuucuaaucccucugcugccaccuguccagcacugggcaccaccauucccaguuuuuacgugguaccaggguuagaacccacaauucuguccauacuagacaagcacucaaccaacuuagaucgccugguaaauuuuguggacuuauaaaaacuuuuauuagauucggaguaggccuuaaaugcuagcuuucaaugggcaagauuauggcuacaugaaaguacagcucaggcuguacuucaccaggucuguuuuguugcuaugugcaugaaagaaugugaagaaaaauguuaacaaugccagagccugcuaccucccucucugccccuccuagucuguuaccuuggcuucuccaccuugcuuccuggugcagcccacacccuuuuugcaguuuuuaucacuccuauccuggcucuagcugcuguccucccuauccugcugcuuauuguuuaguaauauagaugaucccauguuguuuagaagauguguuucugacucagucaaauuccugugaacuuuuaguuuugauuguguaugucugugugugugcaugccaugguacauguaagggauguuguacuaacuuuucuguugcugugacaaaacaccacgaucaaggcaacuuacaaaacacaguguuggauugggcuuaugauuucagaggacuuagugucugugauggcagagccagagcauggcagcagaaacagcugagagcucacauuuugaucuauaagcaggagacagggaggaacacuggaaguggcaccaaucuucugaaaccucaaagcccuuccuacuggcucuucccagcaguuccaccaacuggggaccaagcauucaaauauaugagccuagggugugugugugagggaauucuuacucagaccaccacaaagcacaacuuacaggaauccguucucuucuuccuggguccuagggaaucaaacucagguccuuaaguuucauacaaguaccuuuaccucaccagcacuccaugagcuuuugauggcuguuuuugauggcugguccacuuggaugugucuuauaaaguuugauaaaggaaacuuuuacagaguucagaggcauuggcaacauuauccacagguggaucacauuuuuuggugauuuuuuuccccccuguucuggacaguguuucuaauaguugauauugccuucuugucugucugucuuuccuuccuuccuucuuucuuuccauccuuccuuccucucucuugccccuccccucuuuuucuuuaagacagggucucacuguauagcacuggcugacuuggaauucccaguguauaccagacuggccucaaacucacagaaacccacccguuucuguuccccacacuagcguuuuguauguucuggcccuaguuacuuugcccuugaacccacuggcaaugguacugaauuguuggauccgcagcacuggaucucaugacagagcacuccugagagaccuuauuuaggaagaccuuaugcuugacaaauaaauauaagaugaaugaguguugaaaauaauguaaaacacuaauuuugcuuuauuaaaguauguuuuuaagauauuuuuauucuuuuuuaguuauguuuaagagaguguaugugcacaugagugcagguacccaugaggccagagguguuggcuccccuggagcuggaguugcaaguaguugugaguugccuggcaugaguauuaagaacuaaaguugguccaggguaagugaaguaagugccgucucuccagcucauaaugagguuucuuuuuuguuuugguuuguuuucauuaucuuaugagauaaaaacuuaggcuaaaagaggauuugucucuaucaaauccauaguuaguuauaaaacaaaauuauuuuuauugcauaucacauagagaaacuaaugggcugaaauugcacagcuguucauauaguuuauagaccuucuggaccagcauaaaagaugcugguaaugaaccuugguuaauuacaguucugcauagaugcugcuuuguagcuccuguuacuauaaggagaagaaauagauaaucccuuaacacuaaugaccacuucgaugguuggguuucaguuaggcuucuuccccucuugugccugaagggggaugucauuguaacagaaugcugaaaacuguaaguugacaaguuagaugaauauuuaggcaaauuuuuagucuuaccauauuuacacuuguggaagguauuguucaaaucuacaguuuuauagacucugaaauuucaugaaauacacucuaaaacuauaguuuguauaucuuucaaaaucucaggggcuagagcaguagcucagcaguugagagcacuuauugcuugucuuagguuucuauugcugugaagagagacuaugacuacaguagcucuuauaaaggaaagcauucaguuggggcucacuuacaguuucagagguuuugugcauuauagucuuggugggaaacauggcagagugcagacagaguauggcagaguucuggaggcagagucaagaguacuguaucugucaaaaaaacaaaacaaaugaagaguacuauaucuggauuugcaggcagcaaggagaaacuaugucacacugcccagacuugaguuuauaagaccucaaagcccacacccagugacauacuuccucuaagaaggccacaccuucuaauagagccauucccuauggaucaagcauucacacacacaaaccacacauacaccacucacucucuggaagucguuccuauucaaaccaccacauugcucuaacaaaggacccugguuuaauuucuaacacccacaugaugguuuaaaccaucuguaauuccaauuccagggagucugacaccaucuucuggcuucaugagcaccaggcaugcaugugguauagguucaugcaggcaaaacaaaauaaauaaaugaaauuuuaaauuccacuuagaaaauauggaauacuaagagcaaaacauuucaaaacucuaagggaacaagcaggcuaucaugaguuugaggcuagucugaacuacauaguaugauccugucucaggaaaacaacuaaauaccaaauagugauacuacguuguuuugaacacagaagggagcacaggguccauagaacaaggggguuugauuagccuaugagauaucuaaaggcuuccuacuuugcccaagauauaguggggugaguaggagcuaacccugcuagaauccuuuuacuagacuuacaggcugcauuggagaaaccaggaaaugagagaaauagucuguccuaagaacugccuggagucaagaccaaggagccaggagcaggcucugcuggcaccagauaacacaccucauuuucuuuguuuauacuguuauaaaggcaguggagccagggaaagguuuuuaagaagggucaauaagcaaucgaccugcguuuuaaaagaucaguuugaauagauuagaagauugguggcugggagaaauuuagagcaggcaagagaaacuuuucccaaacagcauuagcccacugcugagcagacagauaccaaaugaacaccuggugaaguuuaaaagacccacacugggaguuggagguguucagaaaagggagaaacaaauguauauauagggaagaucugaagaauuaucuguaggguuuugaaggaaucuguuuguaacacuguuauaaaauguaguacucacaugcauuuucugugagaaacuuuuaucagauucacaaaaggucccuggcucccagaagaugaaaagcuaugugaaaagcuuggguaguagucagccugagagaagaauggucuugcacagcaguagaacuuuguauuuaaucauuccagucaggagcuuaaauuaaaacuacacaagaaacugucagcauggauggcagcgguugguauuacuuuagagcggauugauauuucaugccugauccaacaagaaucuaggaagcuaggaaggacagaaugguauggaaaguuguaaugaggcucaugcaacaaacagcgcagguggaaaacucuggcuggagcagcuggcggggaccauuguucucucuagccaguaggagcaggagagaguuaggaauuuuaugaagugaucacuauuacaaguguucaaggaaagguuaggaauccuacacugaaugcaaggcugaaauggcagucagaaucuugagaaugcagaaauggaaagcuuucuauuuagagucacguggggaagucuagaccucucugcacuguaaaaaguaugcaaagacgauaacuugaaacugaaaaccuuugaauuauaucugaacagaaaacuuaggcacaguugguaacuauuuuucaaugggaaaguguauuugaagggaaaaaaagaacuagggucugaagauaugcagcucaggucugagggauggggcugguaaaaagcuugauuaacauacaagaauacccagcauuguauaaaccaggcaaccaggaguaguugguguaugcacacccauaauccuagcaccugcagguggagaugggggauaaggcauucagaaacaucuuugccuaccuaaugaguuuagggccagucugagauacaugagacccugucuucaaaaauaaaagggggcuggcugggcaugauggugcacaccuuuaaucccugcaguuucgagguagaggcaggcaggucucuugagauugaaaccagcuuggucuauauagcaaguucaagcccauaaggccaacauaguacaagacccugucuccagaaacaaagcaacaacaauuuuuuuaaaagacccaagaucuucuguguucuacuguauuauacacucuacugugcacuggagguagggcugugauccuaccugguacugguguagggccaguguauuuuuccgaaguuugugaucucuguuggugccuguguguucuuaucuagcucccuuuccagugugucggaccucaguaugcuucugcacaggucgaggagaagauaaagcuccccuccccuccccuccccuccccuccccuccccuccccuccccuccccuccccuccccugucucccucucuuccuuucuguccaucugucuucaugaagacaauggcuuaaagagucuucagcaauggcucagaauuucauuuuauucuuuguagcaguuucauugcagcauaagcauugacuuauuaaaauuccuacuugucagcccagccauuugaaaagucagagggcagcaauugucauagcuuguuuguuacagagcuuggaacuggucuuuuugugacugucuucacauccuuuuaaccacagacucuucauacaagauccaucccacacaguucuguuuccugugucaguagcuuucaacaagcuguuuccuuguuggcaggguugcaucaguuuaaaacaaagccaaacacccaccucuuuuaaaaguaaugcuacuggcuacauuaugcuguugaaacacaucuuguuucuuagugccugguauugaacccagggccuuguacaugcuaaccaaacacucuucaaugaacuauacucucaaguccuuuucuguauucuuguugagagcagucuaaaaggaaaagaacaguacaaaguguucaaagagaaauuuucuagaaccaugaaucaagcuuuuggcuaagaaauagccagcagccugccuguauuugugcugugguguauguccugagagggacuuaauuggucugguggguggcacccugccugauguacuguuuacauuauuggagcaggugacacagcauuucccauguccucugugaucugcaaccccuucaccuugcuucccaagaucaaaugcauagauaaauauuggcauuuauaggcugacaaccuggagauaaauguuacccugcagaggaggcuguguaaguuggggguuauucagcaagaauagacauagaaucugaaaaucauuuaacagaauuuagcagaagaaacacucuuccucccauuuaugaauuuuuaguaauauuuacuggggaggggguggccuagacaccaucuucucuucuaaggaggauucagaaugcugagagaggaaggaauuggacuguuuccuuuggaauucugacuccccuccaacccccagggaaaaugucccaaagagcuccugaugaccaggcauuucuuuauacugacagcugucugaaauguuaauggauuuccuggcaaauaaaacagggcagacccuccuuuaagcauuacuuugcuagagcuuuuccccaacuuuaauucagaagacucuuagagagauuuuauaaaggaauugcugucauuguucauaagaaauuugcuuauuggugaccacgugggccagugugggucacugacucccccuccccuagguacagggcccagagauaaggcaagucaugucuugcuggggaggguguguacaacaagaaacaggaagcuguguuucagccgacuggccuggccugcuuugccuggagcuuucuaacccagagucaggugugcugagguccuucggcagaggacacugccuuucugagcuggcaacgcucgcucgccuagcacaaguauccuuaauugcugugcagagaaaacuaugaccacacuacagcuuaaggagcuuucacagucgggccucuaccggagaaggcgagagcguccugagagucugagagucaaugggcacgcagaggaagagcugaggugagugcaggguuggcuaagggucaagguuccucucgguuguagcgauugugauuauagcgggauucacagccuaguggaucccuguucuuuggguaggagccucuuguggcccuggagccuguucccacucuccucagcucuucuccacaccugggcuccuggugcaucucuaaaugcagcuccagacuagcuucucaacgggaaggaauugauuuucccugggggcuagagcuagcaguuuggguuuaucagagcagauuuuugugagaaauuagacuuugaguaugugucagguaguuuguaguauuuggugugggggcuggguaggguuccuaagguuguuauugaagugauguaacaaagaaauguuguggaacuacugaauauaguuuagcagugauggacaucaaaaaucuggagaacaaguuagcaaaagauuaguuguuuuggguuucaacuuuaauuuaucuaaaaccaacauuuuuuaguuuuuugcuguaacugccaagaaguuauuuuagauuugguauucugaaagucgcuacugcauuaagccccauguuacugugaaagaggauuuggcuuuucguuuuuccuuuccuuuccuuuccuuuccuuuccuuuccuuuucuuucuuucuuucuuuuuuuuuuuuuggcgcgggggggggggggggacgggggggggggcggggggcgggggagggagauaggaaguguuccuguuuuccugcugacagaaagcugcaguaaaaagaagcauuuggaaaauauaauuuucuguaucuaguguaauuuauucuugaauuagaguaucugaauauucugaccagauggccgcgugauaucuauaccuugcauuuguucucuguugacauggaagaaauugacaagcuuuuaaaacgugugucucauuauggucagcuaugucacgagaccuguacuuucagagagaaaugccuauuugaaaauuauugacuuucuccaauuuuugaugauccugauaacaaaagaacuguugucaaugcuggcaaguguccaugcaugccuucuuacgguguaaagugacuuggcaacauuuacuguauucacuuggaaaucacuggauucaacagaauguaaaggcuucugaguuugaaguguuacacauuugacuuguaaucucucccugugagaggagcaguccaaacccaggcccucauacaugcuaggcaagaacgcccaaccuacaagcccugucacaggccagauuuuugcacucagaauucaagagagaaguuagcaaacaaacaaauaguuguaauuucagauuggguuuucuuagaauuuccuguuuuaaaaauucaagaucuguaaaauauuuuaaacuguuuuauacuuauuuucagaccuaaaauacuuauguaauauaagagguaguucauuuauauaauuauagugaucuuuaaaacaacuagaauuguuuuguuuguuuguuuguuuugguuucucgagacgggguuucucuguguaguccuggcuguccuggaacucagaaauccgcuugccuuuaccacccaagugcugggauuuuuauccccuagaauuuaaauguagaaaaaaaaaugcugucuguuccaaugaauuaaagaaaaauauuuuuucuacccauuuugguuauguagcuccuuggugaugauaacagugguuuguguuucugcuguucuugucuccuaauacugggaaaagcacuuuccauauugacugugcaguuaaaacagaaaaaguagguaagguagacuuuuuaaugaguuuagagagauaggauuuaccacucguuguauuguaguauuaguuaagaagaauuaggagaguaaugaaguuaggugucccaaguuucagcaccucagaucuucuaaaggagaauaaaaacaagcgccaacaguaugugccauuuaccacgggagaagcccucauggccgucucugcaaggcaagcaguaucuuagaaauagugcagaguggccccuugguauugcaaacuuuauaugccccaguacaggggaaugccagggccaagaagugggaguggguaggggagcagggcgaggggucggggauauagggaacuuuuaggauagcauuugaaauuugaaauguauauaaagaaaauaucuaauuaaaaaaauagugcagagcaauaaaguaucaugauguuaagacaucauuuaucccauuucaauugagugccuacugugugucaaguaaagguucagggugaaugagagagacauagccucuuuaucagggaacaccuguuggcauaggaacagcagaugucuucccuaggagcaguguuugaguaggugaaauaucaaguauauuucauguuaucauacuguugcucaaagcccagcugcacuuuugaguuuauguuacaugcucccuuucuuggcagugugugaacucuuaacacaaacucuguggaggacuagaaagggcaagggccacugccagaaaacaucuuucuuguaauuuuaaguagaagacuagucuaaaauuaaaaagauaaaguuuuaaaggauucuguagcaacaugaaaauaguucuaguguuacacuugaaauugcuucugaaagauacaugugaagagcgucguaacuucuggcuuuacugauacucguuuuaaugugcuaguaagaccuggaagauccuuuuuguuguguuauauuguguuguguuuuuugagagagucucacuauaaagccuuggcugcccaggaacuuacucaauagaccaggcuggccuagaacuuacagaguugccagccucugucuccugaccuaaaaguuacuuuguaccuguaauguuucuuuuuuuuuaaaagauuuauuuauuauuauaaauauguacacuguugcugucuucagacacaccagaaaagggcaucagaucucauuacagaugguugugagccgccaugugguugcugggauuugaacucaggaccuuuggaagagcaguagguacucuuacccguugagccaucucgccagccccaccuguaauguuucuaacugcauuugagggccauggagauucaggaaauuuaggaaucauucugaguuucagaguauugaccccuuuuucccagaaaaaaaauguccauuuccaaauagcauuuccacuauacacacacacacacucugucucucucucucucugucucucucucucacacacacacuuucuuaacuauucuuuucucucaacuaacugucuuuuuaaguuuucuuuuaggaaacucagauaacaaacacauccaagcaauuugcuuuaaacuauucagaaucgcauuugcuuccccugcaguguaagagaugaguuaauaacugaucuagagaccaaucgagaugcagcacuuuggugccuauucuacaacauguucuaaugucuuagugaccaaugaccucaggucagaccucacccaugccuaauuggaaaagccccacaaaccuagaaggauuuuauauuuucuuuuuuuuuuucuuuccauuuuuuauuagguauuuagcucauuuacauuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccaucuuuugauacauaugcagcuagagucaggauuuuauauuuucaaaugauuaaaagaaaggcagaggcagguggaucucugugaguucaaggccagcguagucuauagagcaaguucuaggacagccaggacuacaaacugaaacccagucucaaacaaacaaaaucuucauaugaaaauuacauaaaauucauauuacaguaucugaacauaaaguuuuauugggacauagcugugcuucuuucuaugggucaucuguggugccuuugugguaaacugguacuugcauuaugauacagauuggcauggcccacaaggacaaaaauuuccuaauugccccuuuacagaaauccucagcugaucccuggccuaguacuaugaugaucucucugccucucuuuccuggaguuaugcucucccuaccaauucuuaccaccuaccaguugacuuuaugcauagauaaaaucagaacuauguccgaacucugaaaugaaucaaaaagcauauuuuauauucauaucccuguaauguagaaguacagugaauaauaugaaggauauucuuuguaaauuuuugggggcaaggucuuauuaugucacccaaacugucuuaggucucacuguguagucuaaacuggacccuaacuuagggcagucuuggccucucaaauacugaaguuauagaggugaacuaccaccacccaugaaauguaaagcuaacagaguauagcacacauauguuucauggggauauaggucaacccacagcauacaguagaauauaggauuaagggucauuccacuacacuacauuuuaaaauaagaauuaucuuaugaauaugaguacacuguaguugucuucagacucaccagaagagggcauuggcucucuuuacagaugguugugagccaccauguaguugcugggaauugaacucaggaccucuggaagagcagucagugcucuuaaccacugagccaucucuccagcccuacacuauacacacacacacacacacacacacacacacacacacacacacacacacacguacguacguacguauguguguguguguauguauauauguguguguguguguguguauauauguguguguguguguguguguguguguguguguguguaguacagugcacaucaguuaaagugcacauaguguauucaucaucccaccucucuucacaguucuucccauugucuucuccuuuccuguguuccuagacaaccuuaauccaagguggagcuacauuaccuugcagucuuuagaauuuuauauuauuuuuuuaauuuguuuguguauaugaguguuuugccuacauguauaucuguguacuacauguaugucuggugcccugggagggcagaaacagauacaggcucucaugcgcuggaguguugcagacaguuguuguuggcgugugggcgugcaauccagcucuucugcaagagcagcaaguguucucucuucuuuuuuuuuuuuuaaagauuuauuuaauauguaaguacacuguagcuguuuucaaacacaccagaagagggugucagaucucauuacaggugguugugagccaccaugugguugcugggauuugaacucaggaccucuggaauagcagucagugcucuuaaccgcugagccaucucuccagcccacagcaaauguucuuaaccauccaaccaucucaccccauaucuuuguuuuguuuuguucugauuugauuucuuaauuaaacucagaauaauuauuuaucuuugugcauuuaauuauuguaguuuauacuguaaacaggcuuacuuguugaguuugacauaguauuuauuuccagucuuucucuauuugaaaaaaagcugcuaaugaaauuuauguacauaccgcuguguggauaugugcuuguuucacuuuggauaucuaaauuguuuagcuaccagucuauuuuuuucagaacuugcucauuuuccaaacagauucacauuagugguguauauaguuucugauguuaccacaucuccaccaauguuuguaaugaucauaaaauuauuuugucagcuuuucagcuuuuccauucuguuguuaaccccaccaagauuucaaaugcuuuuuguuuuuuuggugguuuuuuuuuguuuguuuguuuguuuuuuguuuuuuugacaucuaaugaaauugggugaaguagaaacuuaaggguucuuuggaaauucaguuguguuggauggucuuuuguuagggcacgaacaugaaaggaguguuuuccugaaguggacacaggggaacaacucaggcagacucgugaaggaacauuuuacuaaagcagacacaagacagaggauguuuuguaaaguacacaggugaaagaacaugugauaugggauuuuuuguuaacaagauugguuaccuagaaauucugaguauacuugauuguaucuuaaaaguuaaaacuuuuaacucuuuuuuugagaagcuggagagaugccucuggguaaaagcacuugcuacucuuccagagguccugaguccagcaaccacacaguggcucacagccauuuauaauggggucugaugcccucuucuggcgugcauguguacuugcagauagagcacucguaugcauaaaauaaguaaaucuuaaagaaaaaagaaaaaaaauuaccauugaacaaaaagugaaagcugaagucuuuuauuuuuccugugggugauuaauaguaaacaaaacauuuucuacuuguucuucauagacauuugccagaaaaaaaaaucuagguuuaaaaaaaaaaaaaaacuacuauagguuucaaguguuguaauuuacucuguaaaaugcaccuuugguucggucugcauuuacuaaagcaucuaccuucauggaauugagggauaugcucuuaacacauuauaacaaaaaaagacacagauaaauaauuaaaaauuauugugccauuguuggcaugaauaguaaggguauagacagaguuauuaguugcugauuagcagauaccugguaguuccaaaguguggagauuauuuuuugguucagauaaucguacuuuaggccuuguaggccauuucaucuguccuaacuccucaguucuacaaguggggaaaugcaacugggcagcaauguuggaggauggguguaacccuguguguucuagcaaaccuuucuucauccagugaguaauggggaugagcuggaggaaagccuccugguuuuucccugccuccuugcuuagaaaguauaaaguaaauguagauacaacucuaaaaccaaauauaacuaaugacuaaugguucaugcugccuaaacucaaaugaaaauacuaagaccuguuaaagucucuuuauaugagcaaguguauaagucugugcuuuuguaugucgugccuggagaugaucugugccuacagagcugguggcguuuccguuucugaauaagagagcaggggcauugcaacaggagcaguaacaaaacuuuuucugaauauauucgugcucagaguaaucaaguaugccaggagacucccaccaccaccaccaccacuccguuccaggaagcagcuuugccugucacaugggaguaaauaugcaaucaccacagcaguguacaauuggagucuuacccuuuugaauuacuuuuuaaauuucuuucuucccccuuuuuuccuaauaucuuaucucuaagucuaccuuuuaagaaauuuuaaauuuagaguuuaaaggguuuuuuuagguuuaaauuaaaauaugaagaaaugguuucauuguggcauguguguguguguccauuguacuguauucuaaugucuucucccucucugcucuuccacuuauuacacugguugguuccuuccuuuccacagauaguccccacuucugaaucuguuacucuaaccuaagaucucuucuuucccucuuaugaaccucuuaguaguuugaugacacaugcaugagugguguguguguguguguguguguauaaauaaaucugggcugucccacaugugagagaaaaacauaggguacauaucuuucuggauugcuuuauuuuaacagaaugauuuccuauauuucagagaagauuuauagauagguuaucucugaaaaaaaaucuuguggucauuugcucuaauauacuagauuaguauuggccauccuuaaaagggguaaaaaauuguguacuucuucguuuuggcuuuuugcuguuuguuuguuuauauguaugguuuuauuucuuaauuuuuggggguuuguuuguuuguuucuggagacaugaucuuacuauguagcccugacuggucuugaacuuauucuuuagguuugccucagauuccucuucuugucucagcugcccaccuuagugcuaggauuacaguuauagaccaccacacccagcuuaucuacuugcuuuguagugcugggggccaaguccagagccuccuuugcuacugaguagcagcugcagccauaaaucacugaugugugguacagccagcauagauaccuguuauuauugaugggacagcuuuucacucccaugucauuuuacuaguuuauuugaaccauucucagugagcgguucaucuuuuggaugguugcaagauccucaccucuuugaaaaugugucuucuguccugguugguuuuauugucacccugauacaagcuaaacuauucuagggagucucaguugagaaaauucuccaucagguugucuauaggcagguguguguguagggggacauuuucuugauucgugauugauauggaaggucccagcucaugguggauagcacuacccaggacaggcaguccugaguguauaagaaagcaaacugagcaaguccugaggaguaagccaguaagcagcaugccuccauggccucugccucagcuccugcuuccucguuccuaccuuuagauuccugcccacguuucccucagugguagaguaugaccugagaguuaugagcagguaaagccccuccuccccaaguugcuuuuggucuugguauuuuaucauagcaauagaacuccuaauuaguacaucugugucuguuuuccuauaggagucauuggacauugugccaaguuaguuuuuauuaaaucuugcuuucuuauauuugaauugugaaagagauuauuuuuacuaaugcuugauucaaaguucaaguaaaagguccuguuaggcagcagacuaagugcauuugcuguuuugaacuaaaaucacugauagcaguucuguauaaaggcuugaguuuaauuucaagauuuguuugggguuuuguuuguuuuuuguuuuguuuuugagccgauuuuuuuuuuuuuuuuuuugguuuuucgagacagaguuucucuguauagcccuggcuauccuggcacucacuuuguagaccaggcuggccucgaacucagaaaucugccugcuucugccucccaaguacugggauuaaaggcaugcgccaccacugcccggcuugagacgaauucuugcacuuguuauuucacuauaucuuaccuagaacuauguagaugaaguuggccuuggaccuaccaugauccucuggcucuuucugccuccugaguaguggaguuacagaugugagcuuccaugcucagcuucuuuuugcagucuuuaaguaauuaaauguuaagugugcacacaaauguaacccacauggugccugucuauguucuaacucaguuacaaaauaacugaaacaauuguaauccaccugagcuccauaguauucuuuccccagccauuugcuagauucucucuugcacaccauucuaauagguuuaugguugagaugagaacugggggaacuggaugcgagcugucaccacugcuauggcagcagaggaccaggugcugugaauagaaggaagaagcaauguccucaaggacuuaaccagaaugggcaggagaaagcaugcuaaacagaguucuuaggacacuugagucacucuccugucuucugcuaaauuauauauaagagcaaaaagaaagucuggugacaaggcuugauucugcuguuacgacucaggucuaccuauuguuggauuuaauuuuuaugacugggagaggauaguggggagggggaaaagagaaugaggugugggacuggagagauggcucagcggguaagagcacucacugcucuuccgaagcuccugaguucccagcaagcacaugguggcucacagccacccguaauggguucugacgcccucuucuggugugucugaagucagcuacaguguauuuaugucuaaugauaaagagugcgcagggcugaccagagcgagcauagguccuaaaauucaauucccaacaaccacaugaaggcucacaaccaucuguacagcuacagugugcucgcauacauuaaguaaauaaauaaauaaauaaauagauugauagauaaauaaaucuuuuuuaaaaagugagaaugaggugugauaugucauuucauaagagcuuauuucauagcagaaauaucuauagaccauugcauugccuuuugcauagugugcuuggggcugauuuucccaugcacaguguccugauuacaucuuggcaguggugcuuccucaucugcugaagcaaagagaacucagcgaagaccucaaguuccucagcuguccuccucuuauguguccuucugagaacucucuuugacuguuucacugaacuguacuuuacugagcuacccacuccucccaccucuuccuaguuuucagcagcaaauauggcuguuuuaaguuucuaagugagacaaguuccucauguuggguaaggauccuaaaagucugagaacucuucaacuauaggauccugaccacaggcuuccucuguugguuuuaguucaacagagaaaagaaaguaccugcuuuuuaaagugugguaucuaaaaagaauaacuucuuuaguucuauuuguauguaugugcaugucccugugugaauauauagccugugagggcaaugcccauagaagcaagaagagaggauuggaugcccuggaucuggagcuugaugugggugcuggagacugagcucugguccucuacucaucuagaaaggaggacucuugucagguuagcuaucuuuauagaaaacugucucucuccaggccagaucuuaguagaugcuguugguguagcaauagaauaggaugagcugccaugagauagcaaguguuccaagggcuuagguaagaguuuccuaggggaagcuuacaacacauaaccaucuccuacuuauaucuugcagaauucuccaaaggucugguuaucugugacugcucucugcaggcccagagaaccaaagccugaggcuucuuuccagugcccucuacugacaacccgagugcugcuuuuaaaagcuaagauguagggagccaggguucagcaauauuucacuucccaacaggaugugaguugccaggauuauagaauaccucugggaaagagggaaagaauugaauaaagacccucauaaccaugugaccugguuucaggggacagaacaaagaguauuugaaucuuaacgagacugcagcccaggcugcaaacuggcugucaguguaauugcaccaucuggucaacaucagacuccuagggucuuguuauguccuucccacgccaucuuuuaucacauuuaugguaaagaaucugaguuauggcagcuaaaauacuuauugccuuucucugugcgucacaaaauguaaagcucaugaagggaagguaucuugugacuuugcagaaagguuuuucaguuucucugaugcugguagauauauauucuguaucaagaaaguagaugaaaaugagagaugcagggauaugaacaggaaagaccuuugauuugaaugaaguguuuuacuucuguccucuauacugauauuuucaugguucucuuuuuuucuuaucagugaaguggggcucaaauuaaguuuagugaagaauaaaaacucccacuaacuuccugucacaguguagcuggcgguuguguucagugagaaagcucugcugagucagaacuaaaauaagaauguaucuuagagccugacaggcggcugcugcugcugcugcugcuuggcaccauggccauauaaagagcuccugccugugccaaaugguuucccugguaacuugggcaucucuuaggucaacacagcuaaaaauaccguuauucuauauuuggagcuuucucaaauguggcuuuguaucuuucuaaaaagauguuuggaaguaggugauaauauguuaauucaucaugauaggaauaaaagauguuaugagcaguaaaggaaucacuagaggacuaguuucuaggaaaaauauuuuuaaaaucacagcaaagccuccuaaccucugagggaaauauaaaaaauuguuuaaguugauccaacacuccaaauuuguguggggcuucaggaguucacugcagugauuaguuacgggagcugucucuaaagcacaaucaugcuaaagaccucuugagcuguaugggugucagcaggggugguaccugucaaccugucaguguuggcccucugccucuuagcagaaugcuugauggaauauggagagggugcucagucauccaccuuuagacagagacaagagauccagcuuugaggcacuugcauacagaacacaguguucgguuucucuaaagucaggcuaauugaaugggauauggagguucuagcugaggagaauaauagugauucuuugacaguuauacauuuccucuagaggauauaaggcauuguugggugacagggaagugcaaauccaacuuacaaaaugaaaugugcaggcuacucauccugcccagccuaccaguuguucacgacauuucucaguguucugccauuaaugguuaugauuuucucuacacauuuggcagcucaucuccuuuucacaguagguuaccaguaugguaaggaugugucaucauagagaaaaggcagcuguuuggcauuguguuuuuguggaaagguaggaaacguaggugcuguuacuuucucuguacacaguuuucagaauguuacugucagagagggacauaaaggaagagcaugagcuugauuuguuucugucucucucuuccacucucccgaccuagggcgucuuuuacacaaucacaucuuuugcagauaggguuuuguuaugugaaucacuuagaggugcuucgugagaaauagaccccaaaguaagcuauuguuacuuguuaaacuggauaggguuggguagcugcaguauugaugugcauuauuuaagccaguuuggggcauuucugauguuguggagcuggcacacaugguucugucacagguccuuggcagccccuugcugcaucuugccugaucugaguggccucucuauucugcagacaccagagaggaguucuugccgcaccugauaguagcagauuugaauuauugauuaugggacaaaguaucuacuaguguacuuccugacaaguuuccagccuauggucggauagcaucacacucacuuccuuuaugaauaucuccucaaauaucauaaggucagccacgugcuacuauauaacuacgacaucaaagcuaccuccuuuauuuuacauguuuuauuucaguggucaauucuuaggaacaguuauauguaaauagccuuauaccaggcauccuggcauggggcauugguggugcaggguugaaaacugguacuuuaauccacacauuucauauuuucauguuuuuaaaugauuuuuuaaacuuucucucuggguuauaguuaauauacaauaaaguugugggcagcauuagcacacaucuuuaguccuaauacccaggcggauacagucgaaucuuaguuggaugccagccuggucugcagaguacauuccaacagagagcaacucgguccuaacaaaacaagcaaacaaaaugauacaguaaagucagagugcucuuauuuccuuuuaauaaccguaguaaacaucgugguaauacuaauacagacguaaauguaugcaucgcuauucagcuucagcucaguuaagaaagcuuguguuaaccacuuuuucacucuucuccaugugaugaauuuguuugccuuacacaauuaagaagcaauuuuaaaaauaaggcaaaaggcauauuaucugaaaauucauccauuucugcuugagcuuugccuacuuccuuauugucuugaaagaaaacauauuacauuguccuacaaacuggaaacggggaagagcuuuccgucuccauucucucacuugcguuguuuucaguagucccgggaaaaucagaugaaauuuuccacuuaagccaaguagagaauuacagggaaauaguucugccaaguaguaauguaacuaggccauguuaauugauuugaauaccccauauggcacccagaucuuuuguagcaauugaagaggcuucauccuagugguaguugcugcuaaguucuuaguuucgugauggauuuagaauaaauaagcaguuucuagcucucccauuccacaguuaucacucacugugguguggggaugguuccagagcacuucucuacaccuccaccucugcuguaccaucaugcccaugggauagcaaagccugugguugcuugggccccuuagaaaauggccugguccuugcauaaaauuuaccaaacuuucauuuuaaaucaucucuauacuaugcuaccuaauacaaugcagaagaaugaauggauagguggaugaauaaugacauguuaaagcuaaacuuuuacuauaaauuugauuucuuuugcauuugugcugauguguuugcauguucauggugggaugguaaacaugugugcacagauauguggaagccaauggccaaccucagaaguugucauccuugguuuuguuuucuuucauauguguuugcaaguauguaugcacauggguauagaaguguucaugucugaacaugcauguggaaacacagguuaauacgcggcaucauccucgauuauucuuugagauagggucucucauuuaagccagagcuuguugaucuccuggacucaauggccagcuugccacgcaccccuccuucugucccuccccaauccucccccacccguguguguguguguguguguguguguguguguguguguguguguguugagacagugucucauagcccuggcuguccuggaauuugcuacauguacaccaaguuggcuuugaacuugcagagauccgccugccugugugcuaagauuaaagguauacaccaccaugccugaucugcuuauaaaucuuguaggagaggggcaaggccucaugagccucuuucacuuccauggcagaaaguuaaugggcugauucuuuucuggaucuuuuuuaaauaauccuggcugcugacagugcaagagagcacuagucaggucaugcucagagaacaguauuccauacacagacuuucacugcagugcagagcucaccaauuagaccacuucugguuggugaccagaggcaugacaugagguugaguccagccuagguuuuguagcgagauccugucuuaauuucccagauucaaucccagcccggccuccacucccaaagcugcuuuugguaccucugcuuaugaauauguucacauuuuaaguaucuaacuccuaggaacagcugugaugguuuguaugacaugucuaaacaggcuauuuggauuuuugaucuuuggccauuugggguacagucaugaaguuagcagacuggugaaaucagaagcucugcagcugucuucacguuguacuggagugcucuaguguguaguuuguucucaacaaaacauuaaacauacccacugucuuagcuagguuuguauuuauuguugcaauuaaguacuaugaccaaaagcaauuuggggaggaaaggguuuauuacagcuugaaugcuagggcaggaaguuaaggcaggaaccuuggggcaggaagcgaagcagaagccauaugcacauggaacaucagaagacagcuuuucucuuuccauugucuagggucugaaaagaaaauucagguuaucaggcuuggaucaagcucccaaugagccaucucaccaucccaucaauagcuuuuauauauaucaauaacaaaacuucugggaaaaggaaucaagaaagcaaucugauuuacaguagaggaaauaaaauaggaaaggauugagagagaaagaacuaggaaaaaaaauuagccaccacuuagcccauggaaaaauauaaucucuuugaugaaaaucaucaaacacaagggggcuggagagauggcucaguguuagagaguacuggcaccuucuccaaagguccugaguucaauucccagcaaccacauggugccucacaaccaucuguaaugggauccgaugcccucuucugguguguccgaauucagugacaauguacucacauacauaaaauaaauauuuaaaaauuaaagaaagaaaaucaucaaacacugaugaaagaaacuaagagguccccaaauuagaaagauauguagaugaucaugaauuguuaaaaugucuguagaaccccuuaugaccaacaaguucagcuccugucaguauaccauuggggcuuagagacaugacucugggagcccuggcugcucuuccagacaacccaggcgcagucuagugcucacauggugacucacaacuguaacuucaucccagaggaucugacaccuucuucuauccuucaaugguacauagacauauaugcauagaaaacacacacacacacacauauuauaaauaaaaacuuuuaaaaauaccagcugggcaguggugaggaugucuuuaaucccugaacuuggaagacagaggcagauggaucucggaguucaaggccagucuggucuacaaagugaguucuaggacauccaggccuguuacacagaaaaaccuugucucgaaaaaauauauauaccagcaauauuaucugcagauguagaaaaaguacuccacaaaaauuugaauugauucacauagacugucaaauagcuaaugcaguccugagcagagaggaagaaguuuggaagcauuagcagccuaaguaauuugguacuggcauaaaaccagacuaauagagcagacuggagaacacagauaaaucaucaacauucgcugauuuucagcgaagauggugaggauauacuauguauauauacauacaaugcauacaaauuuaucagagaaauuacugcucaaaugauauaagauugaagcucaagaaauggcucagcaguuaagagcuuuuucuguccuuccagaggcccggaguucuguucucaguuggauccauguccaacagcuccagggggucugacgcccucuccuggcaucuguugguacuguguucacaugcacaaagcucacauguauuagacuuuuuaaaaaauauuaaaugcauuaauagacuguuuaaaaaaagaugaaaaguuaccaaguagucauuaaaauacggaaccaucuuuauuaucuuuauuucaguuugaauuuuaaaaacuucuaucuugccauauucuuuaaucuccugcauuuuuauuucuacccacuuuuugauugauagauagauagauagauagauagauacaacaaacuuuuauuuccaagccuaaaaguuacuauaguauugaggucucuguacggucaaauuuaauuacuaaaaauacuaugaggaacugacuggaagccuacugagaguccuuccaaagcugcagauucccccccguuggguuuucucuaccugcaguuuguccuucuuuagucauuucacuuuugugguguuuuccugccaguuuugucuccucuuuugcuccuucucucuggcguccaucaucuuggccaauuuccaagacaggucagcacuagcuaggaacaguucugcccacuuuuauuagggagcaucugcaagugccagaauuguuccuuaugaauuaggucucucucuggcuaccauuugcuuuccccacugagauguaagaaaugucguccucccuccuccuucccuaggaaaagguccugauugauauaugcugcaaauacaguuucacccuccacagauaacaccacacauucuuaccacuucauuuugauacuuuguuaccugucuucagcugcauggagcaugagguuuaagauuguggguaaaaaauuguacuuagcuaaccucuauuauccaaauuuuaucguuuuuuuguuuuugucuuuuugcagucuaaagaaauguagucucucucucucucucucauuuuucuuaaguagucagguacaaauuacaaagagaucagacaaaucgauuacauagagaauuguagaggauuuugugguauuauguccauguaucaguaaccuuuguugaacuccaugauucuguuauucuuccagcauguaagcuuauaagggcugauuaugucaguuauugucaagcauuuguggaauuaaagacuacuuuugcugcauuuauuauaagaacagaagagcuuuuaccaaaaauaaacugggcuuguaaguuacauaagcauuuaagccagguagcauacacuuuaguauagcagaauggaucuuauuuuguagauuccaguaucaaggaauauuauauuguacacacaaggagaaagagaguaaaauauuguuuagccaucaaaacagaaagaauuugugucauuucaacacuagaaaucauugauuaaauaaaauaaacuaaguuuagaaaguccugcaugcuuucacuuacauuuguaagcuaacaguuuaucucagagugguuaccaguggcuaagcaaggagaaggcuuggguaaugaaaagaggugguaauuggaaaccaagauacagaggaaccagaggaacaacuuauguuacauaugguauacuucaguuggauaacuuugguaagcaacaauuaauugacucguucuaaauagcuaguagggaaauuuuugaauuuucuacacuuuccccaaagaaaugauguauaauuaagaugauuaagguguuaagcuaguuuacccuggucugaucuuuccaaaguguguguguguguguguguguguguguguguguguaaaugucacacuguaccacauugaugugaacaguuacugggucaauaaaacuacauguuuuagcacaugccuauaaucccagcauuucugggcugaggcaaaagaaacaccaguguaaggcaagccuggguuacaauaugagaccuuguccccccaaccccccccaaaaaaaauuuaacaaugcucuguuuaaauguggcauagcugugcaugccuuuaauugcagcuuuuaggauauaaaacaguaagauugggagccaaggccagccuccacuucauagugaauuugagaugccuaugaaacacugucuccaaaaacaaaaugaaauagaccuuaaagauacaggucuuaguacuuaguaucaggcaucacccuuagccuaguuucagcugccaauagagaaaacaauaaaagaucuucucaccacuuucuguaaauaugacaggugauccagaacaaucacuaucuggccugccuagaagccaguccucucacaucaacuuuuugcaaagacauguuuuguuacaugggcuacuaauuuggagacccagagccauguguuagcucuaccucucugcaggcugguagaagaauuuacaggagaggaaugagagguuguuuauuggcuggacugucagaagggggccuuuuagguucuuggugcagccauuuguggccaucacauuucuuuauaggucauaaguuuacacaagagauacauucugagggagguuuugaacuugugauaucugauauaaggucacugaguggaggaucuuuguuguuuguuuuucaauggaagacacccuuacuggugguaggcaaguaaucuaccacugagcuacauccgaagaccuuucaaauaaaaguuggucuuugguuuuuuguuuguuugguuuuuuggggguuuuuuuuuuuagauagaauuuuuuuuuuaaucauuuuauuaguuuacauucaaccccccuauuccauccccuucuccccccuccccuuugccucuaagagggugcuucuccacccacucacccacuucugccucaccgcucuagcauccccuaugcugaggcaucaagccuccaggaccaagggccuccccucccacugaugccacauaaggccauccucugcuacauauguaucuggagccaugguucccuccauguucacucuuugguuggugguuuagccccugggagcucuggaugguccagauaguugauauuguucuuccuauaggguugcaauucccuucagcuccuucaguccuuccccuagcucuuccauugggguccccgggcucagucacaugguuagcugugaguaucuguaucuguauuggucaggugcugguagaaacucucagguaauagccauaccaggcuccucucagcaagcauucuugauaucaguaauagugguggaguuuggugucugcagaugggauggaucccuagguggggcagucuccggauggccuuuccuucaaccccuguuccauuuuuugucccugucuuuccuuuggaaagaaauauuucuggguuaacaauuuugagauggguggguggccccaucccucaacugggggccgugccuaucuacuggaguuggucuccacagguucuaucuucccuuuguuucuuauuuuggcuaaagucaucccucuaggguccugggagucucucauuucucuggcagcugggacuuucuaguggcuacccacaguuccccaccccccacugcuacauauuucuauuugauuuccugacccucuguacuucuccccugccccuucaaauaccuggcccugcccuacuuuuccucuccccucccaggucccucucucuaccuucugugauuauuuuguucccccuucuauauaggauugaaguaaccacacuuuggucuuccuucuucuuaagcuccauaugguuuguggguuguaucguggguauucugagcauuugagcuaacaugguauguacucacugauaaguggauauuagacagaaucuuacuguauaauucaggcuggccuuuaucguuguggagcccgugguggguuuaaauucuaaauucgucugccucagccucucaagugcuuguauuauuggcaugcacccccacuccuagcagcucuuucaaaguuaaaguaugauuggaauauagcucaacagauucacucucagcaucucuuaagugaaggauaaaucuacauuuacacagaagccucuaaacaacuuucauuggcaauagccuaaaacuaugaaguacuuaaaucuucagugagugaaugguuuaacuacauauauauuaauacugcugaauauuaugcagcaacauaagaucaaacuacauauacguaucuagcaaccuggacagaucucagugacugugacuaaacaaaaccaaccuucggccagcacauauaguaggguuccacaaaugacacguuauacaggugaaaaacagauuaguuaaggaguacaguaaggagauuucuaugggcagagaucauguccugcuugauugguggccacaguagcuacacacucaguggcaguagaacagcuaugccacugccaggcucccaacuucgcugcucuauuuccccuucuucagagaggaaacugaaggaguggcuuaugcuccgucagcacgaggcugaagaauugucugguucuguccuuccuguuuuacuuuguccuaaugaaaagaaaccaaaaccaagagaguauagaugaauggaaagggugauauuugcacagggaagcugucucuagggcuuucccucuucuggcauccaccagucugggguccaagcagguccagggcugcagucuuggaauuccucaucauuuugauaucucuggauucaaaguagggaggugugaucucaguuccugcuucuggucccauuuuguaccugccauauacugguuuugaguuccuguuuuauuucccagugauucuguucagccauuuucucucauagaaguuacagcauagcccugucacuuauuauucagccucuuuguggccuugguuuucuuacuugugaauagcaccuguuucauagaggauauggugauaugauaggagacacuauucacgguuacucaggucucaacuguugcuugucucucaaagggcauauggcucuucuguuaucacuaugaccugcagugcuuagcgccgugccugcucacaguucuuugaggugcuugcuuuggguaggauggcuuguuggacuagagaauggaaccacagaagaacccugcacccuguguugccucaugcuucucuguugcuauuaucaucaugacaaacacaauuacaagacaguaguaguuuaagcuaaauauagcaggaauaccaugaagaauccgugacucuccuguuacaggauuagcugggauuaaauugaagaauuacaguuaaacucuagucugguuuacacugcuccauucauugaagccuuuacuaugcuguuacuuuuaucaagaacaaagauaauaaauggcuacauagagcuucccuucaggggcucacagguccuuucugaagcuuaucaagcuuuucaaaaauuucuguguauacccaaauggagacucacucagacacaaauugucacuaacacgugaaaugguuuugggagcuucuagaagucauaauagauccagacugcugugcugcagagcucuuaacaugaaaagucaggagugacccuggcagcugggugacgcaugugggaacagugggagugacccuggcugggaaacaggaggccuggauauuguuucucuucucuguauccugcucggcaucacaggacucugaacucucaagcuuguacaauggccuucccaggacgggcacgcccgugcacuaucccagagaaugaagaaaucccccaaacagcccuuaacagcguccuugaagcuaaugggaaugaagacgagagggcugugucaaaccugcagcgcaggcacagugacguaaaggucuacaaggaauucugugauuuuuaugcgaaauugugagucucuucccuccuaaaauacaggcuuucaagucuccagaucuucaguucugcauuuccuagccauuuaagccagcuaguguguuuuaauuuagcagggcuuuuccaggguguacggagggcugggggugguucucagauugccuugucuuauaaacuuccaccagaggacauacuagaugucaaggaaaaugccaccuuccugggaagaauagacagcgcucaucuuucuaauaaugguacauuuucacuguguuauccauaagagaaguuggcacuuguguugucaggaucuauagcaggaaaaauauacucugagaguucccaaauaugaaacuaaaaauuuaaucgauaaacacuuuguuggggauuuaucccauaaucaauauuugaggugguuaauaaacucucaagauauuugauaacagaauuuuauauauuguauuuuaagaguaggaaauuuguuucacauguggagauaaaugagauguaaaaauuggaagguuugauugugguuuccuauguuagccgaguuauggagguggguguguaacaucaguccugguuggcuuuuguagacauguauucucuccgcucccauguuuucuuugucaucaacacuuuuagugaaaaaacauuuucuggaaaauuaagcaauuagguauaaccaaucuaaugacuuaucucuuuaaaaauagcuucuucauacauuguuaaauacugucaaguauaaaaaaaaugugaacaauacaggagagucaggcaagagagaagcugaguauguaaucccaacacuugggagguguggagggucaggaauuugagaucagccuuggcuacaugagacccagucucaaagaaagaaaaaagagcaccaacugccagccaacaaggugagagggaggggaagccugagcucaguugggaggcacgcggucgcuguuuucugucccugcuuuggucacuaaggggaguucauauauaugaauauguguguaaaacauucaucuaccuacgcacuuggccaagucuacuugaguuuucaaacauaauuaagucuggaauguagcuguagugaauauaaacaggucagugcuaauagcauuuuuaucagcaccauuuuaaaaaagauugaaauccaauacuucuuguaugagaaauauguauuuauucgauuaaaagugacauauuacaugcuaguaauacagaggaaaaaguaaacuuuugcacauuuuucuugaugcagcucccuccuuccaaucugcuucugcucuuggcacagagauauggcugagaggguacuucagaacuuccagagauucagucaccccagaccuugagaaucauugaguuaagugggaguaaagcaagacauuccagaauguucuucagcuuuucggggagguccauuaaguuugcugaggagugauaucauuggagagaauuuagaauuauaauggugcugugucuuuuaguagcaccuucugcuuuccagaggggauuauauuuuuuuauuauuucauccucaaaacagcuucugauaauuccugagcggaugugggcuagcgucuuucuccacucagccacucuuucuguaagaaaagagggugcacagaucccuucagaguuuuauuaaagacguugcuguucgucuagauccucucuccucacaauaauucugaaaagacaaaguggaagucucuauacacagugcuuaggccagguucgucagaaguaaggcugccucuuuucacguuuuaaaaguguuauuuuggggcgggggcggaggggagagugucauacacuaugaaggucaaagauaacuugcuggagucaguuuuucuucuaugugaauuccagggaucaaacccacaucuucaggcuuggcagcaagcacugucaccagcuuugcuuucucucgggcccaaucuuuucccuucucuucagugacacuccuaucuuaauugagcuuaugaauuaaaacagacuuuugauugaucuggaauggugaauguggggauucagcauaguguuacuguggcaagguuacaacacagaauugucuugaaacacuugaggaagaagacagauguagagcuguccuccauugggguggacaaagaauaagucuugcuauggaaaugcuaaccuuggaaagagcuaagagcaaggccgcugguuaaaguguuugugaagugagaggcucuccacgccaucugucccuuggcaguggugccggcagacugaugagauauuugaaaggucagaagcuaugccaggagcagacugcuuuuguagagguagaacuccaccauagaaucagccucuggaaacaaaaaaacaagccaaaacaaacaaacaaaaggcuuggucagugacuguucagcauauggaaccuucuccauuucuagagcuuucagaaacaaaauagcuauucaugugaaauccucaccuaagucugcuucagcugcugccuggcuccugaagcgccaguggcuagagaaaacaauuauucgugaucacauccuguguuuugagguagagugggauugcuugugagggaacugucagagucacucaaugcuaguuaaugccugcuuuuauuuuccuggccuguaaaacaugauugugucccuaccaugaacugccaagaguuugccgaaaggcugugaucugugauggagaugauuccuuguaagcagagagccuggauucuaccccugugucauucauucaugaguagcuagugccaugauguugaguuaacuguucaccucugaaccuguuucucuaucuacaaagugauuuuuuuuuuuaaagauuuauuuauucauuauauguaaauacacuguagcugucuucagacacaccagaagagggagucauaucuuguuauggaugguugugagccaccaugugguugcugggauucgaacucuggaccuucagaagagcagucgggugcucuuacccacugagccaucucaccagcccccaaagugauuuuuauuacauaaaauucugugauuuagugauacauuuuauacuguaguacuaaauguuugcuuuauaaacugucuaauagaauugaggcaucuugucuaauuuuuagugguuuuaagcaguuguuuugaacaauaucgaaucaaagguauaaucuaaaucuagguuaugauaugauguuuaguuacaugaaguuuagauucuguucuuuaaagaaauugacuuuaagccgggcgugguggcgcacgccuuuaauuccagcaaucaggaggcagaggcaggcagauuucugaguucgaggccagccuggucuacagagugaguuccaggacagccaaggcuacacagagaaacccugucucgaaaaacaaacaaacaaacaaacaaaaacaaaaaacaaaaaaaagaaagaaaaagaaauugacuuuaaguuguuauuucauggaggguagaggcucaugaggccccaccuauagcagaguagcuaacuauuagcaguuggcagugccuaggggaaggaggcaguuuacuuuugcaguguagcccauuguuggugacccaugcuccagugauugaugccacgcauuccugcacauaugggcagcacuaauuagacucagugugucaucaugaggagggaaggaguaauggacgugaaguuauagggugacauggaauggagagucuuggaaguggggagcaggacuaccugugaucuaaauauauuguauucaugccaaaaaacaauuuuaaaaacauuaucucauggauaucuuguuuguguuuuuugagacaggguuucucuguguagcccuggcuguccuggaacucacucuguagaccaggcuggccucgaacucagaaauccaccugccucuaccucccaagugcugggauuaaaggcaugugccaccacugcuggccucuuuaauauuuuaaugaaaguuacuuauccagcuguaauucugaguucuuuaagggaaacauuuauccauugauuuauuuauuugagauagucucgcuauggcuauuugguccagguuguucuuuaacuuccggguucaagcaaccuuccuugccucuaucuccuaaaaggcuggaacuagagguguacaccacugcaccagcgaagagaacuuuuggcuuugaucuguguucuuuguauccaacacugcuuacaagaaugcugaaaauguuaaaaucaaacagaaacagagcaagagguccuuauagaaacuaaagugccaagguuagugagacugggucauuuuuaauuagagaacuugcgaaaucugguuuuauggauaaaauaggaguuuuuguguccagcuagaguuugcuccucguucuugaugcugucugcucuuucaguuaacagguuaauagucucugucuugcccuuuguguguuuuagcaacauggccaaugccuuggccagugccacgugugagcgcugcaagggaggcuuugcgccugcugagaagaucgugaacaguaauggugagcuguaccacgaacagugcuucguaugugcucagugcuuccagcaguucccagaaggacucuuuuaugaggugggucaacucagcuguccuucacuuucagauuccuuaccagagauugaguaagugccagguauuuaguaccugggaggucagugguggaaugcauguggaaccugugggucccaaccuaaauaggauacccaggcauaacuaccuacauucaugcccgucaguacaucucaguucagaagcuacagugucuuguaacugcccaucagaccugaguacuucuucuccaaguacagaauccuuucucuagccugcagcagaagcaucucugcccccaaaugcgcgcuccuacaucgaaucugcccagccucaccccugggccuuacuuuaucaggaugucacugcacaucuuccuaaaggggaacccaugucaccaacuuccugauuuccaggccauauucugcagauuuccaugcauguauuucguaaagaggaucuuguuaggacuugagcacuacaggaaccacucuguuuagcccuucuaugugucuuaagcuauuuucugaacacuuguuuuucuugaugucaucgugugaucuguacuucaauuguauugaaacuuucuuaucacaggaaauguauuauggagguggcuaggaaagcucauucccacaucaugagugaacaugagaguaaucacuuuggcaauucauuuuuguuagcaucccacuuaacauauuugcaaaugugugcauuuuuauaugauacaugugcauagaauucugauaaagcuaagaaugucuguucuuugauuucuuuuuuaauuauuauuuuauguauauggguguuuuccaugcauauauaucugugugucauaugcaugccuagugcccuuaaaggccaaaagagaugauccauuggaacuggauuuaaagcggguugugagcugccauauugaacuaagguccucuauucuuaauggccaaaccaucucuccccuuugagguauuuuuccuuuucuccuaccagacuucgauuuuucugucucuaugccugaaaaaggaaagguaguuuauagcagucauuacuaaacuauuaguaccacugaggccuuucccugcucugggcagauugaaauucccacgccagccuggaaaacaccauuuguucccccauagauguuaaaaaaaaaaaaaaaaaaaccuuccauuugugaauugucuguauuagugcaaugcaaggaaauagcauugagcauugagucauagaaugaaauuuuauucaguaguacgcauauuguuccggacuuucuacuacaccucaagaaaaauuaaacaaaaacucuuaguaguaggaagauacucuuuuuuuuuuuuuuuuuuuuuuuuuuaauuccuuagagaaucuuuuuugucagaaauccaacuguagaagagaagauggaaagaacuucccaggguauauaggugaugguggugagccagaugcucuguugacucugaauggcugucauugguaagaaaaacagaaguuaggccccuagggauugugauggcaugggagggaaggcagcuguuggacugcuaucauucaguuuaacaaacucuuagaauuugacaaaggaaaaaaaaaaaaaaaagaauuugacaaaggcucugaaaucucuuaacucagccagauaagacuguuuugauuuuaagaucuuuaugaagaauuagggaaaauauaaguuaaauauaaggcuuuuauuauucauucaugaaagucaauacacagagguuagaaaaguacaggcggagguagagagaaaggaauccaugagucaaagcuuuauuugucaucagcguccaaacaagacuccugugaaguuucauuaguaggcuuaaagcaaguaggcacaaauuucagauggcgugcugugacaccuguaucuguacaauccgugcugggugugggagucagcccagcuacucaagcaguaucuagcugaccagggaacccuggucaucuggauugaucauacuauagaacuggaaagcauagaacuggagauagggugacugauacuuucucugguaugagaaauauagcuucuguucacagcggauacuuaugaccggcucacagcacacacagagguuccagaaauaugggggauggcuuagucaguaaaacgcuugccauacaagcaugaggaccugaguucaaaucuccagcacuuacguuaaaaaccagaaguaguggcacauccccauaauaccauaguucaggagguagagaugggaagaccuaccugccuaggcucuagaugaaaucagucuggucaagguagguugagcgccuaucuccaaaaauaagguggacuacagucacaaacagaugugcauguguaauugcacacauacaaugcgcacaugaacauguauguguacacaucaaaaaacaaaaaagcagggagcaauguuacucauacugucuaagucuccuuuaaucccuaccuuucuuuccuuuguggcccugagaggugaaaacauccuugacaacacagcagguagcaauuugugaugugacaggguuagaacccauauugacccuaguauccauucaggucucuucuuaagauuaaggaaauguuacuggaaaaacaauuaaggaaagaccugagaaacucagagggaaaacuuaguucugguuugucuucuaccugaucugcccucuggaguccuccagucccucuucaugccuuuucucugauaccgucccuugccugcuauuuuggcauuaaauaucacugucuuucuuagcuaacaaugcuuaccuuccgugcaccugccucuacaugugguccugucaguugcaaaaccauuuauguuuggucagaggggaaagcauggaaacagccugagcagagcagaauaaaacaugacucacacuuguccuccuguucacuccuuacucucuucacugcugggcuauaaauaucucccuaguauuauuccaaaagauguuacaaaucccagcaucgggcuauuauugggcuguugccuucuggguccuaaggaagacagcuauuuuagcuacaauguuuacuguuuaagguccauuuuccagccaaagauuuauaaagccacagauggaaaauacgaacuuuacuuuugauuaagugacauguuagagaaaaagcuauccccaucaaagaauaagauguauguucagcuaugcccaacaauggaagaauaagauguuucagcuaugcccagcaauggaagguuuuccagaacuagaaguccauuugauuuguuuugucuggggucucugacugucuguuuuuugagguucuguaguccaccuggcugagggugucguuaaacuccugacccuccagcuuccuggggcugagauuacaggcagaaacuugguguguaugugucagucuuaguauaaugagccaucaggacauauggguuggugauauaauucuuucuuguuuagcuuucaaagagcccuagguucacuuugcuauaauaauaccuuugcuauuauugcuuuuaacuuuugucaaaguauccucuuccccuuauuuccacaguccuuacucuuccuuuucccuuggaaccaguuaugaagacuuaaagauaaccaaauauggugacacagaccugugguuccaucauuuggguggccaaggcuggagauuugcaaguucaguacuaucuuggugugcuugcuuaauaagacacugucucaaauuuaaggggggcgggagacaaguuuuguugacuuacuuuaaaacaugauucacuuuucuuuguggaacuuccuaauauauuuauauuagauuaguugacuaggauauucaucccucuaggcaaagagaagacuggagccagauucuucacuacccacucacuagaacacauggcuagagauaggaacaaaagcauuucugucgcaucuguacaucucuuaagcaugguauagcugguuaugauugcacaggcuuauaauuccagcaccugggagaggcaaggaggagcaggaauucccaacacccacugguaccuccaaggccaugggagcucaugcucucuuuuaccauguugagcaccaggaauauauggugagcagacauacaaguaggcgaaugcucauaacagaaaaauaaaacauuuuaaaaguaaaacuuugucuuaaaagaaaagcagaaccaaaaagaaugcauagcagcuacuaggaauacuaccgagauaugaucccuacucacucagugacccugucuccuacuagaugaugugcuuuaaaacaggaaccuaaaaaguuucaauuuagguagaaaucugucucccucugaaaaauaaggggcuuugcagauuuguucaccaagaagaacugauuuacagauguugcuugcccaggagguucauuacuaacguaaccagccaguuccaucugcuucaguccaugucuuuccugaguccgcagaacucagauucgucucuuacauggagcaccuuacacuucgcugugacuguuuguuacaauacucaucuucccacuuaacuuugaauacuucugccacaaagacuguccacauugaucugcuaucucuaauauauaaccauaaccccagcacuugggaaauggagagaaaggaucaagaacucaagccacucuugacuacauaggaaguuugagacuagccugagcuacaugagacuuuucucaaaagaaaaaagaccccaccaaaaaggugugcuguuuucuuucuuugcuuacuugcuugcuuaaaauagcaggugggccugggggugugguuagcaguggagugcagacucaucauguagaaggcccuggauccaaucccagcacugaaauguaaacuaaaaagaucaugagacauguccaauacccaaggaaauacagcucccagcucuuuauaaugaagaaauuauuaucuccauuuaagagaaaguaagauuuauuuuauguuauuagugcuggauugccaaacuaaaauccaguuuccuucauucugauacuauucugcauuuuacuuuaaaauaaccuauuagacuauagaaauuaacacucguuuuagucuucaucaggaaauaguaaccuuauaacagugugagcauguuaaaaacauagcaggacagcugggguguguugcagugguagaaggcuuaucuaauguguucaagucccagguggugaugcuucuccaagccuugauugagauggggcuuucagugccauagguguccuaaggcagcaugccugugcuucccguaccuugccagggagcuaguccccuguucaggaguauuguacauugccagcauacaagacuuacaaggucauacuuaucccaaaaauaacucagcaucuguuugugagccauuuacuacacaagaugcauucuaaguuguuguuuuuucauuugauaguuacacgaauccuacaaacuagguaucacugguuacaugugguaaagcaagcccuugccuacuguauauagugacagcugacucgauuuuucucucaggacucgacuccaaagcugcauucucuugcacuacauugcccuaucugucucagaaacugaaaugauuuagauaaguuucauaauauaauacguuuuuuucuaaaaucuucacucacacauucuguagauccuacagaaagccagugucagaucccaggguucuuuucauaguuuucacagcucugguuauguagagcuugcaugaaugugugagucacuuauagcuauagguuuucaaguuggauaauguaguuauaguuaaaagaguccgugcugcuggcuggugguggugcacgcccuugaccccaaacuaggcagguggaugucuggaaguuugaagccagccucgucuacagagugagaucaggauggcuagggcuacauggagagagcuugucucaaaaacuaaaugaauagaaauaaaucacugcuaguuuccauagauuuuagcuguuuuguggagggaaugcccguuuaaacagaccccgacaccugcauuagugguuccuaaguauagcuuugugauaccuugcuuaucuccaccaaaagaggucauuuuucuuucccuugaaguauuuuuagaagugagcuaaacccaccaguuauagagggauccaauuccacaaaucuuuccgacuggcauagacuggacccagaacaagggcaugacuguagcccucuuugugugcugcagauccagccagcacacccagggccaaacucucuguucaugcugcagauuucucucuccuuguuugguuuucccagugugugccuuucucccccaucccagucgauauuaacaggaaaggccuguugguaaugaaugcuguaauggaacaaugauuaacaaagaguuuccucacucauuuccucuaauacuguauccugauuauucaggaaggcugggacugagaagugaagacugaagagaggaaacuccaaagccagccucucugcuuaucuacugacccacuugucucagagcaauucaugacagauguauaaaucaccaagugacuguccagcaucugcauuucugaaaugagaccaucagcuaaguucccgauuauuggcucuaaagcaacaguuauuaagccuccucccucaccccucugauaagaauauuuacagaacuccaaaaccuacacagaaagaagcagggcuguugccauggggcucaucuucucccacaccacacuaucuccugggacauaauguuucuugcuuauuguauuuguggugauaaucaaugagaagcaucgccuauaggcuccuucaucugaacauuugguuccccgcugguggcuguuuggaaagguuguggaaccuugagggaggaaguaugucacuggaagugggcuugaggauuuauugacucaccccacuuccugcuuucuuucuuugcuuccugucugugaauaaaaaugugaucagccagcuuccugcuccugccacuagggcacgccuucccugcuaugaugaacucuguccuucuggaacugaagccaaaauaaacccuuucuuccuugaguugcuuuuagucagaguuucaucacagcaacagaaaguaacuaauacaguauuccuuguuuuaaauuggcuuggggguuuaauguaauuaucuaaacuauaguguuuauggaaauuugauucuucaaaaguuauaguuucugguuuguucuucauuuuauaucccaaacuuuucuggguuaauuuaugggauuccccagacucugguuuuuugagacaggguuucucuguguagcccuggcuguccuggaacucacucuguagaucaggcuggccucgaacucagaaauccuccugccucugccucccaagugcugggauuaaaggugugcgccaccacugcccagcugauccccagacucuuaauuauuuuaugcucauagucucuacaguguguggaaaagaagcagcuuguuauagcaaaaucucuuggaauaggaaugguaguccuaauacuggaucuuguaucacagaggagcacaggaucuagaaugcagguuauugcaauggaaucaguuccugaauacuuggacucuguuuccugagucagucugucugucugucugccugccugcuucccccccccacccccuuucuaagaagagauccaugccaggcagugaaucucuucugccuccaugggcaccaggcaugcaaguggugcagacauauagacaagcaaaaaacccauacacaauaauuuuuaaaaauuauucuagaauauguacuucuuguaaauauuuaaguuuacagugaaaaauuuuaaauacuggccuaaaauaaugcaagaaggagcuuuacauauaugcagauuaucuuaguugagaguucuguaucuuucguuaaauuuauaaaaguaaaugagacuggagagcugauucggugguuaagggcugcuucugcaaaggauccagacucaauucugaacaccuagauaguaacuaacaaccaucuagaguccaguucuagugggucugaugcucgcuucugccucucauggacaccagacacacacagugcacagacaugugugcagacaaaacacccauauauauaaaauaauaauaauccuuaaaguuaaaauauguacaucaaaaauaagcagucagaggugagaccagcuguucacuguguccucgccuuguauaguuucuguauguggggguggugugccugugugcaugcacauauguacccauacaugugcaaguugagguuguuuucuuugauuguucuccacuuuuauauuuugagauacuguuucucacugaaccugaaguuaguucaucaguuggcuaggcuuucugaccaaugaaucuuguccaucugucacucugccaccuuccccaggccaggguuauaagaacacauaucuauguauauggauuguguuuuguuuuguuuuuuaauguugguuuagaguaccucguguuuguacaguuuauucccuguaccaacauagaggaauauggaaagucccaaaguuagcuggggaggugacgcacagcuuuaaccccagcacucauaacgcaaaggcaaaggcaggcagauuucugugaguucaaggacaaccuagucuacagcacaaguuccaggacagacagcuagggcuacaaagugagacugugucuccaaaaauaaauaaauaaaacccccuuugguaaggacuggaggaguugauuggcagagaacacuuuucuaacauucacaaagauuuggguucaccacacacacauacacacacacacacacacacacacacacuaaaacaacagcaaaagccacuuugucuuuucaugaaauaaucucuuucuaugcuuguuucacauauauaugaaagcugauggccuucaugguuuuucuuucaguuugaaggaaggaaguacugugagcaugauuuccaaaugcucuuugcucccugcugccaccaaugugguaaguuuuacugcugaauauaagugaaaauagguuucacacucauauaagucacuauaguaguuuugucucuuuugcgaugagaaaacccucugacugaaagcagcugagggaggaagggccuaucucaugugugcuucaggaagcagugcaucgcugagggaaggcagugcagaagccugaagcagaaacuggagaaacagcuugcuggcuugccauaaggcuuaagcucagcuauggcuguauauuucaguccagggccacuugcccccguacacugugccacauaguaggcugggcccuccuagaugacuaaccaucaagacacuccccuacagacauggccacaggcccucuguucucaggugauuguaggaugccucaagcugacagguaaagcuaacguggacagucauugaacagcagagaguacuugcuauuauauauaaagcuauauauauauauacuugcuauuauauauauauaaagaagagccgcaaucuggagagaauugacuuuuauggacauguggguaaagccaguagugggccuucugcacugcuuuucccucugcacauagccuuugccaacuugcugguggucuggccagggaagguuucaguugacuggauaacggugcuuuuguacuuggcucacucauuguagccacuucaguggugacucaacuagaacauuucuagggcuuggagacccugcguucaaugauaaaaaugauuggugaaggaagugggugucucaaaaauauagcaagaccaaaaaaacagaaaauacuuuguagagacugaaguuauaacacucagugguagaaaugugcuuagcauucauaaggcccuugguuugauccucauggaaugaaaggguugaggggguguguagugagaguaaaggaaagagugcuauaagauuuuagcucucugugucacugugggcauaaacaacuaagagguacuggaagagcucaggaccugaaagagcuuggaaaggaaagccauggugugguaugguauggcacgguacgguacaauauggacaguuuuaaaaugcaaaauaaaaaaugaggacccaaaugagagaaagaucaucugucuguucucuuacuccaacagacacaguguaaaaggcuuucuuuuaaacuaggcugguaaugcaggccugugauccuagguaccugggaggccauggcuggaggaucucaaguuuaagggcucacuugagguccuauguaaaaaaguaaaagggaaaauugcaagggcugaagaggugauaucuuaaagacaacuuagggguaaggcaguagcuucuaugggaggaacacuagagucagucccuccauaaacacuucccuuucauuuauggcaaauaagacaccucacaacauucuuugugcuuuacuuuccuguaggugaauucaucauuggcaggguuaucaaagccaugaacaacagcuggcauccugagugcuuccgaugugaccucugccaggaagugcuggcagacauaggguuugucaagaaugcuggcagguaggaguuuuccauccuuguugacuguggguggacaaagggacuguuaacucucauguguuuuuuucuauagagucugagguacugcucuagggugugggaacucagaacuaaccaugugaaaugaccccagagcuuggucacagagucuguuacugccgccuccuguucugcuaggagagggaggcagugaugaaguccaugugcaccaugaguuacuaguggaaaagauuuuccucuacuuugauucuagcacaggagauaguuuucuaaaaaaugguuucuuuaaucuuuagucagagacaugagaaguauauuuuuaaugauuaaaaagaacuuaagauuuuacauuuccacuuugacccuuuauagacaccuaugucgcccaugucauaaucgugaaaaagccagaggccuuggaaaauacaucugccagaaaugccaugccaucauugaugaacagccucugaucuucaagaacgacccuuaccauccagaccacuucaacugugccaacugcggguauuacaguauuucccugacauugugcaaaacaguagaaucaacgugaaggagcagaguugccuauuuuucuguuacugcagcaaaccaacuguuuucuucaagcuuuuauuuuauuuuauuuuauucugcaugugagcaugugcucacauguauguacugugcaccuagggucuugugcagacuaggcaaauggucuaccauggaauuaaaccucaauucccccaacuuuucguguuagaagaagguaguaagcaaaguaaaagaacaauuagcagacagaacauaagaagcaacagacagacagcggaacaucaccaaaucaggugccuacaacaucuggcagaaaugaguagaguaguccaauugagcauguaauugagcauguagaagucacauuaucagguuaggcauuuacaacauacagcagaaauagcuagagauacucugcugaagacagucauugcuugaguuaucuuuuauguguauuggcguuuugcugguauacaguauaugcacuacauaugagccuagugaccaugaaagucagaugagcucauuaaauacccuggaacuagaguuaaaaaugauugucagccaucaugugaaugcuaacauugaaccaagggcuucuauaaggacagccaguauucuaaaccacugagccaucucuccaguucucauguucuuuuuuuuuuuuuuuuuugguuuuucgagacaggguuucucuguauagccuuggcuguccuggaacucacuuuguagaccaggcuguccuugaacucagaaauccgccugccucugccucccaagugcugggauuaaaggcguguauuauuuauaugaauacacuguaguugucuucagacacaccagaaaagggcauuggaucccauuacagaugguuaugagccaccaugugguugcugggaauugaacucaggaccucuggaagagcagucggugcucuuaaccgcugaaccaucucuccagcccucauguuaaguucuugauugagaaauuuauagacagagcagaauguucucucccuggaugagcuuuuagcuucccagggccaccacaggccugcuuauaccaguggcugaacaaugguaaccuuuguuggaaaugguuccccucuagcuguucucaaaggcuuaauucuuuuagaagccuuaguuguuugcuguccuuccucccuuuugcagcaguagagggcuagccugccccagaacagggagccuuaaaagacauuugaaauaaacaugcuggauucugggauuuggagaaauggcucaauaguuaagagcauuaguuguucuuguaggcgacccaggcuuaguuccuagcaccauguggcaaaagacaacccucuguaacaucaguuccagggcaucuaaugcucucuucuggccuuugcacguaugcaccagguacacagacauacaugcaaacaaagagcuuauacacauacauuuuuuaaagcccaugacaauuugccaguauaauuuaucuuuucuuacuauuuuuugucuuaauaguuauaauauucuuuaaugaaaaucacucccauuauuuucucuuauccuugcuguuauaggccacugaguuuaacuaagauugcuugcaaguauguggcuguggaguuauuuccugcaucuuggacaccuuaccuaaauggcuacacccugaagauaaaugacuccuccuccaccaguagccauuaacuuccaauagcuuuucaguucaugugcccugaacucaauauaauuuauauuuuauauuaauaaacaccuuuguaucauaggcuguccacagauucauaauccucuguccucagccucccaaguguuggaauuacagacauggauccagcacugggaguuuuaaggcagacagauggacugagauguaauauguuauuauaagacaacaaugauaagcaugauugaaguggcaugugucugaccuuuccuugugucucaccauuaaugcaagauacuaguaacaaccugaaacccagccaagucucuuaauucaaguuucucagaucaccuuuaaugaggggaaaauagaaauuaucagggauucuuauaauuauaucuuuuaaaaucuuguuaaaaaaaaaaauccugcuaccucuguuggguucccauccgguuguacaauaguauucaguuuaaugucuuuugguggacaggaaggagcuaacugcugaugcucgggagcugaaaggggagcuauacugucugccaugccaugauaagaugggggucccuaucuguggcgccugcaggaggcccauugaagggcgaguagugaaugccaugggcaagcaauggcauguggaggugaguacagccugcccaaggggagccagugcuuucaaucuccaugccucaagugugcuagcaagauaacagucuaaggaugaaauguggacaucuaaaacaacaguugacuuuuguccuaguuuaucacuaugacuaaaacaaaacaaaaaaaccugaccaaaccaagugugggggcacacuccuuuaauccuggcacuugggaggcagaaccaggaggaucucuauaaguucagagcuagccuggucuacauaguaaguucuaggacagcuagaacucacuauaaagagagacucaaaaacaaacaaacaacagcuaccuaaaagcaaauugggaaaaagaaaggguuuauuauggauuauaaguuauugaccauugugaagugaagccaagguaagaacuaaagcagagaucaaggagacaugcugauuauuggcuugcuuccaggcucauugucagcucccuuccuuacacagcccaggcucaccugcccagggauagcaccacccacaguggacugggcccucccacaucaauuagcaagcaagaaaauacccacagacaugcccacaggccagucuuagagaggcaacuccuagaauuauggacuaguuuguguuaaguuuacaaaaaugaacaagcacaacuuuauaguaaauaaaaaaaucuagaauguuguaacaugacagcauaaugcuagauauauacuuuccuaaaucuuucuugaggacaacauugucacaucuaacaacagauauucucaguuauaaauacugcugggaugcccauuucuucuuuuagaugucuuauuugaugggcuggauuuuuguuuuguuuuuuaaagauuauuuuauuguauguguaugaauguauuaucugcgugugugugccuggagccuaugauggugagacaggggcaucaguuccccuggaccuggacauguggauagucauaauuuccaugcggaugcuggaaccaaacccagauccagaggagugggugcuucuaacugcuggguacuuaguuauuuucugguuuguuuuuugguuuggguuuuuuuguuuuguuuuguuuuguuuuguuugguguuuuguuuuguuuagagacagagugcugggauuaaagaugugugccauauccugcugcugagcaauuaucuuaaaguaaccaauuacaguuuccuauacauuagcacugagaccaugaaagcaucuggucuugcugggugugauugugcacaccuuuaaucccagcagucaggaggcagaggcaggcagauucuguaaauuacagaccaaccuggucuacacagcaaguuuuaggucagcaagagcuauaagaucuauauagugaggcacuaucaccaaaaaagggguagauggaaaucugguuauuaaucuauucaauuuuuuuccagcauuuuguuugugccaaaugugaaaaaccauuucuugggcaucgccauuaugagaggaagggcuuggccuacugugaaacucacuauaaucagguaaugacuguacuuaguagauauaugauagaugcaaacugaaacaucaauguuuccacuggagagaaagugcuuggaaaaugugcauuggucuacagagauguacuuuaaaucuuugagucucaaaacacucacuaacuaauguacaaacaauagcuguauaucuaccuuuacccacaaucucccuuugcuuccucugggugcauuugauuuuacuauauaaaaauagagcuuuauauuaauacauauaucuuuuauguacagauauacgugcacauuuaaauguccauaguuuuuuguuguuguuuugaggguuuuuuuauuuuauguauaugaguguuugcuugaauguauguccaugaaccccauguguacagugccuguggggcccagaacaaggcauuggauccccugagauugaaauuaaaggugguuguaagcugcuuauguggaugcugggaagugaacuuagguucucugcaagagcagccagugcucuuaaccacugagccaccucuacaacccaugcauaguuuuuugguuguuguuuguuuguuugcuggguuuuuguuuuguuuuggguuugguuuuuugcagggcaaguuuuuuguuguuugguuuaguuugguuuuauggguggugggugaguagaugguugguugguugguugguugguugguugguugguuuugauuuuucaagauaggguuuuucagacuaguccugucugggaacuagcucugcagaccauguuggccucgaucucagacugccugugccucccaagugcuggaauuaaaggcaugugccacuccugcccaucuuaugcauaggguuuuuuuguuuguuuguuugguugguugguucguuuuggcuuuuuuguagggguuuuuuuuguuuguuuguuuguuuguuuguuuuguuuuuuguuuguuugguuguuuggguuuuuuugugguuuuuccagacaggguuucucuguauaguccuggcuguccuggaacucacuuuguagaucagaccgaccucgaacucagaaauccaccugccucugccucccgagugcugggauuaaaggcaugcgccaccacgcccggcugcauaggauuuuuuuuuuaauuuuuuuaguugagaauuucauauaauauguuuugaucauauucaauccuaucuucucuaagucuucccagauuuacccuaccuuccuauacuuugccuucuuauaacccccaguuucuuuuuuuuuuuaauaacccaucaacuucaguuugugcucccauuuacaucuguguagggagcuguacacuagagaauggccaacuuaccaggagcuacacucuuaaagaaaguugacacuccuucccacagcccucaacugcccauaguuccucaguuaggacuuuaagccauaagcauuugaugcagucauguuccuuuaccccaaauguuucaauguauauuucccuagaauacagaacuccuuauauaucacagauaccagcauugauauaaugauuucacuuauucugcuuucaucauuuagacauuugcuuaucuauuucucuagagacaagguuucucuguauuacugcagcagcauucccagcgcugggaugcacuaccacccagcccaauaauguucuuauaguacuucuuuguuuccugcucuaagauuagugucaguauuguuauauuucuuuagccuccucaaauauggaacaucuccagucuccuuaguauauccuuuuccuuucaucucuucagaugguucuccacuauuauuuugaggucaugggcucuuggcuggaacacugaauagagugguaugucuuccucagcacuucucuucuguguucauugcuguuccacuggugcccacccaggcuugguguugacuauaucugcacugggaguuacugcccaccccaucccccaacccgugaacagucacuuucugacagcauaaaugcccuccucaucacuuucuccuuacauuuaguagcaugcaagagugcugccugcucuggguggaaaugagaguuacccaguuuagugcccucccugcucaguugcccucagcguucugcuugaacaggcuucauccuccuuccugggcauaggguuguuuuguauguuuuguuauuuuggugcucaaauugucacaaggaaagauaugauuaagugaagaaaauggaguguuugauuguaacuaaccaauuacugauuuucuuuagaaagaauaaauucucaaauuuaguugccagcuacuuguuuuucagugguaaacagaauggagaucauauaaauauuuacuguuaaaaacuuaauucugccaggcgugguggugcacgccuuuaaucccagcacucaggaggcagaggcagguagauuucugaguucgaagccagccuggucuauaaaaugaguuccaggacagccaagacuauacagagaaacccugucucgaaaaaaccaaaaaaccaaaaaaaaaaaaaaaaaccaaaaaaacaaaaaacaauucuaaugcagcuugagccuucaccauuuguuucuugucuucauucucagcuguuuggugauguuuguuuccauugcaaccgugucauagaaggugaugguauguaucugcggguggaugggccgacuuugucauaaacacaauggugggaagauggaaagaagcuagcugcuccugugguuugcaguucgggcacugucaguugcuucccucuuggcaugcuucuccagaacuguacaacagcuagaugggcuaccaaggcagcacagcuggugcaagcaagcuguacagaggugcuaggacgugcuguguggcaaaccaggcaggacagauuggcuguaacaaagaggaagcagcuguguuugcucauggucacuaacuaguccugccagaaauuuccugacaaaauucuaaacaauaguguuugcugcaugcuuucugauucucagcagacaucaccuaaucaggaaauacaagguuaguucaagaccuucauuagugcacugcagucaauuuaacuccucccugcaguagacacugucauguaaaggacaaaggaaguuaggugcuuauucucaacuucaaaagaaacaccccuuuaagucagguacauuaaaaucgggaauuuaaaauuuguuaucuaauguauauugcuucaggggucuuggagccuuguuagaaaagcucaccugagcaaggugagacagaugguuaucuacugcccacggugcuacaaggaauaguguuuuagugucucaaauuuguaaguaaagaaaaauuaaaaguuaaaaaagggcaaaagagccgggcaugguggcgaaugccuuuaaucccagcacucuggaggcagaggcaggcagauuucuaaguuggaggccagccuggucuacaaagugaguuccaggacagccaggacuacacagagaaacccugucucgaggaaaaaaaaaaaaaaagggcaaaagaggucuagagagagagaccucaaaggauaaaugcguguguaaugaggaccagaguucuauccuuagcagcauggaaauacugcucacacagugcaaccugccuguaauuccuguguuuggaagguagagaggggcuccccagagcaagccgccaaccacacuaacuguucuggcuagcucugaguucaacugggagaccuuuccuccauuaauaagauggagagugaucaaagaaaacuucauauauacacacaugcaugugcacccacacaugcacaaaggcaugcaaaaaaaaugaaaacauagaaauagucuugcuuaaaucauaaccuaccuuuccaauaaugugaaaaaagccaggcacucaagagacagacacaggagaucucuaugacuuuagggccagccugguccauauguuguugaguuccaggccagccaagagcuucauaauaagacccugccucaaaaaaaaaaaaaaaaaaaaaaaaaaagcaggugaaaagauagccauaauaauaaaaaguaaauugguuagaagcauacgaggagcaucgagcuuuugggcugugcuuuugcaagggagaaaacaaaacuucuuaccagacaugauggugcacauauguaauuccguaaucaaggaggauaaagcaggaagaccagaaguucaguccaaccugggcuacacaguaggacucugucucuagaggaaaggaaccucucaggaaagaaggcuugagccccccucuaggugcauggggagcagccguccgcguucuucaggguggggaagugaagcccucuucccgcagugaaaugcucccgugugaccagaucucuuuccccacaguggucucugcucucaacaaggccuggugugugagcugcuuugccugcuccaccugcaauaccaaacucacacucaaguaaguacuggguccaguccauugugauuaccaaagcuaaaagauuuagaugccauuuagaauguaaaaggggaagugauugauuccugucucuuuuucucuugaguccuucugaaaguacauguucuucuuuaauuguuccuguucuguccuuucuuuguuccacucaaagggauaaguuuguugaaauugaucuaaagccagucugcaaauacuguuaugagaaaaugccagaagaguuuaagaggcgacuugccaaacgggagagagaagcaaaggauaaggacaagcagagaaagagaaagccagugugucuguaaacguucugucccuccuacuccauucucauugcuucucugugguuagucucuuaggaugccuuucuuuucugugugucuuuuuguuguucugucuuuuuuuuuaagcgugguuuuuugguuuuuuguggccauagagauugaaauacucguccugugugaacuugguucuuuugucuuuuacaaguauaaagcuuaaugagacccauacuuaccaagggcuguguaauauguacauaucugccgcagcucagcuuuucugucagugugaccaagagacaccuuuucucuacaaccuuuaaauaguagugggaacaguuuuaaaguauuuuauggcaauuaacugcuguggucuuugguuucuuuaccuaaaauuauuuaacugaggaaguggaguguuggguguuuuagaaccacacgugcucgcagcaugucuucuggcugagcaaagccaccuagauggcauagcaacacuguccucugcagugcucuguaugcucacucccugccgcuugugaaggcauuuccuugaguuuccagacucuuacucuuguuuuguauggguaugcuucagucuuggacguucuguuggaucacugacaugauuaguucaugguuuucuuuauggugguuugaacuugaaaagaagguuugcuucauuuucuuauuuccuuuuguugaagaauuaaaaggcaaauauaaacuucaaacaagagaacuagucucacuaaaggaggaaucauauauuuuaagcuuuugccaccaaaaauaguuuuuguucuaagaaaacauugggaaaauauuuaguuuaguuauaguuacagaguacauguaguuccaaaaacaggcaagacccagaauuccccaguuaaaugacuuugggcagcagagaaaccagagaccagcaacaguugauagauguagagcuacuuuaaaacuguuccaacuacuauuuaaagaucgcagagaaaaagugucuaggccacacugugacaaaaaagcuggucugagccugcacaugagacaggccuguacauucaagccucuuaccaccauuuaaaccaaacugccccucaaguauucauuuaccaacuggcaacauguaacauuugaaucagcguuaguuucuuuguuaaaaaaaaaaaaauggaaagccaaacucagaaaugucauaauguacaaaacauauuuguaaauacauggguagggauuauucuuguuauuaacauuguucuuuaaaaucaccucagugcuggaugugauaguauacauacaccuuugaccgagcaugcaggaagcagaggcaggcagaucucugugaguucaaggccagacuggccuaaguagagaguucuaggugagccagaacuacauagaaagaagcugucuccaaaagaaaaagaaaaaagaaaaagaaacaaaaugacuucaaaacaauuauuguuaucuguaacaguguaucacuaggcuuauucuacaaaugcuuucuaaguauaacuucacagcaaaugaacagguuauaaauaacguacagagcuuggaauucagcaguacuaagcuccugcaauuagcuuuucugaguacauuacagguggagaccaccuaagagcuguuuucuccagaacuguuuauaagugaauugauacuauguguucuucuagcuuuaagaauggaaucauguucucuauugaacuaccacuuaaggaacacuuaagggcugucccauuaccuuaguguucaagaaugauaaccagcuuuuugucccaauagcuaaaaauaaccuacuaugauuuaagcucuuuuuuuaaaaaauaauuucagguaauuuuuuuaaauuaggagacaaaaggaaaaucauuucuacagggaaagaugaaaccuuauaguugccuaauuaaaaauacuaaauacaugauaagauccuuuuaccuucaaaaauuacaucacucacauuauaaaaaccauuucuuugugggguguggugguuuuaaucacagcacucaggaggcagaggcaagaguaucucuguuaguuugaggcagccuggucuacaaagcgaguucagaacagccagaucuauacagagaaacccuucuccccccaaaacaaaacaaacaaacaaaaaaaccccccaguuuuucuuugcuuuaaauaaauauauuggaauaaguuuguuggugacaagcauggugguucacacuuacaauccgagcacuggguagacugggaaaggaaaauccccaugaguucuagccaacuaggcucuagagugaaacugucucaacaaacuaggggguaaaaggcacugagaagaggaaagcgcugccugaugcuuuaaaguuugauugacuuuauuugggaugaagagaaggcccagugcuuaaaacaucacauauucuaaauguagggguacagaaccauuguauaagcauauuuucaacugauaccagucacucuugacauuuaucauaauaagaauugacauuagaauuacaguucuuuacugacauguacauagagauuuuauauacuauguuacauugcgucuucauuuaugucuuuucaugaauuuaugucacuuuaucauguuuguguauauauugugcaugugugugcugaauauauuuccacuaauuucuuuuuuauauauaauucccuuuaggaauaaauuuguggaauuugacaugaagccagucuguaagaagugcuacgagaaauuuccuuuggagcugaagaaaagacuuaagaaacuaucugagaccuuaggaaggaaauaacuuuuggugucuuuuuucucucucuucuaaucaauguuacuuaaccugaucuacccuugcuuaaaacuaugucagagcauuagaaugguuuucuucauuucccuuuucucauuuaaaaacgaaagaaaauguuuauuucuauguaaaacacagaugaaaucaggacuuucauuucuuuagccauauuagucuguaggcauuaaaaguauauaaccaaaaacaaaaacaaacaaaaaaaaaagguuaaaggguaguuuuaauuaagccauccaaaauauaaauuuaacuucagaguuaaacacccugcucuauggaccaaccaaagcacuugcugccagccuaguacuaaguugaauccuuaagagaguaucugagacaguguccacaugggucauguggagcaagaacuuacucccacaaguuguucucuaaccuccacagauggccauggugcauaugcgccaacacacaguuaauaaacauaauagacaaccacuguuauaaagagucagcuuucacgggacucacauaagcuuugcuucccugaucgcauaagaaaaucauuucccauucauauacugggaacuguaugggaagauaagugcccaaacaguuccuauguugucaugugcuuauccaguuagcauuguaaaaggaacaugcauauuacuaagaagcaaaaacauuucaggaugacugauuucuuuuuuuauuaaaucacuaagcuuaguuuucuauuuuguucuccuuauaaauuuuuccuucauaaaauuacuuaacauacuuguaacuacuaaugcaucuuuuacauuuuuaagcaaaacaaaacaaaaauuugccaguuaucuggaaaauauugcauacauugugauguuggggaaaugaagcauuuuaaaacuauauuacacauaaaaugcauaguauucaaaugggacaugaaaugcacuauaaugcagcuucgaauguauggcuuucaaaagugagcgugagccaggugugguggcacuaggcuucaaucccagcucucugcaggcagaucucugugaguccuaggccacccagggcugcauauuaaaaccuuguuucagaaagaaugacuguaucucguauuaucuuugugcuaauaucuauacuucauacauaaucuaacuugccuugccuuagaaaacugcauccuauaucaggaauucuagauauuucuuauaauaucaaaaugaguauuuugauugagauucauaaauuuagaaucauucaccacugauacauacuuuaaaaauucuuuucucaggaagccagugaaaguuaauuccuguccucuuauuagaacuaugcugauauacuaaaacauuuuaaugaaggcuuuuuuauuucaaaugucauaacuggguuuuguuuacuauaaagcaguaaagcaguauaaaugauaccuuuagacugaaagagggugguaagaguaucaacucuaaggaaaaauuggggaguucuacuuuauaaaacuguuuauccugaaaugucugggccauucuguuuguaugaacucaauaugcaagaguaugaacauuuuuuaaauuuuucugcugcuaacauguuaccuucuuuuucaguugccaagauauauuuugcaaauacugcugaauauaaugacucacauuguagucucagcauuugggaggcugaggcagaaagauuaccaggaguuggagacaaauccuagguuacagugugagauacuaucccccaaaacauccccacaaacaaaaacacuaguguauuguuuugccguaaagaauaucucuggggccuaggaaaacguucagucaguaauggacucacaccagccuuaggaccugaguuuaaacuuggagggagcagaucccuggauuuuacgagguagccaaacucagccuaacuagugagccccagauccaagggggaaauccuguauuccaaaaagcaagguggaugccuccugaggaagggccgccuagacugaucccuagccuccacauccacacacacacaugcacacauucagaaauauggauguguacacacaaaaaggauaucucaggaugcuguuacucugccauuaaaaguuuauaaucaugaauuuuuaaaauacuugauuaugcacauuauggaauacauuucuguuuccagauaacuaacuuguaaccaaucauuuuauuuccuaauauccuuuucauauuaagagaauuauaugugacuaaaaauauacaugauuuguguuuguuaagcauuuuaaauuugucuuugcuuuugacaauaagaaccaaaauuucuuccgugugccuuugucagcuaagaaugacuagcaguggcuaccuuagaaguauuuaugaacuauuguacaugcguuuaggcagauagaacuuguagucuagcgucuugauguaacuuacauaccucacuggaaguauggagcagaaaagcacucauucccgugcuuuccccaucccuuucgagguguguggccuugccugacugccuuugcuuacgugacaucgcuuaagccagaguccccacugcugucuuugcucacuucucuucagacaggaauauuccaguaaguuugaucucauaauuaugugguaauucaucuagagauggugcuuuucacugugggguaaaucauuagagcccuuaguguggaagauggaggucuaaauggggccaagacagagacuucaucuacuuccuauuaguugugggguuucacuggcugcuggcauuugucagugaacaucuguuugaauuucugagaacaaucugaaauaauucauugugcuuaugaaauuucuaagugcccuuuuuguccuuauccuaauauaacauggaaaauggauacacaaaaaagauuuuuugugucauguucaaagccuuauuauaacacuuugccugaaauaggucauuuugccucauccauuugccaaauuagccaauuucaaguuagggaaacuuugauguaggcugacaauauccuuguauuuuauuuuagauuguaagcuuaauggcaagaaauuauaucaauaauugugcuuuuuauguagcaaccauugcuguguacuuuuggugcuuaauaaauauucauaauuauucauaguguguuacauauca

SEQ ID NO: 5506 - RNA, 48903 nt, Mus musculus
cuuuuuacaaggccaaauugaaguagguuuauuucauguaccugguuacaagauuaaguauuuuuauaguggugcuugcuauuguauaaauucauuaaguaagccauaaccugccuuaccuaaucuaaugguuggacacaacagaaaugacuggauacuuacauuuggauaauagaagauuguauggucuaacuagauucuuuuuaguucuuuauugaguaagcccauaagaacauccccuucuguuugccuaacuuaacacaaaccauauccaaguacauuuucaguguuuaucaaacucuugauguugaaguucgagcucagagugcuggccuuuagcugaucucauuuagggucuucuuucccugcugauuccaccaggcccauucccuuggcugucugguuucaauggauagcagguagggacagugggaaucuccuucauuuggcuaccuuaagagauucauaguuacucccaccauuuacccaugcuucauugaauuucuucacuuugacacucagagcacugggcagaaaucacaucuaguuacggaaggaacagacaacuuagaugcacaaguaaucaaauguuuuaaaugucauggcuguuaucaauuaucacuuuauuucugcuacaaaauucaccagaaaaagguacugcaacaaucuaauauaaagcaaaucuuuaaccaaagaacaugguauagaucuuuuaaaaauauugauacuuuaucacaagaacuagagaaaaauccaauucuaucaucaggaccaagcugaaguuucugagguaguagagacagguaacagaaaugugaauggaaagaaggaaaaaaggaagagaagaaaggaggauggggaggaaggagagaaggcuagcuaaggaaaugaucaacuuauuuaaaauguaaaaauuaacgucuucaaaagagcacaacauaucaagaaaagacaguauccuacuuaaaaguuaauuuuuaacuacacaggagcauaaaaaugacagaagagcacuuugguuaacuccuaucuucuguggcucuauccauaugucagucuauacauaaaugagcacaggaauagcuaagauuacuauauauauauauauauauauauauauauuucaaaucuaaaauaaaauuaucugcauuaugguccccuuauucaaugauaaguaccaugcaggaaguccagauaucuuaacaggaauuaaaauaaguugcauauaucauauuacuucaauagucugggaaauucuauugcuuuuaacaaaauuuguauuagccauucuaauauagauaugucaggaguacauaaaaauaaguacaccugaaauacaccaguguuuaaacuuuuauuucacaccaugcaagaucaauuauuacacacuaaaaagugacaacagcuauaagcuacaauuuuacauuuauacaucggaaacaucuguuuucaaaaggugaacauaauuacuauacugucuguaacaauuacgcaucaauucaacugcuuauauagauaaaacucacugugaaaaauuauuuuauagcuguccacauucugugauacaaauucuucuacuaacagacccuuuaggagaaccaaaugauucaaucuuucucacaguauccaugccauccuuaacaaacccaaauacuacaugcuuaaaguccaaauguucugcuuucuucaguguuauaaaaaauugagaacuguugguauucuggccguaauuggccauggauaguaagccaggaccaguguguuucaaaucaaaguuuucaucgucaaauuuaucuccauaaauggacuguccaccuguuccauuguauuugguaauaucuccccccugaaaaaaacaaaaaaauauuucuguuaauacugacuaaacauuaaaacacacagaaugauagggcaaaucacgaauccucuauuucuuuaagaauacauuuugacagcuaggcagugguggugcaugccuuuaauccuagcacccagaaggcagagaaagguagaucucuguaaguuugaagccagccuggucuucaggacaaccagaaguacacaacacagagaaacccugucccaaaagaaaauuaaaagaaaaauugaaaacuaagaaauacauguacugcuguuuuguucuggguggggaggucaagucuggggauucccuccugucucuagcagguacaaagcauuagaaauuuggauccuuucaggcugaauguuugaaagagaguguccaguuacagugugggaaaacugaaaauucccaagaugaaugaggaugaggggaagaagaaauaccuucccaagaugguguggucuaguuuuagcagauauaaccaugauguauguauagugacacuuacuuggcaaauaaaaucuggaacuacucggugaaaaauggaguucuuaaaaccaaagcccuucucuccagugcauaaugcucugaaguucucagcaguuugaggaacgauauuugaaaauaauuccaugauuauccguccuagagguucaccauccgcacaaacaucaaaaaacaccacaggauugguguccuuugauaauucugcugcaagggauguauguccauucuggaguuuuauuauauuuuguugacauucuucaaauuuuuucuuaaaacucucagucauuuccuuugucuuaaaucucacugcaagcuguucuacuuuugcuucuccaucuguuauaaggaguggaggugggaagaccuuaauauuaaacuuacauucaaagcauguguaugauauagacuucagaagucaaucaaguuaaaaggcaugugaagguagagacucaccagcauaaucggaggcaguccagacuaaagcauuguuugaaacauuuaaagguuuuaauuccauggcuuugguaauaacaugguuugcacacacuuuaaaaaccuggucucuucucauuaggauccgauaauacuucuucauuguaugccagagaaucuuuauaucuccaauaccucucuccuuccacugacugacaucucugucccaccuauaaaguuuggcucucucuuugaacaaaacuucuucaucuuccucuccagauuucacuucuaccuaugacgagaugagaauaauuuauauaaacaacuagucaugacaaauccauuaaccagugccaacagguuuuacucuagcaugguaucuaauuaauacccuauacuaauaauauaucugauuugguuaagcaguaaagaugugacuuaucauuaaauauuuuauuuaucucugugaaaagaaaaugccuuuaaagguuaaaggggguuucaaaaaugcugguucuugccaagcaugacaguauacaccaauaaucccaacauuuggaguguggaagcaaaagggucaguucaaggucggccugggcuauacaagaagaaaugugguuuuuugcauggaugggcaguaaucccagcacuccagaggcugggaggccagaagauuagaacaguuuugaggccagucugggcuaguacauguaacaguauguuaaaaaguauucuguuuuuauaacuuuauauauauggcuguuuugccugccuguguaucuaggcagugaauuccucuauugccccugaucucaaaagaggguaacagaucccuuggaagcagaguuacagacaguuguuagcuaccauguguguacuaggaauuagccucugagcuaucuuuccaacccuuucuauucuuuuaaagaugugcucauuuucaauuuuauguaugugugaguauguacauaugaaugcagaugacuacagaugccaaaggcauugaucucccuguuacaggcagcugugagcuggcugacguggaugcugggaaccaacaaguacaaacaucaccucugagcaaaucucuccagacacagcagugcugauucuuguacugugacaguaacugagacuaaaaauggauaucauaauuuucuaaaaacaagucuucuccauuucuuaccuaaaauuauuuuaugaagacaaacaugaucuccuaaugacaagacaaaaaugccuauggcugagcaggauguccagugaguaaacacgauugcuagcuacccaauccuaaaaaccugaggucaaggcugagaaagcuauccucuaaccuccauauaacaccauggcauaugcauaccugcuuguguucucucauacucucugugguaugugcauacccacuucuuuccucccucucacccacucucuagaaacaagaacucgggaaaagucgagugggcaccaguaguauugugcuuguuaacaugagcaaggcccuggauucugucuucaacacuacauccaaaaauaacucaaaacauuuccuaggaaaaggcugggaaucugggcugcugauauggguucagcaguuccuagcacuggcugcucuuucagaggaccuggguucaauucucagcgcgcacaaggcagcucauaaccaucuauaacuccaucuguauauaacuccaguccaaagggaaaugacacccucaggggauaugaccauaggcacacacaugauacacagacaugcauguaggcaaaagauucauacacauaaaauaaauaauuuuuuaaaaguuuggaaauguaacaaauagaacauaauauuuaacugcuuugggaaaaaauguagauagcaguauuuuuaaaaaaaaaauggaugcaggguguuauuuuuacauaucaucacuagugaaguguuuacuuccugguauuuaccucugguaaggagacuauagguucaaaguggauguccucauuaugaacuacaucuucaucacugccgucuucauccucgccaccuuuacuuguugucuguguuccaaacacagcugcuccaguauuugcccacuggaaauuuuuaucugauaaauaaauuagacaauuuaaacagugaacucuuaaauuuuuauaaaaaagaauuuugcauuuuuuuagauuacguuucaaugaugaaaucagugaauguaauuuucaacaaugucauaaacacaucuauuugagauguucaaaguaauauuauucuggccauuucaacaacuauggaauacaauugacugcaguguguuucuagguuaaauacuauuuuaagaaagcaaagugccagacagaguggccaauaccuuuaauacuaacaccaggaaggagaggcagguggacaucuguguguucaaggcuagccuagucuacacagugaguuccuacagccagagcuauuauagugagacccuguuucaaagcacagaaagaaagagggggggagggagggggggagggagggaggaaaagaaaggaaggaaggaaggaaggaaggaagagagagagagagagagagagagagagaaaacagaagauguauaaaguaauguaaggauucaacauggaagaaaacaaauacaaugaagaaaaaaauaaaauauaagcaaagcggagaaauaauaaagcaaaaaucuacuuuuggcuucacacucccuauguuaacaaaacaaacaagcgaagugaagaggaugcagugauacuauuuauuaaggcaaggcuaaccugguaagcuccaucucauccuugcuguacaauacugauaauaagccaucacuaccaauguucacuuggcuuuucaggggagauaaguauaccuacuguacugguauauuuacucacuacccaucuuuuaaugcuaaucuaguaaauacauuaaaacuaaaguugaaaagcuuggugucacaccuuuaauugcaacauuugggaggcagaaagagauagaucuuugugaacugaaggccagucuacucauauuaagaguuccagcuuagaaaggauacauagcaagacccugucucaaaaaaauaguaacuuggcauaaguaaaacuaugaauucuuaucaaucauuuauuuucucccuccccggccccccccccuccagacaggauuucucugugugccgcuguaauaacuuuuuuucuuucuuuccuucuucuucuuccuuuuuuuuuuuuuuuuuuuuuuuuuugagacaagcucucacuguauagcccuagccauccuggaacuuauucuguagaccaggcuagccuugaacucacagagagcucugccugccuuugcuucaagagugcagggacucaagguguguaccaccacugucuagcccuaucaaucauuucuaaaaguuuaauguguuucuguaaguagcaugaaccuaaaaauguauaaagaucuaaguaggacuuaaaggacuaaaauuuuaaauuggauuauuucaucauucuaaaaugucuccaaauaucuuaaagaauaauuuacauugugcuauauuaugaguaaagacagugaacaaauagcaccugcauggcucauaaccaucuguaacuccaguuccagaggaugugcucacuaagggcacugcauacaugugguagaaauaaacauaugcgacagaaacacacucacaaauaaaugacucuuaaaaauauacacaccacugauaaaugagaagagacacuaguuuguaaauuucuacagccguaaugcagaaauccaauuugucuuaaaaccaagucaggguuaucccaaaacugaaaaacauacauguauaugaggaaaggaaguacuaucaguacuaaacuaaaauuaagagaaaauucuuagagcuguuaucaucaaugccagacuguguaauccuaguuacuaauaagcaaaccaaggacagggccauccuacuuaagucacaacauggaaaggacugcuuuuuucaauuacacuuggcugaaaucaauagucaucuuuuuccucuucaucuuaccuuuagagccaaaagcaaaaucuccagaauuacuugaagccaagucugcaaaugacaggccuguaccacuuccaaauccaaacaaaacaggcuuguuuuccccugacaacaaacaaacaagcagacaaacaaaaaacaacuuucaguuugagauaagauuauauaucaaaaccuuacccaguacuccaggugaggcaagguauaaaauacacuuuuuaaaucuaguauuuacucuucuaaaaugccuucaaguucacuaaguuuuuugaguuguuuuuuuuuacagacuauguguuuguacauauguauauauuuccuuuuuaaagaaaaggauuuauuuuaauuauuugaguacacuguuucucucuucagauacaccagaagagggcauuggaucccauuacagaugguugugaaccaccaugcugggaauugaaaucaggaccucuggaagaacaauuacugcucuuaaccacugagccaucucucuagccccuacaaacuauauuuuaaauuacaaaauacauucaauuucaagcuugcucaguaauauuaaguuuacaggugcuaugcccaaugaacaccaacccaaaaccuaaaccaauucuccuuucaaauccacugagcuacacacuaagcuacauuaugagacuacauaucaagguucuuacacacccaaucaagcagucaaaggguagagcuuagaaaaacucuguacuaaacauuuuuuaaaagacuugguuccccccaccccuggagacaggguuucucuguguagcccuggcuguccuccaacucagagauucagcugccucugccucccaagugcugggauuaaaggcgugcucuaacaccaccuggcaagacuuguuauuuuuaacuguguguuucugcaugucuaugugugaguaaauaaaugcacaugagugcaggcucccagaaaggagaaaaaaggcugaagguguggguuaccugccugccaugggugcuaucaacugaacucugcaaaagcagugggcacuuaaacuaaauuuuccuguguucuuuacauuuagacaccuugucuaaauucuacuaguuucaugaucucugagauuucuuuggccuacuuaguguucucugaaaacagagcuuuugguuacaaaguuagcuauuuuguccagcauauuaaagauaaagugccacaaaugugcucuuugugaccuauguugggguuacuucuggaaaggaaaagaugaugauauagauguccauauauaaagaaacacaauucacaaagacacuucuuccaacuuagaacaacugagacacauaguaauuacuguaaaugacaaguuaguuuuggagcuuguacaaauuuuaguaucauaaaaauguuaaguuucuacaguaauaaucuuuaacuaaagcaccgugaauauguuuggguaauacuaauauauaauucaacaacaguuaaguuaaaguauuauuuaacaccaagaaaauuaccaugcaagcaaauuauucuauuuuaugcagacaggccaaucauaaugcucucuauucucuaauagcuuaaaaucaaaagauagguaggguguuuuagugcagcauaggcagccagaucccugagugugaggccagucugaucuacagaaugaguuccaggacagccaagauuacacagagaaacccuguguuuaaaaauuaaaauaagggcuggagagauggcucagcaguuaagagcacugacugcucuuccaaagguccugaguucaaaucccagcaaccacaugguagcucacaaccauccguaaugagaucugacgcccucuucuggugugucugaaggcagcuacaguguacuuacauauaauaaauaaauaaaucuuuaaaaaaaaaauuaaaauaaaagccuggucuacaaagugaguuccaggacagccugguuacagaguuacagagaaacccugucucgaaaaaccaaaaaauauugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaagaaaaaccaaaaaauaaaaauuaaaauuaaaaaaauauaccaaaugauaaaauguuacuauucacuguuucauuuuuugagaaggcaaugauuguuugauuacugugacaaauacauuaugcuccuauauucaucuuaaacauuuucaacuaagcucuuagaaucuacucuauuuucucaaacacauaggcagaaccuuauauauugcauaauauaaacacaugaucaacuuuuaccuuugcuugggaauuccaugucaguuucuuuucuaguggacaaaucgacagguuuguccauagucccagaaacaggggaugagcuacuguguuugguaucagaaucagguucuucagacuuacagccaacaggguuuguuacuucagucucaccuauaugcucaauaccaacucuaucagucacuuucucauucugggauuucugcaaaaaggaaagaauaaaacauaucauuaaaucauccucuacagucaccaaaagaaauagaaaaauaguagguaguuucuauaaaguuugguauguguucuaaagauuuauuuauuauuuauuuuaugugaguacacuauagcuauccucagacucaucagaagaaaacaucagaucccauuacagaugguugugagccacuaugugguugcugggaacugaacucaaaagaccucuagaagagcagccagugcucuuaaucacugagcucuccccagucccugguguguauuuuaugucuuuauaauaaucacugaaaagacaggaaaauuaacagaaauaaaaacuacaaagggacaggcaaaauuaaaaaugaacuuagaaccaaccuaccucucugauuaaaugaaugucaaauaguccacuaguaaaagauuauucaaucagauuuguuuguuuuuacuacagaaaacaccaugguuggagaguuaucuugguacccaagcuugcacauuuaacugcaagacccuggguuugguuccauggaaaaacacacacaggacauuaacagguuuaggagaaugagaaguuagagggaugggggcauaaugaugaagacauagauuaucccuuagcagccuguuuauuuucuaauagagacaaaguagauccagauaggagaauagggagaaacagagaggaguugaaggagggaaaugaaaauauauugugugaggaaagaaaauauauuuucaauaaaagaggaaaaaaacuuacucauaucagcuauaauuuaaugguuaagaaauuuuaaagccgauuuguuuagaucgacaaagaauccugcugguguuucaacggacaugauauuaagccuguaguuuagccucagauucaauauccuaaucauuuugagaguucucauucaugaacaguaacacgguucucuauuuauaaucuaacacaugugcuugcuaaggccaaauauuacaucugauaguaagauuuuaaaauguaccaagagaacugaguggcaaacaauggagacagucuaaccugagcuucacagacuuuucgaagcucugacugaaaauccuccccauuuccauuguccucaucaguaucacugcagacuccacagaaaaauguagguggaagcuuuaaaguaucugcuuuugcucuuucuucaacuguuggcuucuuuucccaaacaauaacacauuccuugucauuaucugaaaaagccauacaacacaagcaaugacacaaucagaaacccaaucacuccauaauugucagucugaaggguuugcaauacaauuuaaagaccuccuuaacauggacuaggaaugcucaugaaaccagugcauggguaccaaagggaaucagugucuuucaacuaguauuacuuuguuaauacuguaaaugagcaugguuguaucccguaaauaaaacuggacauuacagguaacuaucagaguaaaccuuucuuuacccauguauuguggcauaugccuuuaaucccagcaguggucaaagagggagaucucugugaauucaaggccaaccuggucuauaaagugaguccaggauagccauggcucuguuacacagagaaauaccgucuccaaaagaaaaaaaaaaaaaaaaaaaagaggggggcacuuaaaauacuaaaauuguauaaacauaccugcuagauuuucuuccaaugguuuuucugagucauccagauagaguuuuccauuaagcuucuugacagccauuucauaaucuucaucuucaaaugcaauugaucauauugagcaaaauaauuuuaguagguagguuuucccauccacaaaccuagaaaugaucuucacacucucccucucucacacauggcccugagcucugacaaucuggccuuuaaccuccgacugcuguucauaguucccauuugugcuccccucaugcuuagccauucugucauuucaacacagaugccaacacguggucacucagucccacaugagauuuucuauaagaccacugugcaaaagaucuuacugggccuuugaggauguuauccuucucccucuuuuaauuugaauacauuuggaauuaugauuacuuccaauuuccuuaaaacaucugccuggcauaugauaaccaucuuuuuaagggcuuuuuuuagucaaugccauucuucucaucauuucauacacugacaauuuuauaaacacaggcuaaaaacccaccgcuaaggguauuaagucuguuucaauuuuguuuguuuguuuguuugagaugaggugucacucucuaacccaagguagucugaaacuccccaugaacaugaauucauaagcauccuaccucagucuaucaggugcuaggauuacaggcaugagccgucuugucuggcaaaaagucaggcuuuaaauaaguaaacuauacucccaauuacuaagauuaucgauugacaacaaacuuaccauccuccucuucuucacuaacauagccaggccuauucuuauaacaaaagaaaguugaaggaagcagaaguuucucugccagggcuuucugcucaggggugggagugaguucauacacaaugagaauaucauuaucugaggggagaucuucagguuugcucuucucuugugcuguaaccaaauuaaaacaacugagaaguaagugaacauaaccagccuaauuaaaaacacaaagaacaugaaacuuaucuaugaguuaaaacagcacacugauaaaauaaaaacacauacuuuggaacaaaccaaguucuauaaugaucaugacuuugaauuaaagccugguuuaguguucuauuaaaacuuuuagaggauacaaagcuuuuaaaaauccuuuuacugaucacucaaauuacuaauuucuguaauuuaaaaaguguugcuauaaucacacuccauacacuaaacaaaaguauccaugcauuuacuacugagaaaguaccucugguauuauccaacauaaauauuaguacaaccuuuauuaguuccuauaaaggaagcaaacaauuuuuuuaacugcaaaggauggcaagugauagcaucguauccaauuuuugcauacuuccaagugugcaacuagauaaaaucauguugcuacuuuacguauaagacaauuucgguggcuaaaaacauugcaucuacucccaccugauaaaaggacaaagauuuagagagcaaaaaaggaacccuauacauaaagucuguucugauauauuaagaaugucuaacuuguagguacugacaaaacagugccuuaaaccagucaugaaacauguaugugccagccacuacaggggaccuauccucuaaagcuucccuguccaauaugguaggcuuacccauaugcaguuuccuaauacuugaaagacggcuaagucaaacuaagguguacuaaagguacucaaagucugcacacuggauucaaauggccuggcauaaaagaaagaauguaaauacugugugguuuuuuuuuuuuuaaucuuaauugacuaaaaguugaaauauuuuguauacauacauuauauugaauaauuacuaaacugauuuucuuuuaugcuaccuauuucuuuuaguguuucauuuucuauguugcucucagaauacuuuagacagaucauaauauauuucuacugguuaggauaacuaaagagaacugguacccauuuuucugcaaggucaagaugaauacuagacaaauuucccccauuugcucguaaugggcuucuacaaauucugcauucuuauuauucuagucaagaagcaacacuuauuucuauaaaugaccugcauuacauaagaaacauauguuauagaaugauagcuguucaaaaugaggucuaauuucaaauauaaucucuaaacccucaguagacauguauuauauucauauaucugaauacuggcaggcaguagggcuaaggucaacagugagaaaaaaacaggucuuuauuacagaguuaaaaagaauaaagaaaaguucaaugaagcaguaagacaaagacagacagacauuaauuaagcagaguugaaaaugaggcaaagacagcauaauaacacauagacagcauccagauacaaauuuaaauuaaaggcuguuacaucaccacucaaaaaguauguuuuguaauaugucauucuuuaacaugcacauugcaguguuaauuacuccaauucauacagccacaauuacuuggcuaaggacuaccagcuaguagucgccucacaccgagaaugcuagcucuauaccuuugcucucagguugugagguagggaugcugguccaaaaggccauuggauuagauuuaaaaaggcuaaaauuaaauccuaggaacauaaagaauauuucauuuuuuucuaacaucugugaaacaaaauuaauaacuuaaaaaauucagaccucuccuuuuauaccaaucugguuaucuuacauguuaacuuuaugcacaagaucucuuucuuugccaacugaauaaaugguggcaacacuaacuuauauuacaugcaacuucucaguaacacaugcuucaagugauuuuuaaaaacaauacaacauugaagaaucaacauuuaaaagacucaauacucaugauucaaguguaugaguccuuguauuauacuagguucuuuugcacugcuuuauaacgaacgauacugucucuucaguggucuguuaguuguaauauucacaagcuuuuuagggauuaaacuuguccaaauacuuuuguacguuuauaaacucguguuuaugacacaacuuugacuaaaauaugacuuuccuauaaagagucaaauguaaacacuaacuguaauacuaaguacuuacccuuuucugguguuuuaaauguauaacuaguugaagaguucucuuuugaaaaggcacugagauuuuugacuuugccaucagaagauugcuugaugucagaguucuguggcagcucacauuugucggguuuuacuuuuccuucagauccacucuggacucuggaagucauuucacuauugcuauuuuucaaaggugcauuaaaacuaaauccaaacaaagaaccaguggcugaacuguugccaaaugcaaauggcuuggauuuuucacuacuaaaaaugcuuuuaacagauucugagccaaauacaaacuuaggaggagaaacuacugcuuuugguguuguuucagaagugcuagauguuucuccagcuucugaaguuguaucuauuacuucaucucccugaguuaaaucuguccuuucucuugugguuucuucuaaaacagcaauagcaauuuugccacauggugacucucuaggggugcucagaugagaaacaugagguguuaucaaugaaucuuuuucuugggcuguuuuugcuucaucaaaaauuuucuuaaaugagucugcaacauccuguaguuuaaaacgaacagccaaauguucuauuuuucuuucuccaucugcaaaaucacaugcaguccacacccacacucuuucagucccuuucauaguuugcaaagucauaucuggaguuauucugugauuggcacaaaguuuuaauaccuggucccuucucaucacgaugcgaacuuguuuauuaucauaauucuguaagaucuuuauaucuccaaugccucuuucuuuccacuggccaacaucuuuaucguaucuguaaaguuuugcucugugacuaaaaacaacuuguucauuuuccucaccacuggauacuucaacuagaucagguaaaggaacaacagguucaaaguacuguccaucucucucuucuucuugaguaacaucagacuccucaucagugccaacugaagcuccacucugguucaauuuggcuggagacuuagauggacucagagcagauuuaaaacugaaguuaaauccuguaguggacucaccaaagcggaagagguuuuuccgcacagggcugcuugccaauggagaagcaugaacugagcugcugcugacacugucauccaaggcguccucccguaagucauaguuaucccauucuaaggcaggcccgguguuaucaggauuuugcuuggcuguggugucugaugcacugggagcaucugcaccugaacuugcauucucuucaucggugaccuuuacuugaucauuugucaaaaagguuuugaaaucuuucaggccgcucuucauuuccucagcucucuguauuaauuuagcagcccugccaguaucuacaaguuuauggggugucugaaguggaaugucuaagagaagacguugacacuccucaaauuucugcuugaauucuucagcuagcucuggcguuuuaaacuuugcagccaguuguuccaguuucgcgucaccaucggagaaaucacuagcuagccacauccaugcucuaucugaccccgagagaggcuucagguucauuguagugguuauccaaugauuggcacaaacuuuuagcacuuguucucuucgcaucagcauucucaguuuaccauugacuucauuuuugagaauuuuuaaauuccccaaaccccuuucuuuccacugacuuaucucagcaucaaaucuaaauaauuucacccuuugugaauacaaaacuuuuucaucuucuucuccuguuacuaguuccaccuuuucuggcaucugcacuacuggcucaaaauggaugucaucacuguccucagucuuauaugcaucaucaucuuucucgagaucagaagacguauuugcuuucucagccacuuugccgcuuugugacgagaauaauuuuucuccugcaccugaaaaucccuuaaaauuagggucuuucuugccaaauugaaacccuucucuugauguugacuuugcaagaucugcaaagguaaaggugcugcuugucugaccaaagaccacaccacuaccauucuucugaccacuaguaucaugagcuuggaaacuagggucauuuucaagauguuuuucacucuuuuucucuugauuucccuuuuccugaaugccaaauuuaaacccaucagcagauacaggaaugcaaaaacuaaauccauccuugauugacuuaaauucuguauuagagccacccugaaaggcaaaggaagguguuuuuucuugauccacaugcccaaauuuaaauuucugcucugaaaugccaacuuuaaaauucuuuucuggaaaguuacuuuugaauucuguucccacuugacuuccugcagauucauuugacugugacuuugagcccacugugaaagcugaaggagcuucaugaggcuuaugaguuggcuuggaggcuucacaagccacacauuuuagggaagagcucucauuuuguacagaacaaacagcacacucccacucuccuuccuuuuuggggaauaagccuucaaauccacucuuuggagaccugcuugucucugaagaggcaggagcugauacacaagauguaggcugauucugcuuauuuggauacugacaagcaauacagugaguagcacuggcuucauuucggacaaaacacaagcuacagucccacuguccuucuuucuuggcgaacauacccucaaauccaauccugaaaggcuuacucaucucugagguaccaaacuuaaaagagggaggugcaguagauaaacuugguguaacaggauuauuacaagcaacacauuuuauagcaugugcuucauuuuucaccgagcacaaacuacaaugccauucuuugaacuguuuuccuggguucucacaagcaacacauuuuuuagcgcuucuuucauuucggacuaggcauacacugcauucccacugaccuucuuuuuuagaaaaaacagaucugaaaucacugucaacagacuuaggaagaucucccugaccaaauuugaaagaaguuugaacaaacgaagacgcagacuuuguguucugacaugcaaugcaccuagagacgguggguucauuucuuacuaaacaaacacugcagucccaauggccuucuuuauuugcagucauuguugcaaaucgaucuugagcauuuuccaggccaguuuuaggagcaaagccauuuucaacuaauggaggaccuaggagcucuuuguuacugguuggguuuguauucuggcaugauacacauuucuuagcaguugcagcauucuuaaaggagcagcuguuacaauuccaguaaggcccuuccuucuuuacaaucuggaauucaaaauucaaguuuccaccaucagcuuugcaaauauccuuguuauccugaguugcagacuccuuuacaauucuaagaguaugauuuggugcuguagauguguuuguuccuaaggcuuuuaaaauguucugggccucuucaaauuuacacuuaaauagugcugcuuccucaggaguuuugaaucuaauugcaagcuguucugguuuuggcaauucaucugcauaaucaagggcaugccauacaaaagaucuaucugagccagcauuuggcgucaguuucauaucugggcuuauguaaugauuugcacagaucuuuaauacuugcucucgucucaucagaaggcgaauuuuaccagauguuuuaugccuuaguauuuuuacauugccuaucccacguuccuuccauucuuuggauucaccaucaaaacggaacaacuuugcacgauugcaaaagaauucuucuucaucuuccucgccaguuuuuacuucuaucuugucaggaagagguaccacaggcucaaagugagggccaucauccuccucauccccaugagcacuuccuccaucugucucaugacuuuuauuugccagcucggaagcagcuguuguaaauacagacuucccuggaccgugaaaagcaaacaugucaucacugcgaugaaaaccaaaauucuucugcugauuugggcccauguuuucuguaaguguauuuuugcuuccaaaacugaauguauuccgagacccacuagcuuggccagauauuggcuuuaguccacuauagccaucuccuuguaaaggcuuaucugaagucagaagaccuagaagacuuucacuauugcuauaagcuguugaaggaggcugggccacuaccuguggugaugaaaaugugaagucgccaucauuugauuugaaauuugaguuaaauuuaaagggaguuggcuguguuguaugugcugguguugucaaggguggccuuauuacuucacccugcaugggcugaacgaaauuggauuuuccaaauucuauaaccuuugauucugcugaccuugaagcgugagcuacaaguggaggcuuugugaaauacccugguucuggcaaagguggauuugugcuugucuguugaacauuguaauuaaaauaaucaucaccccuaggugauagaauuccuguugcaggagacucaaaacgcaagggaggaccauacaucuccugagagaacauacaagcagaugaacuuugcacugguggugugugcaucuguugugaauaugcauaaauauguuguugggguggaagccuauucaugccauaaacuggacccuaaaagggaaaaaaaauacuuucuugauuauucauaaaacuauaaaaaucuacaaacaaaucaacucucacaaaccucaaauuagaguaucauucagcagaaaacaccaauguacacagcacauuaacagauaccaauggugccacaaagacaccugaauauauauuugauaagacagcaccuuaaaaaucuguacugacaaugacuagaaaaaaauaauucuucauucacuaaacaauuacuaaaugauguuaacagugaugauuauuacuaacauucauuaagcauuuauuaauguaucaacuaggcacaguucuaaccauuuuaacuuacuuuagaaguuaaagguuuuuagccucaaaaacucuauuaacuauaguauuauucucauuuaaaaccagguggccuaagagguacacagguuaaaaaacauugcccaaguucacaauaagcagaaccgggaucuaaauguaccaacgcacccagaucuccauccuggaagucauaguuuuuaguuacugucauaauauccaguuugagucaaaaggaugacaauaaaucagccuagcaaaacaaaaauagccuuacuccuaucaaaauagaauaauaacacaagggccaaaaccauccaauccuccuauuuaaaauauuccaaauguuucgacuuauuguuaacacacaaaaaaagaugacuaugaaaugccuauaucaaaggucacauaucuuccaauacugaacuacuuguuucaauuucuuuaaaagaagccuaaacauuuaaaacguaaacaguucuaauugugugcuuuuccuuuguuaccuuggugggaguuacauuagcagcuggucugagaagauacugggaguuauaugcaggugacugacuauaauauacugaugggccaguaguugcaacuaaagugaaagaaacaaaaacaagaaaacaauguuaaaagucuauucuauaguuuaaaauacuaccuagacaagaauuauaaauauacaauaagaaucaaaggaaguuuuaauuauucugaucuuuacauuucuacauacucaaguauaccauaaagcaauuaauaaaugaagaacuaaaaaaaaaaaaaccaguuaaaugacacaaagaauaaaaaauaacacuacuauugucaacaggaacaaguacuuaacaagcaugccagaguaaggcauaauggcacaugccauuugaucucccacacucaaagggacagguagauuucuguaaguuucagcuaacgaacgcuacauagugagagagcucuaaaaagaaaacaaagaaaguaaaugguccaagaucagcagaauguaaaagcacagaacggcuccacguuaggaaaaaaguuaucacaaagaauuuaguaaccaaaaugcaccugauggccuaaacauuuaaaagaggacuugaaacucuagagaaugacaggguugcagaauaugaucucaaauaauuacucagauuuaugcuuaaaauaaccugguacaauuauaaaaagggucucacaauaagcauaaagccaacuacauggcucagcagguaaagaugguuaccacauaaacauagcaauaugccuuucauuucuagaacacauguaaagguagguugucuucugaucucugcauaugcuguggagauauauauauauacacacauauacauauauauauauauacacacacacacauacauacauacauuccacagccacguguauguauguauguauguauguauguauguauguauguauguguauauauauauauacacacacacacacacacacacacacacacacacacguacaggcccgcacgcaugcgcacaugcacgcacauauguacaaauguuuuaaauuaaaauuuaaaaacaaauuagcaucaaauuuguucuuuggcuuaaagcagacagaugugcacagaugcaugcaugcauacauacauacauacguacauauaaauacagauacacaaacuauauguuccaucuguucugugagguuuauaaaaggcacuuauacuaauggcaaaacuauagugguaugcuuaaucuguuuuacaacaguuuuaccagaacuaaaaaccaaaagaccuuucauacuguacaugaaguggaaaacugaaauugugaauuaaucuugaaaaaagcaauaaaaaguagacggacaguaaauauuucuccccguuugaaucugaaaaaccuaauggaguguuauuuuggaacuccccugaggaggaguaaacagguauggaaacagguugguugacaugaggcaagaaucugaaaaaucuagauaaggggcuggagacauggcuuaacaguuacccacacuugcuguccuuacagcacagcauacaagcaacucacaacucucugcuaucagcauuguaugccuaagcacauauauacaugcagucaaauaaguacuuauaucuacaauaaaaaagacauauuuugucuacaauuaaaauuagcaacucuaucagugacuaguaacucagcagguaaagaugguuaccacauaaacauagcaaaaaauuagaaguccuuauaaacuuaaugaacagacaauucggggguaaaauucaagagacuauaaaauacaaagcauguacuauauaaagauauuaaaacugguaacauagccgggcgugguggcgcaaucccagcacucaggaggcagaggcaggcggauuucugaguucaaggccagccuggucuacagagugaguuccaggacagccagggguauacagagaaacccugucuccaaaaaaaaacaaaaaacaaaaaaaccaaaaaaaaaaacaaaaaaaccuaguaacauuuuguucuuacaacucaggccagguuuuuguauaguuuagaguacaagaugguacuauuagauacuaguaauaaaagcaaaaacagaacuuuuaaaacacaugaagaguuuaacaguauaguucuauucaaugguagaacacaucaagcauguaggagacccuaggauuaagcuucagcacaauaaaaaaaagaaaaauaaaaaugaaauuucuaggguucuaacaacccuagaaaugugaccaagcauuauuuagaggagaacaaacuaaaacauuaaaaauacuggcaguauuugcauaugaggaaauaggguaaugugguuauuugcauacuguguuuucaaagauuuuucaaaaaaauguuccaaacuuaaaguaacauuuaaaaaaaagcaggccauacacauacacauauacacauaaacacacacauauauaugccuuuauauauauacauauaaaaucauuuuauguagccaaauaagaaugaucaagaaagacaauguugcaaaugaucugacuagggacuggagagaugguuccccuguaagcuggcagacagugcacaggaguuuuaagaaggcaagcaaggucugagcucuaaacacauacuuaucuauguaaaauaugacauuugaguuuaacuucaaaaaacguugcuaacacuuagaaaucacugcgagaagaacacagugauuuaaguauggcucuaugaaccaaauaugcuuauuucaauuggaucucccucuaaccuuccugguuugaaagcaguuagaaaacaacaugcacuaaagggaacaguggcucagaccuucaaucccauccuucaagcagagauaggagaaucacucuaaguuugaagacaguuuugaguuauauaucauagguucuagaccagccugggcucaaaauaaaaugcugcccacccaccccccaaucaauauacauuacaguucuaguuaagaaucucuuguccaaauuuuugguaccaaagguauuucagguuucagaauauuugcauauacauaaaaaugucuuaaaaauagaaugcaaguaccacuaaacucauucauauuucauaaauucauccagaacauauucugaaagucucuggacuguuucugaaauggggccuuacuacgcaggccaggcuggccuugacuugugaucuuccuagcuuagcaucuugaguacuagauuauaggcauguuugccaccacaccaugccuggucauuuucagugauauauauuuugacaacaaccuucaugaguguaugguauaggauuuuuccacuuauaaucaauccugugacaacacacaaaagucucagguuuuaaagaauuucagauuucagaaugucagaauaggaauaccaaguggcacuguaucagacuagaaaguugcuucucaauuaggggacugccacaucuaccacuaauuagcuguauaguaaguaauaauagaaaacccuucuaaaguuauuuucucaucuauaaaaccaaguuuaccaauaauguuuacaaccuguuacuguaauaaaauuaccuacaaaauguacuuuuacacauagcuacccacaaaaagacacuauuaauaaccuuggcucauuagguuuacuagguaguaaaaaaauauuccauaccuaccugcacauauacaaauacucauaguaauuauguaaagcaagugucaagaaaaacuuauuauggagccagcugugggagugcguggcuacaaguggguaggaagagguagguaaauaaauuucugaguuugaggccagccuggccuacaaagugaguuccaggccauccagagugacauaggcccuaaauagaugcacagacagguaggguaauuaauaaaaaauaggaagagaacaacucauuauagguuuuccagugaauaaucauauuugaaaauaagggcaggagagauaaaaaacaccaaaauuacucaagaaguuuaaauucuuuuuuuuuuuuugguuuuucgagacgggguuucucuuuauagcucuggcuguccuggaacucacuuuguagaccaggcuggccucgaacucagaaauccgccugccucugccucccaagugcugggauuaaaggcgugcgccaccacgcccggcuagaaguuuaaauucuuauuaggaaccucuuaauacauaacuauauuaacuaacauguuucaauuuaugaaacauuucacaguuuaguuucaauguacauaaaaaaauuuagcuuuaauauauuuagaguauuaagacuuguuuauucuguuucugauuggauuuauaaaauuucuguauauuacaguguuuugguaaacaaguagacauauucuagaauguacaaaaccacaaacaaguuaaauucacaaguuaccuauuuaaauggggacaagaaggcugagcugggguauaaaucaggggaacaccuaucuagcaagcacgagcuccaaagucuuaguacuacaaaaaagaaaaagaacuuaaaaagagaggcauuauuuuacuggaauacaggguuuguuuagcugacagcucaccuguuaguggagccccgugaaaaguuugugagcccugauauccgucaggagcugggucuuguccguaaggcucugccggccagcgaugaggggaugcagaguuauugcuauuuagcuucaauuccugcaucucuuucuauuuaaaauaaaaaagaaauaaggaauguuaaauguuuaauuauacaaugcuggaaacagucucagcaaacacucaacaaauauuguaaacuuaagugguuggugucauuuagauuauacuuuccacuggaaaaggagugccaagaacacaauuccuuaauuccucauucacuuuaacucuacuccaaagaacuaacucccuaaaucucauaacauuuccauucauuuuuacuuacauuuaucuucauaaaauuuaauccauccaaaacauuuaccuacucaaaaaacuaagaccuacaaaugaaacaucuuuuucugacacucacuuuccuaagcauuccaagcuaccuacucagcuuccaaauucucggucucauaaaucuauauucuucugauuaucaacacugaaaaucaucucuuaauacuuauccacauggaagguaaccaacaaauguccaaguuuacaaccaaugcucagcagcuacuaaaagcauuauaugcccagacauuaucgcauauacacuguuagaucauuguuagcaaacaauaacccauaccucacauagacggguagagagacaaaagcaaggaaggacagagcugguaccuaagcuacaccagacuccaaaacgguuucacaacaacucucuacugccagacaagauggcagaaacacuagagccuucuacaagacuaucuuaucucuguuacuuuauuaaauggacagcaucccgacacaagaacuuacaaaacuuucuuuuuuaauaugggacuuaccaaugaauuguuucuauuuuguuuguugaaacagaguuucucuauaaagcuuggcugucccagaacauacuacuuguaccaggcugaccucaaacuggagauccugucucuaccucccacgugcuggaauuaaaaguaugagcaacuaccaccugguuuccuauuucacuuuucucaaaaaaaaaaaaaaaaaaucaaauauaucuggguauaaaaugacuggucaauuuugaaaacagcuucaaauuuuugaaaacagcauccaacuaauuuaaaauaaaugagaucaaaaaaaccuaauguacuugcuuucuugaucuaaaugcugcauuuggcaagguagcucacauauauaauccgaguaacaggaaaaguaaggcaugaaaacuguuacaaguuucaagccuuccaguacuauauauaaacaaugacucaaacacaaaacaaacaaauaaauguguuucaaauaccucaauuuucaaguucaaaauaguccccacuuauccaccuccucaacuccgucuagacacuacacguccacaaauaaaaacuacaaaacaugauggguaccuagcccauaguucuaaacuggcuauacaauauaaccguaacuguuaauagugaaagagcuagggacccuggggagccaacagucuguaaagugucuguuacacuguguucagacuccaguguccacauaaaagcugggcuuagugaugucaaccaaacauccuagcauuauagggcggagagagagaauuccccagaacucacuggccagucaaucuagccaacuggugaauugcacaaucgauaagaauaaaauaagguggaaauuaauagaagacaaccagaggucaacaucuguggccuccacauguacacacacauuaaaaaaaaaugugguaacaacugguuucaacaauucuaaaacuucacaauacauaaauuagacaaaagaaaaaaacaacuuuuccaagaauaacuagcgucaagagcucuguguaggaaccaguuuucuaagcucacagacaaggucuccauuacauuuccacagaauagugcugaaugacugaaaccuguauauugaaagaaacucuaaugugguaguaugguuuauauaacacacacacacacacauacacacacacacacacacacacacacacacacaaauuauuguacaaacccaaaacuuuguuauuuaaucaguuuucaaagcugaacacuguugauuauauauaccauaauaaucaccacauagcaaaauguacuuaguguaacauuagguauaggaauaauuuaguucuuagccaauaggcauuaaaaaagauuuguguaauucuaaaauuaaaaaacaaaacacuaaaugcuagacuauaaauaagccauucauauaaaaagcauacacacacacacacacacacaauuaaguacagacaacuuuucaauucccaaugauaaauuugauauacuuucucaacagacaugcugagaaaugaauuaacacaaaauaguaugauaguguauaguaguacaaguuacucauguggggauaacagaaaucaaauuauguuuuacauaaaaaguuaucuuaaagccgggcaguggugaggccuuuaaucccagcacuugggaggcagagacaggcggauuucugaguucgaggccagccuggucuacaaagugaguuccagaacagccaagacuauacagagaaaccuugucucgaaaaaccaaaaaaaaaaaaaaaaaaguuaucuuaaaagacuugcgggggggaggguaugggggacuugaaauguaaaugaagaaaauaccuaauuaaaaaaaaaaaaaaaagggggggggggcuggagagauggcucaacaguuaagagcaccaagugcucuuccagagguccugaguucaauucccagcaaccacaugguggcucacagccaucuguaaugggauccgaugcccucuucuggugugucugaagacagcuacaguguacuuacauaaaauaaaaaauaaaucuuaaaaaaaaaagaagaagacuugcaucucauauggaaauaguaaguaauuuagaaaauaugguuaagagucaagggaaacugauucuaacuauacuaaggguacacuuugaucaacuguaaguaaggacagggggggggggggagagaaaugaaugaacuugaagccaggugugguggugaaagcacuuaaugacaguacucaggaggcaaaggccagcccaguggacagaggcagggcagccagaguuacaaagaaaaacauuugucuugcaaaaccaaagaaaguaaggaacugauuagagaaaaaaaucuuagcaugagaguuacagugaaccaaacuaaaugucaccuuaauggccucuacuugcuggcagaucauuuucaguaaagaauuuugaucuucugcccaucgagguggugucuuuggagaauacuagacauacaaacaaacacacgaauauguuaacaguguuuacaacauguagaaaacaaccucauaguacaaugacucguuugcauucuacuugccuuguaacuuuuacuuggugauagagaauauuugguaggagaugguguugaaugcuuuaacucugaaucagcacuucgccagcaaccauuuuuauaaagaguaccuccuucacuguagucuucaaguuccugcauaacugaguucagcaucucuuuuacagacucaaggggaacaggcaacugaaaaagaaaaugccuuaguuugcaaaaauaaugcuaaaauaccuuagaaauaaagacccaauuuuauuaagcuguucgcauuuuccuuauuuuguuuauuugagucaggaacucacuuuguagcccaggguacccuugacuucucaguccuuauucagccuucgaagugugaagacuauguguguaccacagcacauuuuaacaagcaucuuauuacauguuaaguuauacauauaaaggcauugcagaauauaaagucuaaguuguuccuaucacauuuguaagucauaguaacaaagaaaagugaacuuagaaagcuuuuccuuauggaaguuacacauucuucucagauacuuugaacagagugaaauauaaaugcugaaauacaccagacaauauaauccuaagaucagcaauacacauuaauaaacaaaauacucagaaagaagguuaaacagaaaaccccuuugagugugaaacugcugagagcuaguccauaggaaauaauaaggggaaaaaaaugcugauuuuacauaaccaaaauucauuaagaacuaguccuggagccuggcgugguggcacaugccuuuaaucccagcaacuugggaagcagaggcaggcggauuucugaguucgaggccagccuggucuacaaagugaguuccaggacaacacagaaaaacccugucucgaaaaacaaaaaacaaaacaaaacuaguccucaaguuaucauauucauuuugaauacaugaaaaaaagacaaaauuacugucuaucuuagaaaucaguauguacuuagauaccaaaguuguguagguguaugagugugugagugagugcaagcaagcuagauauuuacacauguauggcaggaaugugcacaugcgugcauguggaagccagagauugauaucaaauauuucccuugaucacuugaucuccaccuuauauauggaaccauggacucuugcugaacccugagcugcuucuucuaaucuaacuaguaagcuugcucaagggauguccuaucauggccaccuagaauuuacuugagcacugaguggccaaucuuagacccucacacuugugcaaucuucccaaccccaaaugccaaauuuuuguuguuucgagauauaccaaagcuaagauaaaagaaaacuuaacauucguacacauucacacuacacacaugccccuagcacaucuauccuaagugauacuuagagacauaagaaaugcccacauuuaaagccugggcaguuaucaacaauacuaaacaucagacaacagccagcaacuuacuuucugaaccacagaaguauuugaaucacuaucaucuaaaauccuuaucagguagucccuagucuuucucagauaauuuuugcauucuucuuguucuucaggagacaaggcaucauuuucaaugucuucugcuuuccuguggaaaaucuacacaaaauacaauuagauuuuucaaagcaagcaagcaaacaaacaaacaaaacucaauucaauucuuauuucacuuaccagugcaagauuccaauaagaaacuacauuuuuaauagauucaaaagcagucauagcaucuucuauauuuccauuaacagcauccaauauagcaaaaguuaugugugcaucuucuucauauucaccaauuucagaugccuaaauacauuuauuauuaguuaaacugcuucaaacccaaauuuccaaagauuacauuuuaucugaagaaaauuaacauuucauuauagucauaauucuuaucagcuacaagauuuagaaagcaaaacuaucauaaaauagcaacacaauuuacuuaguuauuuucuauauguguauaaauuacauaaguaaucgguucauuagcauucuuuauuaccugaauauccacacuauggaaauguuuaaacagaggaucaauagguucaggaauacuauucuucuuucugaucaucuucaacaaugguaaaacuuuccuccaauaaugaacacuucugccuauguauucccguugaucauaaaaagaauuaagacugcugcccuaaaauagaaagucagaaguccgcaacauuauaacuguuuuugagaaacugagaaaacuuucaaauuaaaauuaaguagagcaucaaaagaaaaaguuaugaacugccuacaagaggcagcccaaucuauuuucaagaguugccauuuuuaaguggcaagauggcacacaacuggcucacaaccuuguaucugggauauagaagcaagcaaauuggaaguuuaaagucaucccuggccauauaucaaguucaaggccaguuaggcuaugugagacuauguaucacauuuccucuguaacaacacuugcaauaaaaccugacauuuuuagagaaccaaagucugccucugaaagaaacacuuuggucaaaaagcuaaacagccacaucuacucugauauacaauacauaauauuagucuuagcacuagucagcauuuuacuaauuacuuauguguaagcaauuaacuuuauuacagaaaaacacuuuuauuuaagacaaaguucucuuuuaaaaauuaacauuucaaugaacucacuguuuuuugaagacucugggcccaaugcacaagcagagcagguugaaggccgugcuuuuccuggccucucagacuguuuauuucacguugaacuagaagucgcaauuuugcugagguuccaggucuuaaaaaaguaaguuuaauugaauuauuuuaaagaacugcaguucagcacuuacauauauguuaagugucuucacgugacaacuaaacuaaagcccuaguaaaacucgggcccuaaucuaaggaguaucacuguuuacuacuuacagcgccuuucggugaaucagaguacaaacugcaucccaccacgucuucugucucucuguacaaagcugucugcacacaggaaguggcaaacacaaugguugauaggaaguguggugagaauuacacuucuccuuuaauuguaagugacugguauauauaacuccaaguaagaauaccuguuugauuuuaaaaaauaguaaguuagaaaaacaaauuacaaacacuaaaaauauuuaauuaauuaucaucauugcuuacuucaagaucuaaaauacagauugauucaggugcauuuguuucaagccuugacgucuccugaggcaaaugguggaagagcuguuuuaaccauuuucgaauugcugguaaaguagacagugaauuccauuguaagccaagccagguaaggugcugaagacuaccauuaugugcucgaacggcaccuggaacagaggggaaaaacugccaugcaugauacauuuucuuugggucuuuagauuacaaaaauaaacaacuaauuuagcaaaaaauuuaauuacaaacauuuuuuucuguuucaaaacugaagaacagaauagcaaaaauuucacauuuuuauugaauguauucauacuuuuaaaaacuuuguuuuuccaagacaggguuucucuaugcagccagucugucccgaaacucacaugcuauggccuugaacucaagagaucuaccuaccucugccuucugaauguugagacuaagggaguaugccaccaugcccagcuacacuuuauaaauuuuaauaagaaacaguguaaaugaaaaagguuuucuauaccaucuaagaaaauaagacucaucaagaaaguuaaaaauuaaacuuaaaaaaacuuaaaaaauuaauaaaacuaaacugucaagaauaaugugcacuuuauauuauuauuauuauuaaaguuucaagauuuuccuuucaauaaggaguaauuaaauuacaauggaauacuuaauuuaugagcauauuaaaagauguuuucuucuauaagaaaucuaauacugaaaaagcuuaugaaauucuggaaguaaaaaaaaguccaacuuuccuagaaacgauaacacuucuagcaauuugcaagaaaaaaaaaucugucucaguaguuucauuuuuaggaaacuccaaggaauugauuucgaaacacauacuaucuauuaaugaaguucucuaacacacugcccuuuugugaucaucacugcccaucugaaagaauaaaguuauucaguuuguacaagggcacuaaaaaggucagcagacuagcaaagugguccagauuuauaggaagaaauaggccauguacauugacuagguauagcaagaaaaggcuaauggcacuccuguccaaauaaguauucaccccaacaaggugacugucacaaagauaaaacaaaacaaaaacaaaaaacacccuagaacauaaacaaggaaaaaaagggcaaauacaacgaagaaaacaauggagaagaugcaaagguagaaaaaucuuaaauacaacuuucauuaaaaccugguuaaaugaggccagguguaguagaguauaccauuaauaucagcacuucagaggcagagcagucggaucucugaguucaaggccaucacuuacauagcuaauugcaggccaggcaagacuauauauagugagacccuguuucaaaacaagcaaaaagauccuguuugaaguucuaaguaguauuauuuuaacaguaguaaaaaacuguaaauaaauuaaauguugaauaauacaaaguaccuagcaaacaacauauacauacagauauauacauacacacuauaggagagaaaauucacaaaagcaaaacauauauaaauauauguuuauaaauaauuauuuugccaggcagugguggcacacaccuuuaaucacagcacucaggaggcaaaaaacaggcagaucuauuaauucaagaacagccuggucuacagagcaaauucuaggagagccagggauacacagaaaaaaauucugucuugagagagagagacagagagagacagaaaaauauagaagcaaacaaauauuucaaagaaaaugugucauuuacaccuguacaucuauuuuauguaaacuaaaucuagaaagaauccaaaauauauuaugacuguugcgccuuccugguagaaacagauuaugaugaagaauauuucuuugaaagaugcaacuuaccaguaucauaucuagccaagucaucagggucuggcacuuguccaucaagguuuccaauaucaucauucccaagaaaggaucucuccuuggaugacugacuggaaaacagagcaucacagagagcagacuggccgcuuuuguuagcaaaagauuccacaacuuccuuuagaaagucuugcuugccacgacuuaaguuuaacaacaugugcccugaaaaacaaauuauucccaucauuguauaaugaaacaauuacuuacuccugucucuuaaucauuucauugagacauccaagaagaaauuaacaagguuaucugagaccccauuuuccaaccuccaaaucacagcuggucaacaaaaacaguacuuuaucaaaacuaaacaagacaggcuucacaguaucugucuacauaaaguaaaacaaacagaaggggaaauaaaaugaauuuaaaaaugccaaaggucuuaucauuuuagauaguuaauauaggaauuaagagaccuuccgacaacagccaagaaccaagccccaaugcucugaucugacgcccugguggcuaaaacucugauggcuaaaacuggguucucagauucuugcuguuuuuaaagaacauuaaggaaauaucuauauguaggcucuaccgaauuuuuuuuuuauuccacaaguucaggauaaggauuuaagccaguacuuggauuaaauacuauuacauauuacaccauggauggaccccaaaaaauauaggaaauauagaguuacgaagcauuuucuaucacucuauuuaggcaauuaaagacuguccccacagagcagugucuccaagcaguaguguuaaacaacauuuggcuacagaaaugcuuugcacacucaagagggaugcucuaacacccagauagagcagguaucuccacugggaagcaaacaaaauuaaguagguucuuauuuuuaaagaaugcaauggggauuuagcuuaguccuagccuaucaaguacagaguccuagguucaguccucagcccacacccucuggggggagcaaaguggggcagauagaaugucuuuuuuuuuuuuucuaaucucugcuaugcauaacaccuuuggcaaaguaagaacaaguaugaauauagcaaaacguggcaaaaauaagccaaguaauuauagagaauuaucuaaggauacuauaaagacuuuaacuaaaguagccuaaagaaaguuugaaucuuaggauggcaagauggcucaacuuucaaggcaugugccacuaagucugaggaccugaguucaaccccagagcccacaugguaaagacagaaucaacuccuaagugauguacaguaugagugagaacacauacaacucauacacacaaauaaauaaguguaaggaaaaaaauuuaaauauuuuaucauuucagaauuuaaucaguuaaaauauuauguuaccugacuggcuaaggcgaucgugggccaucguuuccaggagauuuuguccagcuucuccuuuuauuaauuuaaccuuuggucugggaaccugacaauuuuagaauaaaaauaaucuaauucaaugauacccauauucccaacaguuagauauuccuuuccauacuauuucuuaaauaaucucguuaauuagaaaauaauuauuuuuuuaaaaauauuuuaauuaggguauaguagauaacagaagaaucuauugugaguucaagaccugccugugcuacacauggacuuccaaacaaaccagggcuaugaagaucuugucaaacaccuugaacauggagaaguggagcaggugccuaacuagacagagccuucaguccuacagacuaguguucauaguacugaaagauauucuucacacugccaaaggagaaugguaaacaccaacuguaaugguuuguauaugcuuggcccagggagugguacuauuagaagguguggcuuuguuuggguagguguggccucauuggaggaagugugucccugugggcauuagcuucaagagccucauccuagcugcuuggaagccaguguucuauucugcuagcagccuucaaaugaagauguagaacucccagcuccuccugcacuaugccugccuggaugcugccaugcucgaugauaauggacugaaccucugaaccuguaggccagccccaauuaaauguugucuuuauaugaagaguucuuggucacuguaucugugcacagcaaugaaaacccuaacuaagauaccaacccagccacacacccuucacucuacaaaggugaccugacugcgagauacacugacaguguacaaagcuugccaccgaauaacugaucugacuuaaggcucacuccauuagaugaacccuaugcccaaugccaccugggugacuaagacuaaauaggccaaugagcuaggaaaaaccaaguacuacuguucugcuaaaggaacguugcaauaaaaugcauccuaacaaccuccugcuauacucauaaaucuuugcauggcucaacuaacaucagagaagcugucuccugcaccagauggagacaaaugaagacccacagucagacaguauacaaagaaugaaagaccuaggaacacucagcccuaaaaagaaauguuccaaucaaaucccuccccacuagggcucagggaacauuacagaagaggcagcagaaagagucuaagagccaggauauaaaaaaggaagccaaggaaucaaggccuucuagauacaacagggcuggcgcacauaugaacucacagagacugugacaccugcacagggcuugcauggggcugcacugcauaaggucccagagcugaaagugaauaaacaucucauuccuaacccugaagcuaucuccaauugacugccacuugcaaaugaaaaaguuuccuccaagacagucucacuaaagaaacagaccacucuuagggguaggccgcauggccagcauuaggcacaaaaugaacagcaucuuugaagguucuuucucucauguuaugucagggaaguuuuuuguuuguuucuuuuuuuuuuuuuuuuuuuuuuuuaccuuacauguccuuugcacguaauuauggcuuccaguuugggacuuuuauaagaauccuaagugugcaaauaugaguaucacuacaucuauagccuuuuugugcuuuuucuuugguucuucuucaucucauuuuaucauauuccaauuuuuuguuuuuauuuuacuauuuuuucuuacuauuauuccuuagaugucuguuuuucuauuaaagacagaaaguguguggaucaagaugaaaagauagaaaggaacugagaguaguagggagaaggaaaacuaaccagaauauacuguauaaaaguaucuucaauuugaaaaauguugccaaaagaaacagacagagagggauaggagcauaagagaaaagggagagaaagaaaagagcaaaagaaggagaggagagggagaguggggagaaaaugaaauaugugaagggaaagaggagaggggagagaaagguagaaagggaaagaaaggaagaagagaaaguggaaggacggagggaagguuaucugcccuauauaaccucuugaaucaagcuuauuuagcccauauacaauuucaucuuuagaggcuggagagaugguucaguaguuaagaacaguagcugcgcugggagcugguggcaggcggauuucugaguuagaggccagccuggucuacaaagugaguuccaggacagccagggcuacacagaaaaacccugucucgaaaaaacaaacaaacaaaacaaaaaacaaaaaaaacaaaacaaaaaaaaacaguagccacucuuacagagaacuuggguucaauuuccaguacccucauggcagcucacaacuguaauucuaguuccaagagauccaacagccucauacagacauaugcaagcaaaacaccaguguacaugaaauaaaaauaaaacauuaauaauaaaauuucauuuuuaauauuauguuccuagagauggccaagcuaaaagaacaaaugcuucaaaaugaucuacaaauaaauaagcccaauauagacuguccacaagaaugcauuaacgccugcuucaccuaacuaaacaaugcacugaccuuguuagaguuguuuaucaaauuaacuuguauccuaauuuuaacacaggauuuauucacauauuuuuauuauacauuaugacauuaacuauaagaaacacaacagucuuuuugaaauaauaacuacaccuaaaaccggaaaagcuuaccugaaaugcuacaagauagcacaaugcagccagcucagaaagagcucgccacuggaugucacucugcugacccaucuucaaaagcagagaaccaacaugcauguagaaauguccuuuuguuucuaggaaaguagcugauagcucaucauuuccacccacagaagacuucacagacugaagagcacuaucaaagcuguaaaauuaaaagaguaaacaggcaguccacaccuacaacaaugugacuaaucaguuucauuauuuaauucaaaauaaaauuacuaagaccuacauuaaauuucaucuucuucauucacacuucacagaugaagcacccuaguggauaaucacacaucaaagagcuaguaggaauuuucacccagcacucuacaaggauauccuacuccaaaauagcuauuacuuacacacacaaaaaaaagcaaaucaaauuauugauaaaaugugaauauccaauauuaaaugagaauaagacauaguucagaaauuuuuaguuuauauuuuaacuaacauuuuuaaaaucuaguagugaccaaucccugcaaguuucacacugugugaaggauuauuuuaaagcagcuuaucucaagaaaugagagcaagagacuuucuaccaaauaaugucugagaauuucuauggguucucaaagaucucuuagggaauuccuugagguuaaaacaauuuuuguaauaauaguaagaaacaagaaauguuuugcccuuuauacuuuuucccacacaugucuaaaugaauuuucagagaauucaaauauuaaacauaaugacauaguugagaaccuagcuguguucaauuaagacagaugcuacacaaccaaaauguauaauaaugucuuauuuucucacaacuuuguuguuuaagaaauccuuuaacucuuagggucuuucucuuuagcucuggcuguccuggaacucauucucuagaccaggcuggccacaaacucaagaaaucuuccugucucugcauccugacugcuagguuuaaagucaagcgaauuuuggcaccucuguccagugaauccuuuauuuucaaaguagugauccaugaacuccuaucagccuguccuuacacaaauacaaagcgauguuuaugugauaugaaauuugguucaaaaaaaauuuuuaaaaauggggguaguaggguaaacaugaaaacuuguuauaucugaauuacuuuguuccuaagccaaaacgauguuuuccaaaauauuagcgaugcugaacgcuuacaucagcagaucugaaccuggccacugagagacaaaaaacuuucuuacaugguuuuuacucaaaauuacauuaaaaauaaaaagugacggccagaacauucauuuggcuguacuauuaagcaugccaaaauugaauauuaagcugugaggcuaauuuuaaaagaugaacuguaauaaucuucugaggauggcaauacagcuuaagaggguaaagcuauuuauagccaagacugaugaagucguuccccgggaccuacaaaguggaagaacagaaccaacuaacuccucuacguuauccugauaacugcaccacagcaugugacaccucauacauaaaagaauggaacuuaaaauuacaagaaaauaauucucuaaaaauaaguuguauauaauuauauaaaaucccauaagagcaaaaguaauuuuccucugaguguuuuacuguguggacuguagguaaacuagaggaaugcuaacaauguaaagaaccuagaccaauuauugcaaaaaagaaaaccugucauuuguuaagugugugccugugcacacucucucaacaucaccauaccuuuccaauaguucucuaccuuccugcacaucucugguggaaaguguaaguagcauaagguuagcauaggcuagaaguaagucuuuauugguugcucuccaaguacuuuuaucagaauccaaacacugcagagacuccagauauuccuaauuuuuaagaaaaacacagugaguuacaaaacuucaauagacuuugaaaaauugaccacuguaucccuacaaacuacuuggcccauucuuauuaaaacugugcaaaacugaguguuuuuaugcuagccuuuuaaauaaaauaucaaacacacacacacagagcaaauuauagguguaugaaauuacauuagccuuauaaauaaaaauaccaaauacacagaaagauccacaccgaauuuauuuucccaauuuauugacuuaaauugagcuuggcaaaaaugucauuuuacaguugugcuauaucaaugaaagaaauugaaguguuagaacacuguagagaaauaaguuucaccuaccuuaagagucuguacaacacauaaauuccauucuaaacuugaacguaaagcuguguuccugucugccucauggcagugggccacagcauccuucaaucuuuuauuugaacgguaaagcucuacuagucggauauuuacaugaauaucaucaggucuugcauaaaguucugacugaaucaagucaaaaaguuuauuccauccaucuucaccuuuacaaucuaaaaguuguuccuauuugggagaaaagucauuaaauguugaguaaucuaaguuuccucugcuucccaaguacugggacuaaagucaugcacuaccauggcaggcuacaacacauuucuuuauaauaggucuaagcuucugaccuguagauaauuaucuaaugaaccaaagauuuuauuccagacagagcuucauuuacaccuuagcugcacacacccucaccuuacuuccacugauuacaauaugauacaaucgaccaacuacacuguacaaucuaugaaacuguauaaucacuaaaacaugauuccagaaaaauaacugagauagcauuuguaaaguuuuauguugccuagaaagacaacacucagaacuguuuuaaaggaauuacuuaaagaaagcaggagcauguucuguuaaguugcuacugagaaguauuuaagcuucaaaauacuaaaaaugaucguaucuuaguuuucuccauaaguuucuugguuugaggcuuuaccuuuaacuuauaaauggcaggacuuccugggaaaaguuuggcugcucuuucaacccaguauuuugcucuuccaucagucacaucauuuuuacaaagcaauucugcaaucuucaacacaagaucuuuuugcguuggguuuaauuccacugaacgcugaugucagaaaaaauaccgaaaauagaaaauuuaacuuguauacauaaagucaucaaaaaagcuguacacauuaucuauuuuucaaagacuuuuacauuuuuaaaaauuauauguuuuugcacaugagcacccacaugaauguagguacacaaagaggacuacagaggaugucagauccccuaaaacuagaaguacagguaguugaguaguuccauaugggugcugggaccccacucaguacaagaguagaagcagucuucugcugagccucugaagauccuauuccuaaaugaugugaguuuaaagcugggaaagcacccauagguuuuuuguggagugguguggugcccccauaugccacacuuuucauuuuagaacucaggaggcagaggcaggaagaucugcgaguucaagaccagcuuggccuacauagcaaauucuaguucagccagcacuauauaagaugcccuugaaaaacagagcaaaaacaaauuuuugcaaaaacaaaucaaauaacuuuugcauuacuuaggaaaauuaaaagaauaaaugaaaucauuaucucugaccuuuuuuuggccuuuuuauaaguuacauuuuuauuuauucuggauuccagggguguauguacccuugugccaaggcaaaccagucaaggucacaggacaacucccugcuuuuaccuugcagguuguaggaaucaaacucaaauggccagccuuagcagcaggugccuuuaccagcugggccaucucaccaguauggacuuaaauuuuguguuuuaaauauucaaaaucucaaguauguuccgagcuaagccaccuaguaguacugauguuuguuuucacuacguggauaaaauguguaugauuauuuacuacauaccauggguuacuuauuacaaccccugcaagguuauauuuuucuuuuaagcauguacugcuuuuuagccugcuuguaguaugucugcgcacuauguaugugucagggaggccagcaagaugccagaugccuuugaacuggaauuacaaaaggcugugaaccaucaugugggugcugggaaggaaacccagcuccucuggaagagcagccuaugcucuuaauuauuccagccucacauaaccuguacuuuaaucauauaauuaccuuauaacauucuacagcuuugucuauauuuucuucgacuucauaaagaagacccaaaaaucugugggcuuuagggucucucucuugcacauuaauauacguagaaauguaucuguuuuaaaauacaaaaauaacaaauuaaacauauacuguaccuaguauguacauuaaaauaauuuaaaauaaaaauacuugcaacuagacugaaauacugauaguagauuacagccuaaaccaagcaaccauccaauuauuuuauuguagcucaauuacuggcuaccauuacuuauuuaacauagaguuuaaaaauauucauuucaaaguaacuaauaaccauacagagcuaauaacauguuuacacauuuuacuauuuaauucacgauuuagacacuuauuuuauguguaucuaagugcuagcauaaaaguauuugugccacaauggugccuggugcccaaggagaccagaagguggcaccaggucuccuggagcucaaguuacagguguuaggaaguccccacuuccucugcaagagccucugagcacuccuaaccacuaagccaccucuccugacccucauuuuacuacaaagugcuauauuccucaaauauuuuuccaccgcuaccuaccagaaaugaacacauaaaaugcuuuuucuuccugauuacacuuaguaaagcauugaagaauuucacauaagauaaucaaaaugauuaucaucuacaaacaauaaaauuuuaaagugaaaauauguaaaacacuaaaguuucccaaacuaagagaaucgugucuaaacaagaaaauuauacauaaauacauuaugucauacauaaaauucaucagagagauaaguaacuaagugugguauuaaagaacuauccuuuuaaaaccaagguuacaugcagccuuucucacuaccaagugcccuccucuuccuaucacugcuuucauaaucugccuccaguguaacuuccaccucuaggcuacucugaguaaggaaaugagacucagcaagucucuugccuuacugacaagacagcaacugcucaacuguuagcacugagucugugucuguugcuuaucuccagccaccugaagcaccagauagcuaaccaagaagaaauugacaaacaggaaugaucucuuucauccuacccgagagcaauuuuagaaaaaguguuuuaaaccaaguaacuucugcacuagauauaaacagaaagcaguaagaaauacuuguuagaggcucaaucuaacuauugucugagagcaguuaauuccugauuccagaauacacuugaaagaaaaaauguguucuuuagcaguuuuuccuauuacaaggaugaaaaauuaaaacauuuccaguuugguacuuacuuuuuagcaagaucauauucuuuagcuucauaguacagcuuugcaaaauagaauccuuucauugacuucuaaaaaagagaguugagugguuuuacuguucacauuuucaaauauugcauuuuuuucaaaguaccaaaaaaaauacccuaacaaguuuaauacuauuuuuuuuauauaaaagguaaaaaaugcugccuaguguuuuaaaaguuaauggucccaaauauuauaauuucuaucauaaaaaauaaauucaaggauaguuaaaacagacaucagaagcuacauuucaaggcauguaaaguaauucauaucuguacuccuaagcacucaggaaauagaagcaaaaagaucaugaguucaaagccauccuaaacucaaaaccagccugagcuuacagacagacagagacacagacacagucagacacacacacagcuucacucauucugacuggcuagggaugcuuggccauguauuacccagcauguuuuauguauuacccaccaaguauuacccagcauguuuuauguauuacccaccaaguauuacccagcauguuuuguacugacucacuggcaucacucuacagagaaguacacagaaaacaacuugucuggggaaagagacauauacuagaaaucacucuuuuccuaccauguguaagaagucuccuugggaaagcauuucagaaccauuaagguacuagaaauucccuggucaacguacuauuuucuuuacagaccagcauuuuacacaaggcuaaaauaaaauuugguauuuuguuuugguuuagguuuuuguuguuuuuuuauuugcuuguuuuuuguuuuuugagacaggguuucucuguauagcccuggcuguccuggaacucacucuguagaccaggcuggccucgaacucagaaauccaccugccucugccucccgagugcugggauuaaaggcgugcaccaccaccgcccagcucaagcaagacugauuucuuaagcaaugaaauugguuuuuuugcuauuuacuuuagugguaauaugcuaagaaaagcuauucucacuugagauucguaaaauuuucaucccuauucuuucaguuucucuaaaauuauuuugaaauauaacaccuauuuuuccaaguaguauacacuggagccuuuguuucuaaaaccaaccaucaauuuucaagcaauaccuacuagauaacccacccauuaaacaaaccaaucccuuucuccauauuuuggaaagaaccaaauguucacguguaacagaaucugguucuguuuugaagccaucuucuagcucuagcacaaacugaccugaaaugccacuacagcccaggcugcaaaugaacugggauuacgguuaugagcuacuaugcauuaguauguaucuuuuauguauugcagucuuaauuuauuaauaccucuuucugcuacccaacuuuacaaaugauuuacaagauuauauuugaaaauugaacaugacaugacaauagcaaguuguauuuacuuucaauuuuuuuuaacaguuuguuuauccaauuuacuugucugcauguagguuguguacaccacauaccugugugaugcuggaggaggucagaaauuaguguuguauccccuggaacucaaauuaugagccaccauguggguccugagaacuaaaccagugucuuuugcaagaguaguaagugcucuuagccucuaagccaucucuccagccccuucaauuuuuagcuaagucagacaaacuuguaauucaguauuagcuuuaguuauucaaaaacaauauuacaauauacaaucaauguauauaucugacuagaggugcuuuugcaaguucacuaggacaaguagaggagauauaucgcuacuauaaauuuguaaacuauaugaacauaauauuuaagauaacuggggcugcaggggaucugauacauucuucuggccuccuuaggcacaagcacacacaaagauacauagacauacauguaggcaguacaccuacacacauaaaaauaaauuuaaauuuuuuuuaaagacuaaauauaauuaggacugacaacguggcuucagugaguaaauguaccuggcauuaagccuaaagaccuaaaucccaucccuaggccucacauggcagaagagaaccaacugcagcaaacuuaccuuuaacuucuacacacgugagcauacacauauacauacauaaacacacacacacacgcucccaaaauaaaauguaguaagguauuaagcuuaaguaucaagcagaacauuggugagcaagcacucaaauguuuuuauaucaauguuuguugcauuauauguauuaggcaaaagauauaaacaaccuaagugucaaucaacagugaaugaauaaccacauguagcauaccuaagguaauauauaaucuuauaauguuaacuuauaaauaucuuaaaaauuaucuuauaauauuaaaauauucagccacucaccgcuccccacaaaaaagcugggcagugguagcacacgccuuuaaucccagcacucaaugccacuauagcagaagaagcaggcugcucucuugaauucaaacuagccagaucuacaaaguuaguuccaggauagccagggcuacacacagaaaccccaucugaaaaacuauuuaaagaauaacaauaggggcuggagagauggcucagcaguuaagaaaacagacugcucuuccagagguccugaguucaauucccagcaaccacaugguggcucacaaccaucuguaauagaaucugaugcccucuucuggugugccugaaaacaguuacaguguacucauauaaauacaaauaaaaccuuuaaaagaaaagauuaauaguaguaauaauaauaaggaauuaauaaggaauaauucucccaacaccugcuacaacauggaugaccuuaaaaauauacuaacaggacaaauauaagauucuacaaaugaaaaauaaaaaauaaccaaauucauaaauagaaaaagaggucaccaggaacacagaaaagaagggccuguggcauuauuucuuaauagaacgcguuuagcaucaucuuuuuuaaaaauacaaaaaaaauuggaaauaagaauuaugacugagcuggacaugauggcguacacguuuaaucccagcacuugggaggcagaggcagaggcaggcggcggauuucugaguuugaggccagccuggucuacaaaaugaguuccaggacagccagagcuauacagagaaacccuguccaaaaagaaaaaaaaaaaaaaaaauugaacaauggaacuaguuaaaacaaaaaaugucuuauaguugucauacuauccaaaucaauauaaccaacccaaccaaccuucgauaaauauuaaaaaaaaaauaguagcaggaugugguggcacacaccuucaaucccagaacuugggaagaagaggcagguggaucucugugaguuugaggccagccugaucuacacagugaguuccagaacauaauagaaacucugucucaaaacaaagaaaaacaacucaaaagucauauuugaauauguagagacuuugaaaugguuccuaacauaauuuaacaaccauuuacacauuuacauacaauuaauacaauaguauuagauacuuuaguaugcuuuaucugaaaugcuuggcauuuuuagauuucagggucuuguuuuuuuagauuuuuaaauaucuucaagcauguuagauauccugguaacaaauccuaaaucuaauauaaacacauuuaucuaaaauguacaccuuauagacagaaacccaaaagcacuuucauauaacucuuguaccauggcauucugauuuugauccaucagaggaaacuggguguaaaauuucccacuuugggcauaccagcacuaaaugaacuugagacuuuuaaaaucgcuuugggggagggguuguagauuugcuggacuggauuauuuaaccugcagaagccaucuaaagaagagacuuuaaguaacaacaacaacaacaacaaaaauuaugccauuugacuuguauguucaugaacuuugguuuauauagaugaccauaaaacccucagagacagaauguaaaauauauauauauauauauauauauauauauauauauauacacaacugaauugggcguuuguaaacaaaaauugaagcccucugacucuuuguaucucaaagucugcccuaaauguuaacacgaaucauccucgguaacacuaaauaacacuaacaaggucaaaaugccguuuacugaugaagagucuauacuguaccaaguuaguuuaccaaugguagaacuugauuguucaacacaccccucccccgcccaaaaaauaacugacuguagagccucuguacaucucucuccaccggccaacacucuuuaagaacccaaaauaaacacaacguuaaugaucuuaaacacacacacacacacacacacacacaaaacacguugcgaaauaacguuagaaauguuaagguauugcaacuaccgccuagaaggaauuccgacuagcagccuccaaaagggguuuggggaagcggggcacagcacuagaagacuuaaauuaugggccuuccgugucguuuaugcugacgcgcccuuccuucccgcccugcuucguccguggagccacccacacaaccgugcaagcccaccgccgcgcggugucagccuccccccgagacacggcagccgugacagggccuagcuauccgggagaccgacgacgccgggcgggcgggcgggcgaaccccgcagagcgccccacgacggccuacggagcggaggccgaagaagccaggcccgagugggcccgcggauagccaugaagaggaaacgcuggcggccgcaguccccacgccuccggugcucagcagcgccacgccgcccgcgaccgccuccacuccagcggggagccgaggccgccgggagccaugacaccggcgccaccgccaccggaccagacccgcuuaccucucggggcgacggggcggagcccugcaccgaggcgauguaccgcuccacgucggccuugcuacgccucaucgcgccgcggaccaggcuccccaggagcggcagaccagcccuggggccuacagcgacugcgggcuccaggaggugagcgccgaacaccggugacgcagcuccgucgcgaacggaugggcacagggcgugcggcgcgcgucaucacugugcgccgcgcugcggccuggagcgccugcucgcugucaccccgccacgcccgcgcuccagaccacgugaccguuucgcaaacgaucgagacgaacucccuuuccccgggaaaggcuuuauagauuucacuggugcuacgucacaaagcggaccuaaaauggcagugcccuaauaaauccgaccuuuucgggugcugcaucuggucaacacuugauuuccuucuaaag

SEQ ID NO: 5507 - RNA, 50011 nt, Mus musculus
gcggccgcccccucuccggcgcgccggcgcggcaggggaauauaaaagggacgccuggcucccucuacugcccagucgcacugccagcaggcugagggcggcagggagcuagcuagcggggacugcaggcgacaggacugacccgagccgagcugucgccuuccucccggcccgcuauccaggugaggcgcuccuccgaucuuggagacggaugcgggguccccgcgggcagccggggucccuucgcucuggaguggggcucagcccuucucacagccgcccccgggucuccccgagaggacccggccccgcacccccgaagucaggccgccccggcgcucucccagcuucccucgccguccccccacccccguccugccucuggccggagcggcagcagcggcuugcgccccgccccagcacuaggaccuucuugaauguuccaucccgggcagccagccucccugaugacuugugcagcgguaccucguccgccccacuaagccgggggaaggcgagggcggacgggcgggggucugggccgcccgagccgcagaugguuagcauguggcaguggagaaagcaggcagcgcuugcagccgggggcugagucucuccguuucgaucgcucuucuucucuuuuuccuuuucacuuuuggaaaguaaagcugggaagugggaccuacucagaaguuaggacugaacuugucuguugcgcuucucggcguugucucagcaaguagacauagcccggggcgccgaguuuagcugagaaguugcugucauucacaguuggggaagcuggcuucuuccuuccucuucaucccagugaaucacuuaaggacacacgcgucugucucuguauuucucucucccucugcuccuucuuuccuccugguuuccaaucuugcccaccuccucugguucagcucacccugaugauccccuuucccuuuucgucuuucacgcuccccuccucuugcagggucaacaagucaguccauuuuggccaaaccuucuaugguugugugagacuuuuaaacugaauuuugugauugaccccagauggauguucaguguggggaaggaugguacgguuaaauacgagguuguuucuccuagagagugggaauuugguacaaaggcaggcuuucggacuuaacaucuucagcugaccauccaaaaugaggacucuugggguauugcaccgugguuuauagggaagagccuccacagaaagggauagacaagcuccuggguucucuuuuaggaaaugauuuuuuuuuuuuuuuuaauuaaaaggaaccugccagguucgacuuaacucgagagccauggcucuuggacuuuuuccuuggaaugcacucuggagggauggaauagccacuacgugagugggggaggggggagacguggcaacgcuguucuuucaucaacuuuuuuuuuuuuaagguugagggggaaaaaaaaaaccucguuucccuucucagguuuagaugaagcuuaugaauggaacuuagucuuuuccuaaaauaaucgcauaaaaaaauuacuccugcguagcaggaacauuggaaauuaaacuuuaaaaagacacaaaaggguuauuuugauuauuucuagggagaaaagagauuuuuaagcaggaaguagaagcugaaagugaacacgcucugaauauuuuuaucuugauuugaaauaggaauagucgugauuucuuucuuuuuuuucuucagccacugauuuucuuuaacuuuagaccgucagugucauuucagaaccuuaaauaugaauuagaagcuuuaucuuuuccuuuuguaggaagcauagauuuuuguuccuuacuuuaaaaggucaugacaguuugauuuugcaauauugugucuaauuuuuuccugagggcagaugcuuuuuggauuuacagacuaagaaaaggucuacuguuucucuuuuagguggaugaagcuauuuccauuguuauacugaauuuuuuuuacuuugaaauuaagcugagacuuugauaaaaggcuugggcauuuugucacuuuguaacucagcuaguaaaauaggugaaaaccagauacaacuuguaauuguaaagaauaaauauugaaaaaaaaauugaaaaaccuuuauagccagugguggucauacaugucuuuaauccugggacuugggaggcaaaggcaauuggaucucugugaguucgaggccagccuggucuacagagugaguucagcauagucagggcuacauagagaacucaaucucaaaaaaccaaaaacaacaaaaacaaaauaaaaaaccaaggaggagguggaagaagaggaggaagaggaggaagaagaugaagaggaggagaagagaagggggagaggaggaggaggaagaggaaagaaagcaaagcuuuaguucuccuguguaucaccauuguuguaggagagcuguagcuuuggugaggagacacuaauuuucuguuacuacagagugaguuauggacugacaagcugugguuuucauggagcaguuaauuucaagcauuugcuuugaugcuagggauauagagagaauggagacagcuauaaaccuuaugagccuuaauuucugugggaggaaugcuuuguuuuuaauaaaugacuaaccuggguauaauuauuguuuuuagauaaauuugugagauccagaguguuuuucagucuauuuuugaagcuaugaaaucucuugaaugucuacagcaaagugggggucuaaaucagaaaauacaaauauuucuguauaguuuaugcccucacucaugagcucuguuauaagaaucccuaaaaaauuuaaggcuauguaggcuucuugagacagacuuucuuggcuauuucagaaagcugaagugagcauauguaucaauuucauucaaguaugagaguggcccuaguaagcuauugcugaaagcgguucuaacaaaauagguucuuaggauuugcugaacuacuguauugugagucaguuacaauauaucauauuagaucuugucccuccucucccccaacauuguaacgcucugaaggugaaaaagcaugcagagaagcaaaaugaauggaaugguccuuaauguuaauauugucugucugccuuguggugaggucuaacaucuuacaauuaaaucauucugcagaacguuguauaauuguaugaacauaggagaagccaaauaaacucggugucuauauaugugaaaucaguguuuauauucagugaaauguuuuuauauaauuuuuauauacauuuuuguaagacuugaagcuauucugucauuaguuuuccuuuagccaaagugacauuauaccugagcgcaaacguaaggaguuaaaaacaguucucacuuaaggggccacagaaaugucgaagcagauucaauacaucccuuuuccuuuagauguucaggagggcucuuaguauauuuggcuggguguuggcuaaaaauacaguacaaagauucaugcuucuuacauaacugucagcagaaugaauccugccuuagauuuuuuucugcuuccuguuuuuaucaauguguuuguguuuuggugguuuaguuuucucaguaauacuaaaucaguaugauacgucuguuauuguauauuugagcuguuguuauaaauagucugaagggaagacuguaauucagugguaguuucauuuucuuggaugguugcaguuaacuuuaauuggcuuucuuuucauagcuauauuuaauuaguuacugggggguggauuucucacugaaaagaacugaaaugucagccuacccaugucugccuagucacugaaaaacacagcggacaaaauuccgcucaauauuauuagcucaguuucaaaggacgcaaacuuuaguggauuucaucaaaggugacaaaagaaugaaugauagcaauuuuaagaaugaaaaacauucaaauguacggaaggaagaaaaucacagcugggagaauucuaugacaacauagaacaccagggaagaggauuuaaagcagguauugggguuagugaagaggaaaaaaaacaaugagacugaagcaauaauuaaaauguaaaggaauuaaaauauuuaaaacgcaaggggagaguagcccugguugaccgggaacuucccucaaacuuagaaagaucugucugugucugccucccaaaugcuaggauuaaagacauaugccaucaugcccaaccugguauugguuauuuuucuauuguuauaacaacacacacaaggguagauaguagguaaagaaaagaacuuuguugguuuauggauuuggaagucuuacaaguaggacaugaaagggccaucagcugccaacaugaugcggguaauuuacuccauuuuaagguugaguaaguucugaauggaacuacauauuugaaaucauucacaucuuuucugcaacugaguucauuauuuuuugcucuccuauauauaauauucuuaaaaguuuuauuauuuuuauuggauguguaugggcguuuugccugcaucuguccucugcagaggacagaaaagggaggucagaagccuugagaaugggauuugccgaggguuguuagcuaccauaugaguacugggaaucaaacucuggucuacuguaggagcaacaagagaugcugagccaccucuccagcccuagagcaugugaucuuaagaacauguggugugucucuuucuccucuugagaacuggcguuaggaaagaggaaacugaaagcuagaaggagaagagucaggccuaaggaaaagggauuuaagauagcuaacccagcacuccagagaugggcagggggagcgcaaguuuaaggccagucugggcuauguagugagagcauacuucaaaugaaacagaacacccagaggcacuuuccguaggacggccuugggagagguggaaguuuggugaaguguaccuugaagaugacuuucaggcuguaaccuguuuguuuguuugguuuuuguuuguuuuugagacaggauuucucuguauagcucuggcuguccuggaacucacuuuguagaccaggcuggccuugaacucagaaauccaccugccucugccucccaagugcugggauuaaaggcuuacggcguacgccaucacugccccagcuaaccuguuuauuaagaggauagaaaguguuucugcucucuacuaacuugccugcuuucuaauggaauugguuguggccagagauaagagaauacauaaucuuuuguauugggaaugauauuugagcaauauaaaguauauaacagcaauuugucucucagguaugcagaguguauuaaaccccuuucuagauauuucagcauggagucaauauuuuuucuuuuggacuaucacaaagaaccuaaaauaaacaguugauaaauaaugucauuaaaaaaaaaaaaaaaagccuugagccugggacugaagaguugcuuaacuguugggugcacuggcugcucugucagaggacccagguuuggcucacagcaccacacacacucucaaaaccaucuguggauccagggcccuugccuaaccucugaggguacuccaugcauauuauacaccaacaaaacacuccugcacauggaauaaaaauacaccaaucuuuuaaaggaggggggaaagcuuuauuaaguacuguaugauggaugcaucaacuagaagaacgauauguaguuguccccuguuguccacaggaggugccuucaaagauucccaguggguaucagaaaccucaagcgauagacuguguauuuugauaaaacacacaaacuaaaggaaagcuuaguuugugauuuaggcacaauaaaagaugaauaucaauaacuaaauagaaaaaugauaguguaucauauaauaaaagcuguguuuauuaucucucaaaauaucuuauugaacguuauggcuguuuucuuacagggaaguacuuuauggcuucucuuuguaugucugaguuuccagcaucgcuacacuugugcuuagaacaucgugauucaucaugacacuacagugacauuaaaaacuugagaaaaauaucacuacauuuacuguggggggguauguguacauuuaugucauaaugugugcaugugccauagcgugcauguggaaggucacauaaagagagugacauugaaguuuaaaaauuuuuuuuguuuguuuguuuuguuuguuugguuuuuuuuuuuuuuuuuuuucgagacaggguuucucuguguagcccuggcuguccuggcacucacuuuguagaccaggcuggccucgaacucagaaauccgccugccucugccucccgagugcuggaauuaaaggcaugcgccaccacgcccggcuugaaguuuuuaaaauuuuuaacuauaauuuguguguguuuugccaauauguccccaaacccuagaggacaaguuuuggguuuugguugaccucaaacuuaagcgacuugccugacuuugccuacccuguccugggauuaaaggugugugccaccacugcccagcaguagugaauauuuuaauguauagccaucauaauuacagaaauggacucuauaaacagcucauuggaagcuuuuauaaggucucuggagagggaauaacuuuuaauaaauguuguugaugcuaaucuuuuugguuuucugguuauaauuuuuguaagauucuuuaccucaguaccugacuuuaucgucugaauaauuucucaagcuugaucaugacuuguucucugaauuauuugcaccccuuaaaaagcaaaguuggucccaaauacagugauaagagucagcaguugugacaccagcugcccagagcuucacaugagcucaccucuuuaguccucagaugauucuauuuuacagacaaugcccuucucuucagagguagcccaccugcuguacgcuuguauugacauggagugggaaagaacuguagaguugauuuguuguuaguuucuguuugguuuuuuuuguuuguuuugcuugcuacagaaucucuuaaucuagagccuaggcugaccucaaacucagaaucuucaggccacuuuucuacuucucgaaguccuuggauuuuuuuccccaugucccucauaucacaugugucuggucuugccugauuguacgucuguguaccguauguaugaugucugagaaggcaaggagaggguguuggauccccuggaacuggcguuacagauggugucaaguggucguuugggucuaggaguccaaucccgguucucuagaggaggagcuagugcucuuaucugcuggauucucuauccagcccccaaaggacugguuuaaaaauuauuuggugcugguuacuuuuagccucauguuuuaacuccuugcuugucccccuucuuacuaaaguggccaccaaauaaacuagacauuguuaauaagucuuauuaauuuagaaugcuucuaauaucaaagugacauuuuuaggcucucuguccugggaaauaagaauuuuuuuucaacauguauugagacaagauuguguguguguguguguguguguagauauagguagauuuaucuugggcuggcuuagaacucacaaucuuaauguuuuagucucuugacugcuugaauuguagguuuguggcagcacacaugauuaggagaugucugcauauaucuaaggugcuugaaacaauuaagaagucuguuacauaguuuaaagaaggcagucucagccagaugugacagacacagguggaucucuggguuugaggccagccuggucuacauagagaguuccaggacaagcagggcuacauagaaagacucagucucuaaaauaaaaugugcaguucaaaaauaaagaacaacaccauuuaauagcgauucuuaauuuugcuauuaaaaauuugguuauaguuugaaaaaauuguccaucaguguacuggcuaguuuucugucaacuugacacagcuggaguuaucacagagaaaggagcuucaguugaggaaaugccuccaugagauccagcuguaaggcauuuucacaauuagugaucaagggggaaaggccccuugugggugggaccaucucugggcugguagucuugguucuauaagagagcaggcugagcaagccaggggaagcaagccaguaaagaacaucccuccauggcuucugcaucagcuccugcuuccugaccuguuugaguuccaguccugaccuccuuggugagguaagcugaauaaacccuuuccuccccaacuugcuucuuggucauaauguuuguacaggaauagaaacccugacuaugacaaucagaaacaugaugaaacuugauggaauaaagugaagacaaugauuugaugaaggauuacagggaaaaugagcaauuuaacuguuccuucaguaauugcuuaguuguuuuggaaaacauguccuauuuugauugaaaagcgugccaaguccaguuccgcagcacauugugguggccuucacuaggaaccagugugcugauugugaaaacucacaagacuaaaggugaacacaaagcagcaguuagggugagaucugccagagcuuucuagaagguuucaagcaagaccgggaggcauggacagacguaaaaggaaccuuguggaaaauuuuaaugucaggcaaaguuuagauuagaauaucaagcauucuuucaucucuguuaagauuuggaugaugugucuggguaggaggaguuuucuuaaaauguugcaacuuuuuuagaagaaaaguauaaggcugaaagggugauacaguuucugccagaugcccugugcuagucauccauuaaguagcuuggacuuggacuucaacgaaugcugauaauacaguaaauguuuauaguguaguaguaaaacgcuuucaaaaucuguuccuagguuugguggcccuguggaguggggaggggggggcugcacuuuccuggaagcaggacagaaguuuguuuguguugaaguuuguuuguguuuguuuguuucuugggccuaccugagaauucgucuuucaggaagguugucccuauucacacuagccuauuauauauauacauguauguuacaggguuguauaauuuacaaaucuacuguaaagaauaaucagauccuuguccuuuuugaugugcaguuuugcuguguagcuuaggcuggccuggaacuuacguuauggugacucaugauggucucagauuuacaguuuuucugcuucagccucguaagugcugggauuauaggucugcacugccauaccaggcucaaauuauuuacuuuuuuuaaagguuuauuuauuuacuuuauguauaugagugcacuguagcugucuuaagacacaccagaagagggcaucagaucccauuacagaugguugugaggcaccaugugguugcugggaauuaaacucagaaccuccggaagagcagucaagucucuuaacuucugagccauuucuccagcccccucaaauuauuuuuaauaaucauuccuauugcuacagcaccaaguuuaucuuggcaucggugagucuucuuggucuuccuuuucuguuucuucuucccucccucaucucuuccccuagcucugcaagucucucagggauccuaagacuugauuuuuuuuuuucuuuuaagagauuacauucaguaucucugggaauucaaggccagcuugaacucuacuccaaaaacccaaauaaauaaaugauuaauuuauuaauuuuuagugauuccauuccauucuuggagacuuuggagcagaagacauuuauguguggcuuuucuuugaugcuguauuuucuuugaagcuugacucguaacuacucuauaguauuugcuuuguagacuucgaagagggagagauaaauggaaguagggcauuauaauuaagaaaaccauuguguuaaaacaagugauugauaaagcuaugucucccuauuaacaugccacuuagguuguucagugaguguggcuaaaugagacauaguauuaaaacagauuagaggaaccauucaguugcgugauucuguuuuuccagaagaaaaauugaagagaaaagcccauuuuaaagagaguucuguuuuugugauuucaauguuuuucuguauccagaccagcaacaucagcagcucaugaaauguguacaaauugccuguuuauuccagaccuuuagaugguucugauacggcagacaugaaacauccagaaaacacauagauaggagaugacaagauggcuuugugugugguggccuugccacccagcccugaggcccuguguuugcgccccaggguacaugcaaagguugaaagagagaagugauuguacaguugcccucugaccuccacacguguacaucaugucauuuguacauacaauaacucaaaaagcagaagugugagagaaagcuuauuccuauaucuuuaugaaugaauuuucugcauauuuucucacgcuguuaaaacuauguuacauuacuaauuuuuucccuuuuguuuugcuagagacacuuucucacuauuugugacccaagcuggguuugaacugcugauucuucugucucagcuuccuacaugccuggauuacaaacgugcaaguuuaaaugguuuucguguacugcacacacuaaagugugggugugugugugugugugggugugugugggugugucugugugugugagagagagagacagacagagagagagaguguguguguguguucccauguguauucccgcgugugugcauguaugugcacaggugccugcagaggccagaggaucugaggguuaaacucaccucauuagguuuguuggccaguggcuuuacccaccgagccaucguauggccaccuguauucuuauuuuuaagcuuaugcauucccagcuuguuuuguuuuguuuuguuacacuguuuugguuauggagaaacuuugcaacuuauuuuguuacacucuuggccaaggcuauuagaucuuuguaaaauuuauuuugaagaagcagacauauucacauuaauagagcuuugaggcuuuauauaggcuuuaaaguauaguuuucagggcuggagagauagcucggaaguuauuaaauagcacugcuauucuuccagaggcacuggguuuugaguuccggcuauaaauucuaguuucagguaaucugauguccucuucugaccucugcacacacugcacacagguggcacacagacaaacaggcaaaggauccauauacauaaaauaaaacggggaugggugggcuggagagauggcucagcagcuuagcacacuuauugcucuuacaggggacuugggcuugauucccaacaucaugguagaucagaaccaugcaaaaaguuuuaaaaagaaucaguuacuggaagaaaaauaccacuuuagagcugcuuuuuaguuauuucuguaagcuaaugauucuugguuuauugugagguuuaaagaaaacagcagguaacaaagaaucucuaauaacaauauauuuuaguaauaaaaauguucuuaccugacagaucuaaacuuuaucaucaaaguuaaaaaauuaucuaauucuuguaacuagccuuguauuaauauauugaaggcauguauaauuuuuuuuuucuggaaauagcauuuacucaccaagaaaauuauggcagaaaucugauuaaacacugagagaauucuagacucuucagacagccugguguuuugaaaaagcuuugugcuuuggcaggagcucaagagaggaagugccugcaucugcuacauucuagaagcuuuccccagaucacuguaaggcagccaaaaaaacuguguuucacuacugugugguucuggaaguaucuggaaguuuguagcaaauuggagagaggagauauaggaguucuuccaaaaugccauuuuauuguggugaacuuuuucauugcgauucaacuuaaggagaagaugaagguucuuuucaacuuuuguggauuucagucggccucuguugaagccuguuaguuuagacagcuuagaaagauuagagaagugucuacaaaacaggcuggcaagucaaccuaacagauaguaaccugcuucugagacaagccaaccugugguaguaacucacucuguuuuaaagcaaugagaaagcuuguguguuugguaggggaggaggaagagucaguuaguauguaaagcaaggcggagccuuucaguggguucucaguacccucauuaugaugagcaguccucacuggaaaagacuacuggggcagaggaaacaggaggcagggguggugagaggcucugugguuagcagacugugaagaccagaguucagucccccagagugcagguauuaugccaaguggguaugacaggcuggcugcagggacuccuagccacaugagugagcucuggguuuggcugagagaaccugccucucaguaauguagaugagugauuagggagauucggacaccaaccucagcauaugcagcucacacauaagaaugaaaaaagaaaacaaaaguuaucaagaagagcuuugcugccagguugaacguggggggagggggagggucacggcuguguacaaggcuuggguggcuuuauuuguuauuuuucagcauagaacacagaaguaagagaaaaaguguucccuuaccccuuccuaacaucaacaacaacaaagcaaaauaauagcaaaaccuuucuccucuaaagcuagcccucaaagcuauaucuuuaagagaaauuacuaguuuaaauguacaaagcucuuuugguauucuccacaacuuaaguagcauuagaggugcgaguguagcugaguugguacaggacuggcuuaugcucuggguuucaucuccagcuccaccuaaacagggcaugguggcacaucccugaaaucccaguuaucagucggaucggaauucacaguuauccuuggcuagauaguaaauucaaggccagucuggauacaugugauccugucucaaacaaaaaagagcauagcuucauucaugguuaauuaauauacuaauccagucccaucucuuucaucauucaugauucagcacuuucacaguuaugaaauagucaguuaccuuccauuuuuaucaccuccacaacuucaaacuuucaaguuuagaaccauacuugggaaagauggguuaaguuagaaauuuuaaggauuaaagaacucugauuuuuuuuuucuuuuaaaucauuucuaacaucuuuaaaguguauuggugaucucuaaaguauauucugugagacauucauguuuuagagcuagacaaagggacaacauuuucauacuacagaaaaagccucaucugggacuugagagacggcucagcuguuaacaccuucuguguuccagaggaccugaguucuauucucagcacuggaucuaguggcucucaacugccuauaauuccugcuguaggacaucugaugccucugcccucugaggacacccacacucauguguucaucacugcacacacacacacacacacacacacacacacacacacacaaaauuaagaauaauaaaaaggaauuauuuuuaaaaagccacaacuguuuaguugcucugcuugugauaacgggaaaacaaguggguugaaguuuuucuauaguauggagcaccuaaauuuauuaaaguuaugaauuaguuguuaaauugauuuguaaaaauuaacaucaauucuaggggcagccuggaaacuaauuauugcuguucuuauaggugugugaaccugugaaguuccccaagaugaucuggguuguuuuaaugauggcgauucuacuuccucagucuuuagcccauccaggguuuuuuacgucaauugguaagucuuagguuuuaacauuuuaaaauuuacaugcuuuaauauuuuuaaauugaugaaaacaaaugcacuauauuccugaagauuagccuugguuuacuccuugccuauuuaaaagggccauuuaaaaaauuccuuaauggggggcuggagagauagcucagcaguuaagagcacuaacugcucuuccgaagguccugaguucaaaucccagcaacuacacggugguucacaaccauccguaaugagaucugaugcccuuuucuggggugucugucugaaagcagcuacagugugcuuacauauaauaaauaaauaaaucuuuaaaaaauaaauuccucgaugucugccuuucuuuguucuuuaaaaaagaaauaguuuacugagaucucuacaggagugcagugugggcaguaguuauacacucucugccuugguuuucuuuaaauuaauuuuuccugauuacaaaagugauauguauuaugcuuagaaacuuagaaaauuuuugaaaagcauaccaaaaaaguuagugauaguugggguauggcagcacccaacuauguaugacuuuaaucccaggacuggaggcaaagguagacagagcgguaugaguuugaagucaagcauggucuuauacugagguccaggccagccaagucuacauagucagacccuguuuuaaacaaaacaaaacaaaaaagaaaguuagcgauuaaucucuacauauaauuaaugcauauacauaccauuuuaaugcauagauauauaguugcucuguacauuacuuucaaauaugauuuuacuucauuguaaaggugcuauuuuuuccacaccaucauuuuaaaaaguauuacacaaauaguucguugaagcugggcagugcuggugcacucuuuuaaucccagagcuuagggcagaggagguagaucuuugugaguucagagacagcuuggucugcagagugaaccaggacagucagcucuaucacuggucuggcuuaaggcuucugcugcacugguaacacuggguccucaccaggacuccgcucggauagacuguuguugcaggaucauggagauccugcagcuuugggucuguuggacugacaccuucccgagcuccagcaguucauagaugggguagauguuaguguggaucaacuaaaggccauggaucuuggccugcaugguagcugagcuggucugcccaccagcucgcccacacccacagcuccaggaugagcucuccagcauugcucugacuguucacccaaugcuagaacugccuuucauguccucaggcuguuuaccuacaucuaggcuugcagggccaucuccagcaugcugcccaaguaaggugugggagcugucuugucucgucucgucuuuucuuuuuuugguuuuuugagacaggguuuuucugcauagcccuggcuguccuggaacucacucuguagaccaggcuggccuugaacuaagaaauccaccugccucugccucccaagugcugggauuaaaggcauaugccaccacugcccagcgucuuauuucuuaaaaauaauuuuuaaaacuuuugcaacuuuuuuaaauguggauuuuuuuuuuucgagacaggguuucucuguauagcccuggcuguccuugaacucacuuuguagaccaggcuggccucgaacucagaaauccaccugccucugccucccaagugcugggauuaaaggugugcgccaccaccacacggcuguggauuuuuuuuuaauugauuaaaaauuugaucccaauuuaucuugaaaacuaaagaugagauauaaaagcagagacaaagaagaagaaacauuaauucuaguaaaguacuguuguuuauuaauuuaguuugcaaaugaaaacaccauuuuccaacauauuuucaaguuugcaaaauuuauuaguucuaaaaacuagaaccagaacucauuagaauuuuauuuggguuuaucugauagggaaaaaaaaaaggaaggaagaaaggaaggaaggaaaaugauccuuuacgacagaccuguuccauuccaguuaaaucuccuacaggauaaaaucuuucuaaugaauucuaagagauuuauauugaugaauauuuaauaaccuuccuuuuccuguguaggucagaugacugacuugauccauaaugagaaagaccuggugacaucacuaaaagauuauauuaaagcagaagaggacaaguuagagcaaaucaaaaaguaagugcguuuuccuuacuacagcugucuccgucuggauguuuucacacuuucacuaaagcauagagaggaaaugaagcgggaaagugucuaaagcgggaagcacaggaacacaagggcugauccugggucaggguuggugugugucagcuuguggccuagguauauguacgugcauauguuugcagauguacaugugcauagaggccaaagguuaaugucagauaccuuucucuaguacucuuguuuguuuguuuguuuguuuugagacaggguacugaaucuggcaaggcuaaucggcuaccaaguuucaggaaacuucuuguuccuaccacccagcucuagaaucacagauaaacacuacuauugguggggguguuggggaucugaacucaguguccauccuugugugauaaacauuuuaccacccgaaccaucucccuaguaccuaguuagcuuuuuuauuauuguggcaaaguaacuuaacaaaaacuucuuggaggaaauaaugacugucucacaguucagauguucgaguuucauuucauucuaacugagcagcucgaauggcaguuagggcgcagagguagagaauggagggguuggcagucuuccuccuucccaagccuguguaggugcugcccacauucagggucagucuucucugaaaacacguuacagacacacccaaagccgacccuuuaagagcuacuuugugggcuggagagguggcucagugguuaagagcacuggcugcucuuccagaaguccugaugucaauucccagcaaccacaugguggcucacaaccaucugcaauggggucugaugcccucuucuggugugucugaagagagcaaugguguacuuauauacauaaaauuaaauaaaucauuuaaaaacaaaaaaagagcuucuuuguaaucuaaugaugcugacaaugaagauuaacuaucacaguguggaaggauaugaauggaugaggacauggaagccugcuaauaucuuucauaaucucuccaauaagccaccugcuagagcaguuuuccaguucaacuccagggauuccgcuguaaauuuauagugacaaguaugauuagucauaucuaauuuaaaaacaauguggcuuuucuugaaugauaguuuuagugacucagguuuguaguuaaaccugacuugagaauuuguacuuuguuaaaugaaagccuuaguguuaauguauuagguuuugagacagucugacuguguagcccuggcuggccugaaacacacugagauuggccugcucuaccuguugcaugcugggauuaaagguaugcacuguccugcugaguccugcauggccacgaagaaggaauggcguagcacaguucccaucccuuaagcagagcaagcaaggcauagacuuccacuagugucgauaguuacuaggcacgaggcuuguuuguauaauaaugugcauauuuucauguuccuccuuuggggaaugcucucccugcuaagguuaaugacuccaugaaaauaagaaagugcaagucugggaguugaggguguguacaguuuuccugagcaaaaauggaaaaugcugagaccccgcagcccuuaaggcuguggaaaugaacucuuaaaaaacaugaguuaaaaaaaaauuaggauuucucaacuauguaaaauauaaggaugcgauaugaguucuaugaggggcuucauguaccuaaaagaacagaggcagguacacuaagccagcuugucagaaagauacaaagaaaggagauaaagagauuuaggaaacuuuggucagaaacacaagaauuacuuagagaccuaacacagcucuuuuuuucuagaagcuuuucuggcuuuggucagaaaacaugaacuauccagagagcuuuuagaauauuuccuagcaugagagagaugucuuaagcagagagcuaucccgagcagacugcagagcugucaacuugaacuuugauugucuuugucgauugacuucgacuuguucuuuugcugcucccaaacaccccuucuucagaaacccagcuccaagccgaggcuggcccugggcacuaacccacauggcucgugguucuguuuuaaaauccauauucuacauaggguguaaagauucgcuguaaauuagcacauaguugcacacaugugauuccagcacugggaguggagucaggaagaucacaagucgaaggccaaucuagacggcacaauacaguaaggccuugucucaaaaagcaaagcaacggcagccaaaauaauuaguaugauuuaggcugggcucaguggcacacaucaguacuuguugccacucaaggggaugaaacagagagauucuugagccuagaaauucaagguuagccugaaugguaacauugugagauccaguccuuaaaaagaaagaaauguguaagguguuagagagauggcucagcaauuaagagcuaagcuuucaaaggcccgagguucaauuccuaguacucacaugguggcucacaacugucuguaacucgaguuccaggggauccgacaccucuucuggcuucuuugggcaccaggcaugcauguggcaaacauucauugaugcaggcaaaauaccagaugcuauacagaacauaaaaauaagaaaaaaguagaaaaaaauuuuagagcauaauauaaguuguuuuaaauauauacuuagcagaauuuaggcagggacaguuuauuuuuauuuuauuauaauagugauuuuugcuuuugagggcuuauggggaucaaaauuuucagugauuaaauuuuagcauugucugagaugagauuccauuugggagaaacaaucuaaaacaaagaaguuguauuuugauucauuguuagguuuuuuuuuucuucuuuauguuguguuuuugagagucuuuauauuuuuacuuuaaaaagaaguuauaggcaaugguuuuaagugaaaagcuuauaauuagucucauuucccaaguauuuuacuugauugauucuuuuccuugcuacacucuuuuuugugggguggggagggacucacuauguagaccaggcuagccuugacuuuacagagaccuacuugucuuugcccccugagugcugggauucaaagcaugugccacgcucggauggguggggaaguggggaggagcuggggggagggaaagcauagucagaauauauuguuuggaaaaaaaaagucuauuuucagaaacaaaacaaaaaaaagcaugugcaaccaugccuggcuuuuaguacacacuuuucugucugauaucuguagaugggcagagaaguuagaccggcuaacgaguacagcaacaaaagacccagagggguuuguugggcauccuguaaacgcauucaaguuaaugaaacgucugaacacugaguggagugaguuggagaaucugauccucaaggacaugucggauggugaguguaaaggggcagggggacggaaagcugacucgggucccaagugcaucccgugccugugacguaacugaaguauucacguguguuugcuuugacuagauauaauugaaaucugagcauuucaucuaaaaaaaaauaguaacuucuaauauuugugauaauguggguaauuuuaccuuuugaucuucagaaaugauuagauuuuuugacauauaacuucauuucuaagggcaaagacaaugggaguuguguuacaaagaggaguguuagccguguucguauuggccagcuuuguauuucuguuucugugucucuguauuuuuuagacagcaucucacuguguagcacuagcuggccuggaacccacagacucuaccugccuccaccucugcaugcugacugagggcaugugccaacaugccuugcuuccuugggcauuuaauacagucucguguguucuagauugccuggcacguuugucauccucuuguccuuguaguucuugguucggaggugugugcuaguguucuggccucuggguggguuuggguuuuuucucuuuugauuguuuuuuccuuguuauuuuguauaauaacaauuacuauuaguaauuaauauuaguagugacuauugguaauuaaucuuacuaauauggauguaguuuuugcagugaccucacauugcugacauuuuaaugggacuagguauugacauuaauggucuguuccaucuguguuguuucuuguaaauguagacauuucaugguaagguagaaaacugcuaagauauuuuuuauacucaauuuuuucuauuucaaggcuucaucucuaaccuaaccauucagaggcaguacuucccuaaugaugaagaucagguuggagcugcuaaagcucuguuucggcugcaagacaccuacaaucuggacacaaauaccaucucaaaggggaaucuuccaggugaguggacgcuuccauccguggauauauuugucacuuagcugcucuucagcccacaaggaaaguguaauuuuuuucauuaauuaauuauuuauucacuuuacaucucaauauccucaccuccucucagucuucccuucacacagcuccuuccccaugcccccuccccuucuccucugaggaggaaaaggaauauaauuuuauagcaggauccccugcaauccaggcuggccucaaacucaaguucauggcagucccuccuguuuucgccuccugagucugggauuacagguguauacuauuauaccugccuuuugaucuuaacgguuuuaaacuguagcguuuauuuauuuauguauuguuuguuuguuuuguuuuuuggagacaguggcucucuuuuuuguccuggauggcuuggaauucacagagaucuaccugugucugccuccugagaacaaccuaaggaaggaauuuuaguauauaagaaaaccucauuuuuccgguauuuuagaacauccgcuauuucuuaaaugauuuguauaugaaacuauaaucaucaaaauguuuauguuuauuaacuaaaagcuaagauguucagaauaugaacagguauuaaaagguucuguaguaugaggcuaaagagauggcucagugguuaagagcaguggcugcucuugcagaggacuuggguuaaauuccuagcacacacaauauaccuaucuguaauuccaguuccaggggaucagauaucuuuuucuggcuucuguauguacuaugcacauaugugauacauaaacacacauguaggcagaauacacaugcacauauuucuuuuuaauuuaaaagaaaguucuauaguaugaaacagucuauuaaauauaguacaaguuguauuugacuuuaugguaauuugcuugucacugucuuucauuauuacuggagaaauaaaaaguguugccucuggucagacugaaauugguuuucuccguaacaaaauaagacagaugguuauugaggaagauacuuuuuguguaucucuucaucugggauaaguccugggaugguaaauuuaaucuauuauguuaaauuaaaguaaacuggaauacuugcauaaguauucagauuuauguauuuuauuuucuguuucuauuagcacuacaucuuaacauuugauaagauuauaacauuuaaaagccgggcgugguggugcacgccuuuaaucccagcacucaggaggcagagguaggcggauuucugaguucgaggccagccuggucuacaaagugaguuccaggacagccaggguuauacagagaaacccugucucaaacaaacaaacaaacaaacaaacaaacaaaagagauuauaacauuuaaaaauugguuucugguuuacaaccccacauuuaauagauauuaauuacgucaugugugcaguuauuaaggucauuccaaagauauaguaaguaagacaguaccuuugucaacuaaggcacuuagauaacaauacagugaaugccuguauauagagagccugccauucagcuaaguaacaggaacuuuguauggcuuaacacacaguuccaguggacaugcaugaguuaagaauaggauuugguuugcgagaguagugagacaugaagcuagagagguaagcaacgccaucucuuagggacuuguauuauuucucccuuuuucuugccuguuuguucccuucacacccacuauggaauguccucauuuucagaugcuguugauuuuauuuuuaauuuguuuuccaaaacccaauucccagaaauuuuucuguaauaauucugaguagaucggaaucacuuuaccaaagcagagcagccaaggauauucugcucuuuagcuuacucauagggcacugccgggauacugggucaguuacagaguguuacugugcugcuuguguguguugaugugugcuuuccccuaaugugcuuucuuugcauggcccccaaacacucaguguugcugacucaugagcucaguguacaccuauaccaguagcacaguaucgaaggugaaacuuuaaugugauucuuugcuuucuggaaguauaucacauuaaacuauuaagaaguuaggauuuugauaucugccuuguuuaaauauguccaugccaauuccaacuuuugaaacuuuauugccaugcacuugaggccagccuggguucauaacagguaucagaccauacaggaauuguuucuuuuaucaguuuuucgguuaguauuaaucuacuuagguugguuugaccaaaguagaaucuccauucccucacaggauaauguguaaauuuaacaggaguguuuugcuugccacuuuaauuuuuuucauucaaaguaggguuuuuuccauacaguauauuuugauuauuguuucucaucccccagcugcuccaagauucucccuacuucccgaccuacccaaauccacauccucuuucuuuuacccaguagaauacagacagacaucuaaaacagucaaauaaaaacaaaccaaaauagguggaauaagagccacccuccccuaaagcacaagaaacuaauacagacugagacagacacacacacacauacagacugagacguacacauucacacacauauaaaacccauaaaaacaaaauuggaaaccauaacauagaagcaaaagaucuguauggcuaaaaaaaauaugcaaguccagacagagcauuaugaggggaaaauaaccuccaggaauaccauugaguuucuuuguguuggccauccacagcuggguauggggucugcccauauguguuuguauacccagugauagauacuccauuggagaaaacccccucuguuuucuccuccuuucccucccccucccuguuugauucucccauugcaauugucuuugccccgccccaccccacccacugccuauucauccaaugcuuaucuaugcuuucucuccuuccucccccuagucuugugcucugugcuuacacagacuucuuagcugauauaaucagauacauaucacauuugucuuuugggggcuggauuaccucacucaggaugaucuuuucccuagcucuuuccauuuaccugugaauuuuuuucacagcuggguaguguacgacauuuucuuuagccauguaucuguuaauggacauguguucuauucuggcuauuaggaacagagcagcaaugagcaugguugagcaagugucccugcaguaggauguagaauccuucaggcauacgccgaguggaaauaauacccagaaggagucggugacaagaaauaaucaaaagcagggauaaaaucaauaacacagaaacaacagaagcaaaaaaaaaaaagcaauacaaagaauccgugaaagaaggaguugguucugauuaguaaacccuuaaucaaauugacuaagagagggagauccagauuaugaaagugagagccgaggggugauacccgugggucccaaggagucuuugaagaagagccuacucagccauuugcuuuucuuucucuuccacucucugcucaucucuugcuagagcgccccuuaagcauaggauagauauuguuguugcuuuugagacagauacaagauauaauuccuguugugcuauaguauacuuuaacuuaauccacgucucauuuugguaacuucauaugcuucauauauacaggauaaaugcaaacacauaccugcucaguaaccuguacucauguugaugaugauguaauacuaauaauguaacauaugcuaacaugcuaacauaugcugcgagauuuuaucuaagccuuguguucuucuuaaauuguuuuacauuuauugaccauguaugugugugcuguaugggaucuguggcaugcguguggaagucagggcaauuuguggaguggauucucugcuuccacugugaguuuuagugaugaaucuugugacuuccugccgagcaugucacuggccccaggcccuuuaggugccuacccugucccagcuaugcaguucuuauuaugguauguuauucugucuguuuguggaauuaggcuaauuuuugcucuguuuaucuacuuacuauuugagacagggucacucuauauagcucugacaguccuggaacuagaccgggcuggccuugacuucacagagaacucacugccugccuuugcuucuugagugcugggauuaaacacgugugcuaacacaccuagcugauuuuugcuuuucuuacaacuaaacaaauauuccaauguccaaaugaaagugaaguaauacuuggagagcuauguaauccuauauaguucacuauggagauugcuaaugcucuggacguuuguuuguuuguuuguuuguuuguuuguuuguuuguuuuuguaggagugcaacauaagucuuuccugacagccgaggacugcuuugagcugggcaaaguggccuauacagaggcagauuauuaccacacagaacuguggauggagcaggcucugacgcagcuggaggagggagagcugucuacuguagauaaagucucuguucuggauuaccugagcuaugcgguguaccagcagggagaccuggauaaggcgcuucuccucaccaagaagcuucuugagcuaggucuguuaucuggccugacuuacagcggcuccacugggcgucugucuuaucugcauauuuacuuguucuucuaaccacagacagccaugugcugucuacagaaagucuacaagucagacguauguuguucucucacuaccuguucccagaucaacggugcuugcuguguucucugacgguuuuucuccaggaauuuaaaaauuggaacuagccaagcaauuguggugcauuccuugaaucucuagcacuugggaggcagaggcaggaggaucucugugaguucaaggccagccugaucuaccuaguaaguuccaggacagccaggacuacacagugagaccuugccucaaaaagcaaaacaaaacaaaacaacaaugaguaaauaagaacuagaucaagcuuagaugaagaacucaguugaaaaugcuuacuuaccgcgugguaauucccagccacuuuccuuugaaggacauuacugcuuuguugcauuucauagucaaaaguuagaaaaaugauaugagaauuaaacagcaacaaaaaagguuuguguguauguagguguaucacauguguguauugaucaccaaggccagacagaagagggugucacaucccuugaaagcaugugggugcuggaacccuggcccuucucaagagcaacaagugcucuuaaccucugagccauuucucuaacugcccagauaucuugguuuccaucccaagauauacuaugcugcaaucuucagaauguauaaaaugaugaauucagccagccuuugguacauugugaagaaagaauauuuaauaauuuuuuaugauuaauuaagaugauagauguuaggaaagugagacugcucaaaaagauugaucaucugaaaaugaacuuuaugauaauugauuuauuucuuguuagauaaugaaucaagauauuaauucaaauaacauuuguuuuccuguucuguuuuucuauugauuuaaauuauacuuuguauucaauauagaaaauguuauuaauauagaaaaagaggaaucaacuauuuuuguuucguuauaauguauauucccuuuucuauacacuuuucucucuuccaaaaauaggcuuuuauuauauauauuaugugcauaauauauguauuaucaaacauacauugugagcaguuucagaagaacuagaaauacuuuauaaacuaguacuuuagugccacaagcgaugucucuaacuuccuguucuuuuguuucugucucugugugguugguuuuuccuuacuaaaagguagcuaaaaauuaucaguagcaauuucugaggcaguuaguggauuuugacauguuugaaaauuauauauucaguuuccucuuuucuucuuacuuggaaauuuggagcuuaagucuccucagcccucagauguguguuggucugcguuugugaagugguucauuuugucuuuaucauagugauuacuuuggagccacaaaauuaucuuuccaccaguacuuaaaauacacagaugaauaagacuucuuuucuuuucuuuuuuuuuuuuuuccccuccuagacaguuuuucugugugucccuggcuguccuggaacucacuuagcuuaggcuggccuugaaccaagagauccuccugucuuugccuccucaaugcuggaaguaaaggcaugccuagccacccccagcugaguaagacucuaaacugaacacuguucucaaagcagaagcagcaauuggugccugacgauacagaccuguucugucuccagcgcuguuucuguacagggcagcgucugcucugauugacugggugccacugcuuguaucuuguuuuggcacuaauuacuuuggcacuauuacugccuccuuucucaaagguauuuuaauuagcagauaaaccuuauguaauauaaacuguucauauugcucuuuucugaugaugggacaacuguaaacuugccuaugugcacacuuuguuucucuuccuuagauccugaacaucagagagcuaaugguaacuuaguauauuuugaauauauaaugaguaaagaaaaagaugccaauaagucagcgucgggcgaccaaucugaucagaaaacugcaccaaagaaaaaagggauagcuguggauuaccugccagagagacagaaguacgaaaugcugugccguggggaggguaucaaaaugguaaaguggaaaaagucaaucguguguaugugugugcggcuguguggggaugugucuguguuuguaucuaguccuggagggauucaaagcuuuguauauuguagucucugugguaaaaucagaaugacugcacaaaauaguaugcugugugccuaccgcagugaaaaugcaucgcugugcaugcgcuacacacuguuccccaaauaacugauagugggacauuguuaaaguucauuuuauuucucuaccaaggaacuaaacuuaggcuuucuguuuugacguugaauagaguuaucagccuaaucgcuaauugcagauguacauugcaccauugcggacauguccacagucugauuccuagcaacacguguuugcuuuuacuugggagcuagugagccaugugagaauaaguagacuuugucagacuucuucaacuuccucacucaugucaucucuaaaguguagcauaugugcuaggcaccuuccugucacugagaaagugcucaagaaagacaacuuucaaaggaggggagccuuauuuuggcucacaguucagaguugucaagucccuaauccaucccauucacuggaaugagcccagggccaggcaggacaucuuggagaggguuuguguuggagcagaacuacugauccacagcaacuuggaagcagaagcaacagggauggaauucacaaugucaucuucugagcacaccccaacaacuuucccuuaagcccauuucuuaaaagcucuaccaccuaccaaccacacugcaggcuagagaccaagcugagaauuuaggaucaaucuagaugcaagcucuaauaauacauaccuuuuagagauaagaacucaaacugacuagaagccauuaucauaucuuuacacaguuguagaaguuacauaauaaucaaaugucuaguuaguugcagcuuuccaguggugagcugugucugucuguuuuggaaacccaggcucuccuauaucgaggauuauuggcuugaaauucagugucuuauucauuauggaaguuugaccuucugcuuguuauugaggcaucccucuuccccagaaaguucucuuuuauuuucuucagugcuggggauuaaacccagggccuuugauaugccagaugaccacucugugcccccaaaucguaaggaucagugaugacauuuuaaagauccuaaauguguguuguugguuugaugcagaaccuguacugggcacugcugcuuuguguguaguuccaagggucaucuauguguguguacacacauugucauuguuguugcagaaaucgucugugcauguguacacacaucauuauuguugcaggaucauuuguguguguguaagcucguauguguguagaugugugugcaugugugcgcacacaaacaucguuacuguuucuaacagauguacgaauggacacugaguugcuguucuaacacguuuauuacuuucuuuguacgcagacuccccggagacagaaaagacuguucugccgcuaccaugaugggaaccggaauccuaaguucauccuggccccagccaagcaggaggacgagugggacaagccccggauuauccguuuccaugacaucaucucugacgcggagauugagauugucaaagacuuagcaaaaccaaggguaacuuuuucuucucaguuuaccagauauguguguguuaaucuuuuaauuugcaaggcgacaggaaggauaacuggggcggcuguaacuuuagaugguuuuaacuguuacugccucaacacaacaguguuaacuuagaguuuacacuaguugucucaguuuguuauccacacaaguaacauauccuauagcugggcuugacacagugaguagugaacacuguagauauguguucauacacagagucagugguuugcugucucacuggaagaccuuucgcguaggucauagcucucaguaccacucagagcucaauuuuuucaugccuaguauuuuuuuuaucugaaugaauacuccaaguauuguaauuuuccuuuagacauaauaauaguagaaaaguauaauuaggaacagauaucuugcuaguuuuaaaauaguauuauauaguuuacuaauuuuaguuuauuauuauuguguuaaauuuuucuuuuauguguauggguguuuuguuugcaugagugucuguaccaugugcaugcagugcccauggaggccagaugaguuagauccucugggacaggauuucuguguucugccugcacugcagggaauccaaccuuggugcucugcaaacaagugcuccaaacugcugagccaucucuccagcccccuuaaucuguauuaguaagaaaaguaguugaaugugaauuaugccaaauucuacacuuucaguguuuggcauagaaacuugucuuuugugugagaguguagaguggagacuaccucucugcccuuaccuuuuccuaccaucuuguucuuuaagacaguacaucuuauuaaagauaaaaugcaaacuuuuguagacauuauuaaguacauucugauuauuaguuuuucuuccauaacauguaagguugaucuauuucucuaaaggcugagguagcaaauguucuagagggcuuugucaucuguguggucucuugucacgacugcucagcucugccaucugguguaaaggcagccaaagaaaauaggaaaauaaaugaggugguuaugguacaaucaagauuuuauuucuaaaagcugauggcaguuuauuuggcuaguggguuugcuggccagguguguauauacuuagauaaauuucaaaguuuuuaaaguuuuauuauuuuuccaaauuaacacuuuuuuuccccccuuaaaucauguaguuuuugugaugcaaugggugcuguccagagauauagcaaauuggcugccuagcagaaaaccucuuaaaaucauuccauauuuucucauucucuuuagaauuccuaacucggucccuuauuuauagucagacccaguuuaccaguauuucuugguagaaucuuuguuaagaauucacuuuugagauggaaggccccaggcuucauaggaaauguuuuaguugagauuauuuuugagcaguaaauuuaguggcagugaaaguuaauuuuucuguuauuucagcaucaaccucccauuuaaauuuuguuuuuuuuauucucuuggcugucagcauuucuguuaagacuaugcauuccuuuuaccugcauggcuguggaaaggcuguuuuacuguacauacuguuaaguacacacuuucucuugaaaagaggaaagaaugaccuuaaaauaaauuuuagacaauauugggacccucuaaucauguugucacgagucacaaucugagguuuuagaguccaugauuaauuaguuacaaauggccauucuuauaauaucaaugguacuuugcauuuuagagccuuuucuucacguuaucaauguucuauccuacugaagaaauuaauuccaaccuuuucuguuugugugaccucuauucacgcagugaaaagcaaguaaaauaguuuuuaagaaacauaaaacuaacuggcuuucaaggcgcgacacaaggugauuggaaggguauugaguuauuuucuauucaccuucuuuuguuuaaagaagaaagaaaagaaaacccagcauuguggcugguuagggaaaugugaucguuuuuuugucuuguaaugcaacuguuuugacgguuggcuucacagcugaggcgagccaccauuucaaacccaguaacaggagccuuggagacgguacauuacagaauuagcaaaagguaagauuggaugccacauacuuuccuccuaacgagcguuuugaacauccuaccagaauucuucuuaaccgaaguggaucgucuccagucuccagcucaaguggccgccauacacuccagagcagugcgugaaugagugcuuguguuucacggguuuucccuugacuagaaguucugguuuuuaaucucugauuggccucgaguuucaggaacuaagugcauugucaugaucagguauuaaacacucaggaaauugccugguccuuuucuuuugccuuuguugugagcaugugaaauuaagaaagaaaaaagaggcaguguguucacccaggguggagugcugcucacacacccuccccuguggugauugucugcuguugucuuuuaccuccaggcuguccuugucauauggaguaaucuggucugaaguuuuuuauuaaaacaaaaacaaaaaccaagccacuggccuacaaguuggcucuggaaagagcagcugugcuucugagcucagccuuccaaaucacuucccaccuccguugacuuggaugguuuagagaaaagccagcuugucuugaugaaaguuucaaaaugaucaacuaauuuagaaaacuuguugaucuauauuugaagcauuaaacuucuagacuugggagagcuccugugaaacccacugcugcagaucauugacauacgccucaaaggguuuagucuuaaaaaagugaaaggacaauaaauacauuuacagucagauucucuccggacgaacgaacgaguggcucuucuugccaccuuucugaguguuuuaugauucgaaccauuacccaccaggcagaccaaucaauccuuccaaucaccuguggcuuggcaaaacagagaacaaagcccagagacagccugcuggaguguaagccuuguccuuucucuuuuuucuuuuuguagcugagccgagcuacaguacaugacccugagacggggaaauugaccacagcacaguacagaguaucuaagagguaagggagaauggacagaacuugaggcauauuuggagugcucuuuccugaggaucuaauuuugaccauauuuauaugauauaguuucuaagaccuagauuucagaucaagcuuuugguauguguacuugauuuucacgauggaccaauagacagauacaggcaguuccaugcaauuccuagucauugacuaguauacagugaaugccaggggaagcucuggcagugccaaccgauagggaagaacuucuaaaaggcucugcccagagcaagacccaaggcaaacucugccgugaagcuggggcuauaugggucacuaguagcuguugaagaaaugucuagaaggacaaagaagcuacuauaagucaguuuaaaaucccuugcuuuuagcaacauuuagaaguaacuuuuagaguuaaccaugguacaacucagcugcauaacucagaguuaggggcugagugaguuaguauagcauugaccucucuguuggcucacgggauaaaaggcugcucagaucacagugaaaacaggaaugucauugcacugaauuguuuuagucuaacccuaaguaauauuuuuccacagaugcaacaauuauagaaauaaucuuguuauaaacauuuaauuuuauacauugcccaucuuguuauuuauauugauaguaauugcucaaucaauugcuuagauuaauguguauaauaauagcugaaacaauucaaucagaagcuacuauuuuuugaaauuguuuuaagguguuuugugaugagugugugugggucugggugugugcaugguacagagggcacguggaggucagagggucucugcaucugugagccuguucuccacucuccccuguugaagcauggucuuacuuucuaugugugccaugcugugcacugaggccugcugggcccugagguuccaggugaucgagucuccucucaucuuugcauaggagggcuagaguuacagacauuuuguuuuguuucauuuuuuuugagacaaaagauucucuacauagaccaggcuaaccucgacucacagagaucugccucccucugucucucaagugcugggauuaaaggcacaaacccccacugccuggccagauguggguuuuguuugcuugcuuguuuguuuuuauggagauggaacucagguuuucaugguauaaucuuguaucugagcuacuuugcuaaagauauuauuuuuaacaugagcauuuauguaacaggaaauauaaauuuuuuuguacuagaaaacuacaaugugaugaauguacuuuuugguguaaaguuagaacucuagauuaagauuucucagcaucaacauuuuugauauuaaaacuuuguucauauuuuuuuuuccuuuuuuuuaaaauuuuuuuugguuacuuuguaguauugggcguugaaccuagggcuucuagcugggcaagcacuggaccacugaaauauguucccugucuaaggucuaagguguagcccaaguuagcaugugacuugaucauccugcuguauccucuuuagcauuugccuauuggcaagugccacuaugguugacaauugauauuuugaaucaggucauucuguguuggugguggcucuuugagcaagguuaacagcucucacuacaugucacaacugaaagaaggcguagggaaaguuagguugcuugcugugccuugauaggacaaguaccuaauaccaccucccuccuccucuccccucuccccuccccucuccuccccucucuccccuccccucucucccuucuccccguguugagaaccacugacuagaggucagugaaaaugcaaguucaggguucagggagggggaauggugugagaguuccaagccuugugcccauuuuuaaaaaauguuuuagauuacauuuuauuuauguguacaugugcauguauguauacguaugugguuacacacaugcagcaugccaugcauauaugaucagaauggugcacacacucaagaagcagaggcaggcagauuucuaugcgucagaggccagccuggucugcaaagcaccacccauaaagccuuucccauaguugagagacuugugcauagguuuggcauuuugguaguaaauacuuuaaguucuccugcuucuaggaaugcuuagaugcuuagcugcaaaccccugccaccuaaaaggaggggaggggaggagaagccguguaguucugcuuuaacguuaaagaagaaaaacaacuuucaugagugaaguguuucagauugcauuuuugaaagcuuucuuguuuauaaaauaaaugugaagaaggaauacccagccaaauacauuacuggacucaccaguuguaauaaauuguguugaaagugauccccaacuguuuguuuucuuauagcuaagcaguuucagacuaacuuuuaaguacccuaguuucauaacccugaaaagucgcuuucucggguuuacugagaaagacauagccauacuugacgcuauacauccuaagaggcagcagaaggcuugcagccaguagcauuuaauggccaagaauaaauucuuggcaaagagugguguguuuuaaacagacuaaagagaaaugaauuuuauauuucaaugacuuuaauauuuauuuuuaaagaaacuuguaucaaacuaaaaauaugcucagagagagagaaagagagagggggaggccuuagcuauuaaagaagcuuccuacuggaaauauugaguauauuuuagcacaaaauuagaggaggaauuucauugauggauaaauggguagaugcagaugugucucgacaccaguaggaaucgaguuuucuuuguggugagccaauggcuuugugugguaaccaacuguuccacccugugccaugucccuggcucucauuuaggggacagggucuuacuaaguuucucaugcauaauuugccuugaauuuguaauccuccugccucugccucccuaauacuucggacuacccuagcacagauaugaggcacugggcauaguugugaaaaccugaauuuugaaauuuauauuaaauuuugaagugauaaauuauuaaauaaacugguauuuugucucccuuauaaguuaugauaaaaaugcuucauagaaaaaauguggguguuuugaucuuaauauaauaaucccuuuuguucuagcaacaucugcauuuuuaagauuccaaaaaggaauuuaaucuguauuuuaagacauuucuaagugauguuauuuucuguagaaggaaaaaagauuucagcauccaacaaauggaauuuucuuuggaaaacauacauggaaguuugcuacuguuuaaaaugaaaguuuaggcuggcuguggugguggguauguguagucucucuauguaguuaggacacacgcuguguagaucauacuuauucucaacucacggagguccuccugguucugccuaaggagcgcugggaccaaaggugugcccgccacucccagccagagugccagaauuaugacugauuucagauuauuuaaaacugcccuaauguguaacaauacugcccucuaauggguugaacauggguuuucaaaggaagagagucaagguagacacauacauaguauuauugcuuaauuauccuaccaagacuauauaagucuuacuaauuagucauugcuuacaccagcaccuaaaagaauuauuaaaaauuggaaaugauccucuugggaacuaguacuuuaagcccagaauuaucauuucccuuugcaaagggacagucuauugguuuauaauagcuaauugugacauguuaguuuucacaucuguguugugguaggauuuggauuguauuacuuacaucuuccacggaggucuguuaacugucccccaaguggccccaacuucaccugcuugcucucuacaagcuaagugaggauguucuucuucuucagccaacuucccugugaugauuuuaagauaaguguuaaaagaaaagucaagauuuuuuaaaauaaaggaauuuugcuuuaaaaaguguaacaugcuaauugaaaguacgagaccuuuuaugaauccaaaaggaagcuacuuggcuauuuaacuuuuaaugaaagauaugguauauauagaauuaccaaaacagguagguagacgcaagaggauuuggaguucaggacauagugaguucaaggccagccugggccacauaagauccugccucaaaaugacaacgaauaggcauuuaaaagucucuggccgugaggaaguagaagucaguuucuguuuuugaguaauaaauucaaguuaggaaagcacagagucaccauucagagcacacgugacuuacuuuguguaaauaaacuaggggcuugguguaugcccucaggguuaaaauauuuaccuagcauuugaaaggcccuagguuucauccucagcacugcaaaaugaaauauaaugaaaaaggauagaaaaaugauguaggauuauggguguuuccuggacaguuuagguuuuagugagagcacugcuaauacaguggacuguagcguccaagcuuagugagaugugagggaaggaaguguugacgagcagaagcaacgaagggcacauuugaaaugguccauguaaguucugagguuuaccugaggcuuacauuggaggaaccuuuuuuuuuuaauuaaauaauuaauuaaugguuauuuuauuuguuuacauuucaaauguuauucccccuuccccuucccaguuuccccuccacauacucuaucccauucccccuccccauugccucuaugagggugcucccccacccacuaacccacucccgccucaccgcucuagcaucccccuaugcugggacaucaagccuccaggaccaaggggcuccccucccacugaugccagauaaggccaucugcugaaccuuuauuaaugugaaguacagcugccaagucauaaaguucacucuuuuaaaagauuuuuaaauguuauuuuuacuuuaugaguguuugccuaaauguauaugcauaaauguauguuaagucuggugccagcagaggucagaagaaggcaucagauacccuggaaguggaguuacagacugcugugagccacaauaugggugccgggaaccaagcccagguccucuggagagguggccacugcucauaacugcugaccgcucuccugccuuauuuuuacauuuuuugcuuucuugguuuuuuguuuguuuguuuuuguuuuuuguuuuuuuaagagaagguuucucuguauugcccuggcuguccuggaacucacuuuguagacuaggcuggccucgaacucagaaaucugccugccucugccuccccagugcugggauuaaaggcgugugccaccaccacccggcuuguuuuuacauuuuuaaguuuuaucaaguuuuauuuuuuucagacaggguuuucuucugugguucaggguggcuuuaaauucccaauacuaucucaacuucccagauccuaggauugaaagcguguacccacagcugucaauucacuguucuaaaggguggauuuuagguguucucaguccuuugaguuggccaauuaucauuuaauuccagacauuuuaauauaguagcauuuauguaucugugggcacauauauguacguguucguguggaaaccacagguugauaucaggacucuaucucauucucugcauuuuauuuuaucuuauuuuauuuuccugagcuaggagugcgccaguuuggcuagucuacguaaccagcuugucuguccuaggauagagucucugucuccugugggcuagggcacaccauccacagaccccuuacgcauuuuuugcauacaucccauuaacuaauccgugguuuuagauauuuguaaugagucugauggacauuaagguugauacuuuuuggcuguuaauaacauugcugugaacauuucugcuucuuaugauuuaauuuuccuugcauaucuaaacagaaaucgaauugcuggugauagaguaaccauguuuaacauuugccccauuucacuguccugucagcagugcauguguaaaacuuacauaagcaaauaauacaugaauuugcaugaacaauguuaaugcaguguuucacagaaacaugggauguuaguuucuuuccucuaacugaauuaguaaaaaucuucucagucaagcagaccaggcagaaguagugcggugcaguguagugcaaaccgguuaucucagcacuugggagacugaagcagggcaagcuggaguucagccugggccacacagugaaacucugaggggaaggaagguuaccaggggcaaccuuggcaugcacacuguccugugugguauuuaaaauguucaguguucucugugccacuuuguaagugguagguauuggguuuuaucuaaugaagcaguggcccuaaaaccaaccuuuucuuguccuagugcuuggcugucuggcuacgaagacccugugguaucccgaauuaauaugagaauacaagaucucacaggacuggauguuucuacggccgaggaguuacagguaagcagccagugucuuaaguuacucccacgucuccacgaggcccuuuagacuugcuggcaauaggaagugcugaccuauauaaucccuacggacacaagugacccuguaagcccagcaugggaaggacauaauaaucaacugcagaaacuggaaauggaagaggcauacuacuaagcuuacuacuaaguauacucuuaaaauuuuaaauuauuuauauuuuuauuauauccuuugugcauccauacgcauguauacgcuguguuugguggcacauaccuuuacccccagccaucccacuagucccuaauuuuucuuguuaauuucuagacucagucuacuuguugaaugucuggagugaaauuuggcuuuuuaaagguguucuuuaaccauauaccguacgguuugccuugguuacaugugguuaccugguugugaccucauuaccaggcuuuaauuccagacguuuccaucacacuagcaagaaacugcaguaagcaguuuuguuuuguuuccccuuccuaagccucuggcaaccacuagcuacuuugugcuucuauggauguacuuauucuggauauuuuuauagggguuguuuaauauguggcuugucuguaagguuccuuucacuaaacaucauguuggcaagguuuacugagguugaagcguguauuccacguccuuccuuuucauggcacaaaccuuuguggagucaccgucuggcugcucauuaguugguggguaccgggguaccuucugcuuugcugcuguggaugauucuacgugcaagguuuuguaggagcaaacauggaaguucccguguguuacgaaugagaguggagucgcguaauaguccugcacuuaacauuugaagagcuuucaacaguuuuccucagugggugcagcagcagcacaugcaggucccaguugugucuccuugacaacaccuucuucuccaggguuagugcagccuggcaggagcuggggcugcugcuuccugggcucacuugcguguuccugaugggcuuauuagucauuucugcuguuguguuaauuuguggucuuuauauauucuggauacuaguccuuuaucagagaaacgucucauagauuuuaaaucccacucugugaccuguccucauuuucucagggguguucauuagcacaaguuuuaaucugugugugugguucauguauuugcacccaggggaagugagacgaagguguuggguaucgugcucugucacuccugccuucuuuccuugaggcaggaucucagugagccccagugggccuuuaucucuccugcaaacccuccucccucccuagugcuggcauuacacaugugcacagcugugcccugcucuuaaacaugggugccaggaacucagauuuucacaccugugcagcaagcacucuuacccccugagcccucucuaccccaugacgucuuaucuacuaaugcaguuugcugugucacuuucuguugccuugccuuuagguaucuuaagaagccauuaccuaauccacagucaacuauauuuccuauaguaguaauagcuucgguucucuuucuccaugugcuaggaacuaaaccucaggucuuaagcaugugaccauacacucugcccuuggcccuaaagaauucuguuauuacuuacauucaagucuuagguccauuuuggauuaugucuuacaugugguauugugagggaggugggaucuaguuucguuacuuccaacugcaugucaauugccccaguaucauuuauugaaaucucccccugcucucauuggagaacuaaguauuauacuuuuaguugaaaaacauuaauaguuugaguguucuuuuuuuccuugucacaguuuuagagugggccaagaugcuccuuguagcacgucauacuucugaguuugaguuuuccccuuugugcuuucagugauccgagggggacuccugaggacucccguggugauucacacacacacacacacacacacacacacacacacacacacacacacacacacacaaacacauucuccuuuucauuaaucugccgucaugagggccccaagaugcuugccuagaggcugucagacggcagugagcacgguuccuucacgucuaucccugcacacacacacuaugaguuucauuucuacacucugaguuucauuucuacacucuuauacuacuguucugucaucucuuguagacugucacacagauuuaucacaggagacaaggaggugacacacugcaggccuugcugucugcaugauccugagguguagcuuucacuggcaaguuguuaaaugagaaccagcagcaagguguguugcugcugcugacauagcacagcagcugagcugacacucagccauggcgcugaggucugugugccuugagcagguggccaguaugaaggaaucacuuacauugccuuuuauucugugauaaucugccuugauauuuaucugguugguugauuuuuuccacacaggguuucucuguguggcacuggcuguccuggacucaaaucuguagaccaggcuggccuuaaacuuagagaucuaccugccgcuguuuuccugagugcuaacauuaaagguguacaccacuaccacccagcuuaaauaucguuuugaugucuuuuucuccccuggccuaguuuacccuacuuuuacaaccuucuagaauuguuacauuucuacuuccuagaggauccaaguguuuguacaagguaacagaguacacaguguaacacuugacagcugugacguggacuuagacuggaugcuuccagugccucuucugccccuucacugggcaccaugguaacugagugauuacauuagacuuuuccccuuuaaccuuaagugagaaaaauuauguaaaggaaaauguauuuuuguuaagugcacugaguuagagagauggcugcguaguuaacagcauagcugcucuuccaagggacccaggcucaguuuucaacacccacauuguagcucacaccuucugugauuccauuuccaggggaucuaguacccacuucuugccuccacagguuccagcacacaugaugcacauacaaauauacaaucaugaaggguuacaacacacaaacuuuuuaaaagaauuuaucguuuaccuaacuauauaggaggucagaauauggaggaucuuaagaauuuuuuugauuauuaucuuguucccccuuauuuugguacuagggguugaacuccgaaccucauccaugcuguggaaacucugcauccuugagugguaauauuaguucuuagucuuuucuccucuuuccuucagguagcaaauuacggaguuggaggacaguaugagccccauuuugacuuugcaaggguaagugaaagaguaacuaaacucacuuagguuagggaacuccaugucacuuaaagacgaagucuccaugacacuuguuuaggacagaagaaggcuugauugggcguggguggggugggagcagcuguaaugagguuuuucagugagagaugaagcuuaaguucagguacagaaggaaacacggacagcugcggggcugugggcaguacaucgaucccugagcaguaaugggcuguccggcugcagcagggacaggagcaggguacacuaccugggggagggugaaagacaagaagcccugugagagggcagauaaugagcaugcaaagcccacaggucagggcccagcgaggcagguggaggaggagugugaguggguguggucaggaggaagaucuuugcugauucuuaguauaaaaccacauugucugauugacaguugugacaggagauccuaaaaagccuucucaacagagaacaacaacaaaaccccucauaaaaggcauuuaagacuuucaguucaaugcauuguugagccuggaggagcauagagguuauuucccgcaggcacacugaagccuagacaguugugggcuggggaugaggcaggaagacacacugcugagggcaccuagagcuuuggguaccagcucugagagagaacuggccucuagucagauuacagucagugggggaaggguggccugacaggagcugcucucugggaguuuuaaagcacagacccagccuccugacaaaggucaaagcugcucaggguggaaauguuccucagugugacaaaagcaggcuucauucucccugcagauuuaaaaaccgacaguggcuaagguaggcugagaagaccguggcagccacagacaggagcgugcccuaaguugcuugcauacugugugugucaccuguaacaaaaucaacaaaaaugacgaaauagcaaagggaaguucuaaauagaaaaauguuaacauuuagaauuuaaaggauauaggaggguuuuguuugguuuuggguuuuuuuaaagaugaaagacaagugaagugaauugagcaauagaugugaaauacaagaacucauugagagugagaaacaaacuggaguccaggagcugagagaucaugagacuccauuaaagugugucauuauuaaaucucacuuagccaggucuuaccacaaucugaagcuucuuacacuaauacugugcugugagauucacagacuccagcucuugcgcucuccagggcagaagcaggcagcccggagcaacucucccggcuucaucuuaggucccuaugcucuuuccugugggaucuugcaaaagcugcaguuuugucucuucgcuacuuaauuucugauacugaagucaggguuuugaugauaucuggcuaaaagucccauuacaaauuuacaacauuaucuuagcuuugagauaaucauugguuccuauaaguagcuaaugagaacaccgagcacuuccaugaaccucucccaacacucacagccccagucaggagugugccaugugcauauucauggcacgcgcugugaugucaccaguucugcuuacuugucauauggcucugcacuucugguacaggugaccuuaugcaauccuguggugcccaagguguaucacugucacaaggcucccuguagugguuguuaccacacacacccuucucacauccucccgcuaggaccauuagacaggagaacacacuauuauucagucagaaaacagcuguagaguuuguguucucugaugauuuugcagguauaugggcuggauugagcacuugaaaggcuagugggacacagcacacuggcgggcacaggcagcuuuugggguguguucuuccacuuacuacugcugugccuggaguguucauguuacugaguuuaugccauuauauucacuguuuuguccacagaaagaugagccggaugccuuuagagagcuugggacaggaaauaggauugccacguggcuguucuauguaaguaacagcuaaauguuugcuuuggacuuaguugcagggcucacuuauucgggcauacuuuaugaaguugguuuggaguggguccugcuuagcauucuuaaguuuuuauuauccaaguaccucugagggagauggucuggagucaucugacuacaucaugaguucccagcuagccugggugucagaauacacaaagggcugaggcuggggcuggggcuggggcucgggcucuaugcuuccuuuagcaugcaggaagguuuggguuugauuaaacucagggccuaaaguacauuaagcaaacacucuuucuacaagaacaacuccaaaauuaacuuaauauuuguuucacuuuuaaauuacaugacaaaucaucccaaaacuuuuccgagcucuguggguagagggagaaaugguacaucaaaccagaggucucauguauguucuggguggcuuuaaguaauagucaugauuuccuccuauagcagagguguuagugggguuagcacccuguucagcucucucacacacuuaugcacuagguucuucuggaaggcguaugcagguggggcucuguggccaccaucuguacaguuccagccagucuguguggcuaggcauccucacagccuggggaguagcaagccucagaaagaaaauuguacauggcguggcauuuuuacaguccaucuuuaggagucccgaguguccuucccaagguguuuuuaagucgcaccugcuagauuguuuacgcuuccucugagcucaguccucagcccugcccagcuuugaggggagggagugugggcugcaucacuugaaaugggcuccagagcagguagugccuggagcuggagcucaaaaccccaugcagucagaaugcauuacauugggaaacuacacuuuguuaguggugugacccuuaugcuuuagaagggcguggugacagaguuuuaacaacucaaaguacuuguuuuagagguggcuuuaugauauaauacauaguuggccuuuguuugguauuuccugauuuuaugguuaaaaaucuucacauuguggugggguugggguucuuuaguguguguuguuuuuucuguuaauuuagguuuguauuuucauucuaggucaacuuuaugauaacuauauauaauucuuuaaucuggguggguuguuuuuuguuuuuguuuuuguuuuucuucauuuaaauuuucucuagagaaggauugggaauggcucagucauuaaaguacugaacaaaacaugaggcccuaaauuuagauugucagcccucaacaaaaaaaggugguacacaucuuuauucccuguacugggaaggcagacaggagaaugccugaggcuugcuggccagccagccuagcugaguagugagcuccuggugagaggucugacugagcaggaaacccugugucacaaaaugagguagacaguaauugagagaagacgccugcugucagccucugcccuuuacacacacgucacguacaacagagagaaacuuuauguaagcagauauuuacugagugccaacuuuuagugaggacuuauccguacacugaagauugucagcaagugaaaccugcguuccugccuucuagagaggacauucaacuugaaaaugcuuacgugcacuucucauuaccucauuauugacuuuaagauguuucuuuuccacccgaguuauaaaggugacugcccaauucuagcuccaucucccucugucguuaguaacuugggugcaugccuguaaacuguguagcauguucaaccaaccaacccagccauaccuaagcaagccucagugucuauucagcaucagcuccacccagugcuaccucucaguguuucuacccuggcuucucuuguagaugagcgaugugucugcuggaggagcuacuguuuuuccugaagugggagccaguguuuggcccaaaaaagugaguauggcuuguugagucuuuuucuccugaguuagagcuguaccuacaguuaguggcucaggcagugcacuaccuuuucaaacuacauccauccccaaguaaagguugggccaacguuauggucuuaacuuccauguggucaagaagcaucugaaagugauagaugaguuagagagcagcguacacuacuauagcgggacaggcgaguguaaguaccgcggaaagugggaagcuggcauuucacugagugaugacacuggacugugcuccacagggcacugcugucuucugguauaaucuguuugccaguggggaaggagauuacaguacacggcaugcagccugucccgugcuaguuggaaacaaaugggguaaguacuuccucuauucucagagaaaugagucauuucucuuugaaacuauuagaaccuguaccuuaaaacagaaugcuuucucccguggauuugccagcauggauucacauugugugagguucagccaagccugucucugaucugaauauaaauuugcgucccauagaugagcguuucagugagauuguuucacaggugcaucuucuucuccagcugacucuccgagaagcauuaguuggaaaguuaguauuuccccuugaagguuacagucggagacuguguccuagcggguaagucagaauacucagucagugcagccugcugaccaaggugggaagaggagagggagauggaaccuuccuaagccugacguuaauuuuguuuccucagcacacagcaguuacuuuuaaaggaauguuaacugccaggauagauuugguuaaggccccuggcuuuagugcagaauuuaagaggcccuccuuugcagaccauacaggcauaggauggccucauuaacaacuaaaauugagaaagaaacagguuuaauguauguuaacccaguguaugcauuucagaguaucagugucacauuucagaugcucacaaucuguaugucuagagguuaucacauaagcacuguaaagaggccuguucagcaaggacuuagaauccucucgcugauuaugacgcuuaugaaauauugggccgcacugaggacagcagacggaaaacagauuuagagacucugcucuguuguaugcaugggcaacaagaggucuaguuguaaacagcagcaaaaagucuuggcucaaaaauagaagaaaaauuggccaauugaugaauaaagauuggguaccagagaggugaugauaaugaggguaggaaccccguuuagauauguugaucaagucaaggaaugcgaggauagccuggucuacagagugaauuucaggacagccauagcuauacaauuucucuaacucugucuggaaacccaaacguuaugaauccaagacaacaguaugaaugcaaagauguccaggacucuuuccaaagaggacuugucuuccuuucugccuuugguuuggagggaggacuuggaagucacacgcuccacucuguccacgcuggcucuuagcaccuccuguagcucacuguaagccucacuagguguaagugcauggcucuuauguuuccaacauuguccaguuuaugcagcauggccuaggucugguuuucaaucuuaaacuuuucaucuguguugaaacugccauaggcaagcuuuuggaucagaacauucuuuuuucccucucacaguauccaacaaauggcuccaugaacguggacaagaauuucgaaggccgugcacccugucagaauuggaaugacaaccaggcuucccuuggcuccuguuguccucuaacgcaccaggcacgauggcugauuauaacuccgacguuuacagcugacuaacacuccaugauuaauugggccaugagccucagccccaugucucaccuguggacaaucacuuauuuuguggauuucuuuaauuaauacucaaucaccacaugauguaaaacuuaugguucaguuuucacaggauacaaggcauugaaaaugaggaaccuaauuuuguuguuuaaaagagcuuuuugguuaauuuuuuuaaaaaaagcauccagaaguagauuucaccacaagucaggagcugguggagcaggcgaggcuguguggcaggcgugcagguggcaggcgagcagagccugugggcuuacagacggcaggcaugcagacgccagugugcugcucuuccgauguguggacugcugagcacugguaacuaacuagggcccagucaggucugcuauuccacgugcagaguuccuauuauuuaaagaaacucuuuuuaucaaaucccccuccucaccacgggugaauucagccaguuugagaaaauuacuuuguucaaaaaguccugcagaacuggccucccaaccgagugcucagccuucgcccuuuuccucagugacugcagguuguccagagacuguuccaagugccaaucagcugcagcaggcacugguguuggcauucugauucaauucugugccuuaggagacugggaguuagaaaacggacagguccuuggacugagggaguugauuuuuaaaaagaaauguuuuauaagaagccaagauguuuguuuuucuccauucugaaauguguuauaacaaugaccuauuuaugaucuuaaaucuuuuuuuuuuaaaaagucucugugugguauuuucauguuuaaauccaaauguaagaauugagcacugcucccaggcccguucuaauuuacuucuuuacugcacagagcuuagauuuacuacucacgguuagaccuucgucacccagaacaggcucccuugggauaagcuucggggaauuuguuccaggauggugaggcuuugguguguguuguuacagugaagacccugcaguuccucagaacugcaguucagaagcaggggcguggucucggcccugcacuugaugaauaugaaggaauucuuuacacggggcuccggcucauuuuaauucuccaagaaaguagauauuaaaaugagcuguguccaucacaaggauuuuagcaaaaaaaaaaaaaaaaaaaaaaaaaaagucaaagauuaaggucagcaauuuaagcugauuguguaaccaaacuguuuuaaaaaacaacaggcuggaaaugguaggcccauaucuuugguccuagcacuuaggaggcagcagcagcagaaucucucugaguucaaagacagccuggccuacauagugaguucugggucagucagggcuacauagaaagaucccaucucaaaaacaggcaaaagaaauucuuuuaggcuaguuuuauagcuuagucagagcaccagugugagucccuggguuccauucccacuaccaaagcccuguauucuagcuaacaugaaagcaacagauuuuacaaguaaaauagggauuucaaggcuaaaaaacaguucugucacaagguguuagcaagcagcuuguaaguuaggaagcuaacauaugcaucagccugccuauauccugaguacugaugagaaaguggggacuuuguugaaaccagcaauggccuauaaacacgugaggaaacacuccaucucugggccuuuaagaagaucagcaguguuaacccaggguccuaucaggacaauaaaguugccuagaaugugugagaucuguuauuauggaaaaguuccucaaaauucaauuuccuaucaucuguuucuggauaugaaaugaagacagggguggaauguuuauaccagugcucauaacaggauuguuuguaaucaccauaaagaggaagcaaccuaaguucagaaacaggugaguggagaaaugauggcaugugcauuagaaaaauauccacagccaauucaucccacucaacauggaugaacccacuuacaggagaucccuagaggagccaauggugccugagccgagaugagacacuuggaguuaguauuuaauggguguguugcacagcaauguaauacauuuacugugaucuaaauacacucuuugguuucagauuuac

SEQ ID NO: 5508 - RNA, 1055 nt, Mus musculus
caccgucuagacuccagagacuccagggacagacuagagguuauagcuugcuguuuuuucuucuaagcacuuccuuuugagcucuaaagacccuaauucugcaucugcagcuaugcacugcuaugaaagagagggagagggagagggagagggagagggagagggagagggagagggagagggagagggagagggagagggagagggagagggagagggagagggagacggagacggagagggagagggagcgcguguucacauacccuaaacauuuuguuuaagcuucuucaugcuucaaucuucaguuuuacuugagaaaggauguauagcucaugcuggccucaaaguaguggcugccccuguuagccuccugacugcucuccggacugugcccauagagcuuccucacuugagggcugaucaggaggcagccaaacaaagucugugucucuaggcccagcuguagggucuuagggaaaccuacagauuucucuucauugaucuugcccacuaauuuucuuugugucugucugucugucugucugucugcacaccccucuuguauuucuacagagccagccuugaagguacagaacaucacccauucaagcauguucugggacagacuugaugaggauggcccaucuccccagaguucuuccuggcgacagucccagggcuaccccucccccaacucuucucauggcuccacgccuggguaaacagcagauaaaggcaagucagucucuccugcagucagaacgcaccucagagucaagagugacacagaaaaugccccugagcagacuccuguccucuuaccucacagacugauugacgugacucguaccagacacucaucgcuuccacuagggauuccgugcgacaccaugaaaacacugucugguguugagcauggugaugcaugcugauaaucucagcacuugggagcccaaugcuaaauuaccagauuuagacuaaggauggcugcguagugggacccggccucaaaauaaacaaauaaaauucugguucauucaucuugccuugag

SEQ ID NO: 5509 - RNA, 511 nt, Mus musculus
uuuuuuuuuuagaauuagccaucuggacucaguuuagaugaucccaaucuuguuggcaacgucuagggcaucauaaucaggagccaagcgagcagacgccuucuucucucugucgggccuuaucaggguauugacuuuggccacaucaaugucauagaguuucuugacagccuguuugaucugaugcuuguuggccuugacauccacaaagaacacaagaguguuguccucuauuuucuucauggcugacucaguggucagugggaauuugaugauagcauaguggucaagcuuguuucuccugggcgcacucuuccgaggauauuuuggcugccuccggagccgcagggucuugggccgccggaaggugggugacguucagaucuucuuuuuguggcuguggacgccuuucagcaccgccuucuuagcuuucaaggccuucgcuuuggcuucggcuuugggaggggcaggagcuuccuucuucgcguucgucgacaucuuggugaaaagc

SEQ ID NO: 5510 - RNA, 822 nt, Mus musculus
aggucagaguuucuuugugcagcccuggcugucuuuggaacuugcucucuguagaccaggcuggcuucgaacucacagagaucuaccugccucugucuccugagugcugggauuuaaggcgugcaguuucugagacucuaauuaauaaaaacaauaacaacaaagcaagcaggcaacauaauuucuacaacagcaacaaaguggcuacugccaggaaggggccugagggcugagacagacagaggagaagucaggagcaggagaugguccccguggcagguaggacagcuugagugaggcccccagauguggcaaugaugagugggguagcccccaauucaaaaaucaggucuccagcagauagaaugaaagcauagacuugggcucacagaggccaagagaagggggacaggaaguggccaaugcucaaacugugccucugcuuuccccccacaagccccugcggcugcggacagaauucccaagcuucugguucauaucacaguaguccacacagucuuuauacccguucuuccuaagaaggguuguggacaggugaugggccugacucaaagcucucagcugguacugucuguucacaaggcuaucuaacagcgggagggcgacacagaaagcccaggaccagauucuagaguggaaacuccagucccaacagcccggguggguggcuguucccuccuaagccucgaagccuauaggaaagcccucacagaggucauaacgcccucaugaaagccacauauguucaccuucuggaaguaauuauuauuccuauuuacaacgaagcaucuggugcccaga

SEQ ID NO: 5511 - RNA, 2187 nt, Mus musculus
gcucgcuggugcuagggaucgcagcaggcaggggggaggugcgagaggguucgaagggacagguccgggcagcgaucggggguuggcaccaguucgcucacccuucgagaggcagagcgcucuuguccgcaaucuucgcugaccgcgcuagcuggugagugucccucccgggugugcacaucuugucggggagugaccucggcucuuggggccucagagcccucaauccugugcaacgccgacacugacgccaaauccuugucccucuugucuuucagcggcuucugugcgccuucauucggaccuuagcagccagcguccuggcgucugaccccgccaugccuagccucugggaucguuucucguccuccucuuccucuucguccucgucucgaacuccggccgcugaucggccgccgcgcuccgccugggggucugcagccagagaagagggccuugaccgcugcgcgagccuggagagcucggacugcgagucccuggacagcagcaacaguggcuucgggccggaggaaggugagcacucagccggggccgaauuggguucggggauggggggugggaggggucccgggagguggguacgaagcgagcugaaucggcucaaagccaccuuggcuucccaccccagcacgaaaaaacagauuacucuaggguuagaagacaagacugcggggcggaaacugaggcacggaguggaaagggacacuguuugcuuaggcaaacugcaccucccccgcccguacagcuccuguggaaggcgcucuaauacaauacccuuucccuguguucucucuauccagacuccucauaccuggauggggugucccugcccgacuuugagcugcucagugaccccgaggaugagcaccugugugccaaccugaugcagcugcugcaggagagccugucccaggcgcgauugggcucgcggcgcccugcgcguuugcucaugccgagccagcuggugagccaggugggcaaggaacuccugcgccuggcauacagugagccgugcggccugcggggggcacugcuggacguguguguggagcaaggcaagagcugccauagcguggcucagcuggcccucgaccccagccuggugcccaccuuucaguugacccuggugcugcgucuggacucucgccucuggcccaagauccaggggcuguuaaguucugccaacucuuccuuggucccugguuacagccagucccugacgcuaaguaccggcuucagagucaucaagaagaaacucuacagcuccgagcagcugcucauugaagaguguugaacuacauccugggguggggugcggggaggguuucucacugccccccaaagugaagacaaggaauuucugugguggagacccgcaggcaaggacugaaggacuguccccuguguuagaaaacugacgauagccaccugaggggcgcagggccaggugggggaaggaaguguucuccaggaagucucuagguuguaugcagguggcucccuguuggggcacacgccccucaguacuguagcaugaaacaaaggcuuaggagucacacaggcuucuggcuggauguguauguagcauguaccuuauuuuuuuuuauuacugacaaguuacaacagcaguugugggccagagccagaagggcagcuggucugcacuggccucugccccggcuggggguugggggcugggggggaggcagggggagguggccgacaguuuguguaucuucuggucugaaaggaccuaguguguuuugucauuuguuuuguaucuugguuuugggggguggggaucggcgcuucacuacugaccuguucgaggcagcuaucuuacagacugcaugaauguaagaguaggaaugggguggguguuaggaucauucgggaucuucgacacuugaaacaaaauuacaccugggagcugcagccagcccaucccggugcccauguacuggaggauucaacugugaggagaggggcugggguggggguggggggcuggaacccucuuuucccagaggagugccaccugggucuuccaucuagaaccuguuuacaugaaguuacucgcgguucaugaauacacuugauguucaaguauuaagaccuaugcaauauuuuuacuuuucuaauaaacauguuuguuaaaacacuuga

SEQ ID NO: 5512 - RNA, 16563 nt, Mus musculus
cacgcaugcgcgcuagcaccgcccucuagcccucaccgccgcagggacaggcgcagcaccgccaucaaacucccacagcucaggcgggcgcgcgcacgccgccgucuacgucguggcgagcgaggccgcacggcuucguccaaggggcggggcugucagucaaagugcacaagcugcugagguaaguggccgagaaccuuccagaccugauuccccccuacgcuccuaccugccaggacuaacugggagcguaggaagagacccuggaggcucgcccgcgccggccguaugcaaaggcagcgucauccgacugagcaugcguggggcggguuggcgccugcgccgugggccggccgcaagccuucccuuccuccccgaguuguuggguaggaagcguaccuggguggaguuggaguagccaggauuagggugcuggcuccuccccucucccgcgagcuucuucaucccaccuagaaagagcuaccgcagcuaggugcugcggguggugauccgucugucuaggugggacaccuagugauuuuuguuaguagaacccaacgggugucauaauuagccaccucacuuggaucccgaucgacauaagcaucugguuuguucugggcuuuauuuuaaaggaggaucucuuuuuuuguuuuguuuuguuuuaagacuauaagcggaaaguuuaugagugcgaggucgucccugucguacacaaaguaaguauuuaaccacgccagccauauugugccccacaaacuaucauuccgcuucuuaggagcguuuccucugcuuggcagcagccacagcuucccugauagggccaaguuccagauaaucaucauucaacaaaaguucacugagugccucguuaugaggaugguagucuccugagcgacaggguugaauacuccaugcagaaagagucaugacuggaacugucucgguccccugcagccucuacugagcugauugcuuuuguccucgguuuguuuguuuguuuguuuugguugguugguugguuuugugggguuuuuuuuuuuuuuuuuuuuuuugguuuuuuugguuugguuugguuuuuuuugguuuuucgagacaggguuucucuguacagcccuggcuguacuggaacucacgcuguagaccaggcuggccucgaacucagaaaucugccugucucugccucccaagugcugggauuaaaggcgugggccaccuccgcccggcugaccucguauuuauaaaucauucauccaggagccacugugacaaggguuuuuauaagaugccuccaggguacaaagguaguuuguuuucuccuuccaacgacaugggauccuuuucagugccucacacuuggguaagcaaacacucuagccaccucacaauacauccccaggcccaggcuugaagcuggugucugcugucuuccuccuuagccuuucauagcuucccugaacccagaacauucccauuccccauaaccuagcuaacaacauugcuauggggaaucgcuuaucuucugccucccaagggcuggguuuacaggcagcuaccacaccugugaggcuuguaagugacuugaagggcuccccaaccccuccagugaaaacacuuacuccauguagcucuccccagccccacugcaagauucuuuauaagaucaugaggugaaugugcugacugagaguguagcccagcgcuaggaugugugaagugcguaacaucacacugccugccucccgagcagacccuucccucccgggagcuuuacacguaagugaaaagcuggauugugcauagggaaaaguguaugugccagugcacaccuguaauuccaacacucgguaagccaagccagcgggaucugggauugcgggccaggccgggcugauuugcuugucucggcuguacuuauuuaacccucauaacucuuccucgggguaggcuccacuguuacugacuccagcuuacaggugaggcaucuaagggacagaaaaggcaacugauuuguccagucucgcagcaggcagcaaagccaggguacacaccuaggcaggcacuucuuuaccaucagugcuuguuugaagauuuacuuaauguaggcgggcagugguggugcacgccuuuagccuuuaaucccagcacuugggaggcagaggcaggcggauuucuugagucgaggccagcuuggucuacagagugaguuccaggacagccagggauauacagagaaacccugucucgaaaacaaacaaaaaaagauuuacuuauuuuuacguguguguguugggggggggggggagggguugaccaaggaggucagaaaugggcagcauaccccucagagcuagaguuguagguggaugugagccaccaaacacugagugcugggacccuaccuccagucuucuucaagagccacaagcacccuucaccucugagccagcucgucagccccccacagucagucccuaaccacugggcuaccuugcccucaggcacagcagcaccucaacaagccauugcuucaaaacuuaggugaccuuuaggaagucagggguucccauggacuguguaagcauucuaugaacauaccuaagugagaggcuacuuagaguuacagggaucagucaguccccaagcucagcagcuacaggcuaggguuuguuguucucuuuacccuuuaaugguggcauccaaaacuagaaacugagguguagcucagaguggaacaugcucuuaacagggcccuggcuuucaucuccagcaccugaaagaaaagaaacccaaauaaaccuuaagcaaagcauuagagccagacauccuacaggugucucuccaucucagcagaaaacggcuuauugaaaguuaaccuugcgcugauucugauucggcacuguuuuuccacuccaacuguuuccugcauggagcuauaguucugagaauugggaagaaaguaagaugaaagggaaguccuuugaugaguuucagcuuagaauagucacuguggcuagccuuugaagcugacuggcagucgcuugggugcucuguggagcagcugaucucaaaauacaaaacacaaagcagaagcaacuaaauagaacaucaucaagguggaagcugaaaagaucagaguuuaaaaucuuaguugagaaaaauaguucucaguggguccugcccugaacugggaggagguaagaccagagcugcucuccagggagcagccaagugagugcgcugucugcuucccuggaaucccaaccagggaccccgccaucaguacucaagucucuuuuaaggaacaauuaaaaguuuaccaggcuauaguuugagccgcugugccacaaaggagcaguuauaaguugcacaugaagaguugcuuucccugauggauauacauaaaauucugaaaguaaccuaaggacaaauugagaguguuauuaaugagcugggcaugcugaccgugccuuguauaccaucacugagaggcccaugggucucugaguuuuacaccagcccaaacuacauagcaaguucugggacagccagagcuacacagugagacccuguuucaaaaacaacaacaacagaaaguuaaaaggaaaaagcuggggcuggugagauggcucaguggguaagagcacccgacugcucuuccgaagguccggaguucaaaucccagcaaccacaugguggcucacaaccaucuguaacaagaucugacccccucuucuggagugucugaagacagcuacaguguacuuacauauaauaaauaaauaaaucuuuaaaaaaaaaagcuuugaaauauaaaccuuuaaaaaaaaaggaaaaagcugguuagugagauagcauuuaucuauaacagacugcuagucuaacagcaauagcuuuucuguuaacccaugucaguguucauuagugcaaccugugacugaccaugucauggaaguagagaccaggcucugcuucucggacaaccacaugucaccgacacggaguuaggaaccagcagccacccucucagacuacauaaaccauuuuccuuagagggaaacuagauggucuggacauaaaggauguacaggaacauagcauucuccaguauuuuucuguuuaaaaaaaaagugcuucaacuuucucagcauugggaauugaaacuaaaucguaaaaugccugaagcuucugcuccaccgcugagccguaccccagccuucaacuuuuucuagcaaguauucagaaccaagcuggggagaugggaaaacuucaguaaaguucuccuuggccagaacggaggggagaugugguuuuauuguuuuuguuuuuuguuuuuguuuuuucuguuuucuguuuuguuuuguugagggcucuuaucuaucccagacuggccuugaacuugcucuaaccaaaggugaccuggagcuucugacugugccccccccccccccccccgcccccugacuucugguccaccacaccucguuuauauggugcuaggagcuagacccagggcuuccugcauacucggcaaacacuacugacugaacaacauccccagcccuggaaauuucauuuuaaagguuguucuaaagccagacaugguggcacauggcuguaaucccagcacuugggagggugacacagugggguugccaugaguaucauucaggccaagccgggauauagaguaaguuccaggcuagcaaauuaaggcuuucucuauaaauagguaguccuuuuaaaaaaaaaaugcugaaaucuauguaauaugaaaauuacccauugucuauuguuauuaaaacaggcucuuggcuauguuuuccaggcuacaaaauccccugccucagccuccugugaaucuagaaugucucagugcacuccuauguaaagucauuuguucaguuaaauacuagaauccuuacccagugagaaacacuagccauaugguuuuauugaaauguuauuauuuuuaaauggacauaaauagcucuucaguugcauuaguagacacacaugagacucauggcuaccaaauuggacagaaugagaauaucagaacauuuccagguugacagcaagguucuaaaugggauaaacauagugcuaaccguucuuaaauaauauacuaggcuucugaggcucugugcuuguugugaaguuuugugacacguguguucaauacugggaccuggguuuucagaugggaugcagaauuaagcccauagaugcucaguucaugaaggaccaugauuucugagcccagguccugaauuauuuuuguuccaguuuugcggcgccaccaaguguuagacuuagguauuacauuuagaugaaaagguuaacgaguucuuaaugaacacgccaguaguguccuaaccaauuucccuuccuugggaacagaacacaguguuauucuggacucguacuuggaaaaccugauaagugaacuucgugcuguggcuuggugaggaauguaaccaagacaaaguguccuguggugcaguauuauuuuauccuuggucccauuucugccuuggcacugccauaucaacauucauaacucauaaauuacccacacucagucccaagugguauaauuuguuaaugggagaaaauaggacucucuaaguaggcaagguuucuuuucguuuucauuuuggguuuuggguuuucuuuuuguuuuguuuguuuguuuguuuguuuuucgagacaggguuucucuguauaguccuggcuguccuggaacucacuuuguagaccaggcuggccucgaacucagaaauccgccugccucugccccccaagugcugggauuaaaggcgugcgccaccaccgcccggcuuggguuuucaagacaggguuucucuguguaccccuagcuguucuggaacuuacuaaguagaccacgcuggccuugaauucacacauaucugccugcuucugccuucagagugcuaagauuaaaggcauauagcaccauaccuaguuucaagcuauuuuuuaaaggauuuauuuauuuuuauguauaugauuacacuguagcuguacagauggcugugagccuucauguaguuauuggaaauuguauuuaggaccucugcuugcuccagccagccccacucgcuccauucaaccccacuugcuccggucaacucugcucacucagucccugcucucacuagcccaaagauuuauuuauuauuauacauaaguacauuguagcugucuucagauacaccagaagagggugucagaucucauuaugggugguugugaaccaccaugugguugcugggauuugaacucaggaccuucagaagagcaauuggugcucuuacccacugagccaucucuccagccuguuucaagugauuuuuaaacaugauuuacucuaaaaccuaagugacauuauaagacuaccuaaggcuggaggguagggaaagcugacccuacugggccagaaugaagugcggucacucaggcuuuauaaacuugccaaucgcuguuucuuuccucuagugaagagagacuucuacuggagggaauggccgccuccucgucuucgucuucagcugguggggucaguggaagcucugucaccggaucugguuucaguguguccgaccuugccccaccucggaaagcucuguucaccuacccgaaaggagcuggagagauguuagaaggugaugucucucaugcuggguuuccuucagaccuucaguucauguagaguguaaaggaccuggggcuggggggggggggcucagauagcuccaagccaaagcccuugagugaccugaccaggguugccacuggcaccacguacccucuuggucuccugcagguugccucauaacaccugcuugauguauuuucucuuuuaguaaguaucuacagauagacuaaucccaccagagaggccuaaaggggaaauaaaagucaauguauuuaccucugugaaggugacucucauggaccacugccggacauggcugugugacggcaugguuuuuauagcacuggagauagacuuggucuuaucacacagacuggcuggccagaacuaggucacgggcagcagccaugaaauggcauuagugacuggaacgucucggauucauguaaacuagacugguaauucauuguaggagcguaagacucaugugacacauuuaacuuaaaaugaacaugucuugcugggcagauguaucucugaauuccaagccagccucaucuucauagugaguuccagccaacuagggauguacaaugagacucucuuuuaagaaaagaaaagaaaaaaaaaauuaaaugcacaugucugggccacucuacagauccugaauuagccuaggacaggaaacugguuuuugaccaguaucugaggccuucucaugaaggagucuucucauauuuucaaaauacugacaaagagccaggcgugguggcacauuccuuuaaucccagcacuugggaggcagaggcaggcagauuucugaguucgaggccagccuggucuacagagugaguucuagaacagcuagggcuauaaagagaaacccugucucaaaaaaacaaaaaagaaaaaauacugacaaggaacccauuaaggacucaaaauuugccgggcggugguggcgcacgccuuuaaucccagcacuuggggggcagaggcaggcggauuucugaguuugaggccagucuggucuacaaagugaguuccaggacagccaggacuauacagagaaacccugucuugaaagaaaaaaaaaaaaaaaagaaagaaaaaagacucaaaauucacuggagucaagcauuuuuguauugaauuauaagaugcucuuuuuugcuuuaaaucuugcauauuuacaugcauauauuuuaaauuaauugggugauaucucugagaaaggcacaaacuauucagggacuggcuuucuagggagaucauuauacauuuauaucagguacuuuuaaaaacccaguuucagguuaaacuaugccaaagcaguguuggggauuggauacccaguggccucaugcaugguaggcaagcaggcacucuuugacccggcugcaugccugggagacucuagugccauaaggcucuggggucacuugcaucuaauugguagagcagccacaggugccgugugguguggaaggcggugugucaggcauguguacuuucugcuuugccuuuuuguuggucuccguuuguguggauauucaaguugguaucaucaagucugacuggaaguagaaucuuugugucuguauuuggcacuaaaaguggauuacaacuguagcucucugcagcagcgauguaguuaaggaggccagccacaaaacaaauggcaaguugaaggcauuuaaauugcuuaacgagcuuuauagaacagagaagaauccgugcuuaacacugcuucaagaaaaaagugauucaaguccgucagaagcucauggucuaacaggccucuaucuagacguucucauuaccucacugaggagucaauuggauucuaucguaugguggauuuaccacguguaaauucaugguguaguuauggccucucuuaaccaguuuccccaguaaucuuaaaagcugcuuacaaugaaagacaacugacuucgacaaagcaaguaucugacauacuuuugaauaucaagaauacagaaaaggggcugucugguaaaauacagaaaagauggcucugcuggcaaaagguaccuggcaccaugccugaccgccuaaguaugacuuguggcuuugauggugggagaagaggacugacucccaaaaguuguccucugaccuucccaugaggacccauacauaaguaauaaaugccuaguuaagaaaaugaaaacacggggcuggugagauggcucaacagauaagagcacccgacuguucuucugaagguccugaguucaauucccagcaaccacaugguggcucacaaccaucccuaacaagaucuggcgcccucuucuggagugucugaagacagcuacaguguacuuacauauaauaaauaaauaaaucuuuaaaaaaaaaaaaaaaaaaaaaaaaaaaagaaaaugaaaacaccaccauuacccucacaguaucugcuggggcuuggcucugcuucagccuccucuccuacaccaccuccgacuuccacaccugugccucaucuccauggauacugaagucaacaggugcucagucucuucugugaaguggcaugguauuugcauaugaguuguguguguccuuccaugaagcacuccuaaaugugaguugacaggaaugucagaucucggggugacccuguuauagguuaauaugccugcaucaaagccuuuucuucuucguuguugaauucauuucguuuugagucuuguguaguccaggcuugaccucugacuccuugagcuucuuauucuccuccuccugccucccaagugcugagacuacagacauagauuauuuauuacucugucugcuuuauuccgaguugggguccaagcccaauggugccaacugagcuacauccccagcccuguuuuuuuuuuuuuuuuuuuacauuaguguaauggaagaggaaaauagaaacagagcacgcugauggaaagcaagaaaccccagugcucagaaggcugagaugggagaacuguucugagugugaugauagccugaacuaucuagagacugccaugccagccugggcacagagugagacuuuauuuuaaaaggcagggggaggagggcaggggcagcagagagcaaaagcauuuaagaaucaagguuaguggggcugaagagaugguucagugguuaagcacacuggcugcucuuccaaagguccugaguucaauucccagcaacaugguggcucacaaccaccuguaauggaauccgaugcccucuucuggugugcaugaaaacagcacuugcauauauaaaauaaagaaauccuuuaaaaaaaaaaacaaaggaaggaagaaagagucaagguugggugugggucauaauccuaacagguucaacuugauguuuguugccugccccuaaaucuaggauauaaauccaaacaaccuauguuuaaccucugggaugaacuucuuguuacaucugcugucugcuaagagcagcaugcagcaagauuuaacaguguccugcccucugcuagcauugcucucacccagcuauuagugagcaaauuagaggcugccuuccagcccacaaguggcuguaucuuagggaccucacaggccacugcuucauauaaaucaccugggguugucucauugccuacuagggaguaauagcuuuuaaaugaaaugucuuagcacugaauugagugggcuuggugauagaguuggauuugggccauuuacugaacuuuuucaccacccggaaucuuugcuuguccuuuaaagggaaagcugaugcacggcugacugguguguugguguggguuauacacaggccgccucgggccgaccccucucuggagaaaucccggccuuuagauugguugaugugacacaugaugugaugugguuucagaaacaguggaccugggauguagagugaauaagucaaaaauaaaaaagaagcacuaggcucuguagucagugcacugcugccugugaacaggaauguggucuugggccucaagugugggagagugugagcugcugucuuugcuuuggaacacaguaccaaggauaggccagugugauaacuuaagugcgguauccuagugauuaaaagagggugggaggcagcacuuccuccuuacagcacuugauccuuaacagcccauaguucccacuuccugcaguucaggaccaccgccugagaggccaccucgaccuacacgugggcuguagaugagucuuuaagaaggaugccaguguggcauugccaugcaagagcauaguccaccgaccgcgucuuuggugucaggguucucggcagcucccuccccuugggcucuagaguugcccacugcucucugcccuucucuagauacaguugaugucauuagcaugugcagaucuucacaccaaucagaagcacaggguacacugggcaugguggugcucaggaucuuaccucaagaaaggggaaugaaaagccaagggugggaggguugaacuuagagaccucucauccuaagugugaugccccucacccccucucuguuuguuuuucucuuucucuggcauugacuugaaggucguaagacaggaagccuuucugguuguguguccacaucauucagguagacucaguaucuggacuuuucccuuugauuacccagacuuguaaagaaagaucugugugaaacucagcaugaggccagagcguguuaguaucuccgugccacuuaauccccgugacacaccgggccaugccugaugagugggugcugacaucuggcagugcuagugugaacuccuaccuugagagagacagcuguguccucucucccauuugucugggaauuugggcaauaaaacacuugcccugggggguugcugccuuuuccuacgugacuuaugucucuggggcuguguuuuguaggaccagccuuugcacugacgguggcaugacugagcuagccaccuucuuauuggcaguuguuggcacuagcuuggcacuaggcucugagcuugcaccauuucccuuaucgggauccagacugcagugcuccguuugguuggaaggucaagcuugccauucguccuuacagaaugaaguuucccagcaagguuugcugauggucaugaugauguaauuugaugaauuaaaagucaacagcuguuuuucccuuggcuguguuuuagaaugaaaguaauuggaguucugucacaguaagucacaaaaguaccuuauagcugggugugccagcuuguugcugccuuguuugccagguguacagaagagaacaggucaggaggcgggcagugguaacuaggacaucaggcuagggcuucuuguuuuuguuuuuguaacacuauuuuugaacucccaaacaaguaggacuauuuuaauauuagguauagaagagguagcucuuaagaagcaguguucuaaaggaucgccuuuguucucaccagaaacaccuuagaccucaaguguagaagacacggaaugaguggacagccucuccugcuuuuccagaagccauuaaaacuaacgccugugcccuuucccuuguagauggcuccgagcgauuccucugugagucgguguuuagcuaucaaguggcauccacgcuuaaacaggugaagcaugguaaguacaggagcugcuguacacuuaggggaaacgaagggacacagacuaugagagggcagugcugugaccaaagccccacacugguuaagaggaccuucugaauugaagagcauucuaagaucuuguugagcgugaaaauccccuuggagguuggaaguugaaggcccggguucaguucucuaggggagccgccgcuaccugcuccuuugcugccucggccucuuccuucugagacuggcuacuucaucccuucaggggccacugucuucuagugucugaagcaccuucugcccugucaaaaccugagucccggguggcacgugcacuucaccgagucuccacaugcaccaguccuccugggacaaaccaugggagcuucugccucagccaccugagagcugggauucuaggcaugagcccgaaguccagcuccacucuuuagcaccuagcgcguguaagaguguggugaugguaauuaucuuuuugcuuuuuccagugcuaaggcucaaacaaggagcauggcacguacuagcaugugcuccaacacugggcuccuccgcagccuaucauaacuguauuuuucucuuuauuguuucuucacucugaaacucacuguggcaaggcaguaguggcgcacgccuuuaaucucagugcuugggaggcagaggcaggcggaguucugaguucgaggccagccuggucuacagagugaguuccaggacagccagagcuacacagagaaacccugucuugaaaaaccaaaaaaaaaaaaaaaagucacuguauagcccaggcuggccuggaacucugagcacaucuccugccuccacuucccaagugcuaggcuugaacucccacaccuugcuuguuuuauauucucacucuuucucucucuccucacaccuuccuucugucccuccuccucccaucucugccucugccucuguguguaucccucugucuaucuuucucucacgcucacacucucuuuuuuucuucuucuuuuaauuauacguguagguaugcaguccauguguggggggugagugagaacaagugccucaaaagccuagcaaugucagaugcagugaugucagaugcagugaugucagguugugagccggcugacgugggugcugggaauucaacucagcucuucugcaagagcacucugcgcucuuauuugcugagucgucucuccagccccucucuuuucuuuauuaagagguuuuagggagcucacuuuugaguaccucuuuugcuacagcaauaaaacccugcuugccuuugagcagagggaagguuuuaauacagauuuaaacauagggauuaagagaaagagagacccuuaggcaaaggagcguacauacccaaguaugggugugggcuucucaagagagucaccuguauuucuuaauaacuguauuuaaaauuuuuuaauauaaacuuuccagacucagagaaagaaaagaaaauggaagcccccucuugagauuuggucauggaaaaggcuaagccugaagggagauaaaagggugacaggccuugccaaauucgcacagcaagagggaaaaagaacaacauucagauaagggcuagagagacuggcuucccuagucacauacacaugaauaauaacuaaugggaaugacuggauuacugcccaccaugugcacaacacacauccacguguacacacacggaggcugauacagcucagggguagagcacuugacccuggguuuagucuccacuaacucaagcaaaggggagacgugcauaaugcagaugaguggagaaugauuaggaaaaaugguuguuguuuuuuguugggguuuuuuuguuuguuuguuuguuuguuuccaaaaauuagucuucagacguacauaaaguccaccuggagaugaagccuaggcuaguugucacauugguaacuuuggcggcagucugaugggaaaugcccuggugugcucugucccuuaacucucuagaucagcaagucgcucggauggaaaaacuggcuggucugguggaagagcuggaggccgacgaguggcgguuuaaacccaucgagcagcugcugggguucacacccuccucgggcugauguugccugcacgaccacccuuagggcacagccacccagggagucacagcuguccugugagcugcaugucugaauccacauccauacuuggugucuccaauucugcuaauaggcaacaagugcucaugugagaugucgcggagauguuuuucacauucauguucuuuaaagcauugggcagcacuugggaagcagaggcaggaggaucucugugaguuugaggcuagccuggucuacauaagaguuccaggacagccagggcuaugagacacugucucaaaauaaauaaauaaauaaauaaauaaauaaauaaaaagaaguauuggggaucagauggagacaguccuuucagagaaccaggaggcuugggaucuaggaaacacugauucucacaagccaaauggacacaugccagagucagccaacugaauggaggauguccugucauucagaggcugucuggaagcuuucaccagccaagcccaaggucagcaucugucguuucacggucacagcccaaacauuucucuucacacaugaaugugguuucagcucaggguccguccagaugggagcuguaaaguguccuuucccucucuguucuuagacauuuaacauuacagacuauuucuuucaccucucacgacaugccaaaugugcuacuccaccucacucugccccccaagauugcuuuuugaauguugcagcacuugaaaauaugaagugaccuaaauccuuuugaaccccgaagucuuaguccggcuuacaggguaugaaagcaguucuguggcaaauaaacccuuacacgagguccagaucgcugugcguauccuuuccggucugggggacuuagacagagagaggaggucagcuuuuccuuagacuugaaagucgcuuaaguaagccguagguuucuuuaugugggcuguuugcuuguauagaaguuccaacuuacugcaaccucagugaguguggccgugggcuguuuguugguuaguucgcuuguuuggaaccuugucucucaguagcuaggcuggccuuaaacucauagccauccuccugccucagccuacuaagugugaggauuacccuccuuucuucacuagguuuuuacacgaagauagagaaaaaccuggaugaccaagcccucgucaugggacccacacugcacaauuaggaggcuuaaguacuuuuacauacaaauuuacccuagccagcauuuagcguucugcucauuaauuaauaacuuacaccugaucugcuuagaguugcuuaauuauaaauaaauuuaauccuaguagcaauuggccuuaaucucaggaguugaaacuauuuaacacacagucgcugccagggaggagcuggccucauuuacuggggaaagucuaggccagugaagagaaacugcugcucaggcagaggacaaccauguaagugggaguggggaaaaauugauccaucauggagcccacuguucuggucugaagcaagccagagcuugagaaguaccagccccagccucacugucucccuguucuucucugccacuguggugaaagccccacgcccagcugcuucccuagagaagaguugaauauucaggugcagcccauggucagacuuucccuguggagagaagcgaccagaccccugguuucaugugagaccagacucucaccucccuucgcccacugguacuuggacuuacuacagacuauuuccuugauuaaguugagcauuucuuuuuuuuuuuuuuuuaagauuuauuuauuauuauauuuaaguacacuguagcugucuucagaugcaccagaaaagggcgucagaucucauuacggaugguugugagccaccaugugguugcugggauuugaacucaggaccuucagaagagcggucggugcucuuaaccacugagccaucucuccagcccaaguugagcauuucuugauacgaccuuaaacauuagagagaagccaggcuugguagcacacaccuguaaugccagcacuugggaggugaaaguagaacuaggauuucauagccagccugggcuacacaagaccuuagagagaagcuagagcaaguggguaauggaagagaugacagagagcuggagagagauuaaagaaccacagguuuacuuugu

SEQ ID NO: 5513 - RNA, 35469 nt, Mus musculus
cagccuggucagcgucucugagauucaaugucuuaagcaaagguaagcuaacuucaguucaaagguuggacuuugugggcucaaagcacugguauauuaacagaagcucagcguuuggauuugccugcuuugccuguguuuuaugccagaugggagguaagcacagccucucagccacagcccuggaccucucuuugcucuuugagacugggucucacuaaauuuccuagacuagccuugaacucucugaagcccaaagaggccuugaacuuguuaaccucucgaguagcugguauuacuaggauaucaguguguguguguguuaguuagaccgagucucacuauguagcucuggcuggccuaguagaccuguagaccaaaauagccuugaacucacagagucugccugccugucugcugggauuaauggcauguacccagcucuuguuuuuuguuuguuuguuuguuuguuuguuuuauguguuuaucugcauuuauguuuguguaccauguccaugccugguaucugagaaaggcaggagagggcauuagauccccuggaaagcuagaguuacagauaguugugagucaccaugugcaugcugggacucaaaucugaguccucuggaagaguagccacuguuccuaaguagcugacccaucucugcagccugcuguuuguuugcuuuugagauggguuucauguagcccaggcuagcuucaaacuugauaggcccugaggaugaccuugaacuccugucgccacugcugauuugccuugcuuuuugauacuagcgauugaagccagggacuugugcauuauuuggcaaacaggguuccuaacgucuguuuucuccuuuuguugaagggucuuauauuguugccuagguuggccuggcuuucguccuggagcucaggcuaccuuggacuuccuggaaguuuuugccucugcuccucaagugcugggauugcaagugugagccaccacacugggcuuaguucaaagaucucaguggcguuauuuuugacaauaccuuugcgcaaugcuucagccuuugagucggaauaugcauccuaacggggcugagcaaagguggcugguuuuauagacagagaaagacugacccucuuggagacccagaggaaaaagugcagaggucagcucaguuauuuuccuucugaaaugggcacaggaaggugcuaaagcaaagacaguaacugacugguaugugugucugugugugugugugugugugucugugugugugugcacgcgcauugggggcaaucagaagaccccgccccuuccuuaggauuuauagggccauuaaugguuguugggacagcaggagccacuaguagggugcccacucuccuguaagcaauccugaugaaaagcacuggcucacaaacacauaaacaaaagccaugacauuagaaggggacuagcuggugagggagauaagauggggccagacaggcacaaauauaaucaaaaugcauucuaugcauguaggagauuauuuuaaaaagaaguuuuaagaggaagaaaaagaacauuaggcuacuauuuuauuuugcuuccccccccccccccccucgggacaggguuucucugaauagcccuggcuguccuggaacucacuuuguagaccaggcuggccuugaacucagaaauccgccugccucugccucccaagugcugggaucaaaggcgcgcaccaccacgcccgucuuauauugcauuuauuuuuuaagagaggcgguuuugcuauguugcccaaucuggcuugaccuuuugggcuuaagcaguuccucugccucagcuuccugaguagcugggauuuacgggggggggggggggggggaggagggggaaccacuguccaacagauuaagguagacggaaguucagcaccucgcugacucaaacuaguccauguagagcaaggaucugucccuuauuuucucccacucucccggaagaugcgguagauaggaugguuuuaguuacaagcagaacuuuaucuuuugugaggcuuagucaaaccaauggcaggaacauguauuacaaauuuaacuuuuucaaguuccucccacucccaccccagaguuccugcugaccuuggacuucuccagguccuccuacuuccacaacuggagugcuggguuucaagcagcgccaccauaaauauuaucagugcccccuuuugauuuuuuucuccucccucuucccagcggcuaagcucggggcaagccccccacauuuuagagaacaucacagaaacaacugccugcacagagccccggaaucguucauccagugagcucugcccgcagccaaggcucugaaagcaaggaccugucucuggaggaagagcagaagccuaaagcuugagggaucugagcugcuucccaaguuggaagcaggaagcuuguccagacuccugggguggagucagcaaaggcaauguacagagcugggcccucuguuuagcugugggauuauaaguggcuaagucacauccccucuuggaagaacaaacgcguucuccuuacacggagugccugugcccuucucaaaggcagugcuugaucauggacauuuuucaagcaauauacaccagcuucgucugaccucccucucaggggugacucagcagccuggucuguaccagcugcucccacacccuacacugccugaagcuucuggauggucucagggaagcgagcagcaguggguagacuuggcaggcugacauaugacacuggagcagagugacauccugcaucuagucagucuccaguguuccuucccagcccagggaaggacagggccucauggugccaaauagaacccgugugccaaggauggauguugccugcugggugcugacuuuccagagugucagaguaagggacgccuccuagugugacauuuccacuguguuccuaggacacggccccacauauacuugauaaaugcguuguuggaacaacaaaauguaagugcuaaugagaaucaaagaucccaggaaacuuuccugaaggacagaaaaggcuuccccggcugaggauuuagcccaaugguggaacauugguccagcaugcguuaggucccggguucaaguacuacaagggaaaaaacucauuaggguagauaaaguggcucacgcuuauuauguuagcucuugggagguaagggcaaggaggacccaggaaaguucaaagucagcuugggcuauguauccguuuguuguuguuucucugagacagcaucuccauacguagcccuggcugaccuggaauuuacucuguagaccaggcuggucuagaacucacagagauuucguaccucugccucccuagugcagagcuuaggucggccagggcuacauaucaggauccuauuccagaccaaaccaagccaagccgaaccucuggccugaggaugcggagggcguccuagcaugcuaguggcccuuaggcuugauccccugcacuguacaaacugagaaugguggaggucguggaucaagagcuccccuucagccacguagcaagucugaagcaagcaagcuugcguuguaugagauucucacaaagcaaagcaaacaaagcaaaaacaaaacaaaacagaaacaaacaaacacaaacaaaauacucaaccaaaucaaagcaucgaggacaaggaagggagaugacaauauaaagaagauaaaacaauuuauuuuuauuuuuauauuuauuuauuuauuuauuuaagucugguuggacugucugugaaauauuuauuuauuuauuuauuuauuuauuuauuuaagucuggccggacugucugugaaauauuggaucccuuucuucccccugagaacaguacugagacaucucaaaaacaaauauugguucuuuugugucuuugacuaaaacaaaaucuuacagccgugagggaguugggaaauguaguuuuauuauaggugcgccuguguccagcuagagagggggugcagaugauggagcagaggugacugauaaugggagggaguagcccugaggaggugugacagcugcucugcugcuaccaucaggagucagcacagcugggcgacacggagugcuacagucacuguccuucuaucucuaauguuaggauuuuggccucugugugcugcauaacgggggacuuucagcguuaugauucauucuaugucuuuuccugagaaaucaugucugagucuuuuuaggaaaaauccuagaauuaacuuuaucuggccacuauuuggaagucuuccuuauggccuggagaucauuaagcaaagauuaguacacagccaguugaggccauuacucuaggaaucuucuuguacuaucugccccugagcaaacucaaacaguauaauugauguagggcaaacagggacaauugacaaacucugcccaggagagcagguuacagagucaaggucucuuuuuuauuauaggcuuagaggucucuaacaauguaauuuaaagauaaaggacuacaggagguccuccugaaggaauacaacucaguaaacaugaucgagugacuaaaauaaacuuucccuacuuuauaguguagauggugaaguauauaauaaaagaagcuagauauuaguauuugcuguucauaaaaaagaccgcuucagauauuuucuguuugucuggagcccuuuccaacagcaaacguugccagucuacaagcaggcugucauauaguaaauguguuugcuuuggaggugacauucuguagauucuuuaaauuggagucauagggcugauaauaacaagaauaaucugcucuguuuguaacuuucuugugacugaacuuguaacccuggacacauaaugagaagacaaacauauauuccguaccacuuggagaauccuuagucugucuuuguucugugaaacuuguaucaacaaagcaccuggcuguuaacaagugggcagcagaaaggaucugauugcuugauugcuaguaaaucagcugugagaucccccugaccacagcgccuggcucccucccuccccuugcugguaccuuaucuccucugcaggcugcuguguccagaaggaccauccgacucuccucucuguacugcggaaaggcuccuugagaaucccaccuccacccccaccccccacccacccccgugcacgcccacgccaguuguugaaauaucaggaggugcuugcccaauguuugguaggaugauaaguuccagacuagccugaagcacauaaggagaccagacccuaucucaaaaccacgaacccugcauuucacagaagguacuacagcauggccucuuggccagcucugcuuggcaccaugggaagucugggagggcugacucuuaacagagcuuuguaagguaaucauauuaccuugcaggcuggcuacacacaccagucuugcuacgucugccucuuguacaccauuucugugcauuguucuuaccagcccuguuuccuuaccaccccagcacccuucagccacugggauccuuuugggucccaugccucucauaaagagcccuuugugaacacuuccaaugaaugcuugcuuccccagggguuccuagagcaguuugaccgggcaaaaggccucaaggacuuuauagcucuuaaugccuaaugcccagaucaagagaauucuucauuuauuuacugcauauuucgaaguuuaaauuuuuauuuuuguauuacugugugugugugguggcuggggaaaggcgcaugcccuguguuuguggaggucagaggacaguuugaugggauuggucccucaccuucuuuaugugguuugggggauugaacucugguugcacauauugguaagcuauuacucacugagucaucuugcggguuuuguuuuguuuuuaaauuaaacuuagcgagcacacacacacacacacacacacacacacacuugaguaccaugcuccucuggaagucagaacacaacuuuugagaauuuuuuuuuuuuuccaccccucuaugugggucccaggaauugaacuuagguuaacaagcuuggggcaaacgcuccuuaagccauuucaacacccucacccagacuacagggucuuaaguccucccaaguacugugcuuaaagaugggccuccauuccuggcucuaagagggauuuuauagaugauuuagguauccacugauuuggcaagaaauugugauaauacgcuccuuguauauacgaacucacauggugaguucugacacauggcuggucucagacuuggcguguugcagaggcuaacugaagagucugauucucuggccccugaagcauggagccuccgugcucugcaagagcacaucucccagcucucuucagcugcucagcauccugcucagugcccacuuccccacuuugcuccccaggggaagugggagcggcuagcaggaacugaagaugggagucugaggcccgugugucuccgaggggagagcaagcuucgggagguuggaagaaggcuggguuuccccucagucaggagaccugcuuccaggcaagauuguugcccaagaugcugagugauggcugaugauuuaucuuuuucucccccaggucuuauuuucccauuaguaagaugauaguaggggcugauaaccucuaaggccucaugccaaugggcucugcaaguucuguccucauauugccuagggguugguuagcugguacuguucuuggggugugugugucagccccagagccagcugcagagcacugugagugguuuugcugggccacuugacuuuccucaccugggcuggaauguguuggggaggaucagggagggagaggcaagggugagguggauucugcaguuagaaucucaguggguuucucucauucuggcucacuuccuccucuucccuuuucuaguggcuguaacuuccccaucuuguuaagcuuuugaaaaauuacauuuaccaauuauauucuugguguguguguauauguguguguuggcacaugcaucaugguggcaagugagaucagggaacaccuugcacgaguugguuuuuuuuuuuuuuuuuuugguuuuucgagacaggguuucucuguauagcccuggcuguccuggagcucacuuuguagaccaggcuggccucgaacucagaaauccaccugccucugccucccaagugcugggauuaaaggcgugcgccaccacgcccggccugcacgaguugguuugccucgccuauuauguggggucccagggauugaacucagguuuucacgcuuggcagcaagugccuuuacucacugagccauauugccuggcucaccauugaacaauaugcuguuagauuacauuacuuauauacaauaaugggucuuauaaugacaucuacaugauuguauagaaugaauacauuugaucauagucucccccauuacuuugucucguccccugguguugaacggcuacucacucccccuuucaugccuuuguaugcauuugacguacugaguuucaugaggagcgugugugagcauuaguuacaggagcaaugacaccuucccagugaccaccacugaagaaaaucucuccgguccccagcagccauuacuugcuuauagauccccagaaaggguuggaccccucccccucuuaguuuuuuaacugaaggggcucauucuaguucugacugaccuugaauuuacuccauagcucaggcuagccugaacuuaugaugcucuuaugaugauccuaacaucauccaagauuacagcgggagcugccgagugugguggcagcugcugcagcugcuuccuccuccuccuccucuucucccuccuccucuucacagggucucaaaaccgguagcccaguugggccuggaacucuacaucuuccugcuucagucucccaagugcuggggucacaggcaccaucuaccaugccagccugguagugacuuuuugcuuuugagacaggggcucaacuguguaaccuuggcugaucuaaaagcuugcuuuguaguccaagcuagcuuugaacucauaggaaucuaucugccucugccucccaacugcugcgauuaaaggcacccccaacccagacuaaucagccuaauaauaauaauaauaauaauaauaauaauaauaauacaguauuucauugcuaauuaugugugugugucuguguggaauguguacaugagugcagguguaccaggaggugccacauuucuuggaguuggaguugaaggugguugugacacccccugaccccgugggugcugggaauugaauguuguccucugcaaaggcaucaaguguucuuaacaacugagggaauccccaccccccacuaccuagaaccaaguuguuuauuuauuuauugguuuuuucgaggcaggguuucucuguauagcccuggcuguccuggaacuaacuuugaagaccaggcuggccuugaacucagaaaucugccugccuuugccucccaagugcugggauuaaaggcaugagccacuacacccggcuagaaccaauuuauuuuauuuauuuauuuuuaaaaauacauuuaccuuuauuuuaugugcauugguguguugucuguaugcaugucuaugugagagauccuggaguuacagaaagucgugaacuguccugugggugcugagauuugaacuugggaccucuggaagagcacuuggugccuucaaccacugagccaucucuccagcccccagaaccaauuuuugaaauguuauuuuacuguuuuuuuuuuuuuuuuuuugagacagagucuuacuauguggcuuaggggcccuagagauccuccugccucugccucccccaugcuaggacuagaagcgugggcaugcaugcuugucuuuaucuuccauccgucacgagucuauuacacagcaucuguucuuucuccaagcaacacaaguugccuaaaauacauuuuuauuguuuuuuuuuuccucuuuuuuuucugcuuacacacucagacuuccauucucccugccuucucaccaacacugauucagagaccucugagucuaucuugcagucugcaguucccaagaucacaaauaaaggcgucucucguuugccguuuucugaguuuguauugauugacaacugcagaauggcagccugugaauuugaauccugaguguaaagauguaggcaaaucuguaaccuguuugugcuugagucucaucuguuagcacggcacgaaucacaauaaaugggggcuggagaugccacucaguugguagagucauugcccgacaugaguugaaggccuggguuugguuccuagaaccaaacagaacauguaugguagcacaggcaggcagaucaggauuuggaagugacugaaguucgaggacugccugagauacacgaauccucagcugcacagccaguugucagccucuuugggcuacaggaaacccugucuuaaaaaacuaaccacuagccgggcgugguggcccacgccuuuaaucccagcaggcagacagauuucugaguucgaggccagccuagucuacaaagugaguuccaggacagccagggcuauacagagaaacccugucucgaaaaaccaaaacaaacaaacaaacaaacgaacaaaaaaacuaaccaaaaaaacuaaucaccgccaggcgugguggcacacaccuuuaaucccagcagcacucgggaggcagaaucaggcagauuucugaguucgagaccagccuggucuacaaagugaguuccaggacagccagggcuacacagagaaacccugucucgaaaaaccaaaaaccaaaccaaaccaaaccaaccaaccaaccaaacaaaaaaccccuaacuaccacuguacaagggucaggcagaagaauuacauguucagagacuuucuggggaauuuggugacacccucuuucaaaaauaaaguaaggagugagcugggaggguggggggaaugguggugugcagcuuggagguacaacacuugauaucaaguauaaugccuuggguucaauaccggcgacugcaaacaaaaaucccugcucccgccccccaacccccaaccauucuccaagggguugaggcagaagguugagaguuccaggucugcugcgacacugaauugucgaccagcaaggccauagugacucggcaucucaaaaacaaauaguaauacuuaaaagaugcuggggcucaggggugggguggggugggggagcacaagaugcaguucagggcuugguaccagcccugggcuggauuccucacauugcaaagguaaagagaggcguuagauaccguucggcgccugaccuugauuuaaucaccagauaugguuuucuuuuauuaccaccacccgcgccuucccgccaccuucccugggcguuuucagccugcuccucuucgcacccucccuccccgcaggcgcgcugcgcgacgcugagucaagcugcgcccaguuugggcggggcccgcgccugcgcacuggcgucugcggcgagguugggggguagauuuauauucgucuggucagcugacguucugcauugcagccugcgaagugaagcggcgccauguacgcccucgcccucuucgccagccuucuggccaccggugagcuuagaaggguccccuggucugguagagaagaacgcuauagcguccccugggucccgggaaccgggcaguccugcgguaccggccucgcccuccgcucgcuucccggggcgcgcuuaggcaggccucgcugugcgcaggcgcagaucggggcugguggcggagggggaccuguuccagauucucugcacugggggaccacugggaggugggagagacgucuuguccugugugugcaggccuugugcaaggccuugcgggugacugcgguucucccugggauggagguugggagaggucacucgaugaccucuuccgucgcuguguugacucuauccugguguaggugauagacauggccuugaagccccauccugcaggucaggucggcccgugaccucugucccagacugcacucguaugggaguugcaggaagcgucuuugugucugccccgggccggggggugauuuuuuuggcuucugugugaacucaggagcguaguaggucuuggagggaauuguguagucccgauugcauuggaacucuuaauuuuuuuguuugaucuggcaaagccauuggccagccuuuauuuuauagcaaguguuucuaaaaugauuuuucuuaaaagcacugcagguuggcaaggcagcgccaggggacucacacuuggaaggcauagguaggaggauuuugaauuugaggucagccugugcuacacagaaagcucaaggcuagucuggacuguguaugagauuuuuuuuuuuuuuuuuuuugugcaagaaaaaugaaaagaaacgcacuugguccugcuugcucugugucauacauaacucgugaguucugauucacccacaccaccaaaaccagacuucuuuuucucucucucuguaguaugggccauugaacuuggaucguaacacacgguaaacgaacauccucuacugagucacacuauaccccuuaccuguuuccuuggaaaaauuauuucuaauacacauguaguucauuugacugccagucuaguuaacuggguuccuucuuccuucuuagguagaugggaggacccugauggccuuggucuaaaacuccaggcucugugccucacgucaaggucauacugaagaaugguagcuugucuugacuguccaccauugaguuguugguugucuaugaugacugcaaaccacgugugcucccugaggcucuuaggacuuaugggcucaguguggcacuacuguaguucagggugccacucauagcuugccuuuuaaugauguucugggugcuuagaauguuccaggucccgucuagucuucacaaagcccuggagguacagacacuugguuuugguuacucuccagcccuccagccugacugccuuucccaccuagacagaaaacaaagaaugccaaaagaaugaaaggccaguuuaaccucugcccauuuucaggccccaugguagagggagagcucugacuccgguggguuuucuuuugaucuccagaaacaaauguagaugugcgugcaccccaccacacacacacacacacacacacacacacacacaagccuaaccagcaggggacaucauuugcugccugcagugguagccccccgacuccaugcugagucuugccugcuugcaggaaacgaagugccauaucuuagugcagugccaggacaugcaguugggggauugcuccagugggaacaagugggucagaguuggccagccgagcuuagagagguggcaaggugcugccggcauggggcagaugcucuccaugaggcugagacggcagggcugcugucauuggggccguggcuaaccucugacugaggucugugcacucugaggcaguguguucucuugagauguuuuagcacaugaguuuguagccuagccugcuuaaguuauaaacagcaacaggaacccccaguuucaccugccaaguuaauccuguuuagcaaaagguagugcucuuuuuuuuuuuuuuuuuuuuuuuuuuuuuuuuuuaaagacagguuccugcuuguacccuaggcagguuggccucugugcagcauagguuaaccauggaacacaauccuccugugucacauaggggaguccugagauuacagacgugagcccccaugccuagcuucucaguuuuguguuuucugugucugucugugcagugugggguaugcacgccucucaaaggcuggaggaggccaccacgcaugcuccauuacacuuuucuguacucccuugagaccagaccucucacugagccugggagacaugccagcaagucccaggcauccuucuaugcccgcccccacagugcuaggggaggguguggccacucgcuguuugugugggcgcuggggaucugaacucaggcccuggggcuugcgcagcaaaaugcagccaucugcgcagcucaucuggucagguucuugaaguguauuggacaggucggcguuuggaaguguguuggauuugaguuggauggaauugucuaggacagagaggagagccuagcuuguauuuucuuugucugugaugcugugaacucaaaaggccuuacgugugccuggcaagcacccuuggcucuuuaccucuacgacucccauuuuuuccugugaaacuggaccgucuaggcucuuggcagggucugaaauggacaggaagaagggcagguuguuguucuauaggguuggggauggugucuaaugacaguuacugggaagucccuaaggccaaagccugcugcuuggauaauggccugcuacuuuuugaaacaggcuguugacacaguucuggaguacuggcuucugggcucuaagccuuguuucccaguuggucaccgaucaggaaguuacggauuucccaccaucccuguuauuggggauugaacucagggcuucucacauguuaaguaagacacaacaacggacuuguggguuuucuguaaaaagagcaggcaagaacaccaguuacacugaccugcuugcuugguuuugguuuuggaaccagggauugaauuuagaacuuugugcucacugaauaccccgcucucccauugagcuaugccucuagcucagucuuaauuuuuauuuauuuauuauuuauuuuugaggcauggucccauuuacuguuguccuggaacucacuguguggaucaggcuggucaugaacucacagauccaccugccucugccuccugaggucugggacugaaggccaguguuaccaugcggggcucagggucagccuugaacucagaucucccuuuuuuagccuugauugcuugcugugcaucuccgguacugaggcuauggguguguacuguaucucugugccuaguuucaaaugacaguuuuauuuauuaauuuauuugaaggugauccugcugauugcagccaggaucuugugacugcuaggcaagcacuuuacuacagagcuggauucccagcugcuuccaacuuuaaaaugugggugcagcugggugcagucucgggcuuuuaaucaagccacuugggaggcauagguaggugagucucugaguuugagggcggcuuggucuauguagaaguccaggacagacacucugcauagagagaccccuuuaaucccagcccuugggagcagaggggcaguuucuugaguccauccuggucuacauagugaaaguuugucaaaaccaaagcaaugguagguauagugguuggguggagacuugagcauuguaaaaacauuacuuuauucauuguuuuuuguuuuuuuucagauucaaugaggguucagaguaaaaguuuuuuggagucuagguuuugagacaggguuuugccaucuagucuuggcuugccugaaauucguuaugaaguugcugucuuccuuccucugccucccaaguggagauuuacaggugugcagagccacgcccgaguuugaguuugguaguccagguuggguaugagacaguugagccgagcuccaacacuguggccuuaggccagguacuuaacccccugauuucuucauacgccauuguguucaauguuauacucucacuucgcugcccugagguuuucaucaauuggcguggggaaguauuguucacugcccacacugauauuaacacugauacuaccggguugugucuucuugucccaccaacagaaguauagucacccuuuacccuuggcuuggugauuuuuuucccuggcuucuuucauuucaagagaugcuguugauuagcaacggauuuaaaugacuuauugagaauguguguccugggcauaauuacagaguuaggaaaacaaguccuuagccggucacuaggaggugccugaacccccacauuaguggaucccagcagcuuuaagguauuaaacucuuggaccuaaaccuguugucacugacuagauccuguuccaagcaugacuuccccauacacauaguugcguauggaaaacaggcucaaggauuagcccgggccaauugucucccugcuccccucguucccacuacacucaguaagcacugugcagccgucccccauuuccucuucagaaccucacacacugagcuauacccacagaugcuccagaaaugguagcacacggacuuuuuugcuucuugaucuuuuuagacacgcagaaaaguggugggagaauuacagagaacccuguguauucagcgaccagguugagaaauaggcucugagagccggucuccugccagugacucugcauggccugggugcuaaccauagacagcagcggccccucagcccugcuugcugucuucuuuuugauuucauucaugagacagcaucacacucuggcuuguaacucacuguguuguccagauuggucuggaacuacagguaauccuccugccucagcaggagucacucauuccuccugcucuccaaagcuuuugguuuacagaggaguuaguuacaaaggcuguauggccaguuccuguaacccuucaccuagcuaaaucuguuugugugcacugcuuucauuuuuggcuuaagcaacagggcuaaaggaggcuaauugcuucucccuggaggaggaaucucuuccuggcuugcaaucugcuuugucauuuuaggguaggcgggcaggguggggcuuagggaagacacuaauuuacugaccagauugcagauuuugcagguuuuuuaaccaaauuacccaguagucucaauucuuguuuuaguauucuagucuaguugucaugucuccuagcgacuuagaagugguuauggguguaugugugugugugugugugcaugcgugcgugcaugcaugcgugcguguaugcguguauguguauguauauaguggucccggggcugaugugcugguaagguagcucagcauguaaaaauucuugccuccaagauuggaguccaauccccagaccucacagaguugggggagagaacugacuuguaaguugucugaacuccacuugcauguaugcaugcacacagauuuuuuuuuuuuuucgagacaggguuucucuguauagcccuggcuguccuggagcucacuuuguagaccaggcuggccucgaacucagaaauccgccugccucugccucccaagugcugggauuaaaggcguucgccaccacacccggcucacacagauuuuuauaacauuaaugcgugaguuugaguccucccuggagcauugucuucacguggcuggccucaccuugcccuggagcccuucaguuucaucuuccucugcauuacugggaagcuacucauuucuacagcuuacacagccugugggcuccauccuugacucacugggugaaaggaagagauggcccagugguuaggggcacuggcugcuuuuggagaagacagaauuugauugccaguguccauguggcggcucacaacuggcguagcccuaguuccugggaacugggugcccuuucauggcccccacuggcacuucugcucguacaaauguauaaauaagucuuuaaaaaauagugucaggucucauuauccucagagcuugggauugaacccaggcucacagaguagacuguuugagacagggucuugggugguugcagcuggccucgaaccaaggcagucuuccucuuuccuuuucuaguguuggaguuacagcuguaugcugccauacgucugucugcuucucuguccugucccucugccuuguccugcuaagcacucuguuacccuacugcugggcucuauucccaguucucuuaauuugagauagggucucaauaagugucauaggcuggcguugaacccuuguccuguagcauuggcaggccuugaauuuguuaucuucuugcuuccaacucccaaauagcugggaucauaggccaguguuuucaugcugggcucaccaagucuguaucaggauuaaauguuauguucuggugguaacauuaagauauuguuucugggaguugacagaucuagagugacacuuuggguugaagugaaaugcuaguuuucauagucauuuguggucaauuuggagggaugcccccuccaugccugugggagauaauuuuucuguagguuguaggacccaggaagcgaggcaaaucugaaaagggaacuagcuauaauuuggggaaguaauuuuccccacacuucuagaaagcagcaguuuucucugguuuucgguuuuguuugagugggccgugcauggggggcuccgggcaaacucucgugaugcgugaguaucaccaugaacccugcuguuguccuagugcuaguaacagaaagagccuaauucaaaucccagggaggaggaggggcuccccucaggacccuuauguguagaagcuaugcaggcuccagagagaugucguucuguggauugcugcuuucggcguugcuucccuugucgucagcgugugcauauggggcuguguguguuuguggggauagaccccagcgucugugcacacuaggcaaggcuuuaccacugagcccuguuguccucuacaaaccacuugacaccuggcuggugucacuuuaacacagcugcuucuguguucagucgguugggccucaugucauauauccuggaaggagcagcugugugaggaggagcuugagguacuccuaaccgucuucagggucucugagaccugucuuuaagacuguguaccuugagcagcuucuggcuagggcccacagccagaauauccagcccuucccgagguggcucaagugcuuucuacucaaggcaugcuggcuuuguccuuaugacagcagugggagaggcaagcaaccagcuugacugcugggccauucuagcagccugccuuuaacuguaggucaggaggggaggguugaaguguuagcuuucaguuuucaaacagaggaagcccagagugacauuguagguggcacacuuacacuugugucugagaccuucucugugagcagccacacaggucaagcguuccccucuugguagggugugucuggugggucaccuucagaagugccagugccagggcugcauggcguggugugcagggguccauucugguagguggggcuggcuggcuggcuggcuggcuggcugaaucugucucccagccugcgacuugcuggcccagcaguggagcacuguaauggaugagcagcucucgugaaguuccggagccauagaagcaugcugcugagccucuggcccuugccgcucccuucucaccuggcuggagccuucuuucaggacagacagaccgugcucacggccagagcacacugcagucuuauuaccuaaguacauggaaguuuaucuccucaucaccugauguguggccaucugaaagcagagcuggucaggaaggguccuuuucuuuuugaguugggcucucacaaagucagaaugggcuacacccaguucagguucugaaagcaaggagacaaggugcagugccagcgcaggcaucuggaagccuuccugaguggagagacuggcgcugcuguguaucgauuuccccggagaaguuucugcaagugggacugaaagccacgcugccucuccuguuucuaagcaacuccgauguugccauggugacauuccccaggcagcagauacaguaagcuguggaaugcaguugcucccagaggcugaacauuuucucuuuugguaacuaacucaauugguauuagcacagguuacauaaaauuguuaaaggaagggggccggaggaugggccagauaaagguuguuccgcaaauggcuggcaggugcaugcucuagacaggguggugcccugggggggggcgggcggugaaccucauagaugaggugauguuuggugaacaaacugauugacugauugauuaugcaugcacauuaguaggauguggcuuugacugcagaaaccagggaccuaaaauuagaauuccugaagucccacagaacugacucggucucuugggagccugguggucuaggcacucucugauucacgauugacaucuuuucuuccuucuugguucaagauggcugaugaggccccagccguugcgucuaaguuucauggaagaugugagggccucucaugaacagacccuguugcguuaggagacugacugcaaaguauagucuuccauccugccaucaguaugcuaggaauggcuggucuucugcacagaauaguagcugcuguaagcaguuguaaggcuuauucugacuuuaaaaguaacccgaggaaaaccaguuuucugcugaaauguaaauucuacaacaugagccucucucccuuuggguuccuguccaggcucacagucugcacuuggccacauagaucucaggccuucccauguaccagacgcccucgcaugcugucuaguuucaucuccacagauggucuagagaucguuccuauuuuugcagaugguuagugugcgcaaguugucaggguuaguguacagccaaacaggguugggucccggcuggucucgggcuguaauccuuguccuuccagaaaaggagaaacuucuguaguuuggggaaguguuugcacaugcgauggguugcuggacuggaggggaggcuuagcaagcauaaagaccugaguuuggggcuggagugauggcucaaugcuuaagagcaccaacuguucuuccaaagguccugaguucaaaucccagcaaccauaugguggcuuacaaccaucuguaaugagaucugacacccucuucuggagugucugaagacagcuacaguguacuuacacguaauaaauaaauaaaucuuaaaaaaaaaaaaagaccugaguuugaccccuagaacccgcaaguuaccaacuguggugucuagucuuagcacggggaggcagagacaaguggauccuggggcuuucuggucagucaaggucacaugguaacacaugagccccagguucuagugagagagggccuugucucagaugaauggcucccgagcacugauacucgugauugaacuucacauauccaugcaugcacacacaugagcacgcaauaaguagguuccagguaugucccgaacaaugagucugguguagggagcucccugaggguaaucagcagguagcacugcccaguguucugagucacaaaggcacugcuuguuucuugcuggccacccuucuccuggcuuguuuggaacuuguuuagcuccuggcagguguccugggcucacuucccuuugcuugacucuugggguuuggggucaguggcuagcagcagccucugagguuguugggcuacaguugucaggguuacagaucucucaggucugauuaaauauccaguucuaaucaggagaaugggucaccaggaagaccugcugcugucacagcugcagaugacaguggcacucacugugugaccgcacauguuuuacaggugucagguaacgcuuaauaccuuaugugcagacuuaagagaccaaggucuccagggcaugugacuagaagugagauccaccuaaauuagggccaggccauuccagucaggcugguguggcauagggugccaguugcugucccugggagaugaaggggugaugguuguggugaggucaggcaguagaaguguuugugugugguuagagcaucuugacaccgucaucauuuucauguccccugacaucaaaagcuuuggcuuuaagggugcacacacaagcuuggaagagcaguggcucacuuaaggcuguuuggauagcaagugacagagcuagacugggagacaggucaugucucuucugugucaugucuaauuagacguugcucagugguagugaugggucuaagucucaauuugaaacuuuagaucuuucaggaugucucaagagugccuggaucacaaaagguucugagcaauucuugcuucccagacuucugguuuguguguguguguguguguguguguguguguguguguguguguguguguguguguguaugaguaugugugggggaaugguugagguugggugggcaggcaguaggugugcaugugccauggugugaguguggaggucagaggucaacuuuuggggguuuuccuaccaaauggguuccaggcaucggguucagguugccaggcuuggcagcaaacacauuuuagccauuguaucaucuuggcugaaucuuguuaaguaguaccaacuagcuucuauaaucccccugccucagucucccaaugacuagacuuucagguguaaacuacuacaccugacuucuaugagugcuuuuguuguuguuguuuuuuuuaauaacacuuacauguauagacacaauccacaguguauaaguuguaagagucguucuuuccccagugggacuagaauacaacccccaccccaccccgugguuuggcaguaagcaccuuuaccugcugagccaucuuaccuggaaguguuuggaguccugcuucuagggcugccguggaacccggcuccugacagcuauccuuaauaccauauaauucuggugauaccuaguuuuauuuuggguuauuuuguuauuacauuauuugccaggacugaggauugaaccugguucccacaugugcuaggcauguuugccgcugagcuguaucaaccuuuguagaugccuucuguuucguuugagacagggucucaucucacuauggcccugccauugccucucagugcugggauuaagguuguaucaccaugcccaaccuugguuuugugcuuuugagacaggguuuucuaugaguacuaggcuggcuuuguacuuaacugccccaggcuagccccaguaguccuuccccagacuucagugcugggauugcaauguuaccauuguuauuuagacagaguuucacuugguaauucugguuggccuggaacucuguguguguguguguguguguguguguguguguguguguaugcguguguaugcaugcgaguguaugcguguguaugccuguguaucaaucaagcuggccuugagcuuacugaggccuuugguggcauaucucuucaucgcagcucuaagagaggcugcagcaggaggacuuugaguuugaagugagcccuugcuguauauagagaucuugucucagaagacugaaaggggaaggaaagacaacgguccccacccccacgggcuuugauuccugggccaggcccuugaaauguagaguuuaacuuguaugugugugcugagugcucuucauaucuacaaggacauagguaacagcagguugaaucagacccugcuaggagcucgggcaaacagucuaagaacauucuuagagguagcuggccaacugccggagaaggaaauugguuuuaaggacugaauguugcaggcuuggaggucagaacauaacuggucaaaaagugguuuggguucauuuuuugaaaaagauuuuuaauuuugauuauguauguguacaugacuaugggugcccguggaggucagaagaguuagaucuuccugaagugaguuacagguauucaggucugcugcaagaacagugugugguaucagccaucucuccagcccuggguaauuaucuauuuauugauaaauacccugggguuggacguccgugccuaacaagacaacccaacucuuuccuuggugugucccuuguuggguuaaggcuggcccucugauuuuaguuaguugcacagugaccuggggucuggaaccauccagaacagcuccacuccccugccauaggcaggacagcucugcucccucgccuguuugaaaaccgccaugugugccucuaugauguuuucccugcccuccuaucauguggguccugggguucacccacugagccaaccccucccccacauuguuuuccuuuugagauaagaggcucacaacucagaccauucuccuuccucugccucccuaaaguaugguuucuaagugugccgccacagcucagugcucccacuucucuuuccagugggcugcccugccggugucuuuccuuuucacugccuuagcucuugugguuaaagugcagguaugagucucuguucugugcccucagaucccuagccacugcugggauggugcccguaggguggugcaccucugucuuagggacagcucacuggguagugugcugggcacugaauaagaugcuaaguuuguuaccuggaucugggucaggguuacuuucagaccucugucaccaggcuaaagcaggcugacugaaugugguuuccgugucaaguuccuggaaggcaaaacaaacacagggucugcuguggcucaggcuugugauugcaggcuaugcucccagaaaccugaugacuuuggucauuauagcaaguccccaguaaagauggaagugggcaguguuagcagucaguguuaguuagccugcuuccuggucugcugggguucgagccugcuggccucugguuccucaugugccugcuacuaggcaccauauuuuuccucacuggggguagcaccaggcaguaugguuuuuguuuuggaacaugguucuguagcucaggcuggccuggaacccagguuaggccucggguaguauguauagcuuagcucuuaggaaccuuugccaagugacccccacccccauuacucagccugggcugggcugggcugggcugggcugggcugggcugggcugggcugggcugggcugggcugggcuggccucugggaaguugggcuugagaacaugcugcuuuugugaguuggggugcgugugcgcgccugugcguguuugugugguggccggcaaggcuggaguacgggcagaagaugcaggaccgugugcccagcuccuuaguucauucccuuagucuuuaggaagagccugcucauggaugucugugugggguacauguuugugggaugcaaacauggacuuccuggguguccaaggugaagcaguguggccacgggguuuucaugguugauugaagccacgugccucuuguuuucaucagagguugggggcagcauccugauaccugccagaguuugguccucaugcuagcccaucuucugcgucugauaaaaauccucuguguagcccaggcuggccucaaacucaccauccccugcuucagccuccugagugcuacggauuacuccagucagauuuugaggacucagaaccugacacuagacaggacacgugccuccugucaguccuaugacuuagggcaggcucucccuggccagccauucugcgauacagucuguauuucuugggcuagggagacccagugaucucucagccagcaggcagagcuaguccuuaacucugcguacuuauguauugggcgguuuuccuuuagcucugaccagcccuguccaagacccgaagacaugcucugggggcucagcagugcugugcagagaugugaagacggcgguggacuguggggccgugaagcacugccagcagauggucuggagcaagcccacagcggugagugcccgcucccagugucuaugcagagcacuugguccuugccccugccccugccccugccccugguuguacucugcuuaccuuuccugucccacaggcaccuugucucuuggugacccacucaccugugggcccucagggucuacccccugucccgggugagggucguggugcaggcacaggcauacccagcauucaccacucaucucaggaaguccagauuccgucugcucgccuucccugucguccccccccccccccaggcuggccacugacugaccccugagacucugcuguagccacacugggcaauggcugcugccuucaccaugauggugaugaaugaacaugcuacuguggggcucugagagguggagguucuucuguguaccuccgagaccaagcagagaaugacggcauucuaggacccacuggugggauggacugagugugacuuaguggagauuggguucugggagcccaauuuuagcaagagaagaaaacuugaauaaauauggccuaaugaaucacucaccuuguggcuaacuuucuaauguggguucucauuuguuuucgguuaugguuugaguauugcuuuaucuuaccgaguuuccugugcgaugaguggaggcuucagagauuaggacagccuuggggugggggugggggcacugucgugccaaguguccagacauacaaaacguucucucucauguuuuuuccuguuagaaaucccuuccuugcgacauaugcaaaacuguugucaccgaagcugggaacuugcugaaagauaaugcuacgcagguaagguacuggggaggagggugggugugggcugugauggagacugugugucugggcucuggggguccagagaggagcacuauuggccaagggguggcagacacggaugucuggcuuuccaggucauacauauaggcuugacaguacaagcuuauguucuuaaagauuuuauuuuuguguacgaguguucugccuacauguguagauuuguaccaucucugugccuggugcucaggaagcacacaauuccuuuuuuuuuuuuuuuuuugaggcaagguguuccuaucuuccuaucucaggcuacccucaaaacuaaguuauaccugucucugccuucagagugcuaggauuaaaggcucuagcccuggcuguuugguuaacccagagccuugcuagguagcccaggcuuuccuugaacuugcucaagccuuuuugccuuagccgucugagagcugaaauuaugggccuguaccaccacacccagcuuacauacugccauuugagaguaugugcuuggggucugggggguuuacccaucggugugugggcacguggaggccgagguugaccgcgucucuugacguaacucauuucagcuagacugucuggccagcugccccuuuggaucugccuggucugauacacaaacuuacugccccgccucccccagcacugggguucgggguauacuuugucaacccuggcuucuguguacauggaugcugaggguacagacuuaggccuucgucacugauggggucgcuugcaggaggagauccuucauuaccuggagaagaccugugaguggauucaugacuccagccugucggccucgugcaaggaggugguugacucuuaccugccugucauccuggacaugauuaagggcgagaugguaggugacuggguagggcccuuuaaggcacuucuagggcccagaagggccaguguguucguauucccggcuuuggguuucuccugcagcucuucuucauagggcuccuugcaccaagugcuguagcacgguggguuuccuguuugauuuucugggccaggugccuuggauuccugacuccugcauccuguugauagggagaaauggguagcccuugucaggccuuuaugucuagagcaagcgcauggcuucaucucugugaaugcagaagucaugagugaccgugagaugcaguguggggucagcuacuaguauacucacuugucacucagcaaguguauacugugcccaaacuggguguccggagccggcagcgaaccaggagcuaguucuguagagucugaaaggcuuucaagaagggggauucugaagaagccagccgguggggcuaagagugccaaagauggagccagggguuugugaggaagguguucauuugauccacaaagccuucugugucccauggaaagacacccaggaaggacagcacacauugcuaggaggugugauggcaacagauggaaauugaguuuugaaagauggaugggcuagccaaacucaagagggauacaggagcuuuaaggacugggaacagcguccaggucucugggaaauuugcugaaguggccacuccaggaagcagguugagcgggguagaauugagguggucgcaagugugagccacgguaagagaucaggauuugugagcugcacagaugugugugugugugaagucaguccggugccuuagcuugcagcugugagcacacuggccaaacaucggucucugacucuuccccucuccuugguggcucauuuuucuuuaaggaagagcugaugaugggcagcagugacacuggggggcugggaagccugcagguuagacaccuggugugcaacuuccuaaucuucuaggcacacugagugagggaggaacugacuggaugacaacaggcugcccuugggaaaggcucucagcugucucuuuuccuuuccagagcaacccuggggaagugugcucugcgcucaaccucugccagucccuucaggaguacuuggccgagcaaaaccagaaacagcuugaguccaacaagaucccggagguggacauggcccgugugguugcccccuucauguccaacaucccucuccugcuguacccucaggaucacccccgcagccagccccaaccuaagguuagcugaggguggguggagucagggcaaacacagcagaagcgccacagugcuggacagaacacaggcucucccuucaggccaugccccacugccugcccuuucaguacuuuggccugagugaauggccauggguuaaaagccugguucccaggagcugcugagccugucuagugcuguggccgcuugugagauauggcuuucucccuggagcuuguugcuguucucuuguaggcuaacgaggacgucugccaggacuguaugaagcuggugucugauguccagacugcugugaagaccaacuccagcuuuauccagggcuucguggaccacgugaaggaggauugugaccgcuuggggccaggcgugucugacauaguaagccucuaucuagccccaugguuuggauaauguucugagcuaggguagcagcagguagugcuaccuucccaguggccccgaggaaggugccucaggguuuccccggugcguuuagugagaccuagauguaauuuugguuaguugaaucugcaguggaggaaaaucacguugggaaagcuguuuuuuccccucugucaccauguacuaaaauguguaccaugcacgacacaugcacggcugucagaggacaaccugugggaguuggcuguggguccucagggauacaacucacucugucuggcuccauggcaucccccuucuagaacgaagggcuguggucugugaaugaggcucacagcucucuuuucccacagcagugggguugccugauaagcagcuugaaggacauugaguucuguggucucagaacucacuuagugcccgagagccugugaauggccuuggaagaucccuacugguguuuugcagcuguguucucaucuugcuaacaauggucgcucuguggccuugggaggcauuugggcuaucagacacugaggacugccaacuccuguucugacaucucuacagguuuuuaaguaggggguagaauaacuaaauugcuguaguaucuuagaaaaucuuaaggggacacuucgaucuauucugggaauuguuguuccuugugagagcaggucucucuguguagcucaggcuggccucguccaugguuguugggauuagaagcccguccauguccgucugcaagucaccaguuggcacuguugaaaagccaguugggcuguggugaacugaaccucugucucucugcagugcaagaacuacguggaccaguauuccgaggucuguguccagauguugaugcacaugguagguggcgggaccuccgcucaguguucgcauugguaacuccaugcguugggauuccccuuuuuccacuugagggccagaguaaaacuucuccucacgaucccgcccauccuuccucccacaaagucuuccuuagcuaaugugaucccuggacugcccugguagccuaggucugcuagucugugcaugcaugagcuggcugucagauugcuagugucuggcugagcgcuggcaucuguauaggaaggagcauugcgccacugagcgggugggagauuucaaagggagcccguguucugggucaggaggaaagaaucagcuacagcugcugcuuguucccuagcuaaaauuggcaucugguaauguccagggggcggggugggguggggcucauugccugagaggugggacauggggcaugggggauaucuagacuugaaccgugcugauguggcuggcagagcugagugagugggcgagaugcccugcucucccucucucacggacugucgugaguccuuacucaugcuugaaccugagcccuuuccugcuuuguauauacuuacuguccagcugcugggcuaaccugcugcccaagcgguccaucuggcuggguggcuuguuugagaucauugcucgugccccaaacaaacaucuaaagacagcuuguaaagaccuccaugguuaagauacccuuugauguggaguggccuggugaaaugcuuccuucagggaagcuacccguuuuuauuauaaugggaaguuuuuuuuuuuuaaguuuuuuucuguaucaaacaauuuggguuuugaaaauauaccaaugaaaucauuuuguauuccaucuuaguuuaauuugcccuuuucccuaaaaacaauagcugguuuuuuuuguuguuuuuuguuuuuuuuuuuuuuuauaaaaggggaaacacaguuuaauuuuccuuuuccccuaaaauuauuggucucaguuucuaguucuuacugcauguggcugccuuuaccucccaaaugcugggguuaaaugaucacucccuacuagucauuacuccuguauguggcuucauauuaagccacaguacggauagaacauaauucauaugacuuucuaugaccuuuguggguacagcagacugccucuggggcgacaacauccuuucaaccaucccuguuugucacuuaggguaacugcagcuggaauucccaaccaaagcccacacacccaccuuccaggcuggcagcuggccugagguuguggagucugcucuguguggagcuuagaaaggccagaaagcucgcgaucagcucuagguggaggcccuucacaaggacaguuuccagcagccacaugcaugcugucagggcuggacuagcucucggccccauccaucccuuccugccaggguguugcccuuaaacucgaugacaucccucugccagguuaacugcuccaugguuguuuuaauuucucuuaacugcuguguccuuuccuuucucauugacuccuccgauuuccuguuuuuuuguucaacagcaggaucagguaugugacagaauuugcuuuugguaguagucuacugcuucuaguuguuggcuauucucucuuuuauuuuauuuuauuuuauuuauuauuuauuuuugcuuuuuuuuuuuaauuuuaauuuuuuuuuuuuuuuuuuuuuuuuuuuuuuuuuggucuggcauggugagcucugacagguaccacgaaggguguccccguauguccuuucccuuacguucagcacuucagauccugggggccagacgguguagcuaccagagccuaugcccaagucagcacauagcacaucaccuguuaccaggguggugguggcaaaggccgaaagccagggcccugacagaacacuugugucuuucacaguggguagcauugcaugucuuagcgcugucccucaccccagugcuucugcaugggcaaacuagaugcagacaguggccuggccugcuggguggagagccuuacacauggccucucgauugugccuucugcccuuuagagagugggucuuggggcaccuagagccucagagauggcauacugugggaaucagugcucaguccauccuggccgagccagugcccgagugggucuguucugaacauugcuuccaggcucuccgguuugaguucuagaagcugaaaggcauuuugaaucucauaaggaagggcuuaaauggaaaugccugaguuuucauuuaugcugcuucagacagagcgcccccgccccugaaucuugcccacccccaccccucaccccaucccaccccccuaaaaaaagguuuuguaccuuagucucucucuggccuugaucuccuaauuguaagguguguuaaagccagggaguuuaggaaccugcccucaguguaucucagugugcgugcucuuguugucagcaccucugcuccugcgcugggcucagccgagggcugccacacgcaguucacacagcaccacacagggucugcggaugggacuugcucuuggcuuucgcagugugguggucugaauauccacacucauuucucucuggcuuggugucaggauggugagaggggaucugugugaagcccuugugacgaaauaucugaucagcucagguccugggcucucacaugcccuggguacaguugugagcacagaauauggcuucugggaaaagcggccuuucuuccccuuaguguaccaguuuacauggaacugucacugaagggggguuuccaugugauuuuaauucugacauagucacauugggcuuucugugagaucaugagccuuauaguucccauccagagagcuuaccccugacagugagcuggcauacguagccuggcugugcuuggggguacagaaagugcuagaagacuauccuacggugaggggcgcuuccucuagguggaacuggguguacacgcagugaucuuuauuuaacuggagcugccagccugagugggaagagggagcuuuacacgagcccucagcucugcucugcuguguaaggaaggguuugagggcagcauacacaggcugucuaacacaggccaugcuuucuucagcaacccaaggaaaucugugugcuggcuggcuucuguaaugaggucaagagagugccaaugaagacucuggucccugccaccgagaccauuaagaacauccucccugcccuggagaugauggaccccuaugagguaccuucuguugcuguucucugccgacuggaacagauaccccauccucccauggugucacguccucuccgggcccugccugccuucugaauguguuucgaguugaaaccuggaggaguucuauacgugcccauaaucuagauccuggcuucacaccuuuaggaaacaugugguaaaagcaugcccgaggggucaggucccagccuuaaaacacucuccucuuguccuucacagcagaaucugguccaggcccacaaugugauuuuaugccagaccugucaguuugugaugaauaaguuuucugagcugauugucaauaaugccacugagguaugcuggccuccuugcaugggggcggggaggagugcucagaaggugccugggugaguugggggggggaugguucuccuggcagauauauaccccaguacccaggagggaggucucuaggggagggcuauagcacccaacucuggacuggcuccuggcaugccuugcaucucuucuuuguguccagcuccagucugaugcgccuuucgccuguuucaggagcuccuaguuaaagguuugagcaacgcaugcgcacugcuccccgauccugccagaaccaagugccaggagguggugggaacauuuggccccucccuguuggacaucuuuauccaugagguaaaccccagcucucugugcggugugaucggccucugugcugcccgcccggaguugguggaggcacuugagcagccugcgccagccauuguaucugcacugcucaaagagcccacaccgccaaagcagcccgcacagcccaagcagucggcauugcccgguaaguccacggcacacugagggaagaaggggccgcucuccauuaaggagcacuugccaguguuaagcccugugucguccuuucuguagcccaugugccuccucagaagaaugguggguucugugaggugugcaagaaacugguccucuauuuggaacauaaccuggagaaaaacagcaccaaggaggaaauccuggccgcacuugagaagggcugcagcuuccugccagacccuuaccagaagcagguaugggcguguccguucacugcuaauguuccaguguguguugggggcggugcuggggguggugguggugucccugugugcucuaggccugagguuuugagaggcaguaagcacaugaagccauggaagaaggccuuaggguagugaccagccucuggacccuggguucuaagaagucagggucucugguggacacagccaacacugggacccgugccccuuuucuuggcagugcgaugacuuuguggcugaguaugagcccuugcuauuggagauccucguggaagugauggauccuggauuugugugcucgguaagccgcgccagaugccggggccucguggcagcauggauggaguggggcaggaagcggaacagccagaccucugucaggggcuggaagugcuucggucucagcucugaauggggccuggcagggcagcucauuucucgucauuugucauacagaaaauuggaguuugcccuucugccuauaagcugcugcugggaaccgagaagugugucuggggcccuagcuacuggugucagaacauggagacugccgcccgaugcaaugugaguauccugacugcuccuacagcgugcugggggguggaucaccucaugggaacaggaggcucuaacugugccucuaacaagucaucuugucggggaugacugagcucagggcauuaggccugcguggcuaugcuuuuugucuuuugagccaucucuguguccccugguauugucuuaccagcuucaugcacagccaccagggauugcaccaaaccugugcggcccauggucccugccucugcacaaguccucaugggucccaggggacacuuugugacugacggaggccuagcucaacccuugaagccuugguucaagggugcuccacaggguguuugugagcagcccugggggccagacuugcuuuccugaugggguauuggucuuggccucuagcgcauaaagcuuugucguuccuucucagggacgugagucagccgggccccuccuguccuugucugcacugucacaccccauggauagcaugugggccugaggcugccccucuugagcucuuguucauugcuguaggauuuuucagucaagcagcagggacugggggcuggaguccugccuacugcaggaguacucuuacaugacagcaaggggcugugccucugguuccgugccaguguuuucagagaucucacagcucugagggccacagguccuguuuugauagcauccuagguuccuuagcuucugugacgucagcagaaagcaggucacacuuggagugacgcugacaagcaagugacgcgugaaggcuuguccugucugaccugaccugucucccuuucuccucauaggcugucgaucauugcaaacgccauguguggaacuaguuucccagcugcagaagucaccuacuugugggucuaggguaaugaacacauagaucuauuugacuuaauaaguaggaacccccuuugcccuucccccaucuccucucccuuacuguagcauuucugucauguaagaggugcugacagccacuuccguguccccuuucugcucgaaggaugaggauaccuugggcaucagcuccccggcugcccuuuucacccaccugcuggagggggguggugagccagagggcaggagcauuuucugagcccuuucuuggugugugggggaucuauggccaucuccuaccaugagggagcuacccagcuuccugugguaccaaggaguuauuuuggaugauuagaagcacagaaugaucaggccuuuagagcgauggaauggccauugucauagcacagagauuucagaagcaccugcagguggcuugcuugggauguugcugucccugggucagccuuccauucugcuuuccugucuucccgucugccuuguugggguucugugggguaggguggggaggggaaacuugugaauguaacuugccugugccgugugacggucacgugggccuggucuuuugugugugaggcccuugaccguguggccucugccuggcuguuugggguccugcacggcuuucccaccaccuguagcucuuguugaccugccuguucaccucaugagugaagcgucugccuggcagugggccaugaacugaggggucucuguguagaguagaagcuuccugugccuccgguugccaggagacagccugugcaguuaaauggaccuagauuuuguuuugcacuaaaguuucugugacuuaauaaaguucuguuaaccaacagauc

SEQ ID NO: 5514 - RNA, 1464 nt, Mus musculus
uccucuuuuuuuucugcuuacacacucagacuuccauucucccugccuucucaccaacacugauucagagaccucugagucuaucuugcagucugcaguucccaagaucacaaauaaaggcgucucucguuugccguuuucugaguuuguauugauugacaacugcagaauggcagccugugaauuugaauccugaguguaaagauguaggcaaaucuguaaccuguuugugcuugagucucaucuguuagcacggcacgaaucacaauaaaugggggcuggagaugccacucaguugguagagucauugcccgacaugaguugaaggccuggguuugguuccuagaaccaaacagaacauguaugguagcacaggcaggcagaucaggauuuggaagugacugaaguucgaggacugccugagauacacgaauccucagcugcacagccaguugucagccucuuugggcuacaggaaacccugucuuaaaaaacuaaccacuagccgggcgugguggcccacgccuuuaaucccagcaggcagacagauuucugaguucgaggccagccuagucuacaaagugaguuccaggacagccagggcuauacagagaaacccugucucgaaaaaccaaaacaaacaaacaaacaaacgaacaaaaaaacuaaccaaaaaaacuaaucaccgccaggcgugguggcacacaccuuuaaucccagcagcacucgggaggcagaaucaggcagauuucugaguucgagaccagccuggucuacaaagugaguuccaggacagccagggcuacacagagaaacccugucucgaaaaaccaaaaaccaaaccaaaccaaaccaaccaaccaaccaaacaaaaaaccccuaacuaccacuguacaagggucaggcagaagaauuacauguucagagacuuucuggggaauuuggugacacccucuuucaaaaauaaaguaaggagugagcugggaggguggggggaaugguggugugcagcuuggagguacaacacuugauaucaaguauaaugccuuggguucaauaccggcgacugcaaacaaaaaucccugcucccgccccccaacccccaaccauucuccaagggguugaggcagaagguugagaguuccaggucugcugcgacacugaauugucgaccagcaaggccauagugacucggcaucucaaaaacaaauaguaauacuuaaaagaugcuggggcucaggggugggguggggugggggagcacaagaugcaguucagggcuugguaccagcccugggcuggauuccucacauugcaaagguaaagagaggcguuagauaccguucggcgccugaccuugauuuaaucaccagauaugguuuucuuuuauuaccaccacccgcgccuucccgccaccuucccugggcguuuucagccugcuccucuucgcacccucccuccccg

SEQ ID NO: 5515 - RNA, 8012 nt, Mus musculus
aguacuuggccgagcaaaaccagaaacagcuugaguccaacaagaucccggagguggacauggcccgugugguugcccccuucauguccaacaucccucuccugcuguacccucaggaucacccccgcagccagccccaaccuaagguuagcugaggguggguggagucagggcaaacacagcagaagcgccacagugcuggacagaacacaggcucucccuucaggccaugccccacugccugcccuuucaguacuuuggccugagugaauggccauggguuaaaagccugguucccaggagcugcugagccugucuagugcuguggccgcuugugagauauggcuuucucccuggagcuuguugcuguucucuuguaggcuaacgaggacgucugccaggacuguaugaagcuggugucugauguccagacugcugugaagaccaacuccagcuuuauccagggcuucguggaccacgugaaggaggauugugaccgcuuggggccaggcgugucugacauaguaagccucuaucuagccccaugguuuggauaauguucugagcuaggguagcagcagguagugcuaccuucccaguggccccgaggaaggugccucaggguuuccccggugcguuuagugagaccuagauguaauuuugguuaguugaaucugcaguggaggaaaaucacguugggaaagcuguuuuuuccccucugucaccauguacuaaaauguguaccaugcacgacacaugcacggcugucagaggacaaccugugggaguuggcuguggguccucagggauacaacucacucugucuggcuccauggcaucccccuucuagaacgaagggcuguggucugugaaugaggcucacagcucucuuuucccacagcagugggguugccugauaagcagcuugaaggacauugaguucuguggucucagaacucacuuagugcccgagagccugugaauggccuuggaagaucccuacugguguuuugcagcuguguucucaucuugcuaacaauggucgcucuguggccuugggaggcauuugggcuaucagacacugaggacugccaacuccuguucugacaucucuacagguuuuuaaguaggggguagaauaacuaaauugcuguaguaucuuagaaaaucuuaaggggacacuucgaucuauucugggaauuguuguuccuugugagagcaggucucucuguguagcucaggcuggccucguccaugguuguugggauuagaagcccguccauguccgucugcaagucaccaguuggcacuguugaaaagccaguugggcuguggugaacugaaccucugucucucugcagugcaagaacuacguggaccaguauuccgaggucuguguccagauguugaugcacaugguagguggcgggaccuccgcucaguguucgcauugguaacuccaugcguugggauuccccuuuuuccacuugagggccagaguaaaacuucuccucacgaucccgcccauccuuccucccacaaagucuuccuuagcuaaugugaucccuggacugcccugguagccuaggucugcuagucugugcaugcaugagcuggcugucagauugcuagugucuggcugagcgcuggcaucuguauaggaaggagcauugcgccacugagcgggugggagauuucaaagggagcccguguucugggucaggaggaaagaaucagcuacagcugcugcuuguucccuagcuaaaauuggcaucugguaauguccagggggcggggugggguggggcucauugccugagaggugggacauggggcaugggggauaucuagacuugaaccgugcugauguggcuggcagagcugagugagugggcgagaugcccugcucucccucucucacggacugucgugaguccuuacucaugcuugaaccugagcccuuuccugcuuuguauauacuuacuguccagcugcugggcuaaccugcugcccaagcgguccaucuggcuggguggcuuguuugagaucauugcucgugccccaaacaaacaucuaaagacagcuuguaaagaccuccaugguuaagauacccuuugauguggaguggccuggugaaaugcuuccuucagggaagcuacccguuuuuauuauaaugggaaguuuuuuuuuuuuaaguuuuuuucuguaucaaacaauuuggguuuugaaaauauaccaaugaaaucauuuuguauuccaucuuaguuuaauuugcccuuuucccuaaaaacaauagcugguuuuuuuuguuguuuuuuguuuuuuuuuuuuuuuauaaaaggggaaacacaguuuaauuuuccuuuuccccuaaaauuauuggucucaguuucuaguucuuacugcauguggcugccuuuaccucccaaaugcugggguuaaaugaucacucccuacuagucauuacuccuguauguggcuucauauuaagccacaguacggauagaacauaauucauaugacuuucuaugaccuuuguggguacagcagacugccucuggggcgacaacauccuuucaaccaucccuguuugucacuuaggguaacugcagcuggaauucccaaccaaagcccacacacccaccuuccaggcuggcagcuggccugagguuguggagucugcucuguguggagcuuagaaaggccagaaagcucgcgaucagcucuagguggaggcccuucacaaggacaguuuccagcagccacaugcaugcugucagggcuggacuagcucucggccccauccaucccuuccugccaggguguugcccuuaaacucgaugacaucccucugccagguuaacugcuccaugguuguuuuaauuucucuuaacugcuguguccuuuccuuucucauugacuccuccgauuuccuguuuuuuuguucaacagcaggaucagguaugugacagaauuugcuuuugguaguagucuacugcuucuaguuguuggcuauucucucuuuuauuuuauuuuauuuuauuuauuauuuauuuuugcuuuuuuuuuuuaauuuuaauuuuuuuuuuuuuuuuuuuuuuuuuuuuuuuuuggucuggcauggugagcucugacagguaccacgaaggguguccccguauguccuuucccuuacguucagcacuucagauccugggggccagacgguguagcuaccagagccuaugcccaagucagcacauagcacaucaccuguuaccaggguggugguggcaaaggccgaaagccagggcccugacagaacacuugugucuuucacaguggguagcauugcaugucuuagcgcugucccucaccccagugcuucugcaugggcaaacuagaugcagacaguggccuggccugcuggguggagagccuuacacauggccucucgauugugccuucugcccuuuagagagugggucuuggggcaccuagagccucagagauggcauacugugggaaucagugcucaguccauccuggccgagccagugcccgagugggucuguucugaacauugcuuccaggcucuccgguuugaguucuagaagcugaaaggcauuuugaaucucauaaggaagggcuuaaauggaaaugccugaguuuucauuuaugcugcuucagacagagcgcccccgccccugaaucuugcccacccccaccccucaccccaucccaccccccuaaaaaaagguuuuguaccuuagucucucucuggccuugaucuccuaauuguaagguguguuaaagccagggaguuuaggaaccugcccucaguguaucucagugugcgugcucuuguugucagcaccucugcuccugcgcugggcucagccgagggcugccacacgcaguucacacagcaccacacagggucugcggaugggacuugcucuuggcuuucgcagugugguggucugaauauccacacucauuucucucuggcuuggugucaggauggugagaggggaucugugugaagcccuugugacgaaauaucugaucagcucagguccugggcucucacaugcccuggguacaguugugagcacagaauauggcuucugggaaaagcggccuuucuuccccuuaguguaccaguuuacauggaacugucacugaagggggguuuccaugugauuuuaauucugacauagucacauugggcuuucugugagaucaugagccuuauaguucccauccagagagcuuaccccugacagugagcuggcauacguagccuggcugugcuuggggguacagaaagugcuagaagacuauccuacggugaggggcgcuuccucuagguggaacuggguguacacgcagugaucuuuauuuaacuggagcugccagccugagugggaagagggagcuuuacacgagcccucagcucugcucugcuguguaaggaaggguuugagggcagcauacacaggcugucuaacacaggccaugcuuucuucagcaacccaaggaaaucugugugcuggcuggcuucuguaaugaggucaagagagugccaaugaagacucuggucccugccaccgagaccauuaagaacauccucccugcccuggagaugauggaccccuaugagguaccuucuguugcuguucucugccgacuggaacagauaccccauccucccauggugucacguccucuccgggcccugccugccuucugaauguguuucgaguugaaaccuggaggaguucuauacgugcccauaaucuagauccuggcuucacaccuuuaggaaacaugugguaaaagcaugcccgaggggucaggucccagccuuaaaacacucuccucuuguccuucacagcagaaucugguccaggcccacaaugugauuuuaugccagaccugucaguuugugaugaauaaguuuucugagcugauugucaauaaugccacugagguaugcuggccuccuugcaugggggcggggaggagugcucagaaggugccugggugaguugggggggggaugguucuccuggcagauauauaccccaguacccaggagggaggucucuaggggagggcuauagcacccaacucuggacuggcuccuggcaugccuugcaucucuucuuuguguccagcuccagucugaugcgccuuucgccuguuucaggagcuccuaguuaaagguuugagcaacgcaugcgcacugcuccccgauccugccagaaccaagugccaggagguggugggaacauuuggccccucccuguuggacaucuuuauccaugagguaaaccccagcucucugugcggugugaucggccucugugcugcccgcccggaguugguggaggcacuugagcagccugcgccagccauuguaucugcacugcucaaagagcccacaccgccaaagcagcccgcacagcccaagcagucggcauugcccgguaaguccacggcacacugagggaagaaggggccgcucuccauuaaggagcacuugccaguguuaagcccugugucguccuuucuguagcccaugugccuccucagaagaaugguggguucugugaggugugcaagaaacugguccucuauuuggaacauaaccuggagaaaaacagcaccaaggaggaaauccuggccgcacuugagaagggcugcagcuuccugccagacccuuaccagaagcagguaugggcguguccguucacugcuaauguuccaguguguguugggggcggugcuggggguggugguggugucccugugugcucuaggccugagguuuugagaggcaguaagcacaugaagccauggaagaaggccuuaggguagugaccagccucuggacccuggguucuaagaagucagggucucugguggacacagccaacacugggacccgugccccuuuucuuggcagugcgaugacuuuguggcugaguaugagcccuugcuauuggagauccucguggaagugauggauccuggauuugugugcucgguaagccgcgccagaugccggggccucguggcagcauggauggaguggggcaggaagcggaacagccagaccucugucaggggcuggaagugcuucggucucagcucugaauggggccuggcagggcagcucauuucucgucauuugucauacagaaaauuggaguuugcccuucugccuauaagcugcugcugggaaccgagaagugugucuggggcccuagcuacuggugucagaacauggagacugccgcccgaugcaaugugaguauccugacugcuccuacagcgugcugggggguggaucaccucaugggaacaggaggcucuaacugugccucuaacaagucaucuugucggggaugacugagcucagggcauuaggccugcguggcuaugcuuuuugucuuuugagccaucucuguguccccugguauugucuuaccagcuucaugcacagccaccagggauugcaccaaaccugugcggcccauggucccugccucugcacaaguccucaugggucccaggggacacuuugugacugacggaggccuagcucaacccuugaagccuugguucaagggugcuccacaggguguuugugagcagcccugggggccagacuugcuuuccugaugggguauuggucuuggccucuagcgcauaaagcuuugucguuccuucucagggacgugagucagccgggccccuccuguccuugucugcacugucacaccccauggauagcaugugggccugaggcugccccucuugagcucuuguucauugcuguaggauuuuucagucaagcagcagggacugggggcuggaguccugccuacugcaggaguacucuuacaugacagcaaggggcugugccucugguuccgugccaguguuuucagagaucucacagcucugagggccacagguccuguuuugauagcauccuagguuccuuagcuucugugacgucagcagaaagcaggucacacuuggagugacgcugacaagcaagugacgcgugaaggcuuguccugucugaccugaccugucucccuuucuccucauaggcugucgaucauugcaaacgccauguguggaacuaguuucccagcugcagaagucaccuacuugugggucuaggguaaugaacacauagaucuauuugacuuaauaaguaggaacccccuuugcccuucccccaucuccucucccuuacuguagcauuucugucauguaagaggugcugacagccacuuccguguccccuuucugcucgaaggaugaggauaccuugggcaucagcuccccggcugcccuuuucacccaccugcuggagggggguggugagccagagggcaggagcauuuucugagcccuuucuuggugugugggggaucuauggccaucuccuaccaugagggagcuacccagcuuccugugguaccaaggaguuauuuuggaugauuagaagcacagaaugaucaggccuuuagagcgauggaauggccauugucauagcacagagauuucagaagcaccugcagguggcuugcuugggauguugcugucccugggucagccuuccauucugcuuuccugucuucccgucugccuuguugggguucugugggguaggguggggaggggaaacuugugaauguaacuugccugugccgugugacggucacgugggccuggucuuuugugugugaggcccuugaccguguggccucugccuggcuguuugggguccugcacggcuuucccaccaccuguagcucuuguugaccugccuguucaccucaugagugaagcgucugccuggcagugggccaugaacugaggggucucuguguagaguagaagcuuccugugccuccgguugccaggagacagccugugcaguuaaauggaccuagauuuuguuuugcacuaaaguuucugugacuuaauaaaguucuguuaaccaa

SEQ ID NO: 5516 - RNA, 1040 nt, Mus musculus
uggauguuaguguuaauaaaacuuuauuuacaaaaauaaggugacgggacagauugggcugguuagcagccauuugauccuuguccaggagcacauggcuuuacagcauuugacaguuauuguuauucaugaugaugaggguuugugcacauguacccugguaccugcggaugucagaggagggcauugggucuccuggaacuggaugucgcaggauggcauccagugucggaugugggugguggaugcugggaacagaacacuggcuggucaucugaaagaggagcagcccggggaaacauuaucagugaagcaguucugucccuguugcccagcccagggucccuuuucccagcuagaucagauccugccuucccacccccaccccuguccccagggaucuguuugaaguauuauuacucuuaggauaaagacuaaccccugccuggggaugcagcucagcugcagaucacaugccuagcauguccaagggcucgaucugcagcaccucagaaugagaccucagaugaaggcuagcaugcccaccaaacacccucuacccucaccauguguggucccucacugaccuuuauauauacaucagcucuuucucaccacagaaacuagcacacgcugucucuccuaucuaaccuuccuucugccuuuuaccuugccauguuuguccggcucucuucucuuucccaggugccauugacugacucuucuuugccucaccucuguguuccugcaacccugcaggcuuaucuagcaagcacccagggcugcuuccugggacuuucuccuugagucuuugagagagucauggaggugucgcgauucuggcuauauuguuacuuguuuauaugcuucccugaacugguuccucuuuagaggguuucccugaggcggagagccauacucagacuauuucaggagccaacacaugguagccaauaggaaugaacgaacaaaugaacgaacgaaugaauguuaaaagacuggagcucuagauucacaguuacucugguacaauuccuguc

SEQ ID NO: 5517 - RNA, 5666 nt, Mus musculus
gacucugaauaccacuaaccccacaacgaaacccagggguccagagaagagguauagcacgcaaggcagcggauguuucuagucuauugggacacagccccaaccccucugaggaaacaggauggucuagcaggggacagccccauacaagagccugaaccucagcgccaccaucuuccagcugcaaagaauugacaugagcugugucugcccacacacugcccugucucagagggcaaacgacaguggcuggacugcucucuccccucucagagaggaaaguccugcuggguaguuuugguccccagcagguguugaccaccuagagcucaaaccccuacacucucugugugggcuucccucugggcagaaccagccuauaggacucugaagugccucagcuuccucaucugcacaaaugagacugucacacucuggugacccaagguguauauagcaagcuuaagccuauuaccugcccuggaaggcaaagccccucacuacucuacugggauuaccacuacauuagcuaaguaagggccuugcgccucagcugagcagacuggacucugagugccaggcugcgugcaaguccgucaccacuaccaucgggugacuguccaucucuuuaaacggggucgcacccgcuguagcuaaagggcacaguggccuaacucgagaguuugaaaucuggccucacccugccaaguagccuagaggcaccauugugauccugugccccuggguggcacugaccauacaggacuccccccuggacugcuaacagaaaguuccccaacagcuaucagccagugauuuagaaaucuucuaggaauggguuaggcuaagaagaucugcugucuuccuggccagggaucacugcaaguucaaguccagaccauccuugcacaugaacaaagggagaagcuuuacuggcaggcacacuuccgccucugugcccucgcccuaucugauaugauaccagguuccaugacgcaaacgcuggggcucucaggcccacagggccgaccaagcugcauguaagaacauaccccauaucuaaggccuucaaagccucugcaacagggggggcuuguguaggacaccuguggggggcucauagucccuccagagacugccugggcuuaggugacccacugggcuucuuggaccugcuuggacuaacuguccuccaauggaagagcauccccgcuacucaagaccuuaguggguauagagaaauaugcaaggcccuagcugguggccugacucuccucuucccuccccuguagcuugaggacccaguuucugcuuccacauaacacaggcugagugcucagagcaggcccuggcacacaggaagccuuuugaugagcucagagacacacugagucuaaaacuaaagagucccuccacaggcagaggccugggaauagcaggaacacacaucucugcucucucccuacugcaccccccccccgcccccaccgcagucucuaagaccccaggcugagaaguagugagguccugguggguacaggagggcaugaggcugucauacucuggccuccgcucagaugcaaccauucggaggucacugcacgguauggugccacacaccuuuaaucccaguauucgggagucagaggcaagcagaucucugugaguucgaggccagccuggacuaaacagaaacaccaugucucaaaaaaaaaaaaaaaaaaaagaagucuaaaacuaaacaggccugugggaggccaaagucuacggguuacagaagcggggagaggagacuggaucuaccaggccucaccgcucacaccuuccugacccacugauucccaugccacagcuugggccuaccacaggcaggccauggcaccaaccuucauggcuggcuacugguugcccucccucugagcccugccuuucuuuauggagucuuaaggacucuuuacuagagaaaugggagacagcacuggugagggauccacauguccuugguggacaugaccaugcccauggcucaugaucccuagggcuguaagcagagcuucuaacgagaccccagagguacaggguaggggaaggaagggcagagccuuagcacucccggcucucacuugccucaagcccccuuuacugacucugcuuucaccuaagcucaaggccaguccccaguggacaggcacaguggcuuacacacauacggcuauauugagcaccaagcccagaccuacacuuuuuuaaagaaagcaucaucaucaacaucaacaucacagucaucaucuuguguaugaguguuuugccugcauaagagucugugcaccacaugcgugcuuggugcuagaggagguggugagccucgggugguugccgagaaucgaaccuaggucuuucacaacaauaacaagugcccuuaaccacugagccaacucuccagccuccgagaccuucaucacauggaaaccacaggacagaaauucagggaaaugaccccaaagaaccuaucuuccaguuacccaggagccaucugguaccagcuaccacacccacccgccacacccacucacagggaauccuggcucuugcacuggggggaugaacucgcaggcccucuugccuaugaggugaagggaccugcauuggagcccucaacugcucagacuuggugcaccggaccugccucguucaucuccuucauuaucaugcugguuccuaggcuugcaagagucucuucuggguaaccuggcucuccuaacugguggagccacugucuugugugacuuuuguaugggaaaugcuuuccccugaaacccagccgcaauccucugagccgcccgcuaccuaucagccagcauccaggaauguacuggggaagaagcuuuggugggcauucggaggaggguggucagccuucucuagguuacaaguagccgggccggagagggcauugcugaggcuaaggauggcuugcagagggccccucaaaccuggccuugcccucccuccaccggggacagcucacggaugagaggagcagggagguugcuucgcugccuccguuugcaacucuuuccugaggagguccaggcucgcccccuccaaagcaugggaagaggcauggaagagccugaauauccaggaagagagguaaagacccugccgccaggagccccgugggcaacaaggagcugaggugguaggauauucagcacugaggggagggagacagaagccagaagucuguaauccacccagaccagcucugccccgcccccaccuccacuccugaccccuggggagccccgugagagccguggcagguucugggaguuugccuagcucuccuacuaugaaacaugaguuucacaagugaccagugccuggcacgucagcucauggaaaggcuggggguucucuaacaggaagagaucucccgucgggacuucggcccacuggcuuuccuguuuccacacuccuauuuauucugauacccagauuccuaucugggggcugggguuggggggaaucaaugacgguaguuguuuaugggggaguuaaugaagcaaugccuucgcugacccuacaccugugggaagccgggagggccagguuccuugcacgggggaccucaccccaccucuucacuucuuucucccagcucagguuacagccugcucccacugccccucccccacucuagaccccgggucuggucacagcuaaaaauaaacucaaggacuggcuuaccagcacacaccuuuaagccccaggaaagaugcuuccagcuuccagauaggggucacuagucugaggaggggagucgggaggcuuccaguauaacacacugcacaccucuuagcaugggguguauaaacacaccuguggaggcaguggcccuuccacuaacuggugcuaagagugcgccaggcuccgugcuaaggaccuuuggugaauuuaccuuuugggcucaucuacccauuuuacagaccagagagcugaggaccggaucaggaaggaagagcgagucugagauccaagcuccagcaggagcaaacaagccagagggcuuucugaacuuuguggcaauguuauauggcagaccgaaugcuauggauugauucuguugugagguugaaaaugaggcucagguaggcucaguagcuuguccuaaggacuaagagaugggagaugcgacuugaagcuaaucaguuauuagagcucgugacaauaaaggggggccucuggaggucccaaggugguuucugcucacauccagggaccaauuccugcccucuuacuguuuaucccacacugggcuccugccuggccuucccucacgcacccccacuguccccgaacuuucauuauccuggagccccacccucauccaaaauccucccccccccaccucccuaaggcuucauucauaaggcucccaacucccgagcugugagcuguacaaugucagcuccaucuggucggacacuuucuuccucuccuucuuucugaggcaaggucucucugugcaguccuggaacucuguagagcaggcuagcuuugaacacaagagaucccccugcuuccgccucccaagugcugggauuaaaggcgugccaccaccggguuauagaggaacucuuuuucuuagcuuaaguaagaaaaacuccauggauguuguuugaguagguugggcacagagaaaagcauaauaaagccaggggcucacuacuguuaggaauacagagagcccguggucuuuuggacccucaaauuccagagaccccuggaccugaaucucuucauucaucuccccaaaggagacagcgagucuuccuugcacagaaggcaaaaaccuguccaaugagauguucaccaaggagugugggcugggagacccagugcgcacaaagaggccauggcuagucaaggucgggugagagaccuggcucccagaagcuccaagagguacuuuacuaagugggugcccggcugauggcuuaaggaccauuccucccugcccuagacuguaaauuuacgagcugaaaggcuggggugggggcaggggcgcucgggaggaacccaacccauaccgccagauucucagccuuagggcuccagguccaggaagccauaaagaugaucuggcugagcuuccccaccccccagcggguguuuuagaggcuggggaggggcucgaaggaaggcugggggcagggaagguagggagucagggaaagccagcauaggaaaagagugcuaggugagucggccuuuuguuugcucuccagaggcucugcccuguacuggggguucuggccugagcuguaucauggacuggcuucauaauuacaggguauccccucugaccacucugggaagcuggaagggucaggcaaaguggugucuguucccuccugcuccuaccagaagacacccuccacugacagcacaaauaugagauccacagaccaaaagaagcuugcccccaccaaaaaucacagaggucguaacugacaaugaaagccagugagacagaacugugggcucccaccucccagugaggcagggcuugugcaguccugggaaagagcagcccagaccugcuugcucgcuugccagagggcuuggugagccccccugguccacccucucugaagacu

SEQ ID NO: 5518 - RNA, 6780 nt, Mus musculus
uggagaacagucagacaucuuuauuacucccuccaaggaccacggaccccugcagaaaggagggguggaaaggauacaggagcaggaggcaaaaggaucggagugcugugcagggcuauccucggagccaagccgccgccuucuucaggucugcugggucucuugaaaacucucacuauggccgggcuuguugacuguugauauuccuuuauauagaaggaggggugggugggucagggaucuucaccugagcauccagccguuccucccaaucagauuccgucuagauugcauguugccugaggaaagugcuagcuagaguauauauguguggaaggacaaggggagccaacuccaucuacacagccguggguggaggcagcugugacaggugaagacugcccaguagggguucuuuaaggccacccggggcucccaccuguaaucccucacggguugcucuguauauaggccaaauauacucugguucucucugaacugcuguggaauugcaccuugauuuguuggguccuuagagggaggaauagacacuuaaucucucuguccaaagaaggaauuuuagcaucauuaguccauaagacuaagucccaagagaaacccgauagguuccuaaagacuuuccacagcagagacaccugggcagaugaaaacacuggacucaacauucagcaacguaaaacucaccgucagugucugagagccagucaaaaaguagcccgaaagacuuuaauacaaaaaugcacucugggacugggcugcuggcaacucccagcuggagcccggccuccaagcuguuugugcaucuuuagcauguggcagcuguccuaagugcucaaaccacaacccuccagccuccccaccuuggauaggggacacacuaccuucugcagagggagugugcauugcucaggaugcagaagcagaugcuggacagggcagggaaugcccucaggcugggagggcuggcugcugucaagugucuugccgcucugucucauuacuucuuucagugcuuccugagggccgugugucuccagagcagggagaggccauggcaguauccagugcaaauagggaagauguuucuagacccuacugcuccccagcacaguggcugcagaaggggcagggaugaguaucuugguaccaguugugaugcaagucaagggugaugcuuggucccguccugcucaucccaagaacaucaaguccaaaagaugcccaaggaagaugugaggggcccucuucuugcagacuagacucagacagagcacucucagggaauccaugcuaagggagcacggugagucuccagcggccucugucuuucuggaagaagcugggcuuagggaaagcuaccauguguccaugcaggcugagugggcagcaagcauccugcccuuguaguugagaccagaucaccuugggcuuggcacacaggaaaaggggucuugauuucaggugugaggaaggguuuggaugcgggcagaugcuugaccucugcgguuccuuuguauccagaguuccuuggcagagaaaagcacacgcagugcucuaagugaugcacaagguuaccaaggacggagcagaaacccgaauauagcuggugggaggagggcggcagcugggaggaggcagcugggaggagaaaguagguccucggaacaaaugagguagggcacggaauuaacgaggcuggaaagggcugagcucagggacucgcuuuuaaaaauuaucucuuagcaagaaaaaaagcgagggaaagaaauuuggacaugggaaaugaugaaggccgggaaggcagcucucuaaccggccucucguagaguaagggggagacacagaucaguggguuuggggugaccucagcuugucaggcaggacagacagaccuugacagacacagugcugggggcggggggcaauaacuagggcaaacuccuacccacaccugguaggcuucccauacuacagucuuugcgcuuagcccagugggucccaaccuuccugaugcugugacucuuuaauacagucccacauguuguggugacccccccaaccauaaaguuauuuuuggugauauuucauaacuguaauuuugcuacuguuaugaaucauuauguagauaucugauaugagaacccaaagggauugcagcccacagguugagaacugcuggcuugucuuuuuuuuuuuuuuuuuuaagauuuaucuuauuuuuaugagcacacuguagcuguccucagacacaccagaagagggcaucagaucccauuacagaugguugugagccauuauguaguugcugggaauugaacucaggaccuuuggaagagcagucagugcucuuaaccaccaagccaucucuccagccugggucuggcuuguuuuauucucaucuuuagcucuguacuuccugguuucuuuacuugggcuccuaccuuucuggcccucgucucucuagaagucuucauuggcaggcucagacuucacccugcugcuccuguccugaacauuuaguggucuugcgacucaccgggcuccuagcaugggcgcaugcgcucagaaacccagaugucuguacaaugggacguauccuagauaaccuuaaggguccuuucaccuggccacuuuauguuggaacggcagagagauggggcagccugcgcuacucccuggguaacuaguugcacccauucuugucucuuuagggagagcggaggccuuagguuccuuggggcccuguguguccuucuuugucucagggcagguagccuucaugcuguccuugcuauugguuuggggcugucuaggcacacggguucuguaguauuccuuucuggucugacccgggcccuggucuaauacugaagcucaguaguucucaaccuuccuaaggcugugacccuucaauacaguccuucauguugugaccucccccaccauaaaauuaauuucauugucacuucauaaauguaauuuggccacuguuaugaaucauaauguaaacaucuauauuuuccaguggucguaggugaccucuguggaauggucacuagaccccaaaggggggucacaacccacagguugagaacuauugcuguaguuagagggcgugcaugguggguggauaugugcgugugugugagcuacuugccuguaucugaccuguauuauagcuggugcugagacauucacuccuguccuggugugguuccauccuucacuggauggagaagggagggagaggaagaaaaugugggagguggagggagagguagacacuuuuuguucagauugaucuaccaggucccugcagcagaagggcucuuuuccugccucucccuuccacccaagaagaaaucccuuggcucucagccagaggucccgcaguugcuugggaggcaacucagaggguccaucuuagguugaaagagguagggauggaugggccugacuuugaacuuuaggguccugcucaucggauuguugcuaaaaaguacuuacuuguucacgagcauuuguuccgagagagugucacggaucucaggcugagggccucucgcuuuauucagguagaguccucagggacuagcccuucagcagcuggagcaccagcccaccaguggcuuuggacuguuuguauaaaccccuaaauaugucacucuaacucaccaccacuggggauggaugacagcucuggcuuugacccagagacuuagcguucucaggccagaggcuuuuugcuggaacuuggcgcuugcacgugcagccccuaagcucuuaagcuauugggucccuuggugcuuggcucuucgaagcucuuugggggcgggaacucccugucuuagcacuucacagccacucaccuuccucagucucagaaccccacccccauuucuuccagcagagugaggaagaaacagugggggguuucugcccguuggcuguguucauuuugcuguuacugaugauuuaaaaacacuccagggcagcaguucucaaucugugggucucgaccccacgaggagggcuggaaugaaccuuucacagggucacaucagauaucccucauaucagauauuuacauaacgauuuaacauaacaguagcaaacuuacaguuacaaagcagcagcgaaaauaacuuuaugguugggggucaucacaccaugaugccuuaaagggucacagcacucuaggucuugucuucucuuuaugaaccagcgcagccugcucuacccacgaugaaggucaucaaaaacaccagcaaacaucaaaaaccuuuuccugggccuagagucugcaacacugguacuggaguacuauauaggacagacaccuuccaggcuaaccccacaguuguggaaaccagcucauguaugugagugagugugugugugugugugugugugugugugugugugagaagaagggaggucucaugcuuguucauggauugugaucccaccgauuagagcccuguuugugugugcacccauggcuucgggugccaccguuccgagccucacaggaucaccgagcacagaguuuugacuggcucacucaaaagcuccccuccccucagugagaacagcuguaggaugaacagggucaccuagaugccaugaggguucgcagcugcccaggcuguuuggagcagucacgacucacucgagcggggacuuuauagcacagaaucugggauuucagagucuccugugagugaguauagauuggucacugaagcugagcugcugccaugacaggcugaagacagacuccugaccaacgugccugggcacaaaaggagaaucaggguuauacugagccaauugccugacucccaguagcuuuugacuguuacacuaaaggcccuugggauuguagcucaccucuaauccuaacaggaggcagaggcuggaggaucuaggaguucaaugccauccuuggcuccuuggcuauguggcaagcuugaggccagccugggcuacaugagacccaucucaggaaaaagaaagaaagaaagagagagagagagagagcgagagagagagaaaggaaggaaagcagcuuuaauaauggagcccagagauguagcuuuguuggcagagugcuugccccaaaaacccgugguuugacugcuagugcuguacaaagcagggaggggcaccccgcaauccuagugcuugagagauggggguaggagaaccaggaccaaggacauccuaagcuauacacugaguucacagucaaucugagaugcagaaaguaccaucucaggggagcaugauggcacauacuucuaaucucagcacuugggagucacaggccggccuggucuaauuaaugagcucuagguuagacaagacaauauagggagaccuuaucaaaaaacaaaacaaacaaucaaagcuccaaagauacugucucaaaaaggaaaaaaaaaauugcauacaagaacgaaucaguaaauuaucaugguuuuuguuuuuuguuguuuuguuuuguuuuagacagucucugucucucucugucuccccucccucucuguuaguguuuugagagacagcguuucucucuguagccuggcuguccuggaacucacagagauacacuugcuucugccucccgagugcugggauuaaagauguguucugccaccucccugaaacagcaucucuuguagcccaggcuggccccaaaaaucucuguguaggccaagaauaacaccaaauucucaauccccuuauucugccccccccaaauacugguguugcagauguaguaucaugucugccuuguuaaguuagcauccuuaccaguauuuagcaaugcuaaccccuaacuuuauguccucagagagggcuggcauguucugauguguuucagaagcagccugugagagucuuaggaaguagaggaauccuuagccauuaugaucuggguucaaaggcaugaagggcagaacucuauauccuauccuagagccaagcccaggagugaagggagagaauuagagccaaugagcuugccaucaagguuucaaagggcucuuacuuccuggggacuuggcuggagaugacccugucuccgacauuaggccuguguuuccugggacacaggauguugcauuuggaaaaaccuauuuggugucauagccuagugucuuagucaggauuucucuuccugcacaaaacauccugaccaagaauccaguuggggagaaaaggguuuauucagcuuacacuuccacauugcuguucaucacuaaaggaagucaggacaggaacucacccacggcagaaaccuggaggcaggagcugaugcagaggccauggagggugcugcuuacuggcuugcuuccccugccuugcucagccugcuuucuuauagaacccaggaacaccagucuagggaaagcaccacccacaaugggcugggcccucccccacugaucacuaauugagaaaauaucuuacagcuggaucucauggaggcauuuccuccagggaggcuccuuucucugugauaacuccagcuugugucaaguugacacacaaacccugccagcacaccuagaaucugagagucaccccuccugaacuuacuugaugagcgcuauccuccaggccugccuccugcagacgagacuugaagguccagaguggggagaggacucauucaaugucacacagcacaggggaagaacagaaaagacaagcuaggaccucucucuggagcuucuucagggcaguucc

SEQ ID NO: 5519 - RNA, 4577 nt, Mus musculus
accuuuaaucugggcuacaccuucugcuggagacaauauaaggacauuggaagaagggagucuagcucuugcucuugcuccuucgccugcuugcugcgugagacugaguaacugcuagauccuuggacuuccauucacagcugcgacugaacaauuguugggaauugggcugcugacuguaagucaucaauaaauuccuuuacuauuuagagacuauccauaaguucugugacucuagagaacccugacuaauacaaacacucucuucuuccuuccuuccuuccuucccuccuccucauucuccuccuucuccuucuucuucuccuccuccuuccucuuccuccuccucuucuuccucugccuccuccucugccuccuccuccuucuccuccuucuccuucuucuucuccuccuccuuccucuuccuccuccucuucuuccucugccuccuccucugccuccuccuccgccuccucuuccuccuucuccucugccuccuccuccuucucuuccuccuucuccuuuuucuucuuccccuccccccccuuuuugggaaagauuuauuuaugagugcucuaucugcauguacaccugggaacugaacucaggaccucugcaagagcagccagugcucuuaaccacuaagccaucucuccagacccuacuuuauucucuauuauacuuagguagugugugcacaugcgcaugugcagucccacagccggagaccagaggacaauguguagaagcugguucucucuuuccaccacagugaguuucagggaucaaacucgggcuuagcagcacgugccuuucuuuauccagcucucucugaugaccgugccugggacugucacuggcucuuauacaagacaguucucugacccaaacugccugcaucuucauuagaucgccugugccugcucauuaaagaucaucacaacuggaucuucaccugaaugucuagcauuccucuuaaccagcuguaugcaauucuuucuuaacugcacaugaucucaggaagggccuagaagauuuaggcuuggaagaggacucugggagaggucucuaucauucauauuggguuuggaucauccaauguaguugcuuuaaggccacucucacuccuucccauaaucccucucccauugcucugugugugagccuagcaaacucauugauucccagggugaccuuugaggggcuuuuaggcagaauugaaacuuaguuugucauugggaggguuggaggagggguggacacuuuucacaucucccccauagaaggaauuucagcuauaacugguagguuaggcaggauacacaaaacggagaugaauuugggaagagcugacgucaugcugccuaaggguagggugacugcugaggaaaauuugucauggcuucuugucccugugcagcauguggcaagugugacuuuuggggacuaguggcccuggcaugguaaaagcagaagguggugagauaagucacuaaggugaggccaccuaaguagggacugucuuggaggaaaucccuggaugucugacuucuagaugguauggaaugacaugucugugcuaggggaauagauagccauauucugagaacagaugaaggucuagaccacacauugcuagagucaugcagcugugguggcaauaccagcaagcagcugcagagguggccuggccguggaucugagaucaagguggcagccuggaggacuacaggcauguguggguggacgaggcaugcagugagagagacauguaacugacacccucaggguugguuucuaaucuaugggaugguuagauacaauagggagggagauggagguacugaccuggcccuucucaaagaugggaggacaaaggagaaagaaccccaaucaucucuguauuagugagcucuuccuagaaccccaaaaccuugagucagguaacaaagaggaagaaguaaaauagaggugucagaagacaacccuggaguccaagguuugauacagagaagggaaaaauaugacccggccaguagacacaggggacuuagcaacaguauaagacacccugcacagggaucuuagcaacagucaaugggagacacucuaguaaucagggaauagucuaaaauuucaaaaauuguuggaauuaaggaaaagcuuuaaacaagcaauaaagggccucucauagcauggcuugugaggccguggggucugggagccaucugagucgucagaagcagggauacugagugacguaaccacacaucugugcuggacacaggagcuguauagccugaggcaggacaagaggaaucgguccaugauggacuggcucauaggauucggcagagacccuugccgauggaccauggagguccccauagaugguguggcugucagaaaauagagggacaggagcugccgagggaacucgguauaagggaaacaguguauaaacuccaguucccgggaaaggccugcguucaucagaagucugaggaaggggucaguaaggacugccagguuugcaaugaguguuagcggcuuugugagacgagauuuuuauccaguagggaaggcuuuggaggcuugaaguggcuugauccaccguggaaagaaccuuguacaaggagagcagccuagagguaagagaggcaaagcagagacagagaucggccguggcuaguccaaggcagacgacaagacuuguguugaacccaaguuccuaaggggcgggggaggggacgacuagaaagccaaauuguuuuuaaggagcuuuggggagacuuuaaagccggaggaacaguucacagaaggcagccaugauaaaacaaugcagccgaagacgauuaagccugucccgagggugggaaauuaucaucuccacaccaggcuacguauuccuccugcaaaaggcugugcugggugugggccucccgggcagcuagaugugguggguggagaggccacagcuguaucuacagccauagugcuguccagcccagggccucucgggacccagguaaccagcagcgcagcagagccucauccuugccugggcguuguaggguagagcugcugugcaagucucgcuggguuccucuggcugagaaaccucggugcucuggaacacuaaagugaagaggcucagagagcuggggaguguggaaagcuaggucaguuucccauccacgccgcucuccccaacacugaucuguugaggaaggcauugauacaaacggaugaaucuuuuggugccauguuaagcccuagcuuugaccuuaguggagcaucuugguuuugaacuuccauaaucaccuggcaugugcuugaaacagaugacaacaagcuuucaaagugcuuccccaagguuuucuuuuuaaauuuaaaaaaaaaaaaagauuuauuuauuuuauguaugugaguacacuauagcuguacagaugguugugagccaucaugugguugcugggaacugaacucaggaccucugcuugcucgggccucgcuugcucuggcccaaagauuuauuuauuacuauauguaaguacacuguagcugucuucagacacaccagaagagggugucagaccucauuacggaugguugugagccaccaugugguugcugggauuugaacucaggccaagguuaucuuuguaaaccccccacccccaaacacacacuauuccuauuuguuaugggaauggcaggcucaguccugcccguccucuggaaagagaguuuguuauaaauggcauaaugugaccucugaguguuuggaagaucugagaggccauuugaaagacaggagugugugggaaagagugagcggugugugugugugugugugugugugugugugugugugugugagagagagagaguguaugugugugugauauguuuacagaggguacaaggccagguguagcuguagcguucgugggaauuuuaugguuggguaaaacacaggugccaacuggaagaauuuugcaccagucugggcccguaaaugcuaaagaguaaacaaggguaucuugugugcguggaaauaggugaucccagaaguuugcagagaauuccacuguuaggggagggucaauacaggcuguugucacuucuguuccagaaccaggugcugaggcccuaucggugaaggcaccacaugcgcgguuugcagaaggcugagaaauaaggcucaggcugggcuaaaagugucuccccacuucaagccggcucccauggugccugucagaaguugcuaugaagguugcuggauccgccacgcuucaagauggaaguaccaggaaagaugcaccagccuguguaauggugaugcgcguaugugcguguguguuacucauuuauagauagaaucaacuuuucgauuggacucagggagagccacaucaggugcuggggccuuagacaaaacccugugaccagggaagucauaggccccagcagggacacaaccgccacagcuguauuaagugauguggcggcuaagaugcuccccucugcgauuguguuugcuauuauaacgcuauuauaauggcuguuuauca

SEQ ID NO: 5520 - RNA, 5001 nt, Mus musculus
ggaucucugccccgcccccgcgguggccugcugcuugcccgcugcucucucccucgcugccgccaccugcuucccgcacuggacaugguaagcgcaggaagucugguggacccugagaggagaccaggaaguggggggcggggggugguguggagagacgacuagggcuccgaugcugggggcgcgggccacgcugagccuccugcagcgccauccagccgggcuagagucgccuggccucccuugggggcgguggcggugggccuggaaaccuagccugucccaacucccaggccuagucugcuggcgggguguggcagcaaggcaagucuccguggcgcugccuggcccuacaggcuugccagauuggggugggggugggggugguguucaguucucucugcacccagugcugucccuggccuuaagccccgcccuaacaccuagauagggugcugugucccaccuuggcgugguggugggucaggaucuuagguaggucccuaggaaaggagccccuagaccucccugcaacccuuaccaaauagcgugguucggguucucuguacucgaucagggauaggaggguguuuuggcagcugaggccugggaagagucauugggcccaaagacaccacaggcuuggauaaucaguaaucgcucagcccacacuaacaagcugacagagcuucccuaagcaaauaaggcccuuaccccucugaccugaguucagagcauugucagccugaaaguugguucuggaaaauucuaaagaguggagcccuguugauaccuggcugccugguuacaagugucccgcuuaucacccacugaagggucaaugcuggaagucccccacccccuucauuaaccacagagcagaucucugcacugagcuggagccccuuguuucugagagcacacacacacugguguugguucuguaggccccacugcuggccugagaacugucacagauguucuuguucuaggaaguguugguuuuuuguuuuuuuuuuuuuuuuuaaugaagcugacuuucacuugauaaccuugcuacugaaguauuuccacuggcaucucuuggucuaaggagugggucucaucccuucacucaugaagccaaagggccauuucgauacccaccccaggguauggaaacgauggguggcuugcaggacacaguucaccuuccuccugcuccccaagccaaauuugaguccuugucaguugaacacuguaucccugggugauucucuuucacaauccuagcuuguuagacucagggccccacguuccucuagaggacagaacagacacuaacuucuguuuuccagggguccacucaggaccugaccugguaugugcugggggaucacaccgugggcacuuuguauaacaggguaaugagcaugccaggugcccuugacagacuacuuccauuuugagucugggcccugugguccuagguuccuaagacagccacccugagagccucacccugacagcuguggacuauacaggggcgaggaggagguggcagagacucaucugggaauggguuugaauggguuucugcaucccaccccagggcuauagcucuaagagaccacaccuugagucaguucauuccugacugaggaugacuggccggaagagcagagcacucacauccccuuugucuaggccuguuucuccucuagaacaccugaacauugcagaauggguguggggauggagcauagagagggaaugcagaaaaauggggaugccaggaagaacauguaauguguucgaauugggcugaauuuugcucuaaccaccuuggggacuccauggugugcugucuuggaaagaugaaggcaggcaagcaucugugaggcucugggagcaagagaugggggaacacuucaccacaacacauucucuuuggcauucucuaugaaagcagguaaaaaccccaagaucugggcugcagauucggccuaguuugugaagugcuuucaaugggaguucuccuucccagaaaccacauuuaaaacacuggcgugauagugugugcuuguaaugcuagcacuggggaggcauagacagauggaucucugaggcucuguggccagccagcauaaccuacuuggugagagaccauguccaaaaaaaaucaaaugggguuggaaauuuguucagagguugagaacacuggcuccuauucuaaaggaccuggaccugacucucaacacuaucguggcaguucaugacugccuguggcuccaguucuaagguauccaacacucucuucuggccucugcagggaccagagacauggguggugcacagacuucugugacgacggcaaaacacucauauacauaaaauuaaaaaauuaaauuaaaauaaugauaaaugauauccaaacaauaacaucugagguuguccuuuggcuuccacaugcacacaugcccauacuugaaccuacccacacaaacacauauaccaaaacgaacaaaacacaaaaacacaaaacuaaaaaaauacaggacccagagucuaucaguaaacggcccagaccccaccuccuggcagggcucuucucuggaaacauaaaggccugcugcuugcuauaaggggcaccugaauccacagcagccagcacugaaguccucccaaaggucugaggcacacucuugaccuauaaauggaaugcccuggggccucucuauccucccucuccuaggccggcaaggcacacaggcugagcgccgaggagcgagaccagcugcugccaaaccugagggcugugggguggaaugaaguagaaggccgagaugcuaucuucaagcaguuccauuuuaaagacuucaacaggguauguggagcaggccugagugggcuacacucuguguguucaugucauguccuguuagccaaggggaaagacauacucaagugaccugcagagaggagaagggacuugaacccucccuucuggaacucagagucauuggaggagacagucuugguagcaaguaucugcccuuuugaaggcacuuuaauaagcggcaaagaauuggcaaauacugacagccugugcuguguggaccacacuagggaugcuagacacuggcacaggcaucaggaccagggacaggauguuauggggguggggacuaggguguguuagagcucuggcauucccuggaaaaagcuaggcuaucccuacugcuucgaggccuuauuggccaugacccauuggcucuuucuucuuucuuaucaggcuuuuggcuucaugacaagaguagcccugcaggcugaaaagcuggaccaccaucccgagugguuuaacguguacaacaaggugaguggcguuguccccggguugugcccugcucuguacaucucuuagaaccccaagucuccccaaagguucacccuuggacuguagguccuuccucaccaauaagucgauguucaccucuucugucuccaaccuagaaccaacagagacucuucacaaaaacagccagucucacuggagauaauaaaugcaaauuaaaacacuuuaaaaugcuguugucagcuauuaagaaggcaagacucaggaagggaaggauaugcccucuguuaacagcacuacuggcuuuauucuagacggaagaacgagaaaacaauaaaacuaaacucagauacccaugcauggugggcagaucagacugugaugagcaugcuaacugcuugacuguuuaggaaaaagugaaggauguguuuaggagcccaccuuaaguucugacuuuaacuuggcuuaaaauuuuuuuuaaagaauuauuuauuuuauguauaugaguauacggaaacugucuucagacacucuagaagagggcaucagaucccauuacagaugguugugagccaccaugugguugcugggaaaugaacucaggaccucuggaagagcagucaguguucuuaaccacugagccaucucuccagcccccuaaaaaaauuuuuuuuacauuuauuuaaauguaaauaugggcacauauaggcugugcaugagggagucuguucucuccuucuauccuggagguugaauucagguugucaagucuguugguaaaugucuuuucucacugaaccaacuugcuggccccuggcuuaaaguuuuuguuguuguuuuuuguuuuguuuucucuugcuaucuggauuugaauuuuuuauccuacuacugagaucaucacgauuuuuggaaacuaugaacaugauguguaagcagcuuugcaccuaucucagugcaauuaggaaagcaaugaccagcuacugucuugggcaauucuaguguccaguuccuugucaccagaaggaauuauagugacuggcuaacuaucaugcagucccugguagagcugagcccauagcugguggcucuccagcucuuccugggaggguacuaccccugaauuuccaguuuucucuuauucagguccauaucaccuugagcacccaugaaugugccggucuuucggaacgggauauaaaccuggccagcuucaucgaacaagucgccgugucuaugacauagaucuacccugacucuuauuugcuugggggaaggagugacuggaggaggaaccuaggaagggaaccaaggaggcuggcccuugcucccugacucuuucagugaccaccaccucccuaugcagaagggaugucaaugucaacagcagggacugagaccuuucucugugccacucuccucacuggggcucugccauguuacacuaauuugaauaagcucucccuuuuucuguagaguucccagccucaguaauguuccaggcugcuucuuguuccuuuucuacccuuucuaguucauuuuccaagguagcugugauaaagcaugacauaaaagcccaauucagauccuacuaauaaaacaagcuccaauguauuauggaaacaugugcuuuuacgccuccaauaaaacuauguuaucgaugggcucag

SEQ ID NO: 5521 - RNA, 49065 nt, Mus musculus
cauuuccgggaggggcggggccgggggcggcgcaccuccaaucucugcggcggcggcggaagggggaacccgggucccguggccagcgagugagucgcucgcagaaccgaggcgcgugaggugggcggcggccagcggagccucugcggggaaagaaggagccggguccacagccugaggagguggagcugccgcggcgggcuggacccggcgggagcaguggggagccgagaggagcuggagggauccgggcccgggcugaggggagaggagggaggccgagcugugguuggggagccgagagggaauuggguuguggggagcugcgcggagggaaccgggcuguggggagcugcgcugagggaggcaggucugugguucauggagagcugggcugaggggagcgcggcugaggaaagcagggcccgagcugagagggagccgggcugagggagagcugggcugaggggagcgcggcugaggaaagcggggcccgagcugagagggagccgggcugagggagagcugggcugaggggagcggggcccgggcugagggggagcagggaccgggcugaggggagcaaggguucaggcugagaggguccugggcugaggggagcggggcccgagcugagagggagccgggcugagggagagccgggcugagggaagcggugcccgggcugagggaagcagggcucaggcugaaagggagugggcugagaggaagcugagcugaggggugcagguccguggcacagggagaggugggaugagggaagcggggcccagacugaggggagcagcgccugggcugagggggagccgggcugagaaggagcaaacugaggggugcgggccccagacugaggggagcagggucggggcugcggggucggggcugaggggagcggggcccaggcugaggggagcagggcccaggcugagaggguccugggcuuaagggagucaggcuaagagggggcgggcugaggggagccgggccuggucugagggggcuggguccgggcugauggggagccgagcugcgggguguggguucccgacugcuguggggcgucggagagacccaggcucgagucuguggccggggcugaguaguggcgccaggcuacaggggcgcgggggaaaggcaggccgggcuggaggagucccgggucccgcugugccgagaggcggcggcgcugccgugggcccggggaaggggcguguccccgcgugcacgccgcgggcuccacugcuccggggugccggggucggcuggagcgcugccaaagccggcagggggaucccgcggaggggcagcgccggccgggcugccgaguaaacagcugcguuuccccuuugcagacgcagaggcagggcagccccggggagggagccggcugcagaggaagaugcccggaaccgaccuccucaagcuggugagucggauccuuucucucucgcucagaaggcucugagucaugggaccgcuuccccuccgaugccuugcuuuugcucaaagcucagcauucgcugccacuuuuuucuuuuuguuuuguuugcuuuggaaacuggcgugaaugcucggggugaauaaauggaugaauacgguggaugcagaacuuagaaauucccugaggaucuuucuacagcccuugcucacggcuuuucucucuuucuucuccuaccacuagagcaauugcuuuuguuuuguuucugaaacaauggcugccucuggaacucaggguggccuggaacuuagcagguacacuuggccuugaacuuuuagucauuucccucuaccuccuagugcugggauuuuuuuguuuguuuguuuggguucuuuugguugguucuuggagauggagggcucauuauguaguccaggcuagccuguaacuugcuauguagaucaggcuggccuagaauucuaagaggguugcuugccucugccuccugagugcugggauuaaugagcuuguuuucuuuuugaggcagaagcucuuaguguagccuaggauggccuugaacuagcaauccuucaaccuucucagugcaccaucaugcugggcucuuggagacagcauaucacuacaggaugucugagaacaccuuaggaagcuggagcugaccuugaagucuguauagugcagaugaaagacaggaauacuugcuuagucuucacagccuaaugaaaagucuacugaaaauagauucuugucccaaauuuuaugaauucucaguagguaauagccuuauuaacuucaaauuuuuauuacaagagaauuacguuuaaaacuguuagaaacuaaauaaaaagaaucuaaucucuucaucccccuucaccuccuccuugcaacaauagauuaccaagagacaauugcuguuggcauauugggugguuaauggagaacaguuagaacaguucuuacaaugagaaguuguuggcuuuccucuaauauaucuggacgugaauguaaaugcugaguucccauacagaaguagaguauuucuuccuuuaaggacuuuguauuuauuuggaguaggguuaauaaacuuuuaagucugauuaggacuugcauucauuuaguauauuuggaaugcuuuuuguucugaguuauuucucuugcucucaucauauccauugaugacuuccugguacuguagaauggagauuuuguucaacuuauugcaauaaggaauugauuccuuaaaaaagaccaaaccuagguuuucauaguacauuuuuauuaugaucugaguucaagguucucuuucugcuuuuuuuuuuuuuuuuuuuugguuuuucaagacaggguuuuucuguguaacccuggcuguucuggaacucacuuuguagaccaggcuggccuugaacucagaaauccgccugccucugccucccaagugcugggauuacucuuucugcuuuuuaugauauauaaaacuguugugccaauuggguaaaaaaggaccuaagaaagugaaaaaaaaaaaaaaaacagccacaguacaggaaaaauauuuuauaauuuaaaaagaaaaauauguguguggguguucguucagugucuuacaugcuaggcaagugcuauacuuaaauccucuucacuucuuuuaauauuguauuuugagacaggaucuuacugucuuagguaggcuuugaacuuagaauuguccugcucaccaggcccuaauuguuucuuaaaagucauacagagaauuuaauauuguacaugagucuaguuauuuauccuuuauguuagcagaauaagguaaacaguagguaggaaaucaguaugaggugaaugcuagaauaauaguauaguucuuauaagucacaucaagaauguauuagaugcagaaagagauagucuacauacuuacuaaauuuuuaccaaaagcuuugauaaauaugcugacauucuccaauaauaaaugaaaaacuagacucuuguugagucccacagcaguuaacuaacaaaguaguuuuaucuuaaguggaauauugagaagaucuccuucuuuuuuuuuuaauauuuauuuacuuauuauauguaaguacacuguagcugucuucagacacuccagaagagggcaucagauuugaacucagguugcucggauuugaacucaggaccuuuggaagggcaguuggcgcucuuaaccgcugagccaucucuccagcccgaagaucuccuucuuucaccuuuguaauacugccuuuggaacaaaucucugauagguagagguuauugaucauugugacugacaguggaagguuuaggaagaacagaaauuauaaucauuuggggagugcacuuuggaaaugcauauggggaaagauucuugucuccuuguaucaucaugccuuaaagucccugauguauuacccaaucuuauguuccuuuauauugcaguuaaagcauugcaguuuggaacuuuguaccuuauacguauaaugucaaaauguugaacagccuuacauguaaagggauuagugagugauagggcugaaaaccacugugugaacagaaguuggagagaaggugugaagcucaccuagagucugcauguaaucaaggagcuugagcuuuguguguuccugucucaguuuugucugucugcuuagggugguuuacuugucuuuuuccauuuagucacgugacaugucaugggacuguaacacuuuccaucuaugucucagggagaauaaaugagcauguuccucuacagaggcuaucucaagagagaaugcaaguuaagcaauuuuguagcaggcuuucuuaacucuggcaacauuuucauccauguucucaguuucaccuaaugauaaucaccuugggaguugucaaaaggaaaauuuacuucauaaagccaguauauuucauagguaucuuuugaggaauaaguuuguagguauucuagguaagacaagcuuaccuuauuuugaugguaauuguuuauuuagguaaguucuuaaccaaggcaguuuugcuucugaggaacuuuugaugaccuuggcugcuaacaucuacuagauuaaagccaggaauaaaaucaaguauccaguaaugaccaggaccuucccaacuaagggugugucauagaauaucugcaguccggagguugaaaaccccaguugcaggucucuaauacggcugacugcucaucugcaggcuuuauuucccuaugaguaggggagugagcaagcuucuugcaauguugcuuagguuauuuuggccaugacucaagccuuguuaucuugggauguaucugggugaaucuauaguacacaaucaucugcaggagaacagauuccugaagaaauuaaugcuuuccugcucaacauuucugggacacuuuuugaagucaagcugccaucaguuuuaaaaacaaagaauaauaauaaaauaaaaucuuggggcuggagagguuacuuagugauaaguucuagcugcuacuccagaagacccagguuugauuuccacgugggggcuaacaacuauacuuucaguucuagcagauucaauguauucugaccucuucugcacuaggcauguaacuggugcacagacauauaugcaggcaaaauacucaucauauuaacaaaaaaaaaaucaaaucuuuccaggucuuugaacuugauucaugaccuuugacuuuuaaaaaauuauuuuuauuauuuugcaucuuuauuuuauguguuuggauguuuugcuucgugcaguaaaacagaggccagaaagcuucaaauucuuuguaacuggaguuacagauaaccaucugagcuaccaugugagugcugguaauuaacccaggucuucuagacaagcaaccauugcucuuaaccacugagcccucucuucagcccuguccuuuguguuugucugucugucugucucucucucugggauacuuucuuucugaaucucaaauggaguuuaagaauaaauugagauugacacaaaaaguuauuuuuauuauuugagccagguuucuugauuguaggguuaauuggaagaaagggaaauuucauuugauacagcacuuaaaauugugugggcacccuggagaaaauuguagaguagguacgguugguuuuuuuauauuguuccagucuuauucuuaauaauuuauaaagccuuuagucuaaagaaaagggagauuauaaauagauaagcuacaaaccccaaauuuggcuuaguuugcauucuaugugccaguaauuuuuaguaacauuugccuucuuaauuaauagacauuacuauuacauauaguuuguacacauagguggcagaauuuagaaccagccugggguuaagaauuuuccauggggaguugauuuguagugaaucagucuucauguauaaauacacagagucuaauuacugagagaaaagcccauguuguaaauggcauagugaaggccaauaauacagcuuuaucagucaucugcacauucaagauguauguuuugaguguuucagggacuguucaccaaggcagggcaggauuaaaaccaauggggagccaugagcggugguacauacuagucagguugaugguacaggguucucuagaggaacagaagagauagaaucaaugaaucuguguauguauguauguauacauacauauguaccuacuuaccuaccuacauaucuauauaaagaggggaucuauaugaguuccuuacagauugugguucagcuauuucaacaguggcugucuccugacaaagucuaagaauccaguaguugcucaguucaugaggcuagaugucucagcuggucuucaguaugcacuggagucccaaagaccuagguucuaaaaccagugaagcaaugacucagcagcaggauauaugaacuugccagggagaaugagggcaagcaggugaaaggcaaaagcuucuuucuuuauauaagcuuguccuuuauauaagccuauauaaagcuuauauaagccacaccaugagaagguguggcccagauuuaaaggugggucuuccaacuucaaaugauuuggucaagaaaaaugccguacagguaugcccaggugcuuggauuuuuaguuaauuccagaugcagucagguugacaaccaagaguaggcaucccaccuaucaucccaaauucaggauaguucagcuauccucccagucccaaaggcuguacaaauugcucuuagcaauuguacaguaaauucuauauguauaaauacauauguaacaauccuuaccuccuagaucaaaacaaaaagaauuccuaguacuccagcaggucucaugucccuccacuccuaguccagguucauuaaagguaguuauuccucucacuuuagauuuacuauuguugauuuucagaauuuuaaguggaaacauauauuauuuugugaguagccuauuuguucaguguuuuguaucuuaauguuuucuuguuacuguauauuauuacaguguauaacuaaugcaguuuauucaguuuauaguugauaaacauuuaugucucuuguguuuggguggaaugaaugacauuguuacuuuuuuuuguuuguuuguuuguuuuugagacagggucucucuguauagcccuggcuguccuggaacucacuuuguagaccaggcuggccucaaucugccugccucugucucccaagugcugggauuaaaggcaugcauuguuacaaucuugaacuugucucuuuguaagcaucaaacuuugucaaaauauauaguaccaaauuuguauauuaaauuuaaacaaauuuacacuuacauaguguuuccuuuguuucucuuuuguuuuuaaugucuaugcuucuuuuucuuuuucauguaguuaaggcuagccucaagcuucauucauacuuaggacuggcuuugaacuccauauuguccuuucuuuucuuucuuuuucacaagugcuggaguuacaggcauguaucacucuccccuaacuuuuuuuguaguuuugagacagagccuuccuuacacugcagcacuagaugaccuuaaacucacacccugagugcugggguugcacauggauaucacugccugcugcuuaauucauuuuuguuuucugagguuuugucaccucuguuuguagcugaggaugaccuuaacuuccauucuuccuguucccaccuccagaggacugagauuacaggcaugccucaaccacacccaauuuauguggugcugagaauugaacccaaagccucaggaauagguagccauucuaucagcugagcuacauccucaaccuuuaauuucuuucucuuuacuucugagguagaguaucgcugugaaucuaagguuucuuugaauuccuuguauuugcaaccagagugacuauucacuggacauucuuuuuuaaagcauguaaagucauuguuuuauuugacagguaggucuaaaaguagaacagaucaauugaucauugaguuucagucuuaauggcuccuagguuuaaaagcauuagaagcaaaaaauuguuuucaaauucuaauggaggaaucuagggcaaagaugccauggaagagcuggucuuuauuuaguauuuuguuguuguuuuuuuguuaagaguagaagaaaaccugugauuauuuugcucaguccuuuuuaaaaguguuuuuacacacuuucccagaaucuguuuggcugucagaaacauacagguuuaugaucugcaagcacaguagcuagcugauuuaguucuauuugcugguaggucaaagggcacuugcagcuuucugauugauuuauuugauacugaagguuaaaaauuguugcaauguauuucuuaccaaaccaggacauauguuuauuaaaguauauucuauuuucacccucuguaagaaaaauauaauguuaagcauagaaauuaagcuacuuaaggucuuucccagcuccuaaccuuuuucaugaucucugcaaaggcuguuuuauguugcuguuuuugaagaagaaaaaauuaacagcagauaauucauuugucaaacauuaaguaaguguugauuaucaguagugauucauuaugaauuuauuuuauuuuauuuuuguuuuugacacaggaucuuaacucaguaguuguggcuggaacucccucugcagccccaacuggucuggaacucaaaaacauuccuguuuuagcuucccaagagcugguauuauagguguaaagcaccaugcccagcuucuacagugacuaaaguguguguguguaugugugugaaaacaauguuguggagucugguuucuccuuauagcuuuauguggauucuagggauugaacccagaucaccaaguugucuuggcaaauaaaugccuuucucuaccugcugagccaucuugcuggccuuuaauuuuaucuuuuuccuuuuaauaguauuuaauguucacagaaacccugugcaaaggcaguagcuuuuuuuuuuuuuuuuuuuugguuucuugguuucuugguuacaggguuucucuguauaacccuggcuguccuggaacucacucuguagaccaggcuguccuggaacucagaaaucugccugccucugcaugccuggccuuuuauuuuucuuuuaaaaaauuuuuauggugacucaccugauaaauaaacaaacacacaaauaauaauuuauuuuguuuuuauuuaaagggggaugauuuugguauauaacuccagcuggccuguaacuugcuauguagaccaggcuggccucaaaacucacagagaucuaccugcuucugccuccugagugcuggauuaaaagugugugcugucacacccggcucacuaaauggauuuuuaaaucagaaaaguacccuugccagaaauuuaccuguucuuugagucuauuuauccagaaugggaguaggggaggagauuuuccaguuuguauuuuauuuuaauguauuuuuuuucuuagcugugugcuuuaguaaaaaaaggugaaagcaugauucacauccaaauacuaaaaugaacauacuaaaaacguuuggccauaauagggaaacuugucacuuauaauuaauuuaaaagagaaauccaaaaauuauauacauuucuauagcagagauauugaaaaugagccagcccaguguaguagcacgcaccuguaaucccagcaauugggagguugauggaacaggauuucugugaguuugagcccagccuggacuucauauuaaguaacaggucagucaagaaacacauaaucguaagucugucucaaaacaaaggaaaacaaaaaaacuaagaaaagaaaaugugcaaguggaggugagacuaguuucugcaaguggggauaaaaguuagaacuuuuauugaaccuugaugaacuuuguuguuuguguaugaaaauuuguuugccugucuaucaauuaucuacagguuagagagcuguaauguuaccauaaggucagaagcuguaacccagaaggugaccuagauaauacuggcuuuccauuggaagcaaacauuucccuguuugcuuuucacagauuauuaaaauacucgaaauccugugagauguuacuuuuagacugacuucucucacugcuuauuuccauuuuaagauuggaugguagacuuuccaaaggauguuuguacagagcaagauucagucccuguuuuguucuugugaacaggaucgacaaaaguccucagugacuuagugacucuguuagguuguguauauuaaaauucugcucuaauacuagcauucuuauuguaagggaaagacuuccacaaauaguuaaaauuuuagaaugucagggcuggagaaauggcucagcaguuaagagcauaugcccuuuuuuuuuaggggacccaaguuggguuuccagcacacacaucagguggcucacaacuaccuguaucuagcucuaguuagaucugaugcuucuagccucugcaggcacuuguguucaugugaauaaucccacacagacauacacauguucacauaauuaaaaauaaaaauaagucuuuguucugggcuucuuaauucaaugguaaaucuaguuugguaauuauauuuaucuaauuuaugaucuucagucauaauauacucaaagaaaucaaaacuuuuaugaagaauauaacauuuuaauggaucuuacuuauucaguaaguuaauauuucuaguuuuuaaagaugucuuacuucccuacuacagugauaagacaauauaacuuucagaagaguuuacugggggcuuacaguucagaggauaagucugaccaucagagcaguaagccggcaggcauggcauugaagcaguagcugagaguuuauauuugauccacaaagugagaggcagcuaaguagaaauggugugggcuuuugaaacuucaaaccuaguuacauacuuccuccaacaaggccauaccuccuaaucuucucaaacuggggacaaagaacucaaauaugagccuguggggcuaauucucauucaaacucucacaaaaggcuaauauacuuccuuuauauuuugaaaggcagccuggcugggucugaacagcaagucauuuaauuaugauaaaauaguucagaacacauuuaauaacacauugguggaagcuugcauaggcuaagaguauuuccuguguguguguguguauguguauguguauguguauguguguguguguguguauauauauauauauaugcauauauauauauauauauauauauauauauauauacacauacaugcauauauaugugugugugugagaaauguauaaauaggaaugugauauauauauuuauauauuuggggaccuuuuuugaaauagggucugacuguauagccuaggcugccucaaccugagugugccucuauaccuggcuccuuaauauucuucugccucugugccucucacuuguggaucagauauaagcucuuagcuacuccuucaaugccaugccugcuugccuacuuccauguuccucuuacugccauguuacccaccauggugaucauagacucacccucugaacuguaagccccaauacaacauuucuaagcauuuauuuugcuaauugcauuuaguugcaugcuuuuuuccuucuaaucuauuuagaaauguacccuauaguacuuuuaaagauuuauuuuuauuuuuaaaauuauauguguaaguauggguaugaacaaaugaaugaguccagugcguguggaaaccagaggcgugggauccccuuaaagcuggaguuacaggcugggagucaaacuugggcccucugcaagagcaguucuuaacugccagucucuugccagccccuguaguaccuuuuugauguauuuccuaagagagacacucagaauuguuacuuuaauuaagcaucuugucuuuauuugacacuuugucuugauugcacacacaugcacaguaaaaguaccauaccaaaaguaccuuauaguacuuuggcuugucuacuuugugagauucuuaaaaggcuuuacuacuguuccaugaguguaugcccagaggcuugugaauauugcauuucuccuccuuccuguggccaggguuguuuguuaucucaguggcugaggaugugcuuugcauaauaccucagggcugcaaguagaauaauuaaacugaaguaaugcugggcauacaguuuaacguauaauggguggccacggagcaccuguggaccuguaagcuuucugagauaacucucagguacuaaucaucuugacucugccguggaaguuuaggggaaguguacaguuugcucuugauggagccugucucuucuguaucacagcuaguuugguugcaauggcuguuugguuuguugcucaauucucacuucuucuuuaaugaccccagagaguuuuuccuuugggcuugugaucugcuuuugcugauuaacucugcugccuuuugaggcuccuagagauauuuuuuuucuuuuacauguuuacuuugugcuuugaaguuuuauagaaagugauauguaagagaaucagauucugggucuuaauuauagaacucucucaguaggugaucuggguaaaacagguuuuucauuuucuuggaaguuaauuucugcucuaaagcucagauuuguuuuggguuuguuguuguuugguggugggggagaggugcaaaacaaauggagcugaaugggaagaggaaaugaauacuuuuccuaccaaaaguuagccaacuuucccucgccuccccccaccccccauuggaaugugugagaaacaggaccuucacuuuguaauaacaaauucaccauacugaugaaaacaguaguuuuuuuuguuauuuuguuuguuuguuugcuuguuugguuuuugagacaugguuucacucagagugaaacaguuuuugguuuuauuuguuuuuguuuuguuuuuuguuuguuuggcugguuagauuuuguuuauuuucuagacaggguuucucuguguagcccuagucauccugaagcucuuuguagaccaggcuggccucaaacucacagagauucaccugccucugccuucugagugcugggguuaaaggugugcaccaucaucaccaccuagugagaaauacuuuuuaaauacacaauucuguagaaaaggaugccagcauagagaaagaugaaaaugacuagaauggugauuugguucaagguuugggcuuguuuuucuuuuuucuuuuuuuucuuuuucuuuucagaaacaaugguaacucaaucucugggugcaacaacuaaaaccuaaucuuauaaaccuuauuaaaaaucugauuacucugaucucuaauccucgcggauccaccaagauacuugggaaacucuagcagcuacaucuuacccuuacucuauacccauuccaaaagggccugacucuuucugcuuccucuuuuccuccgucuaaccuggaagucccuccuacucacccuguuacuggcuucuuuauucauuaugggauugguucacaaaaagccacuugaguacaugacucauaccucauuccagacuaucucucccgggagagcagaauuaacauaaaaauacaggcagcacagagccauccacaacauuuccccauuucuguucuaauaaaaaaacuaaaccuuucucuuaauguagagcacaacuauuaccauuuuguaauuuauaaaguauagauaaaccuagcacucaguccaucgauuuugucacuaagaauauugucaucuauccuaaauuaaaagacuuaucauuuaaggcuacaccuaacucauguucuggcuuuagauuguaagcaaucugaaaaccauccucucgaaucuauaucaucuuucuuaaugcuaaacagcuuagguuggcuaugacuagucuucaacccugacagaaauccaagaacaaguaauauuacugguauuagaagcgcaaaauauaacuuccaaaaguuagccaguuauagagagugcugaucaccuggacagucccuauacuucaaaacauuggagcuucagucuucagccuucuggcccaggaucaucugacagaccuuuguaaugcagaauuuugaaaggcugagauuaucaguagaauguguccuuuuucuggacaguauuuugucuguagaugaaaugaggcaguucuugccuaguggcugucucaccacaacuggaacaacaccacugaugcucaauuucuucuuuggauccaagaaagggaaugcugucaggagcagacaugucucaacaagugaauaaauaacauuaagugucacaaucuguggauuucugacauucuuuuaaaaaaaaaaaaagaguuauuuauuuauuuaaugcauacacuguagcugucuucagacauaccagaagagggcaucuaaucucauggaugguugugagccaccaugugguugcugggauuugaacucaggaccucuagaagaguagucaaugcucuuaaccgcugagccaucucucuagcccagauuucugacaguuuugaaaaccaacuaucuauguaaaguaaucuggacuguucuccauuaacuacucucagcuauuucuaguuaaaaaucucuaaaaacaaccuaacaaaaaacucagagccaugaauuuucuguuuggcccuuaacucacaggcuuaaucaucucagaucaguuuauaauaacaguaauagaaggacuggaucuaagcccuauacuuuuaaauuuuuaguaucaauagaagaaauuuauaccaaugaaaccuugauuuuugcaucaaaauaaauucuuuaccaagauaagaaacuaugacuucaacuuaguaacaauuaaaagauuucuaccacaugagauuauggugaugcaaucaauucuaucucucccuuucuguuccaauuaugaccauuucuacauuccccagaaagacaaccuauaauaaccaccuccagccccaaagccuagggaacugggccgaugacucuucauaacuucuucaagcugaauaugggcgaugagauauuuugaagggguaggagaaaggguagggaaaauaggauaguugguuggccuuaagaaggccacaccaacaauucuauuagucucugaugucuauguccugacuggauccagcugaaaguccaagacaucaggaguucaggcagguuagcucagcaugucugaggagacucaccaaggcuguauauucuguaauauacaaaucucaaaacauuuuagugucaucaagauaacuuuuuuguucgauucucuguaaucuaguucuucaaggagucucccucuaucaaaucugauccauauuacugugaaagguguauagauacacuaaucaccuuuucuaaaaacgcaaagacaaaaccuuucuccuaauucagcauaucuuugagccaguaaccagaaaaaccuuuauuuugaccucucccagaggaauaauagaaccacaaaacucaacaucauacccauuuuaaaaguuaaaacaauccaaaacaaauugaaguaaacuaaaauacuguaugugccuauucuuaggccuuuucuauuuugucaugcaggauaauaacccaaaauuccuguggaguccacauuagacaauuugaguauccuguaagacguaguagagcaauauaucuuuauacccuuuuacuguuuggcucucugccuagagcagccaucuuguuauaccauguaucuguugaucucucuaccuggagucacagacaugaauaauuaacaccugauccaagcagacaaugauuagcacugcacucucuacucuggagucagugacuaauuuuccuaucuuaguucugaaccacaggugaaauucuccauguugauugagacagaaucuguauauaaaucuacccuaaaagcaaauaaucucaaauuuaaauucacaguucaaucccucugcccuaaaaaguaggcaacuucauuuuuuuuaagacuuauuuauuuauuuuauguauaugaguacacuguggcuguacagaugguugugagucaucaugugguuguagggaauugaacucaggaccacugcuugcuucaagcccucucgcuccagcccaaagauuuauuuauuauaaguacacuguagcuguccacacuguagcuguccucagucacaccagaagagggcgucagaucucauugcggaugguuguugggauuugaacucaggaccuucggaagggcagucagugcucuuaaccacuagucaucucucuagccugagccaucucuccagguggcaacuucauuucuuucucucccccacccccucuguaauuccccacagcaggggaucucagggcugcuagcaguuucuuuguuucaaaguugauuaaguccaggugacugguuuuagcauuacccaguuacucucuuuaaaaacaaacaaacaaacaaacaaacaacaaaaccacucuuaacucucaggcuaacaaucuuaaauuucuaguggauacuugcccaauaagcugguucaccaucuguugggggaaauauuaagaagcacuugugccucugccccgaugggcaggcugcccaugcacuggugggcaauggcugaccuguuuuuauuucguggagacucuugacucauaacucuacaaucucuccacccagcucgcuagguucccacuguugagucacuaccacaccagcccugugcuucaaauccuccauggccuuuguggugcacaucaggcaaacucaggcuuugacaccuuuaccuuucucucuugaacccagaugagccaccaugugaaggaaaacacaacacaaacuuaguucagaaacaaugguaacucaaucucuaggcgcagcaacuaaaaccuaaucuuguagaucuuauaauaaaauaugauuacuccaggcaagaauccucguggaucuaccauauaccaggaaacucuaacagcuacaucuuacccuuccaaaagggccuuuguuuugcuuuguuguuguuguucuccuccuccuccuuguccuccucuuuuuucuucuuccuucucuucuuccuccucuacucucuuccucuggccuugaacucaagagauccacaugcgucugccucugaguacuaggauuaaagcacuaggauuaaaaccacccagcagugguuuuuaaagucccccauugugagaaauuuuuuugccuucuuuuuccuauaggcugguauuucgaagaguuaacagccuucacauucuucuaguauaggcugcucucuaaauuucccauccuuuaggaugcaaagccucaucuaauuuucuaagcacuaucuucucuggcuggacagucaguaaagaaaucuuaaguucugaggaagcugccaaaggggagagaggggccuaacaccuuggcuaucugugccuuuuucauaagaugagcacuaaguauacuauguacuaaaaaugggugguaaugauuuauuucuugccaagggaauaguaguuuuucuuauguuaguguuuauacuuagggcuuuauguaugcuaaggcaagggcucugucacuucuaucccuuucuuugcaggauuucaaaguagaagauucaaauuuucucuaguaucuguccaaggaguaaauauuaggaacauuugaucuaguugaccugauggauaugaccugguggauuaauauggcagauuuagcacuucuugaggaagcuuggugaauuuacuuuccuuccuucucaagagcuggauaauugggucucaguaauauaaguggguuguuggcuauuucccuaaaaagaaagagauggggaaaggguccuccaguucuccuuaccccuccuuuguacuaggaauugaaccuagggcuagucaaguguucuacuugacuuaacuacagucucagcucucucaccuuucuguuuuuauuaauuuauuuugagacggaguucacuaaauugcccaggcuggucuugaacuuguguuccuguuggaaaaucaguguuucugggccuucugcacuaaguuaacuucuagugggguauucuuagguaauauugauguacuccauugguuuaguagagaguagugaacaagaaguuauucuuaugugggcuugagcugaggggaaacacauuuaaagauuaguuugugagccuuagcuucuucauuauuaaaaugaagauuagaauagaugggcuuugagauuauuuuaaaugguaacuuuuuaugacuuugaaguaaauaauuaaaaaaaaauaaaaauuuuuaucuggcugauguuugccuguauggauauuugugcaccacauguguaccuguggaggccagaagagagugccuucucuccugaaacuagaguuacauacuuucggcugugaguagcacccgugugugguugcugggaacugaaccugguuccucugcaagcagcaagcuuuccuaacugcugagcuuucucuaguccccagaguacuuuaugaauuaauuuccguuucuuuuagaaucaguagcagguguguaaguuugcaguuugagaaagccaugugcagaguacuuggcuuguguagauaucauucuggccauuuggcaguguuaucuaucuugguugggggcagggguagugaagcuguggguccuagcuuuggccauuaggauaagugagaugggagaaacuaugagaacugcagguguugaaccaauggaucuucugguuugcaccacugaugguuugauucugaagaacaggugauaggaaauaaaaugaaacaggcuuguaucccccccccaagccuauuuugcaacaugauccuuggaucucaguaucuuugcuuaugaaggacaugaucugcucugaugaccugagauauggugacuugugacuuaucaguugaguauacagaguucaaaugacuggccuuucauuuccauauucagucugaagccauugugcccugcacagcuucugugguaaagauguaaaaauucuaggaucuuguggaacacauguuuuaaaggauauaaguauuauaauuauuucacuauaguugacuaaguguugaauuccuaacaugguaaaguuguucuuucagacacucuagcagauaggagguuaauauccaacuuauuuguauucuuacuagcacuggaagaccauggauuaaaauacuugaacuguucucucucgcuggguuuagugcuuugcuuuaggucagacuaaaucacagugccccuaggcuaaugcaguuugguagugacugaaucauaagaaaugacugaaucaaggcaugcuagauauuuagcauauuagaaguucaaagaagacauuguacugugguguaaggaucaacuuucuguuggaaaguagcuuucccaaaacucuaauuuuauaguaguaaucuauaaagcucaggaaaaucauuaccauuugaaugucuuccuggguuagugauuaauuuacucucugccugaugucucagcuauggccagaugugugcuuucagacaaacaggcaauuugagagguagcuagcuuauguguacuuuaauuuugaccaugcaaucuuaguuuauguuccauuauuuaaaaacaaauagccaguugugggagacaguaguaaggguuaaguguuagauugggauugauugacgcaauaugaaaauaaaagaauagaucacugcggaagcugauuguucuuaaaucauaacaauaaaggacaacaguggaauggagacugugccuagguacuggggcuuggaacuuuuuaggacagaaaagggaauuuuggggguggaagauuccacaugcagagcugaucaccugcaguuucaagguuauaaauaccaguggaaauugguauguugauuucuuauaaugaguccauggauccuaacaucuugaagauuaucaacuuuccuguccagaguuucucaacucugguuuuagguuauuaacccuuauuagauucuugugccaguggauacugguaggugguuaggucauaauacaacuauuuacaacuuuaauuagaugugaaugguaccguauagcuaaaauagagucugcccugaacauaaauuauaaacagaaagcucuugagguacuauugaaugcaguguguuaugcaguuagcccagggacacugaacauugaaagaagacuagaaagguuaggauuguagcucaaugguaaagucuacgccugguaugcaagaagaucuugauucaguccccagaacucuaauaacaacagagagagggaagggcuuugaauauugaguuagaaaaccuaggcuucuggccuuuuauucuguuucaagccuuucuguaggaauauaagcacaucauuuuaaacccauggggccucugcuuauaaagucagaauguuuauguuguacuugaucacuaaggcucccuuuagugccuagauucuauguuggaguguugcaucaggacccaacuuggggcuuguucuguuuuuaagacccaaaggagcugccuuuuuucccaaggagauaauacuaggcuauuccacaaaacuguucaaugggcuguccuugugaggugcuucuucauaggggaaugagccuguuguuuguagaaaccuauuaagauuaagccaaaaguaauuuccaugaucacuugguugccuaccccaaaaacuugucaugaccuguuuuacuuuguuauuauucugucuuuggaaauagagaauuuacagaacuccgggauucccauugucuuccuaagaaccaacacaguugggcuuagagagauaaccaagggcuaagagcacuaaggacccuuguuccauucccagcacccacacugggugguuuacaaccacuuguaacuuggagggaugugaugucucuggccuuuucaggcacuuacgacuaacauguaugcacaugaaaauuaaaaauaauuuuaagaggaagaauuggcacagucaccaagaaaauauguucuugcugaauuuaauuuuguaauggaguuaaugaguacugucuucauacuauauuugaggcuuuugaacauuagcuuuucauuuccugguccuuugcuuugucuuuaauguucuguuauuuuucauucauugccaugaagaauugaccuuugaugucaucuuugaaucacuaaaaauguaauuucuaugugaauuaggaauuagcaccaccacuuauagcacauuguuuaacuaugugcuuugaucacagcuuugaccugagucuucucuguuggaaaucagggcaucccuuugauggugauagacuccuggccuuccccaauuuuuugcuggaauugccauuacuuugucggauugaaguuguugauagcaacaguggacucuggggaauggccaccuguuguagauaagcaguuuccauggguagcccucagggaaccuaaaacuugccuaauguuaauugccuauuauuaauccaauuacuaaagguauuauuuuagucuauuugggaugcuguaggauaaugccuuaaacagaguggcuuauaaacaacaaaccuauuucucugacaguuauggaggcucaaaagucugaggaucaaggcaacauaaauugagagcccauuucuagaagguggcacucaaaagagaguucauacaagguguaccuaaacagugucuuuuugcugugacugagaagaagcaggcuugccaggcagugguggugcaugccuuuaaucccugcacucgggaggcagaggcaggcggauuucugaguuugaggccagccugguuuacagagugaguuccaggacagccagggcugcacagagaaacccugucucucgggggggggggggggggggggggggaggagaggaagacgaacgaagaaggagcaggcucauucucugaggucugucuuuuuuuuguaaggggaucaauuguacucaugauggaggcuccucuaugacuuuauaaccucugaggguucuuaccuccugauaaaacugguuccaggguuuaaaaccagcagaaauuuugugggggaauguaagcauuuaacccauagcaguuucaagaaagacuuguuaauuaccugcucuauuugugagauuuugaguucuuaauaauagauacccaagaagaacagaucucaaaucaguacugucuuuuuguuuguuuuuuuuccccaaaacauccucuuacuacuuuaguuuucuuuuacuucuagucuuaccacaguuacugguauaccacuuagcugaucucucaaacuugaaaguuuggaaucacuugaauuauucucauuccacaaauucucauagcugaaaguuacuguucuuguuuccuuucuguuacuaugauaaaauacugaccacaagcaucuuaggaaaggaaaggacuuauuuggcuuacacuuccaggucacagucuauuguuaauggaaguuagggccuggacuugaaacagaagccauggaggaguacugcuugcuggcuuucucacagacucaaguuuagcuagcccaaugcacacauaagccccuuucuauacauuuuccucugaagauuuuugucguguguguguguguguguguguguguguguguguguguguguauauacacacacacacacacauacauacauacauauauaugcauaaaauguauauacaaaaguauagggacuggagagauggcuuaauuaagagcaccuuuuguucuugcaggggacuaugauucaguuuccagugcuuacauaguaauuuauaaccaucucuaacuccaauuacagggcauuccauguucuuuucugacuuccucuggcacuaggcauguaugagauauaccgauacaugugcagauaaagcacagaaaguaauuuaaaauguagauacauuucccuuuagauuauaaguucacugggaauaaugaacugugcauuuacccaaauuuaugccaccuuguugccauaaaaauguugaguuaauaacaaacuauccaaaugaacuagcuuuuaaaaacacucuggcuuaguaaguagggauaaaggcagagcuuuaaaaaaaccaaaacaaaaaagaacaguccuacccaacuuuguagucagggagauaaauagaugaguagacugcaagucagguugcgauaagccuaucacaaauuaauucuugacagaaacuuaaagggagagaugaauuuucaaaagugagaucuccuggccagacccgguagcuccauucuguaaucucacuacuuaguaaguucaggcaagaggauuaaguuugagagcugcuuugccuauaaaguugaagacuagccuggcaacuuagucauacuaucucaaaauuaaaguaaagaagggcuugggauauagcucagugguagaauauuuaccuggaucuggcauucauaaaggagguccuagggucaaucucagagagcuuuugacugauucugguaaguuuacagaugagauuuuuguuguuguuguuguuguuguuuaucucagauacugugugggauacaguaauaguaaaauaccaugacagacucccaguaggugagugaguuuuuagagcaggauuagccaauaguaaccuuauaguugaaucugacucugugaaccaagaaugauuuuuuuuuuuuaaaugagaccaagucucauuauguugucuaggcucgccccugaacugugguacuguucuggacucuuaagugcugggauuguuugcaugaacuugaucuuuacauuuucagagaguuggcuagaaagaauauuuugugauacagcauuauaugaaagauuucagcauucauauaguuaagcugugucggaaccuuagcacacaguacacugccacagcaccagaggugaguagcuguaacagaauuaguucauagcaccuaaaauagucaaagucuggguccauaccgaacuacuguguuuagagaauagagaagggggaaauucaaagagaguagagaaaaaaauggcacucauuuugaggacugguuacagagaggaacugcugggaauaccagcagugagauaaaggugauggcucacugggaauucaucuagauuaguccucuuauuuuacaaaauaagcagaucaacuuuguaucaaaguccacacuguuguaagggagcaacugguguauaaacuuugagggcuguagaagaugauaagauuauugcugagguggagcccucaucuugaguaacagcuuugcccuugaaaaaugagaauugaacaaaccaagagcagacuuccuuucucugaauguaauguuucuguuuuucuucuuauauuucuagaaggacuucgagccuuauuuggagauuuuggaaucauauuccacaaaagccaagaauuaugugaauggauauugcaccaaauaugagcccuggcagcucauugcguggaguguccuguguacucugcugauagucuggguguaugagcuuaucuuccagccagagaguaaguauacuaccccuucuguaaagguagacuggaaucucauucauggcugguggguuggaagcauuucuuuugguuugguuguggcuuuuaaaaaucuauugagaugggaaauagacccugauuuauuagcugugaaauucuuuuaggacuuuugggaaacuuacuauuuaugguuuuguggauuuuuuucuuuuccuuucauuuauaguuuggguagaaacuccuuagguauucguuacuauaaagauucacagaugucucagaauguaggguacauauuuuucgguucuaguuucuucuaagaacauaauuguguuguuugagauuuccagaguagaaauguauugcuuccauuuguggccuuccuuuucauuaaagagucaccacuugacugccaaguagccucugggaugucugcauaaguaacacauggcccuucuuccuuuggaguuaacuucugcuaagggacaguaguacugacuugucagauggacuugggaagaacaacacuguuucuuaggggcugcugaggaggagauaccggccggcuuacacucuuccuaagguguaaacagcuccugcacacccuucucuuucccaccuacaccuuuaggugacuaugaccauaacgcugugaauuauuuucucccuacaggcagugcuugguaagcuguuugauuauacucauaucuaaauaguagaugugagcaguggcuauuuugugaugauccuuggcuuuccccacacugcugauaucuugaguaacuuccuugggagaaguaaauaacugaagaaaaaucuaagcauuuuuacuuguuugauauuucuccauugcuucacuuccuugguggcaucaucuguugggggcacuugccagcucuguagaccaggcuggccuuggacucugagaaccaccugccucugccugccaagugccgggauuaaaggugugugcuaccaccaccagguaguuuuuaucuuuuuaucaugcagccauugagcuauuuuaauagcauuaaagcuacagcaacguacauguugcaaaacaugacagccuagaggcaaguucuacggcauuagagcuguuuaauuaaaguggaaauaagaugugacuguccugucucaaauuauaguucaccguagcuuuaaaacauggucuucaaagcuggacgugguggugcacgccuuuaauccagcacucgggaggcagaggcaggcagauuucugaguuugaggccagccucgucuacaaagugaguuccaggauagccaggacuacacagagaaacccugucucgaaaaaaccaaaaccaaaaccaaaaccaaaccaaaccaaaccaaaccaaacauggucuucaguuucuguuccucauccucuccugguuuucuccuacacuguugacaagacugagacuggccuuuuauuucagcuccugguuuauauguggcuacagcuuuaguugcuugugcagguguacuccuuauccaggaagugucuuucacuccucucccaaccuccccucccccagcucauuggccuugucuuguuuugucuuaacuugggauagagucucacuauguagaccaggcuugcuuagagcuugcaguggugcuccugucugugccucgagagugcuaagaugugcaggugugugucaccaugucuggcgucuuuucuuuuuuacuaugacaguacauauauauacacauauguugccuuuuaaaauuuauuuuauauuuuauguguaaagguguuuuaccauacauaugucagugcaucacauucaugccuuauguuacccuuuuaagcuugggaggggacaugcuggaaucaaauaucaggccuuguacauaccagggaaguacucuaucacucuucagccucucauuuuacucacuuuaaagucuucaguuuaguggcauucacauuuaacuaauauucacauuguuauauagucucuaucucaaaauuuucucuuuaguucaaauugaacuuucagcagauaaauaguuccugagccaaguaugguggugcaacuuugaaccccuaauccuuggaaaacuaaggcaggaggauuguaaguuugaggccagccuggacuauauagacccagaagacaucaaagucuccauuucuuauuuuuccuaagcccuaaaaucaccauucuggguacuuuccauuuuaagguuguauauuuauaaaacuagacuaaaguuaguaaguuguugacauucguacuuguuuguuauaauuaguauuaacuuuagguauuuacuucuuuaaauuaaaauuuuuauuuaacuguaaauauuauuuagaacauguuuugaaguguauauguauugcauaauggucaagcugaguuaguuaacauuuauuaccuuugcguuuucaugguuagauagaucaguuauuagcuggcuauguuaugcacuuugcugaacuuguagcggaaauaaagccgucuucuugggugcuggugccugcuuacuugcugacccugagcaguccaucugaaaacuaccaaaaaccauuauauuaguaagguauucuauuuaagucuuugucaguugaacuccaagccauuuuagcuuuuaauauauauuuuuauuaaaaaggagccugugcucaccauagaaaacuuuuauacaauaugaacaagccauugagaccaauuaaaaucuugcuacuugaguauaccaauuauauuagucaggguuccuagaggaacaggaccaaugaggacauaugaaagauucauuagaucagcuuaugugauagggagugaguaguaaugacuguguuuacauuggaaagcugagacucuaguaguucagucugaagcugggucuuucagcaaucccagucuugugcucacagccugccuagaggauucaggagagcacuggccuuaguccacuguggaggccaaagacucuagguuccaguggcugagaaggauuggcaaaaggagcaggucugucuuucacuagacgcugagggugugacccacacuggagagguucgucucuggaacuuaauccugcggaaggcuaguccuauaacuuccacaagugacaagugcaccccuccccaaaauacguuaaaagaauuuuuuuucuuucucucaagggucucguguaucccuggcuggccugggacucacucuguagagcagauuagcuuugcacucacagaguuugccugccugugcuucuucccaagcacuaggaguaaaaaagcaugugccaccacauucaguaggaaauuuaaaaacuucuauuuuauuuauuagggagguguggauguauggauacauauauaugauguguguauguugccacagcacucauguagucagaggacaacuugggugucaauuccgacuuucuaccuuuaucugccuuccugaaauugaacucagguagugagacagcaggucugacuaucuugcuggcccagaagaauuuuuacuacagaaaaaaaggauauuguuaauucauguaaaaagaauguuaguucuauauuacaaugucuagaagaaaauauucuggaaacaaaauagugcccaaaaaugagcgacuuuagugucuuuucuuguugcuucaucauagucugggucucaaugguucugucacuagcugucuuagcuaggguuuccauugcugugaagagacauuacacgacagcucuuuuuuuuuguuguuguuguuguuuuuugagacaggguuucucuguauaacccuggcuguccuggaacucacuuuguagaccaggcuggccuugaacucagaaauccgccugucucuugccucccaagugcugggaucaaaagcuugcgucaccaccgcucggcacgacagcucuuaauaaagaaaaacauuaguuggggcuggcuuacaguuucagagguuuagucuauuauugccauggcaggaagcauggcagugugcaggcagacauggugcuggagaagaagcugagaguuauauaucuugauucacaggcagcaagaagaggacugugccaugcugggcauagcuuaagcauaagagacuuaccucaaagcccaccccccucagugaaacacuugcuccaacaaggccacgccucuuaauaaugccauuuucugugggccaagcauucaaacacaugagucuguggggccauuccuauucaaaucacuacagcaggucuugcaguguugauaggacucaguaguagaaggccaguacuaccuaagcaagcacaguaaagcaaggaugcagguaggccuugaugaguaccagcugagggaguugacauaucuguguggcaccacacuaggaguugcccuaccagaucccuuaggaaugcagcaaaggaucuuacugaguucaugcuucagagaaaaguuggucuggggucuccuaggcugauagaccuugaugauaaaacaaucuccacagugcauuugaggcaguguagaguagcaggaguccuggacuacucucucacugcuaugaacugugccuugaacaaguucuaauucuccaauccuugguugccuuucaugccugccauagauacccuguaaagccuuuuagccccgccuuaaaaugcugcugcugggguccguagagguguaugcaguaguaaugcacaaguguccuuccagcuuggugauuuauaauuacuccaguugacaggaucagaauucuuuguccuuuguaacugccugaaaguggacucuuaugugcaugauuuccagacuccuuuuaggucuagaaauuguuguuugggucaguguuguuuuacagacacauguuuuggggauagaaagacauuuggacauuuggaaaccuugggaaggucaagaacuggaauauaugugucauuugacuggcaguucugcuucugggaauucauuccauggauauacuuuuauaguguguauuaaaacauuauuuuuagcaugcuuuaauagcaaaaauuaagaugaaccuauguguccugcaguggggagaggguuaaguagauuaugaaacuuuuauuaaaaggaaugcacauaugugcaugcacacugccauauacgugaacacaggcacacaucuacucuuaccuuauauacacagacaggaaugaaugaggaaauacuaauuuuuaauguuagugaguggaaaaaacaaggucuaguacaguacuaggcuauacuaccucuucaguaaaagcgagaaauaaaugagaguuuauuuuuguuacugauaaauacaucaagcuggaaaaacauguuaaaaaaaaacuuauggaagggcaggaugagaucuggguggaaggaaaugagggagaagaaacauuaccgugugugucuauguaacugaaaaguugggccacauaaauauauuacucaaaaauuuaaagguuuuuauaaaaaaauugaaagaaacucucccucuggaggaaguaaaguuguaagagacagcugaaugauugcugucuguuaacugguaaguuauauccauggaguuucaugugacuaauaacaacuauuuguuucuuguagguuuauggucucgguuuaaaaaaaaauuauuuaagcuuaucaggaagaugccauuuauuggacguaagguaggaguaaucugucucccuguuugcuguauauauauaucuuuccuaauuguuucuagaucaauauucucaagggaggguuggaaagauggcucagugguuaagagcaccgacugcccuuccaaagguccugaguucaagucccagcaaccacaugguagcucacaaccaucuguaaugagaucugacgcccucuucuggugcaucugaagacagcuacaguguacuuagauauaacaauaaauaaaucauauauguuuauacacacacacacucaagggagaggaaugauucuuguuugccaaacauggggauuuggcaguguuuggaaacugauuagguugugacaacucugaaagcaggcuccuggagucuaugggcagagucuggacugcuguaaaacacuucuggugcauaguauggacugcccuacaguagauacggcuuaaaggguuggaaaggcuaaggcuuaguuagcacuuucuccaacauauuuggccaaaggagaggugagaaaucugcuaaggaauaacuuggaauuagaaaauccaacugaagucuuacugugcuucagccaaaauauggcagaacugaauuuagauacccaucuggggauuaaaucauggguuggcagacuuucuguaaagagccaaauaggaaacauuuuugucuacucugggcccauggaagaggagcauagguaaggaaugaaccugccaguuccagggaaacuauauucacaaaagcauguaggccucugggaauaguuuccugauugcuagguuggaaacuuaaagagauaacagcuguuuucuugcucuuugcuccucuuuacagcagaguuacucucuucacugaguccucuuugcuaucauacugggauaagauauuucucagggcuggguucuuuaucaagggggagauaagcaggaugggcuccuugcuagguauaagaaaggccuguagaaucccgagugucuucaaagccacagugcuuuucugaacauuucugaccugucucucaccuucgcucuggcuuuuaccagcuuuacuuacuuugaggguuuccuauacuuuugaguucucuggaauaaggggugggggugggggcuuggggguggagugugaauggggaggggagggaggaagacuacugaaaacaauaggcugugccacaaaggagagcagacacuuccuuacuauucccugggauuuuaauaucuccaccuuucuccuuuagucuuaagauuugcuuugacugauugguugguuaauuuuuuuacagggaaucaaaucagguaccuuucuaccacugagccccauucccaaagcaagguuucuucuuuguuggugguaguggugguaauggugguacuggggauggaaucuggaaccuaccaaagcuaggcaggcacuugacugcuaguggcuguaaaauguuccuuuuguugagguuugguggugauggugguaguggcauugaugucauggugguggaaguggcgguggcaguggugauggcagugguggugauaaccaucaaacauggaaccucagaugcacuaggcaggcacuccacugcugagcugcauucccagccccuucaaaguuuuaagaaaaauaaaugcuaggauuccacaacccauucuuaaaauuuugaaauuguagaguugaagaugcuuagaggccaugugauccaaucaaaccuuuauuuuucagaagcagauucugaggcuucgagacaggaaguuccugugugcaugcacauguguguuugugccuugcuauuuacucaacacugucacugagcacuuucucaaucuuaguucuuuuuacuguuuuguuagggauacagugcugaacagcaccaagaccuuucucuuauagaacuugcguuuuaguagaaaagacagaaagcaaacaaacauacaacauuugcauuuugaaauaaauguaaauggaggcaagaacugugagugggaaguacuaguacuugcuaugaauuauaauauacuuccuaguggaauuuuuugugucuuuuuuuuuccuucuuaaaacaacauuaucuacgcaugagcacucgucuuucauaguuuguuccuguugcguggacacugugcauguagcaugauuuucugucuaugacuuuaaaaaugccucuggucuauagcaugccucaacauuguccaguacuguggacauugcuaccuauguacagugcugacaugcucuaaaggagccagguuuuugggguugcacugugagcuacauauaagaagaaucucuuguauucugauuauuccguggccaggauugagaaaaaugugaauggugggugugagaucuugggcuuuacugacuauacuguggaagccacagcacuguaacauauagccuuucucucuacacuugucacccaaaagucucagaaguguagcagcuucuaccauuuuguguccacaauuuacucuguuguuucucuccuaagcaccauuaguagacuuuucugucuugcuaaaaauaagcuuugugagaugagggccuuuuuucaaaaaaaugaaacaauaacaaaaaaacaaaccaaaacuguguaccacaaggcuuuuucuuuuguuugguuugguuuuuuuguuucuuaacggcuguauuccuagccuguaauagugguugcugagcaaacgacuaaguaaaugaauaaaagaaauggcucagaaaguguagcuaugacgauggaaaagaaucauaguugagccaggcaugguggugcaugccuuuaaucccagcacuugggaggcagaggcagauggauuucugaguuugaggccagccuggucuacagagugaguuccaggacagccagggcuacacagagaaacccugucucagaaaaaacgggggggggggggguggugguggaucauaguugauaaauuacauggcagaaaagaccauaguuucuccuagcaucugugggucagauggaucaggcuacccauagcccauuaaggagaugcagcauagucaucccggcaauucugaagccugaauggguacccugggaacucggugggccuccauacuugugguucuuuuaaaauaccuguugaaguuacucaucaauugugcaacagccaggcuccccuuuuucuguagcuuggccuguuucauaacugucuuuaucaaucacacuauugcuguugccaacacagcaacagggaccuaauguaguacucaggcuauuugacuuccaguucaaaucaagggcaacacagugcuggugacaucagcacagcccagaaaaggggaaauuuaaugcaucuuugacuuucagaaggaaaucuggcacaagcugccuggcuaaacagauaaaauguucauuucccuuuuuuuuuucuuuuuaagacaaacccuucuaacuuaguaguacauauuugugucugguguugagccauugacucggucucagagauggccuuucuacuucuguauuucacucuuguaccuucuaguuaacuuuuuuuuccuuuauccuuggagaucgaacaacaggugagcaaagccaagaaggaucuugucaagaacaugccauuccuaaagguggacaaggauuaugugaaaacucugccugcucaggguaugggcacagcugagguucuggagagacucaaggaguacagcuccauggguaagcauugguccaggggugcugccuccaugcuuacuggcuaauguuggcauaggucaagaucacuuggcacucacuacacauacuguagcuuuaggggacucuaugcucuuuuauggcuucugagggcauuugcacucaaguauacauagucccacauagacacacaccacacauacaauuaaaaauaaguauuuuuaaaaagaguaaaagaguugaguagaaacucaauccuguucuucuauuaagaacaaaggaauuucaguaaugacuuaccacagcuuauuuuuaaagcuggaaauacaggaagauguaagcugccugcuaugggcacugggaacugaauucuaauccucugcaagaauacauguucuuaacugcugagccauaugucugguuccugaauuuuagguuuuugucuguccugucuauauuaaucccuguguuuccagugaugccugcucgcugacagagugaccuuuacuguuucugcagaugguuccuggcaagaagggaaagccucaggagcuguguacaauggggaaccgaagcucacggagcugcuggugcaggugaaacccugggugcuuaugugcaugggugccauucauuuccuaguucguguaacuauuuaaucucuuucuuguaauaauaaucacguaagggaaauuuacuguugaaauaaaaccauagagauuaaaaaguuucuuuucacuuaaauugguaaaugugaauaauaaugucaaaugcaucuucaaauuucagaaaaugugaaaugccacuuauaccucuggacuuugcuguguccucuguauuucuagccuuucauuugaggauacugcuuguuuuuugagacagggucuuuacauugguccuggcuguccuugaacugcuuauguagaccagcuguuucaaacucagagaucuuccugccucuaucucccaggugcuggggcugaaggucuauucugcugugcaggacuucauuuugagauuuuccaugcuauagccaauguuguuugauaugggaguuggggcaaggcugacucaaagcacacuccacagaugagccuggcuuuagagugggauguagcugcuucuguuucuaaucaaccuuuguuuugaagcccauuucucauaugaaauuauaguuaaaguuaugaucucuugguccguuuauuaugacugugaauccccacacaccuugguguuagagguucuacuugguuauuucuuggcauaauggucauaacucuauguuuaaacuuuuuauuaaguguaggugaacucagacagaugaacucaccgcaguggcugcuuuguggcaggcaaacuaucauuuucauguuuaauuauugcuaggacccuguaagguagauacugguagucccccuugcauaugaggaaaaugagccucacagggcguauuuggccuguacagcuaacagugacaggcaaaggugcaacuucaaagugauggcuaucuguugauguuacaauuuuaaugcuucuguguuuguauuucuucucucaucaugcuguaaaaucauuuauuuacaugucucuuacauuauauuuugguguuuaaguuggggaaucuaccauaccccuuuuccaguucuuacuguuggacccaauaccugaaaaccuuacucaguacacgauuuugucuugguuaggauagcagccugucuuacacucccuuguauuucuuugcaggcuuauggagaauucacguggagcaauccacugcauccagauaucuucccuggauugcggaaguuagaggcagaaaucguuaggaugacuuguucccucuucaaugggggaccagauuccuguggauguguaagugguuugaauagaaguuuuaagauagucuguaauacaauuauuguucuguuauuguagaauggucuagaugaaguacuguuuuaaaauguuacauauacuuuuaaaauaccgagugucacauuuugguauauauuuuaggaauuuuucucuucagcuucauauuuucaaaaaucuuucagccuauauaaaguugguaggagaguuuaaggaacacuguguuuacuagauauucugccacaucuuuuuuuuuuaaagauuuauuuauuuauuauauguaaguacacuguagcugucuucagacacuccagaagagggcaucagauuucguuauggaugguugugagccaccaugugguugcugggauuugaacucaggaccuucagaagagcagucggcgcucuuaaccacugagccaucucaccagccccugccacaucuuucuacuuggcuuauucucuccauuuuucucaccuucucauuuauauaacuauugaucuccauuuaucuacucugcuccccuccucucccuguuucuuuuugguauuuuugagcuagaguuucauagcucagguuggccuuaaaccugcuuuguagcugaggcuaaccuugaacuccugauucuccuaccucccucucccuauugcugugauuguaccacaugugugugguaccacagcccuggcucuuucugcauuuucuucuuuuaaagugguuuuucuugaccccagugucaaguuuuaaaaagcuaccuucuuucacauuagugagauuauuucuuguacagugaagaguuuuuuuuguuuuuuuugugugugcgccccccccccccccccccguauucuguugcucugugauccuggguaaaccccaggacuauacauuguucgaggggaagagcuggcuuugguagacugucuugcagaaaauuugguuauguuuuguuuuagaacuuaguccguccuucuuuucuuuucuuuucuuuucuuuucuuuucuuuucuuuucuuucuuucuuucuuucuuucuuucuuucuuucuuucuuucuuucuuucuuuuuuucuuucuuucuuucuguugguuuuuuuguuuguuuguuuguuuuuguuuuuuuucgagacaggguuucucuguauagcccuggcuguccuggaacucacuuuguagaccaggcuggccucgaacucagaaaucugccugcuucuaccucccugcugggauuaaaggcaugcaccuccaccgccugccuuagauaguucuuaauguuaguucaguaauggauaugguuggauauauauauauauauauauauauauauauauauauauauauacacacacacacauacauacacauacacguauguauguauauauauuaaugcuuuaguuauuaauauauauuaguuauuuuaguuauuuucauuagagacauugcuuaggguauuacuguauguucuuggaaacagacgcucugucuuuuuuuuuucccuuacaugguagucugauaucaacugaaagcucuuuuuccucugaaucuucuugcccucacaucuuuuuuuguuuauucagggauuugcaugauuccuuggauuuccaacuguccaggaauugacuagaccacacagcucucuuaaguauuguggcuuugaucuuucugucuucgucuuuuuuaauguucuugacaucuuguucccacucuguuaaucuguugucucauuuuguuguuucuuuucuggcuuugaugaucuccuguugcauugcuuugugaccaugugcuggagcauugguucucaaccuguggaucuugaccaucagaaaacacauauuuccgauggucuuaggaacugagacaucacuaaauagcaaaacuugcaguuaugaaguaccaacaaaaauaaauacaggguuggggguuccuaagacugucagaaauacauguuuuuaagcuccagccugauguuugcaguagucacccuuugcucaucgugguucucaaauggucucuccugaugcucgguuugggcugacucaagguaggcgacugucugcagggcuggcugagaagcucugcuccugcucuauuagaaugucagggucuguucuucagagauuguauuauaaguucucacugcacaguuguaggaggguaauacacuuugagcuuuaaucuaacccaaaucccugugaucuuuacuuuuuuuuuuaaagauuuauuuauuauuauacauagguacacuauaacuucagacguaccagaagagagaaucagaucucauaaugggugguugugagccaccaugugguugcugggauuugaacucagaaccuucagaagagcagucagugaaauuaccugcugaaccaucuugccagccaaugaucuuuauucuuaaaaggggucagauuugcuguucuguuuuucuguguuacucuuuucuacccauuggucaugcccacuacauagagaaaggcagaggauaaggacaucucuguuucucuguaguggaaagaugugaucacgauauuucuuaagacuuuccugacuacccugauuugcagaguugacuaggcacugucuuugguuguaccucugcaucgguuauguguuacuguuugucuuagcuaggguuucuauugcugugaagagacagcacgaccauggcaacucuuauaaaggagaacauuucacuggagcuggcucacagcucagaggugcaguccauucuggcaggaugcaugguggaguacaggcagacaugauguaggagaaggagcuuagaguucuacguccagaucugaaggcagcaggaagagagagugacacugggccuggcuugaguaucugagugccugcccccaaugacaaacuucuuccaacaaagccacaccuacucuagcaaguccacaucuccuaauagugccacuuccugggccaaaccuauacuaaccacuccagcuucuauagagagcucucuuuguuucucuuucucuccuuagucuuuauucugucuauugcugcuuucuauguaccucucuuaaugagcuguuuuugguguaaaagaggggguucacuguugagaagcaagaagacuaggccaaguuaaagagaaaucuuuagacuggaacuaacagggucuuaaauacuucucagguuucuuuuuuuuuuuuuuuuuuuuuuucugcuucaaaauaucugccgggugugguggcucacaccuuuaaucccagcacucgggaggcagaggcaggcggauuucugaguucaaggcuagccuggucuacaaagugaguuccaggacagcuagagcuauacagaaaaacccugucucaaaauacaaaaacaaaaacaaaauaucuuucccuauauuaacuucacuugucucauucacagaggauuaaaggggcaaauucauguacugaaaagaucagaucaugguagaauguuggcuggcuugcauaaaugcaaccagguucagucauaccugaaacgaaauguuucguguucugaaacaugagugagagguuuuauauauguugaaaggaauugauagauauuagugacucgaagccucuguuucuuauuccacaacuaaauuucuguccugaagauaggacacaugguauagaugacuaggaauuuggagauuuuuuuguuuaggucauugucaggcuuugguaaggccugguaauuccccaaauuccccaacuuucuacacagcuuucuuggaaccucaugugacagcucugaggcuagaccacaggguguuguugcugauuuguagacuuaaucucaacuauaagcugucuucuccagcauagagaucuacaaacaagggucaucugucuauauucugcaagcuauuuugaggaggguggucugccacauguuucaugaaaggcuuccugagucaauaaauuacucaauuuucugaguuaaucuucaugaccacuucuugaccacugggauucuguacccaaugguauuuuuauucuauauguagauguuaggaaaguuuaguaaacaguuuucauucuaucucaaguugguacguaaucuaaaauucagaacguuuuacuuaucaacagauguaauugguaacacugaaugauugcuuagggacuuuaguuuucuuuuuggaaaggaaaacccaagauuguaugaaccuucacagaugcuaaaucugagauaauuuccuacuggcucagugcuguagcuuuuggcuuuuugagaaaauauucaagccuaguuacuacuaaaagauagugaggugauaggauguguuuaccgaaugucaaguugggcuucagaaguguuaauugcugacccuguagcacacccuguaaucccugaaccacacugucugucuuaaagauauagcaguaucuucucugcccaugucuguuucuauaucaaacauuuuuaagaucagagcaggcuguaccuccugauacccauccuuaacuuacucugguuucuuuucuucacauaggugacuucugggggaacggaaagcauccugauggccugcaaagcuuaccgggacuuggcguuagagaaggggaucaaaacuccagaaauguauggauguguguguuuguuucccuucugauauugucuauuuguggcagcacaguguaaacugagcccaaacugcuucucugcugcuccucuuccuccuacaauucuagucuuuuuuuuuaaaggcaggguuucucugugcaguucugccuguccuggaacucacucuguagaccaggcuguccuugaacucagaaauccaccuaucucugccuccgaagugcugggauuaaaggcaugugccgccacugcccggcucaauuccagucuucuugucucuggcccaguaccucuaccuugucccgucacauccaguagcugguuauuugagcuuaaacauggugcauguuuuuagcaagaguaguauccuuuuucagaggaaacuaauagaacuacaucucugaauccuguguuguuaauuuaucuggagcuuaagaaagacuguguagacuguguaauauaguugagugaacaugucugaaguaucuuagacuaccuucagugcuccccaggaaaauuugcaucugagaguuaauucuagaagggagaauuuaaaaacaaggcuuuuguuuuguuuuugugauuuaauuacauugcuuuucauaugauuguaaucuugguucucuagaccaccuucuguuugauuuauuauuguuguaucucuugggcuaauauuuuuuuucuucaaguauagauaacuaaguaguuuuuguuuuuuguaucaucaaacugugaccacuuugcauaggagaauaaaccuagcugcuguuacuuucuucacguguaaaccuuugaugccugauacuuagugauuguagagauuuuucucccuuaaaggacacaguaguggugagagaggaguaauggggauaucugugacucuguuuccucuuugaacauuauuugaaaacuguuugcaaccauguaggagagacagauagguuggugacugauuguuacggcugacaggccacuuuggucugaggcuaacugacugcugcuucugucucuaugccaggcagacuuacugugugcuagaacagcauuuugcuucucacagaggucuucuugaugaucagcccucuugaggaaguucugccucauacacccucagauguuguaacuagugacuuaaagugcugcugaguucuccaggguccuauugugcucuauguuucauuagcccccuucuccuccaucaccuaguguggcucccgagagugcccaugcugcauucgacaaagcagcucauuauuuugggaugaagauuguccgaguugcacugaaaaagaacauggagguggaugugcaggugaguccugaagguucgaggagcaggaagucaaguugaccaccucuccuucugcacacagaugggcuccccugcuuggacuaacagugugacaggcagccguguuucugaguauugagaggcgguugaucuggucccugauggugucgagcuggauuuuacuuucaacuccuuuacuuucuuuccuuuauuuguaaaaugaauauggaugaacucaucccaccacucacucccuucacacaccugaaugugguuuuuuuggggggguuaggaggauuguuuuuuugagacaggguuucuuuguguagcccuggcuguccuggaacucacuuuguagaccacccuggucucgaacucagaaauccuccugucucugccucccaagugcugggauuaaaggcgugcgccaccauugccuggccugaauguguuuuuaugucucacauaaguguagagaaauuuuuuguuuuauugaggcuuguaagguuaagucaaguuuuuguuaaaucaucucugguagauuugugggcugcuagcucaguaugguuucuauuucaauaguguuugcauaguguugcucucagguacacuuuccauguggacuuguguguacccuucguagcagaaggcagucuuuucccaggguguagagacccuaaaccagugauuacauuguccucacagcaaaaggcauaagcagcuaggacuaagagucuuacuucucuuaaacuuuaaaaucccuaggcaaugaagagagccaucuccaggaacacagcuaugcuggucuguucuaccccacaguuuccucauggugugauggauccuguccccgaaguggccaaggugagagguuuuggcuaugcagguuugcagcaugcacauuaguacuuuaaaauagacaugaugaugcagggcuuugugaggagaaagguuuugauuuuaggcuugaacauagcagauauugauggugcuuaucaaccccaaggcaagucccugcaccucuuuuuggagccucugaaggucacuagcauuuucauugggagaaggguaguacaggacucaggcugccuuugaacgagguauuuuuaaauaguacagacucuuagauuucuaccaggaaguaaugugccauuaggaacaugucuaccguauaaugacuacaguaggacuguucccucuagaggcuguuaaaucagauuuccacuguuucuccuguggugguugggggagccuuaggucagacauauuuaaauacaaauuacaugaaauauauuuuagguggacacuuuugaagauuaaauauacaugaaaaauaaacuucauuuuaaaaugucaaaaauaacgauuuuggacggugggucaguugguagaguacauuccagacacguaugaaauccugcauuugauccccagcaccccauaaaauuggacauuguuguauauacuggucaucugauuaggaggaucaggaaaauucaaggucuuccaugggcuacauugcaaguucaaggccaggcugggauaaaugagacccuguguucaaauaaauauagcccccuuuuaauaccugugagguaguacagaguagcccaucuuuccacuccuauucugcuuaggguuuauuuaugucuucauauguucuuuuuaacuaguuggcugucagauauaaaaucccacuccauguggaugcuugucuggggggcuuccucauugucuucauggagaaagcaggguacccacuggagaaaccauuugauuuccgggugaaaggugugaccagcauuucagcagauacucauaaggugagcuaaguggguaaccaagagauaacaguuggugauuucacuauucuccacucaacaaauugacuaaagccuuaguuuccccccacacauugucuuaggguuucuauugcugugaagagauacuauaaccaugguaacucugauagaagaaaacauuuaauuggggcuggcuuacaguucagaaguuuagucuauuauuguuguggcaggaagcaugacaggcagacaugguacuggagaaguagcuaagaguucuacaucuggauccgcaggcagcuagaagagaaugucacacuagaccuggcuugagcaucugagaccucuaagcccgcccucaguaaauuacuuccuccaacaacacagcaccugcuccaacaaggauauaccucccaauacugccacucccugugggccccuggggaccauuuucauuuaaaccaccacaccacauaccaccauauaaaguacagucugacccuugccugucagcauguggaggugacaagucauggagaaaagcagcuccugccuucccuuauacagggcugagaggauuuccugucaaccaucugucuagcuauggaucuugugccaaaagccuccaaagucuugagguuauuggcaguugcuaaggguugauccuggaguuccugagccuacgugacuauaaugcucaugcugauggcagaguccuuuuaggaaaggaaaccuguguguucaggagcaacuggcuuguuguguuugaugugccugugccugccuagaauuccugauccuccuuccuccaccucccacguacuaggacuauaggugcaugccacugcacucagcuucugaaagauuuuaaguaaggaaagccaaagacugagggagagagggaggaaaccgguucuuaauuuuucucugggucaccccuuacauugagaauguggaauccaugccuucggguuccuccugucuguuagcacugugaaguaugaaccuuaaccugaauaggaagugucgcagagcgccugugagaaagccgcauuaccuugaugguucugugggcagagcugccagauacagccacacucugaccucuuugcuucuccccucaguauggcuaugcuccuaaagguucaucaguggugauguacucuaacgagaaguacaggacguaccaguucuuuguuggugcagacuggcaagguggugucuacgcaucuccaagcauagcuggcucacggccugguggcaucauugcagccuguugggccgccuugaugcacuucggugagaacggcuauguugaagcuaccaaacagaucaucaaaacugcucgcuuccugaagucagaguauguguggaaaacgggguucugcuuugucucuugcucucugucuuaguuggcccacggcaucucugccugguggcacacccuuugagcccuacugucuccugauaaacugggguuuagaccgauuuaccagauggugcugggagaagaaggaacccuugcaugcugugcugagacuuaggagucggguagacugggaaaagccagugguucuggauggaguuuaggacuuagaaaguuucugguguucugucugggagucugaucuccauaaaacccaccugucccagccuagccucuguaguguaagagacaagucaagucccaggagaguaggcucugaucaucaacugagauaaggaccgacggaacggauaugcucaauuucugcuuuuuuuuuuuuuagacuggaaaacaucaaaaacaucuucauuuucggugauccucaauugucaguuauugcucugggauccaacgauuuugacauuuaccgacuaucuaauaugaugucugcuaagggguggaauuuuaacuaccugcaguucccaagaagguaugcugaaagccucuaccucucccuucauuucaugaccugaagagcugagguagccggguaaucugauacuuagcuccuagagcccagcacuuugguggcaacuagaguucauacguauaaccagcaaggugguuugcuuuaagcucagguagaacuggcagccagcaucccgaggcaggaggucacuugcaaggcuuuccucuguucuuccuguggccucuguguucugugaucuaucuugccuauagcgaucagcuugcuucucuaagauacauuauguguguaauguucccuuaaagcccuugagaagguuucugaucacgcaggccugauguacccuucgauaugcuuuucugacuuaguauuucucuccagcuagauggguauguacucacguacagccugccuucuguacguuacagcccuugccagguccauccuuucccagagcgaauuaggagguuccuugggacuccagcucuaugguuuucuccucaccagggcuuacccucuaaggugaaaaccccacccuucauugcucauacacgauggaaggagccaccauugacagucugugcgguggaaacaggacagaacagccagccguguucauuuuguugaggugguucuuguucgugccaaaaaccaaaauccucaucuccuggaguaaaaaccugcaguauggagagcuacuggaguggcuuuaucuuaggcuugcuuucuuuuacaagaucugucccccccucucuccuuucucccauagcauucauuucugcauuacguuaguacauacucggaagcgaguggcgauccaguuccuaaaggauauccgggaaucagucacacaaaucaugaagaauccuaaagcuaagaccacaggaaugguaagaauaccaggggggcuggagggauggcucagugguuaagagcacugauugcucuuccagaggucccgaguucaauuuccagcagccacauggugaaccaucuguaaugggaucccauucccuguucugaagacagcuacaguauauucgcauauauaaaaucugucuaucuaucuaucuaucuaucuaucuaucuaucuaucuaucuaucuaucuaucuucuuaaaaaaagaauaccagggcauccccucuuugaaacaugaggaguagugugggagccugcaaugcuguuuggagucuguuucuaccucagcucggucccugcucccuacucacuagguaucucaggcgagauagaaagcagaagcugcugagcagaagcaggguugcucucauccuguguuugaaaagaaacuuuugacacagaaagggcgauaagcacucugguuuuuguuguuguuauuguuguuguuguuguuuuuaagaagacaguaagucccagaguaguuccucacuuggaauggcaggcuagaaaguauuggugacaaauaacccauggagcuacuacuugucugauggaaggaugccugggcucggaauuggggcugggugcauaaggauggcagcuguacucacaucacuaauauagauccuugguuggauuugcagggugccaucuauggcauggcccaggcaaccauugacaggaagcugguugcagaaauauccuccgucuucuuggacugccuuuauacuacggaccccgugacucagggcaaccagaugaacgguucuccaaagccccgcugaacuuugacccuugugaguuccuuggagcuucaggccuucagaagguucuuggcguuuggaacagacugcacacaauuugacaucuggacuggcuccguagagcacaauaggauaaaccauaagauagcuucagccucaggacuccuuuguuuccuuguggggcuuuuaguuugaagacccugaaggaucccacugcauagugagucuguccugguuauuaauguuacccuagaaauugcuuuaaccuuauuuuucucuaacgucuuuagcaucgucuuuacuuaaucauugugugguggcuccgaccuguccugauuauuuagggaaagugugagauagcaagagggugucucugcugccucagugggguguucuggccaucaggcaggaagcaguuauguaccguguucccucaggugggugucugucugucccacgcagggggagguucagccucugcuucaggagaugccucuuguccucaggaucacugucauuacagcuugcuuuacuuuuccaagcacacgucggccagacuacuggccucuuuuuuuguuuuauuuuuaaauaacuggaguauauucccuuggcaggguuugaagugcuccuuugucuugugcaugaccauggcugcugccaucuuuggagaugccuguuggcagucauauacuuguuuguucuuauuacuguaggguaagaaaugaacauguuuuucagagaaucuagggcuuucuggcuguuggcacugccucucuggauggaguagggguagaucacuccugagcccucuccugggccagaggagccacaaccagacccuuucccacauuuucgugaauagccacauagguaagcgccuacauccugcacaugugggcaguagucuuccccuuggacauugccuuaagccuucauguaaugagaaucugcuuuuauugaagaaaacacuccacaaguguccuugacuuccucauugggugugaagaugugcagaggacacuugcuccaucaguguguguucuuccugccccuuccccccuuauucagcuuccaaagguacgacagcauuuuagcuucagguacuggacguuccucaggccccgcuaaaaggaagcagacauuuuggaguagaaagggauggcuacagccauuacacuuggggccugggguuccuucuuaagacugauugcccagggcuauacagggacaggaccaaucccuggccaauuucccauuugcuucucccuuuuagggauugggggcucugaaguaggcagagccccguucagcucugaugaccguaccaugugccuuucuacccauucagugagugacaacccucguccucacccaggcccuggcagaaguagaccacucuuugaggugugucugcuuauaggagagaacuugggacagaucaccagaagccaugcucuguuccuuccccuucucagggauuccugaguauucagccugggcauugcucgcugggagagccagaccaccaggcucuuccucacccuccuuaggaaguggucuucagcacuguucugaccccagguguuaccagcugguucaucacagggcauguguauauguccacuucccuccuguaugcucuacagugcauuaugaggcucagggaugguuggugugucagagagaggcugaauuccugaguguacacauuaacagugguuagacuguuggacuccucugggccuccucucuggcuuacaaguggcuaaaauggagaagcauccuuuauagucucagcagagccagggaccaagccgcucccuuccuuugugguagcacuagcauggggugcugguguuuuucagagggacccgcugcagccauuuuaauucaugauuaggaaccuuagugugacuuaagaguuucauuguguguuuaugugugcaugacaugccuagucagugacagggguggguagggugucuaguaucaugguaucacguggcuuaguagaugccacaguagcuucugcaaacacuguacugucuuguuucuguauuagaugucgguaaucaugugaauauacugccaugucacuuuuaauauuaccaguuuuauacuuggaaaaugguacuugccucuuugaaaucuauuuugucucuaaugucccuaccaucucuauguucuuuccuaacugcagcaauaacccuucaaaagcaauugaauaauaaaugucccaaacuguaauc

SEQ ID NO: 5522 - RNA, 3364 nt, Mus musculus
ggaauagccaacacauuuaauaauaaauagucucagagucaucacuuugggagaugggccugggaaaggaaaaacaguuaaaaauuauuuuaacacagagagaauggaagagaagggcaaagcccgccagagccaugcuugccacacuccagcuggccagaguccuuucauccuuuaugcucaacaacuuggaaaagcaaggacugaaacagcagcccucuaucggcugcugagaggcaugagaccugagcuguuuggcucugagaggugugacaagcugaacugucuggaaaguuauuaauagacacaggcccugggauccuaagccucagaagacugugaaccaggaggcuuucugacaaaguccagugcauguagcagugagccagagguuguucuggugaggugaggugaggaccacagcugaaguugaucucugauuucgacuuacauguguaugugccugugcucacagaugaacaccacacacacacggacauggacacacauacacuuuuuuaaaaaaagucaauucaaaggggucugucaggaaccucaacaggacaaacucacuagggaaaauaguaccuguucuagaaucaggucacuucagaaacagcagagggccugccuaaaauguagccagcugagugguccuugugcccauuguuuauugucauaugaguguccucugcuucguuaggcaaugagucaucauuaagcaauguaucuugucuccuuucacagaguucucaaggauggagaagcagaaaggacucuaagagcccaggccauuauaucccuaaugggagguguuggguuaugacuaguuuauugcuuagccugguagggaggggccuagugaaccuggucaguuucagggacuuccugaagcuaauuugaguuuguuuaccuuccucuuuaaggagguucccaaagcuauuuuaagugcuuauugcuuaaggagcuuccuacaggaagcaguguuuuuggaaacuguuacacaacaggagaucugugaaguggcuacauuuuagaagcugugguccugguggcuagucuggcagccgugaauacaaauuacucaaaagaacagcagcaucuuuugcuagucugauuuacugacuagaaauuuagugacacaaaaggguuaaaauguugcagguccagagccagacuggcauuuuguggcaucuuuauguccuuuaacaacuacugauugcucugcccucuacuuggcuuaacaucuuuguaacuauccaguaagucagagugcaagaacagaucucuaguuuccgaucaaccaaagggcuaagaaugcucucaggcuagcaucuggggccuauagcugagaucuuuuucuccuuugcuguagccuguuuaccugauauccucaccaauacaauugaaaagugccuuguuuuuacguuuuucuuuguucuucauuaagaggcuggagagacagcuacaccguuccuuugcaaggguuguccaaucauguacaggaugguucauagcuguuugcaacuccaaucccaggagauuugaccccucuuuuggccucugaggacaccagacacauagguggugcacaaauacacacgcgggcaaacacgcauaaaauaacuaaaaaaaaaaaaaaaaagcacaaaauaauucacaauuuuuaucaaacuguuaccauguugggacauggaauaaccuguauuuguguucccgggcuagggucgcuccuauuuggcucuaggauaagccaucucugauccccuuugaggugagaguuguguuuuugcgucgcagcagcgcuggacuccacagucccuucaucaguucucacagcgacccgugaagcagguagacuuuaguuccauguuuacuuuagucugaagagaugaaguuacagugcggcuucaauuagcguuucuuugcguuuuccaaaguuccccgaucugcugaacccggcucauccguggaauuaaaaacaaaauaaaauccagccuggagaagcauccuacacaagaagaugcagggccccgccccuagcgcgcuggcuuugccgacuccacacaaagcgguuccucccuugguucccgagcgcgcaggaggaguugcgcgcugauuggugcgcgcgggcggagcgcuggccccuccccgcccugggucguauccuggugucacuauuggcugagcggccgugcgcgcugagcucccugccccuuuggcuccgccccucgggcucagaacuugcaccgggugccgucggucgccgcgggagcgugagugcugggcgcugggcucuaggacgcauugucgccguaagugcugccuccagcggcccacaggcuucgcgccgcgcugaauaacgguggccagaggccgagcguggcaggggcagaagggaaagcacugggcuuggccgugucccuuccccucccccagcacaccugguagcaccgagucauggcucgggcggugcccagaggucauggacuaucgcuugcgguagugggaggcucgugguuagagcucucggacagcccggcuuccgucuccccagugagacgcccuugcccaucgggagaggcagcugcgcaugucacuugggagugugccucuccgccccuggcagcgugggacgcccccggccucugcgaucaccagcguccccccucugcuugcuccauuugucccaguuccugucugccaggccagcgcgaggcuggagacgagcagccacuggcugugagaaugggguccagggauccuguccuuggccacuguguacugucgguacagucuaaggaugcucacgcggggcuccccaacucuaaagcugagcugcgaaaccaggcgccaacguguccagcucauugccccagcgggcucuuuccccugggugagaaagugggucaucucugcucuggucucgaguggaccuuugggacuguuggggugugauuagcauugugccccuuaccucgccacaucagcucuuggcuucagcagggucccgaagucugucuggagccagcggagccagcgguggggcagaucgugcgcauggcugcggaggcuccgguugccccgcagagcggcugccaggcucuaaaguucccaguugaccacaacaguaacuaaauauaggaccagcuggugcggccggagugucgcaguggcuccuuugcagagaucuuagggcugcagauaaugaaguugaguucugacccuuaaagacugggucauugccauggucaagguuuaaauaccucagccccaaguuuggaauuuaggugagaucaguuucagaucugccagagaaauuauacaguguucacaaucauagcuuccucaaagcagaauagca

SEQ ID NO: 5523 - RNA, 980 nt, Mus musculus
cagaagacuccauacaccuaggcucaauaacagggucugugagacgcccucgcuuacccaaaccucucacgcuuuagagauguggacgcugagcucccaagagaagaugcuuagagagccagcgucagagcugugaagaggagaauacccagguuucuaacuccuuguuuggauucuguggccuguuguggacuucuccgugcuucccggucucucugguggcuucuauccagcucugcagccggauagagccagccaucugaguccucuauugucguuuagaaaugcagagaaggcgcugaccugcuuccuuggggagggcuagcuuaauaagcauuuuaaggcuuuuacagugaaaugcuccucagaggcuauuuccaggcuccgggaagacaucccacuccugccugagccucagccucucuguggcuaccccagccucgcucagcaagggaagccucucuccuccauuaaacacacacuacaggaguccacaguguggggucugauucccagggcccgcguccucaccauccggagagaucccuuucuccuuuccuaagaauucugagccuuuucaaagagggcagcuacucaauggcuuccuuugcuccaaaggccccugugcauuuccagucagggagaaagacggagucucccaccggaagugcuugaaauccccuccacggaagagcugccccagagggcacuguuuggccugaugccaacccuccuuccgcacacuuaccaccucugcugggcgucucagagcacacuuucaacccagcuuggagagaaggaguacacaugccaagccagcgcagaccuucaacaccaguaagggucuucaccaggaugcauguugggagagcauauacuauagugaaugacagcggguaucuacccuuagagcguguuacauacugaaugacugugugucuuugcauccuaagcaaaauuaauaaauuuggagauugggc

SEQ ID NO: 5524 - RNA, 980 nt, Mus musculus
gcccaaucuccaaauuuauuaauuuugcuuaggaugcaaagacacacagucauucaguauguaacacgcucuaaggguagauacccgcugucauucacuauaguauaugcucucccaacaugcauccuggugaagacccuuacugguguugaaggucugcgcuggcuuggcauguguacuccuucucuccaagcuggguugaaagugugcucugagacgcccagcagaggugguaagugugcggaaggaggguuggcaucaggccaaacagugcccucuggggcagcucuuccguggaggggauuucaagcacuuccggugggagacuccgucuuucucccugacuggaaaugcacaggggccuuuggagcaaaggaagccauugaguagcugcccucuuugaaaaggcucagaauucuuaggaaaggagaaagggaucucuccggauggugaggacgcgggcccugggaaucagaccccacacuguggacuccuguaguguguguuuaauggaggagagaggcuucccuugcugagcgaggcugggguagccacagagaggcugaggcucaggcaggagugggaugucuucccggagccuggaaauagccucugaggagcauuucacuguaaaagccuuaaaaugcuuauuaagcuagcccuccccaaggaagcaggucagcgccuucucugcauuucuaaacgacaauagaggacucagauggcuggcucuauccggcugcagagcuggauagaagccaccagagagaccgggaagcacggagaaguccacaacaggccacagaauccaaacaaggaguuagaaaccuggguauucuccucuucacagcucugacgcuggcucucuaagcaucuucucuugggagcucagcguccacaucucuaaagcgugagagguuuggguaagcgagggcgucucacagacccuguuauugagccuagguguauggagucuucug

SEQ ID NO: 5525 - RNA, 13041 nt, Mus musculus
ucaauuuuaaaaaaggagagaggcaaguucauuuuagcuuuuuauuaaaaugcuuaggauacagacugaccuuuuguaaaugacaguuuuacuuuugcugaaacaggacacaugugcacucugauaaacagaaugaagagucucaguucauuggagccccuggccauggcccuggcagaguugcacuugcugcagcaaccucuuuuggccaccuuacuuaagacgguguucugugcagcaugaagcagacuggugccacuguucagccaucuuucuccgguggccagaauaaaccacuuucacaaagagccacccugggcagaguccagucuucuagguugcuaccgagcaauuagggacaaacgagaaagacagaugaagaacccaacgcugaggcccucacaccugucaugugccuggacagacauguggacagucuuuagccaaaggcaaugaagggcacaacagucaccuaccuagcucacucagggcuuuaacaguaggcccuuccacacugacaguucucaucccagcuguacgugggugaacgcagugcaugcaguuugcagacagacaccucaccaagccucugcauuggaaacccggcaguguaacaaaacacugucccauaggcucagugcucaaaacuaaaaugugguaagucacucuccaggagugugcuucuagcuucccuacccucuugcuggacacgagccugucagaauacagcagcagcaacagcagaaucuccacuuaagaaccuacucucaccuugcauuaaaggaaaucagaaucaagauacccucccaucugcagaccaucuccucucaugcacucaaggguaaaauauaaaguuaacaucacacacggcagcaagaaaaccaaaugcuaucuguauauauauaaaaagccuguucaugauccucacagggccgcugcugcuuucauguuagcacucgcugcugccagaaggccaucuggguuuucuguuauuucugaaggagaaaacacagaguccccugaggguuuuuccuggguucucuuguugcugccagaugagaaucgcacagaauucagagccuuaagcugaugauuuugagcugcacccuccgguucagaaccgucccucuagacuauguucaaaagcaucagucacacccacagcauggggucuacaugacagaugucuguaacucuuucaugaggcaaaagucacuuuuuauaucuacaauggaaaaaaggaaggugcuacacagagagaugaaauuucacaacaguauaaaagcaaagccugcugaaacugguaacugcaaauaaaguugacaacgugaccaugauacuucacccacuccagaugaggacuccccuuaccaugguggagaccacccuggggaaggccgaggcucuguccucuccaggcucuugucucggguaccacccucaacaggcagucacacagcagagcccaaugcgcuaucuguucauaauuuuaugaaguauguaaauuucauuuacuaguuaaaaaaaaagaauagaaaaucuggaccaaguaaauugugaacugaaaaaguuagagaagggauaccaauuacauuaacaacacuuucuuuaaaaaauagaaucacuuucuuuugaaaucaaccaguggugagacauguuuuucuucucgggugucccaugauggcacccagcuuucccuggcaaaugcugccagccccaguccccacacacugcccggcagcaacagcaggcaguguggagaagagcacaugucaccacugggcaaugagcguagacagacguguggcuucucaaugccauacaugguuggagagcuuuccuuguucuauuagaaaaguccaugaggaagcugugaauaggaucaguccagaaguaaaacucuuuauuuucacuguccaaacaucagucaauauacugggaaagccagcggaaacccucgccguagccuugccucuugagcacacugcacaugaauacuuccauggggcgggcguucagcuccuucagagucacauuccccuaagggaggcaaaacccagaaaggcugguuaggaccgcacaugcaaaagcacaaauacacacggauaguaacugcaaguguaaaguccugaguucagcuuucuagcacccacauauaggugugcuaggcgugguggcacacaccugugacuccagugcugagagagaguacagacagguggauuccugaagcucuuuccagccaacuuagcccaauaaaugagugccaaauucuauuacugagaaucacagccaaaguugaccucaggucucuccaugcaucuccaaguauguacaugcacacuaagaaccuggcuuauaguucuguauuuucucucucaucagccuaccuuuccagacagagccucccuuuagguucagggcacacugauguagaugauaucccgguucuacuucugcuuuuagugucuaucuaucccuuugccacgcagaccugaacagaguacuguuuccucacuuguaaaacaggguaagagcuucacuucuaucagcaagaagcacuagaugacugagccuuugaucuuaauaaaaaguauauauaaugcuuuauaaagauccauuuaauuguguguguguggaugucugcagcaauggaggccaugggcaucagaucccuggagcugcauuacaaguggcugugagcugcccaauauggauggguucucugcaagugcaagacauacucuuaacugcugagccaucuccucagucccaauauauucuuuaaaaagauugaagcuagauaugcuggcaaacgccuucaaucccagcaccagggaggaagagaccagcagaucucugguucgaagccagccugcucuacauaggccuugucucaaaauaguaguauuuuuuuucuugauccaaaaguaaguaaauauuaacaucaaaugguggcuaacaagcaucugucaaacaccaguuccaggguaugcaguaccacccucugacauccauggacaccacauuauucaugguacagucauacgcaagcaaaacacccauacauaaaauaaaaaauaaaauauuaaaagacugccuuuucuagcauccuaucauuucuucauuuauuagguacuggaaaagagauaaagaggguaggaguauggcugagagagcacuuacuuagaacauacaaaggccuaagcucaaggccuuuuguaucacugggaaggagggaagaagggaagagaggaaagaggaaggaaagaacuaaggaaaaugccccugauaaaacauuuccacucaagggacccugucuuaaaacacaaaaaaaagaaagagaaaauguaggcaugguucagucacgugguccccgccuccugcccgccuccugcccccgagggcucucugcuuaccuuuccuguggucugcccguacagcccaaauauuucacggaguuuuucuucacugauugcaucuguccugucaauuuuguuucccaagauaagaauuggcacguuggauauuguuucaucagucauuaaagccuagagacaggauuaaaauaacagagccaagugagcacuuacuaagugaaagcccaucacuuccuaaggcacccucggcacugcaccugacaacgggcugcuucaucuucacauuaggucugagagagcacagacugaaaggcccugggcgcguuaacaaaccuggguauaaauagaacacagcagaugacuuaugucacaaggaacuggacagaaaguacacaacagccuguucggggaagcaggacaacccacacuugaacaaaaccuuagguggaccugaaacugcacuccacaggaagggcaaaacucggugaguggaaggaaagaccaccacaguggcagugcaaccaagugagacgaaagccacauacagcgccgccugacuggauuaagacauuuauacagauguguagcaacagagcaaaugugacagcaacugacacccacgucauggugccagucugaaaacuguaagcuccacuagcuccuaaagacugugaacccaaggucagcuaucuucacuuucagaacagugauuugaaaaccagugcucugugcagugcucaccuaagacaugagcugcuaaacucaacugaagggacugugcaagauagguucugugcagagcugaagucagacaguaaagcagacacgaggagacagagcugcugcagauuucaggacugggcgucugagucucacagacaggagagcaagggggagcgagcauuuuuacccuguaaguguuuacagguuuccagagcauguccaggaugguggaaaggaacaauccagacagcuuccuucugggaaggaccaucugguaggcagcacuguccccucuuuugaggcuggagcucagcagguguagaugagagauccaccuggagccauuaccauggaggaagcagagacccucaggaauaccuccauuuagaacuaagcagaagaccaaguaucagagcuaacacuggcugggcaugugguacgcucuuguaaccccagcauuuaggagacuaagaagaccaggcugggcuacauaccaagacccugucucaaaaaaaagaaaaaaaaaaaggaaaaaaaauuaaucuagaguauaaaauaggggacagggagacagcauuggggagaagagcaccggcugcuccuccagaggacccugguucaauuccuagcacccacauggcagcuccuaucuaucuguaauugcgugggaccugacacccucacagagacauacuugcagacaaaacaccaaugcauaaaaaaagaaaggagagcagagcuggagagauggcucagugguuaggagcacuggcugcucuuccgaagggcuggauucaauuccaagcacauacacggcagcucacaacugucuguaacuucaguuccaagggaccugacacccucacagcaaugcucauaaaauaaaauuaaauaaauuauuuaaaaagaaagaaguuagccccacacaaaaugagaccuaaacauuuaaaacacacauuaaaaaacaaaaacuugagaggguuucaaacugcaagaauaaaagaaacucacacaugagagagaacagcgcuggagagauggcuaagugauuaagagcacuugcucuuguaaaggacugaggcucaguucucacucagcacccacauggcaguucaguaacuccacuuccgugggauacuacaccuucuggccuccacgagcacuggcaugcauguggggcacacacagacaugcaugcaacuacucauacgcauaaacauugaagggcgaaggaauaggcauuauaaggcaacacuauacaaaggaggaaacccaaagugaauaaaaaccggaagagugcuagcagacuaugcagucugucacaugacuccauaggagacugauucaaaaacauaaaaaaucaggauuggagagacugcuugguagucaagaguacugucuggagagauggcucagugguuaagagcaaugacugcuuccagagguccugaguucaauuccccagcuaucucauggugguacacaacuaucuuuaaugggauccgaugcccucuucugcugugucugaugaagcuacaauguacucauauacauaaaauaaauaaaaucuuuuuuaaaaagagagagagagaacuggcuguucuuucagguucugaguucaauucccagcaaccacauggaggcucacaaccaucuauaacugaagucccauaggaucugaugcccucuucugguacaggcagacaaaacucccacauucauaaaauacaugaauaaauaaaucugcuuuaaaaaaguauaaaaccucucaacucuugcagaguuucccuaugccaaggcuacagaaagagcaaccacaaugagggaacagcaguccuaccaacaaggcuggggcacugggcagcugaggagcgcugagcaucugggccaugcagguacuggugcaccacaagaaguauaaaacucaguuacucaacugcaagcugaacguccucaggcacugagaagcuaaaucucacugggcuggagauagcccagugguugguuaagagcacuggccgcucuuacuccagaucuauuccaguacccacaugaugguucacaacaguuuauuaucuguuagccccauuuccaggaaauacgcuguccucuggccucuucaggcacuaggcaagcacacagcaccccauagagucagucaaaacacuucuacacauaaaauaaaauaaaauaaaauaaaauaaaauaagaacaucuuuaaaaaaccaaaccaggggcuggugagacggcucagcagguaagaacacccgacugcucuuccgaagguccugaguucaaaucccaacaaccacaugguggcucacaaccauccguaaugagaucugacgcccucuucugguguguuugaagacagcuacaguguacuuacauagaauaaauaaauaaaucuuuaaaaauacaaacaaacaaacaaaaaaaaaacaggacuggagagauggcucagugguuaagagcacugacugcucuucuagagguccuuacuucaauucccaguaaccacaugguggcucacaaccaucuguaauggaauccuaugccuucuucugguguguccaaacaaauaaauaaaucuuaaaaaagacaaaaacaaaacaaaaaaaaaaaaaacguauuucuuaucagguauuuucuucaaagacucugaucacauuaaguacugguacuacugaguuuguauuucuuaagggcaagacagaaaaaaaaaauauaaauauaaaccuacauuaagcucaacuuuggauuccaugagacgagaaugauccgcacaguccaccagaaaaacuaugccauuaaucgcugggagauaauuuuuccaaacgcgacgugcuaaaagacaaaauuugaggaucaacaagacuacgggugacaagugaaugaccuacuggucuauaaagggccucgcugagcuuaccaggcuuggcuacagcaguuagagcagaggaugcaagcugauggccugcgagccaagcuugagauugaaaacuacgaguuucgccuucccugacaaaguguagaacuaggaaccccacacccguguguagcacaacgaccuuccccuuugcuaacacugcagaaaugcccaccaguuccacugcuguaaauguagaaaauaagaacugcccagucugggcccuaaagcugguaacuuuguagccuccaagguguagcugugcaugaguucuacucccauggucguuccuaacagugaguaagugugcuaaggccuggcgggcacuagauagacacucaggccaggcacucaaguuccaauguuuaaccacugucauugugugucauuguucuaagacaaggucucacaauguguguggccugggcuggccuggaacuguccaucuuucugcuucagccccuaggugcugaaauuacagaucuguaccaacauggacgguggcucccaaccaucuauaaugggaucugaugccucuucuggcaugcaggaugcagguguacaugcaguuggagcacucauauacauaaaauaaucuuaaaaaaaaaaaaaaagguucuuggcacacugcuucccagcgaugucucacaaaucacuaucacucgucucuuaccuugcucaugcccaccgagaucaaaaguggugaaagucauuccagcaauugucaguucuucugaagcugaaagugucaaaaaggaggaaagaaauaaacuuccaaccaaagguccacgugcuaguacugagaaccaacacuaacgcaaacaaucaaguuuucauuguguaaagacgaggauacaguaugaaaauauucuuaaccuuaagaagccucaauuuccccuuucuccaaguuuccugcuuaagaucaaauaugggagcuaagucucaucacagaacugaucagaaagucccagggaugcagaguaggugaccugagugaacuacaguaacuugcuuccaggaccucaguuacuaagagaacuccaucaacuagggauggauccauccuccauucauggcacugaccaucaggucaccucugaaacuuacugggauggaguguugguacgugcuggccuagucugucaucuuucagcaugugaagaagagugguuuugcccgcauuguccaauccuaagaauacaaguuuuccagauuucuuguagaguccuguaagagaaaagaaugucuuaaauguucuuccuaccaaaggcagcuuagauacuauuguuugaggaaauauaguugcaaccuguacuguguuuuaugaaaauggcuuuaccuaggaacuggagcacacugcugaagccauuguagauccacucaaagaugaaagacauuauugaugcuuacaaccuguguaaaacaugaacguaacauuagcuuucugcaugucuuauucucugacacauguccauaaaccuaaguucccuaaaguaggaaagcaaaguccagggcuggagacauguuucagcaguuaaaaacaguuguugcucuuauagaggacccaacuuugauucucagcacgcacaugauaguucacaacuaucuguuaacucuaguuccaagggaauccaaugcucucuucuagccucuguguuaaacauacaugcacgcaagcaaaacacucacacacaaaauaaaaaucaauguugcaaagacuaacuaaucuccuuaguuuuugagacaaggauuuuguagucugaagggaagacucuaggacucucacaucugcaaauucagauaaccaaagaacuaggcauuucagacacaccaucccccuuuacugggagauguacuccuccaggaagcuacccauucacugcugccuacuaguuggcaacaucccuagcaaugcaguaucuuuaaugaucagaaucaagcugggugggggugguacaugccuuuaaucccagcacuugggagacagaaucucuucguuugagaccagccugaucuacagaagaguguuccaggacagccagggcuacauagagaacaucugucuugaaaaaguaaaaagcugaaucaagaagccaaacaugcaccugguaugaaccaugaugggagcuguguguggugacauguccacgaaaucccagaacuugggagacagagacaggaaaaucugugcccagccuugguccacacaaugaguccuaggccacugggauucuuagaacaaaagaaucaaaacaaagcuaugaaugaagaguucauugaccugaauaagaaguuauuaagcuguucuauacagcuccaaaaaggacacagcaaaucuaucaacuggcccaguuugguugacuccacuuaccaauauccuuaaccauuuacagauguuucaacuugugaaaggauauccuguuuuacagaaacauacaggaauaaaaacuucuauaauauaaucuaguguuacauauuacgaauucuuaauuucuuaaguauacuaauucauaauauaguaagagguucuaaagcaagcaaacaucuuauuuguuucuuuugagacagggucucaaccaugaagcaccaaggacugcugccagucugucuuaacuagcacagacaccaaaaccacuuuuccuagugccuauaggcuuuaaggggaaaauguaugaguaaagccacugagagcucuaagcacaguuaagaaggaaggaucuagaaauaccgaggaaugguaagauucacagagacccauuuccuggucacacugaauuucuguaucagcagcuccguuuaucgcagaaaagaaaaaccacuacuuucucaacaagacaaaacuugacagaaaaugcaguaacugcaauuacacaaaacuuccaugaacaauaacuggaggaaauuaccuauguaugcacauucauacauauguguguauuuuuaucuuuuaagagacaggauccugcuguguugccuagacuggcuucaaacuccagggcuuuaagcuauccuuaugcuucagcauccugaaugcuacuacgcagucucaccugaauucuucaaagaugcuagaugaaagcaaacuaucaaauuacugugguuuuaucaagccuauggccugaccuguaaaccuuagaaacuaccucaugcuugcuccacucagcuuuuaugaaagagcaacauuugggugaagguacagacagaaacuguggcacacagaacacauuuugcauguuaaguaauagccaggaggggaaguacacacuugcaaucuuaccauucaagaggcucaagaagaaagaucacaaguucaaaggccagccugggcuacauagggaauugaaggccagcuuaagcuacacaucaaaaccccugucucaaaaacaaacaaacaaacaaacaaacaaaaaacccaaaacaaaaaugcuggugucucacccauacaaugaauugaagccagccugaaucaugaggucccaucaccaagaaaaaaauaaaaaaaaaaacguauggaggggaggcugggagcauagcucagugcaagcaagggauucuuagcuaaaaugcauggcccuggguucgauucuuggcacugacaaaccugcacaacuuagcacuuuaagaagccaguaacaaauacauguuuaaauucaaguuuauugaguaaauaaaacaauacaucuuucuucuacagucccccuagccagacauccucccuuaucucucacuuuauuccaggagagacccaguucaucuuuaacaggcuguggccuacuguggccucuuacacccaacaagucuaauucaugugcacugguuugcugccaauaguccagcacuuuguuuuuagccacaucucuuuagaagaauucccaagauggacaugggugugaaagcuuugaccacagcaccugagaggcugaggcaggaagaggagcuuuaguguguugcagcuucaccaagccaaaguaggcuacauagugacacucuguuucaaaggaaaacaaaacaaaacaaacaaacaaacaaaaaacaaaaacaaaaacaaaaacaaagaaaaggaaagcaaauauucucagccugguuaauucuacaaaugugauacuuuagaggauuuuuuuaagugguaacguaacugacuuacuuucauuuuccaauuuauuuuccuucccaguucuuguuuuaaaagccuuccuaccaaaaugauaaggaaaaguauuagaaugaauucuucagugauguuaaaaaguaguacugggacuggagagauggcucaguggguaagagcacugacugcucuuccagaguucaauucccagcaaccacaugauggcucacaaccaucuguaaugggauccgaugcccucuccuggugugucuaacaguuacaguguacucauauacauaaaauaaauacauaaaucuuaaaaaaaaaaaaaaguaguacuccucucagagcccagaguugggcuguacugcugcccaaagcugaagaaauggccuugcugacacuguccuugagaucucgggaucugaaccaauucauccaccagcaaccuuagaauuuauacagcaccagcacaaauaccuucaucucauccucccaccaacucuagcaagccaagaugaagacgaggacacucuuuaggcucccuguccuguucaagacugugcggucaaaagcaucaguuccaaaagccaggagagacggaucagagguucagaguaccaacugcucucccagaggcccuggguucaagccccagcacccacaugcggcucagaacuguaacuucaucucuaggggaucucacacaggcacacauggagguaaaacaacaauucacaucaaauaaaaauaagguauuuaagaagaaaagccucucaccuaaaaccaaagcccuuuuccugcuaauauuaaauuccaaucauaagacuuccaaaaggguaaaagguaacuuucuuccuuaaccuaccaccuacacagacgauaaucuuaagaacacacuauuuucuauucuucgucuacucuaucaucuauggaauguuaagaauauuaaaaccaacaacacaauucaugaaccuuaaguaaaaaccgugcaaauaucaagaugggaacaaacaagugccagaaagaccaucaagcaauaaaaaacguacucucaaacauauucacuccgggugaaucugggauagaaggcagcuggcuauuaacuaagaaagucuacguagcugcaaggugaaugucaaagaucagcuuccugacaauuccccccuaacccucccuucucaaccugagcggacagugcccagguacugaagaaacacccagugagggaggauacugagaaaggguacgacuaccaaugguaccauuggucgguaccauucucaccuggguaaaaaugacgaagaaaacauucaucuacgauaaucgcccaagagggaauuuuuccaugcacaggaaaaauaaaaaggguggaugggagugggguguugguggagggagagaccauggguuccagacagggcaucggauacccagaggcugaacguggggcucgagcgcccacucgcuacucgagggccacgaucugcagaacgcaaggaugagugccagggcuccagcuauccucaccgaggaaccagacuccuccgcuauggaggccacgaagccgucuccucccccaaaaaaaaccccgaccgccgccacgccaccccgcagcccguccccgcccagagccggcccgcggaaccgccugcgugucacugcacccccacccagccccuccgcggcggccccgcgccccggccuucgcuguggcccgucccgggcccgcugccccaccgccaccuccuccgcuggggccccgacucacggcccgaggggcuccuccggcgguggcuggcggcgcgacccucccucagagcacacagaccagcaguccccggguccgccagcuacgcgccggauguacgucacgccccucccugagacuuccgggcacg

SEQ ID NO: 5526 - RNA, 7262 nt, Mus musculus
aaagaggucaagccauucagauuguuuauuccccagcuccaacugcucugggcuacaaaaaugaaggcaccgugucugaguuaaggcccagguggcucucggggauuugccuguguaucacuguggcaaugggaagacacucuuguuacugaccacuaggacucugggcuuccaggaagaguucucugaguagaguguaucaggcaagagccacuucggguggaccaggggcuaucaggcugagagaugccaaaccgguacccgccaaaggacuagaacccccagaaggaacaauggcguugcugagucuaauccugggaaacagaugagacaggcucaagaaagcaccccaaaguagaucagagaccuacagaaguugcacgugguuagccagugggugaagacgaugaggggguggcuugggcucuaucccagcagaugacuuagaugucaaaguugccaugccaauacacuucccguggccuuaaagugguccgcuuucucccagggaggcacaguagcuucagagcuugcuccgugggacuucggacaggggccgcugcagccgccacacgacccugaccggcucaguggugugguccagcucucggaggccacccaggucaccagucugacuguacugcuucagggcuggcuggagcaccgugauggggaugcugaaguucagguguggguagguggcucccguguuguugucucgaguguugcuggcgacaaugccuauuggggagagagcaaugaggagaggaagcaguagaugggguaccuauggugcagggaggaccuucgccuugagggagacucagggggccccuuuuggggauugggaacccccagugcugggugcuaagcuuuugcuacagcuucuucuccucauaucuccccaacucuguccauacugucuccuucacaacauaauggccuagcucacuugaucaucuuucuuucucaccacaaagggcaggauucaggguagucccacagccuguggaaccaccaaaugaaucaaacaggagaaaaaggagccagacucgcuuggcuucgccccgcuuugcuggcuagcuuuaugucaccuuggcacacacauucuggaaaagugagccucaacugagaaaauguccccaucacauuggccugugguggguuuucuugauugaugagggaggguccagcccugggcugguaguccuggguaugcaagaaagcaggcugagcaagccacagagagcaagccaguaagcagcaccccuccacggccccugaaucagcuccugccucaagucuuuguccugacuuccucugacaauggaacugugauguggaagguauaaccagaauaaacucccuccccaagcugcuucagaucaugguguugaucacgacaguagaaacucugcgcaagaagguggcaugggucuuuuuuuuuuuuuuaauagcauuuuaagaguuaaagaguuggcucaggaaaauggccuagucagccaucauugggaagagaggccccuuggucucgcaaacuuuauaugcuccaguacaggggaacgccagggccaagaagagggaguggguggguagggaagcagggcacggggaggguauaggggacuuucaugauagcauuugaaauguaaaugaagaaaauaucuaauaaaaaauuggaagaaaagaaaaaaaagaguuggcuccgugguuuaaagcacccguucacuguugcagaggacccgguuuugauucccaguauccacauggcgguucccaaccacagcagcucuaguucuaagggguccgaaagccucuuccgaccuucaugagcaccagggguguucauguuacacauacaugcaugcaggaaaaaaaaaaccucauaaaauaauucauagaaacauagggcuagagggauggcucagugguuaagagcacugacugcuugcucuuccagagguccugaguucaaaucccagcaaucacauggugacucacaaccaucuauaaugggaucuucugguguguuugaagacaguguacucauauacauuuuauauauauacauauacauauacauauauauauauauauauauauauauauauauauauauauacacacacacacauacauacauacauacacacacacacacacacauauauaugcauuacuacuaccuggcaaaauaaauaaauuaaaaaaauacauaaaauaauguaagaagauaaaucuaaaaucaucacuuuguacuuacagaagucucaccuaaaugcuggugcuccuguguauuaauaucuaauaacugaagcuaccaugcagcuccucucuacaugaauaucuaucuucugucaucaaauaaaggaaaauguuacaaucaggcuggccuugaacucacugagcuccucccaccucugccucuccagugcugaguuuaaaggugcgcaccaccacaucuggccuccacuggacauuuguuuguuucucucuucuggugugucugaagacagcuacaguguacucauauacauaaaauaaauaaaucuuaaaaaaaaaaagaagaacccugcauucaucaccaaagcuuacaaauuggugguguaugccguaaucccaguacuugggaggcagaagcaagagaauuaggaguucaaagccagcccaggcuacacgagacccugucucaaaguaaaacaaagacuggacaaccacccacacgguaaaaaggcuccucucuucuucguaaugacggcugcagcguggcacugaccccugcucugccccacacugcccaguuuuaugcucucacucacugcuucacaaggccagcuccguagauuuuugaguuugugacccucagacuaacccaggccuaaauuucguuaucuaaaugagauucagugaaggucauaguaguggccagaaccaggagagggccaccggccuagcucuuucccccucccagcucagcauccuucucucgcuccagaggcagauuagcugaaaacuucggcuaacuaaaggaaggcacaagguccaccauuaucccagaagcaccccccccccccgccccaagauggauggcaggcuggcuaucacuggcaggaucaaggcaauugggggugaaaggagcuaguuacccaggagguccccggagcccgaggagaagagagguccuccgcuggagccgccaugcacagcgcacguggucuguagcaucaccgggcugccauccacacgcaccacggccgacaggaugccugaggucaccgagggcccgcaggccuggccaaagacaccaaagcccaccacgcugacaggcucgccugccagagaggggagaaaagaagcugcgugcauccucuaugcccacucacguccucuccucuggauccugcucauccccuuccaagacccuaggcauccucccucggaucccugcagggagauuaagaauucauccuguucccaguugcauguauccaaccagugcucuggggcaucagcaucgggcaggcccucagcccucacuccuuuacugagugggguagucacuuuucaggcuguggucaccuagcucaugccuguagucacuauccaucucucugggaccaaaucucuuggugaagacauggugauguggccacacccagcgcuggcuccauucuccaagugcugagaaggaacacggcacaucucacccaguccucacugcacccgaaggcgcaccagccccauuugacaaaagggcaaacugagaugguguguguauguguguguuaagaauguacggcagaggacagaugcuaaucuagaggaccucucucucuuuugucaccauaugaaauagaaucuuuggggcuggagacugcuggggcagucaguggugugcuugccuagcgugcacaaacccuggguaucccaugaaaugagugugauagcacaugugugaccccagaagaagaggcaggagaaucagaaguuuaugguuagccuuggccgucugggguguuuaccgcccacuugggcuauuuaugaugaugcugucucaaaacauaaaaaaaucuaagacaugccacccaaauuauggcacuggaguucccaaggcccaggaccccauaucacccugcuucaggcccucaauaagguauccacuuggcucagcacuugaggugucaacgucugauauacagggaagucuaagaagccccaaacccuaccuaagcucccaacucucuugcuuggcaggcuuugcccauuucugccugcuggcuaucaggucucucucucacacacacacacacacacaccaccaucacuucagucccuuuguccucuaccuucauggaagugcccagcagggacaggcgugggaacaccauucagcuccucuuccaggcucaccacugcuaugucauauggagaggucuccugaguggcaaacaccacuuguccccagauugccacauuccuggggacacaggaaacaauugacaagcuagccuucuguugucuuagcacugggaagagagcaauacgagagacaagucuuggaaugggcuggcuaugguggcucauaucuuugauccuaacacuugggaggcagaggcaggcagaccucugugagcucugggcauauugagagugucuuauuuugagagggagggagggagggagggagaaagggagagagagggagagagaaugaaugagugugcuauggacugaagucagaauacagguacagguaucaaccuugaaaucuacacuuaaccagaugugcuuucccaacacaucacacaucuauacaaagcuguguaugccugaccauaaccaggugagugcugugaccaggccuugcugaugcuuggacagucucaauucuuccccuuaaacuacaaccaaggcccugggaguauccccuuuagauggugcagcugaggcucagagaggccaagcaaccuuccuaaaggucacagagcaaacagugaggagccaggccaagccuaacacaacucuggacuccugggcaggcacgaggggaagaggcuucuuuuuggagacagggucccucuccauagcccuagcuguccaggaacucacuauguggaccagacacgggggcacccgacuaccuacucugcaggggagcugccuccagaaaaaccuagugauguccuuaagaucagccaucgaagggagagggagaaguugggggcacaccauaggcaauccuccuugucucuaggaaacuauagauguucaguugccugcccaugggggcccuggcagagcugagcuucacuggcauacagggcuaaccucagaaguucagaaaggccugggcugacaggcaagggacaagcuuaaauaaagccaagguccuaaguuaaguaucuggggcuacagaggacacagaaccauagacaaccaugccagaaagccagggccacuggccuacugccagggcaaaaaaaggagagcaaaggugucucuccacagaggaaguaaguugacugucuaaaguuccuuuccuaccuacacucuggggucacucacauccauccgcauggguccaagcccuaugcucucauuaggacaaccuugcuucaucuucagguggcaaggcaguccuggugaggcucuaagggagcccucacuagguaugccacaucaaucauuaccucagggcuuucguuuaucacuuacaggguugaaguucuuagggucagccuucuauggucaaagggcuuucacagggccuaaacugcaaagccaagagacagaaaagcugcccaaagaguuucaugcuagcuaaagggcucaaagucacccaguccuaccugcugcugcccauagucccacggguccccgcgcuaagagucgcuugugccuggcaguuugcucaagcuucgcugggcccuaucaagaggcccagauccccucacuggaguccugguugucaaauaugaacugaggucucuaacacugggggccuggugagggcgggcaguccugagucuuacuuggguguagcggaguguaccaacacccuggcugcuucccggggugccacauggcgacaggugaccaccaggcgaggcgccacgaccacuccggagccccacacgguaccacacuccaccagcaccgccgcggccgcccacggggguccgagaucgcgcagaggcaggccccguggcgugcucacaucggguggcggcagcagcacagacagggaagcggagccggggugcagacgggcgagcgcccagcgggcaaccugaagcagcggggcggcggcgcacagcagcgugaggcccacccacucgcgggccuuccagcagagcggcgcggccaccagagccaccagcgcacccgcaggucgagcggcgaacacuccgccgccuuccgugcccggcaggcagcgcgcgucggugagcagcagcggcccggccgcguugcugagcacgccgcggcucagcguguugaggaagauguccgggcagaaggcaccgaacggagagccacaagccaacagcggugcgcccuugaccacggccccgagcggugccacggucaccaccgguccgcgccucuccuccgccgccgcgccccgcugcacccgcagcagggcgaaccagccgagcgcgcgcagcugguccuccucuuccuccuccgaaaccgcaucgucgggcgccgagcuuacgaagugccauugaucgaccgcaucggccccgaagagccgagcgaaaugcgagcggaaggccgggcagcugagcagcaacagcagcugcgcuggucgcgggggcugcagaggccgcgcgcgggcccggcucggggcgccggguucgaggcccaggcuugcgcacugaggcgugcacagccccgggaguuccugauccgcgcgaccggcagggcuggcagccguggguccccacugcacguggagacguaggucaucgcugcaacugucgcccggcaggaaggcggugcccgucugggucagcgccgcgcugcccguccgcaggaaggggguaaagaugccuccguggcacagcacuaggccuggguuacggcucagaaucaccccgcugcagcuccacgagcccgcgucaggcuguccggcccgcgaggcgcucaccacgcagcccgccugcuccgccacucucauagaggguccccauugccgccccauggcuuccccaagacgucgcacaacggcugucaccacagggcgacuggcgcaaacucug

SEQ ID NO: 5527 - RNA, 2071 nt, Mus musculus
aauggccaggccuaaaucaggcccacccguggcucauuugaagcccaggcaccaucaguaaugcugaacucgugaagaaggagguucaauuggcguuugguggcgggggugggguucgaugccccuuuggccauuguugagaggaacaaagagggcaggagcuaagggcgcccccaugaggaaaggcguggaaagccacucuggggagccauccuaggcuagcggggcuggaaagcggugcaccuggauggcgcucuggcaaccggggaggcagggcugauuucuacccgcggcagcggcugccgccuuucccugacuugacuuugaucccccucuucuugauauuguuacuauuauuuuuguuauuuucccgcgcaaauuaagcagcugggaccgguagggcgagccgcucaggggccgccauuugccgguggaagcaccgaucgccccggaaagggaacccgaggggagugcucggccucaaguccuccuccgcccgcggcucccgcagcaucccggcuccgcgcccgcgccgccccggcgucucugcguccuccuccauugucagccccgcgcccagcucggcaccccggaggcccuggucgcgcgcccucggcccuugcgagccagcgucccccucccgguucccucggcgcccgggcgccucccuccucccucccccgcuccccgagcuccgcauccagggcucccggcaccgccagccuggccgcgggaccccgcauuucggcauccucccugcuuggcccagggugccccggccccucgccagcggcgggcaucgcgcggcgucuucggcaaaccccccuuuuaucucccgaggaagcaaguugggcagaucgauuuauuaauuucuguggcagaggugggucggugaccggggugcgcccucagggcugcagcggggaggcgccguggcucccuucggccccugcacugcccggacaagaggguuuuguuuccagacccccggcgccccccgaaacaaugaugccaugggcauggcgggcucaccuggugcugcaccgcgggcuccgggcgcccgguggccuagugcgcgccaaucccggccgcagguucggcccgcgugccgccggugcugggcaggacccugccuuucuugggguuguaucugugcgugucaauggcggcaagcggcaguucuccgggccgcggauaguagcggggggaggaggaggagggagaagggauugcuccuucuccacauaaccaccucuaggaggagucgcucagccucaucccccgccagcccaggcuccgcgacggguccgggggcuuucguggggcuugaugagcuauuguccuucugcaguggaaccacagggccaguucgcggagcugucggcugcgaggacaccgcuucccuagagcccggcacggaggccuuguggucaccagccacaggcuccagauagcucgacccaccuuugcugggcgaaagaggugugggcguucaucugcccauuacgggaugagaaggugaacgaaaaaaaaaaaaagcaagccacguuggaugcagcccugaucugaaauuaccaaacacguuacugugucgcgcacggcgccgaaggaaccgagaauuuauucuggugauucgcuaguagugauggagauccagaugugcuuccugguggaugaagaccaugugccccggcaucauuuaaaaauuggauugcguuaauuugccaucucccgacgguuauugagguuaagcacaaagagagugucuaaagaagcaauuuuuuguauuaguuucuggaaaauucauugugauggcggugcaguggacaguaucaggugacacugggcgcguguaguuguuuggucccugaugaaaaaccacguugucuuuuguacugugaacccugucaagggcacauggcucuagggccagucaccguaagcauucaguugaauggacgguccauggugccucagauuuuuuccugcaugaaucagaggacucugggaggaaaccuuuugauuucugcaaaaaaaaaauaaaaaauaaaaaauaaaaaaugugaagccg

SEQ ID NO: 5528 - RNA, 846 nt, Mus musculus
gaugcccagagggaagaagcccaaggggaagaagguggccccggcccccaccgucaucaagaagcaggaggcuaagaagguggucaacccucuguucaagaagaggcccaagaacuuuggccuuagacaggacauccagcccaaaagagaucuaacgcgcuucaucaaauggcccacuacaucaggcugcagcggcaaagagccauccucuacaagccacucaaagucccuccugccauuaaccaguucacccaggugcuggacaggcagacagcuacucagcugcuuaagcuugcccacaaguacaguccagagacaaagcaagagaagaagcaaaggcuacuggcccaugcugacaagaaagcugcuggcaaaggugacgucccaacuaagagaccaccuguccucugagcaggagucaauacagucaccaccuugguggagaauaagaaggcucagcugguggugacugcccaugacauagaccccauugagcuggugguuuuccugccugcccuguguagaaagaugggggugcccuacugcaucaucaagggaaaggccgggcuggggcgccugguccacagaaagacaugcaccacuguugccuucacacagguuaacucagaagacaagggugcucuggcuaagcugguggaagcuauuaggaccaauuauaaugacagauaugacgagcuccgucaccacuggggagacaacguccuggguccuaagucuguggcucgcauugccaagcuggaaaaagcaaaggcuaaagaacucgccacuaaacuggguuaaauguucacuaaauuuucuguacauaaauauaauuacacaaauaaa

SEQ ID NO: 5529 - RNA, 1602 nt, Mus musculus
uuuuuuuuuuuuugacuaauguaacuucuuuuaauugucauuuuaugcuuucugcagcugcccgccacccucccuucccuucgaugaccacuuuuguaggcuauaggggaccagggaacaaaagcugugggggggcgggggggacacgcagccccagucaggugguggagaacaagcuacaauuacaaauuuaucacaacaauuaaugcugaagccugggagagcugcagaguggggaggcccgcuccucuuugucagggucuauuuggcagugaccuugcucugaaggcgaugguacuccuucagccugagcgaguugauauugaugaagccaguggcgucgaugggcucauagucacccugcacguucaugcucaccagcucuucauuguagagugaaaguggagacucccgaccgaggauguacacuuggcccuugaagacagacaccugcaccuucccuucuacccgcuccugggacuucuggaugcaguggcgaacaaauucacauucagggcugugccagaaaccuguguauacgagcucugcgaauuugaggcccaggcccugcuugauuuugcguacuucccgauccaucgugaaggccucuaugucuaaaugagcgugguaaaggauggucccugcuggggucucguagauaccucgggacuucauuccaaugaagcgguucuccacgaugucaaugcgacccacuccgugcuugcccgcaacuucguucagguacaugaagaguuccagggauguggugcggguugugccaucuuugauguuggucaccuucacagggaccccuuuuuugaauucuaucucaaggacaucugggguguugggugcuuuggcaggguccugaguuuuuguguagagacccggaggugcuugauucuugggguuuuccaggaucccagccucauagcugaugugcaugagguuuucauccauacuccaggggcucuugggggagacagggauggggauuccguguugcuuugcauacuccaucagaucauuucggcccuugaaccgguuguaaaacucaggcauccuccagggggcgaugaccuuaaucuggggugccagugaguagcaggugagcucaaagcggaccuggucauuccccuuucccguggcgccgugagacacauacuuggccccuucacgcugggcaaucuccaccugucugcgagcuaugcaaggccuggcgagagaggugcccaggagauagcgguccucguagagugcacuggacuggacagcaggccagaugaacucuuccacaaauuccuugcucacauccucaaugaacaccuuuuuggccccaagcuucagcgccuucuuccuggcuuccucaaagucuuccuucuggccaauguuggccagguaggcgaugacaucauagccuuguuccuucagccacacgaggaugcaggagguguccaggccaccacuguaggccagaaccacagagcccuugcuggacaucuugucuuggauuauagguacaggucccuggaguccguguagucugcuuuucuggccagaugaaccacucagugagcacaggcggcaguggcagacggcgga

SEQ ID NO: 5530 - RNA, 1676 nt, Mus musculus
uagggagacaaacagugcuucaggaaccgucccugcaacucacacuuuagacacgggagacaaguuggagagaugcucuagccauaggcuagggcuuuccgguucacagccuggucucccuugggggaaggguaacgacuugaaaagugcagaagaaggcagaucaccuucguggacuaaggcagaauggagaagcucagaaacccugcauguagcgggcaguaaagacgacgaacaucaucuaugggccaagagcuggauggaggagccagugagguaagacgcaacacuggauuaggucacccuggaaaaagugauggauggucggaggccggcagauuugaaugagggcagacucaccaggaaguaugggagucuccaacuagguagugcuaccauucucaaaugcuuggagcgagaguuugauguggcugcaccgaggagaguuaagagaagagcagcccccaaugucugcugugcgcagcagcaaggguaccgaugagaagccuaguuaagcccugugagagggcuagggauccaaguagugaaagccagaagaggcgagaugcuugagagccuccacuaccucccacuccagacggcucugguccccucccuuuccacuagcacccaccacccagagccagacaggucucuucacaagaagucugagaacaccagugcucccgggagcagauaggauggggagcugggcaccugcaggccagggaauuccuccaaugaggccguggggcucagguuacccgcuugggagacuggggaguagauagagccccaguccccguuggagccaccuccggggcuccccagcucuccacagggcacagggggcuccgggccauagaagcugugguccgcuaugcgcagcgucugagucagugcccagauguaguugugggcgaagcgcagggucucgaucuuuguaaguuuggcgucauccgggaaggugggcaggacaccgcgcagcgcauccagcgccgaguugagguugugcaugcgauugcgcucccgaucauuggccuucuugcgccggcuucuucgcuguuugcugagugccaacucgcucuugggccuguugcgcccuccgcgucgggcgcggagcuuccucgaggucccucggcagucacccacuucugcuucggagcagucccuagguaugagaguggggcuaggugggguggaauuggaacugagcacuucgugguccgaggcuccgggaaaagguuguugugucucuggggacacuuggauggugagcgcauccaagggaugaggcgccauccugcgguugggaaaaaauggaaggugugugugugccagccucugacuuagaggucacugcacgggggaccagaguaucccccacacacaccccgcgcgccccucauccacccuuuggaguuuccgaauuguuaccuaguucucccgacucaaaagaauagagagcagcaggucagucagugacaagcagcaguggauagggucagugucaagcagcaguggauagcugagccucucugcucccucugaaguucugcuaaacugcaggcgcccucgccuggaguaaauugcgucuggaagucguagaaaagcuccgaggagguacucgaccacugcugcagugaugagacccagagggauuucugagcugcaug

SEQ ID NO: 5531 - RNA, 45859 nt, Mus musculus
ccgagcggugauugcggcgcgccugagucaguccagggagagagcgcggguggcgggccaggccgcgggacagccgcagguggggccuggagcgguggccggaucgaggcagccccgcagccccgcgcgggagccaagaugccucgcggggacucggagcaggugcgcuacugcgcgcgcuucuccuaucuuuggcucaaguucucucucaucaucuacuccaccguguucugggugagugauggagcccguggagccggggucggggugggguaugggacgguccacacuccuucgauggcccccuaacacucgacccaggcuuggguucagcuucagccacucagagaggccgccgggagugcgggagggcuucucgcaccacuucccugggaaccgggauaccuuggcggccccagcucugcucgguuccagcagcccagucaguccucagcguucgagcccuguugcccacaggacgccacuuuguucaccuaugcugcugagcuccuaccuaaugggguccggcucgccagccgagucugcugugcauccucuggcugcuguguagggcgcggguacguuguugacugcgcccaccacgccuucagggugugacucuccacagccuggccaaaggugggcagcuuuugugcuuguggccaccuggauuccaagucuggccccuguugcuacuugccugugccuuuccucugaccaagauguuucucuugggcaucuugcuuucuuccuuguuggaaggaaaugcuuucuuguuggagugcggcauuccacuugacaacccggcggcuccuggaugguguugcuauuuucaugaggucuggcauugcccauagaggaucaggauggcauugguugcgcacaaccaggcuuugaauacuacccgccacuuccuagcugaauggucuggaaaguuccuucauuucucugaccauaguuuucucaucuguaguuggagacaguaguuauuaaacacuuggaugguuguggaaguaaaauaacgcaggccaagaugaggccacagagagcuaaaaaaaaggggggagauaguaauaauauaauuauuauauuauaauuauaaaaacauuaacaauaaauaauaauuauuaguauuuauuguuauugcuauuguuuuuuggguuuuuuuuagagacagggccucuguauguaacugccucugucacccaagugcuggcauuaaaggcaccuauuauuauuguuguaguuauuguugugacagggucuuacuauagcuuagucuagcugguggugguguauauguguguguguguguuugcuuauuuguuuugagacagcaucuuaugcauuucugguugauuuagaacucacuaaauaguccaggcuaaucuugaacucaguaauccuccugccuuagccuuccaaguauuggaguuacaguuguaagacaccaugucuggcaccauuaauguuauuaugggcaagaaucuuugccugugaaugguauaagcuaaaagguccccagggacauuuccccccacagggucucaugucaucuaggcuggucccaaacucacuguguagcugacaaugaccuugaacauuggauccuccuguuuguaccucccacacacuggguacugggaucacaggggugugccacuaccccuggcuuaucagggcauuuuagaauaacuggacuucagucuagacacgaggauaucuuuccacagguuggcccuguguuuaccucuacagaaguguguauguagauaggcuuguccagagaucccaaaggguccccugaaaauaagguccucccuccuucccucccuuccucuacuuucucucccuuugucuuucuucucuucuuccucagcuccuuacugcauuucuucugugggcaggaacugcugggcuggccaucaagacugccuuugaaugggagcccuuuacaaggcgacccugcuggcagucaguagaucuugauucuaguccugcuaugucccagacucacuggcauauuguaggcaaaugauaucuguuuugggucucagaaauguugguucuagccuuuggcuagcuucaacuccagguaccccgaaagaaagauuagcaguguugcuaggcucccaaggguagaggguggggcagagacaugggguaugaguugcagggagucugaagguucggauagacgauuugagcuauaacucagaggcucucacccaaaguugcaucggaauuaacugggagguuuccaacagaucccugugccuuggcacacguguuuauuacuguguaccucagcuccucacacaacugcagugugagccaggguugaaaaccccaacgcuggaugggccugggagaccacagugauucugcucaguuuaguccugucuauaagucagagacaaaagggaaaguugaggacaaggguggaaagguggggggucccauucccucucccuccucaccuccauuccauaccuccucaguguguaaccacuggcucuucaugccucccccuuuacaccuguaaaaugggaauguguuacacucugucuugcacacccacagcaucccuuuuuaggacuaguagugagagagaaugaggaaagagcuggcugaaccuggugagauacagacccccccccaaaccuugucaaaguaaaacacaguuauauaaaaucagaagagcucacaaggcccaaaucacugccccuugcagccccuccccacccccacuccacccucuuuagccaaccaagccugcuguguaccaaccgagccaucccugacgguauuucuacuuuaaaaaaaaaaaaaucuccccacccaggccaagaacucagcugugggcaaggcugcugggacggcuccagguaccagagugugacugcagggugacugcagaguggcagcgggcggcugccgguuaaguaauuugucuggauugaguuuccugcuaauugaaaagcauuuacagaaaaacccauuaucuggaugcaaucuccugccucuccccuggcaagaagacaggucagagcaaggguuacucacuuaccaacccagagugugagugcuugcagggcagugguggcccuuuagucccagcacuugagaggcagaagaagcagguggcucacucucucucucugugaguuugaggccagccugagagggaaagggagagagagagggagagggagagggagagggagagggagagggagagggagagggagagggagagagagauuuuaccacagugaaccuucagaucuucugucaggcucuuuuagcuuuggucucuuuuguuuuguuuuuuaauaggauuuauuuauuuuuauuuuguguauaaguguuuugccuguauggaagcuguguuaaaugcuuuuucaaaauagugucaacuauucauuuguuaucuugcuauauggauuauacacauauacggagaucagaggacauuucuggaucagauaguucucucuuccacucugacucuggggaucgaacucagacugucaggaguaagcggcaaucgcucuuaccugcugagccaucuugccggcccuccuugacucuuugucuccugagaaaugucuuuagagaugagaaccuugguguaaaaucagaacugcuuuucugcuguugagcugguagagucccauacacguucuggaggucaaucccucgucccacagggcagcagcggcggccuuucuaagccugcccgcauugcuccaauuuuguccgugugcuguugaaaccagcaaagcuuuuauucugagcauaacagauaagggaaaggagggggcuccaucugggcugaucgugcaagaacacuugcuugcccagcgugagcagccccuggauuugaucuccaucccagagggggaaaccaucaauuguuucuauaucagcacccugcgcuuucccacacugcacaguccucccugaugguccuuuacagggacucuggccacucuucccaaccacuuguauauaauucugcuggaagugcguguggcuuggccaaggguggugggaaggagggaggcggguagaguauauagauggggaagaacugggugggggggggcuucaucuacaaagucaugggggagucguaaccuaugcuggggcacaccuuccugaagagcugcuuuaaggucacccaggcuccugccauaugugucuggugcccauggaggccaggagaagguauucgaucccuuagaucggucuggaguuguggaguuauacaguugugagcugccgugagaguguugggaguugaacccggauccucuggaagagcaaacagccaguucucuuaaccacugaaccauuucuccagccccaugaccaugaauucauaaucucucugauguaccuccaaaaucccgagauuguaggcagauaucaccaugccuagcuuauaaaaaucgucauugacucugcaggauuaggugcauccucucccacugaggccagacaaggcagccccucuacuacuuaugugcugggggccuccguccagcccauguaugcucccugaguucccagggguccaggucaauugacacuguugcucuuccuguggggugcccaucccuuucagggcuuucaauccuucccccaacccuucuaagagguucccuguccuccauccaauguuuggcugugggucucugcaucuguuucagucggcugcuggguggagccucucagaggacaguuacgcuaggcuccugcuauaaacauaacagagucucauuaguaguguuggggauuggugcuugcccauggaacgggucucacauugugcugguuguuagcuggccauuccuuuacucacugcucuaucuuugucccugcauuucuucaagccccaauuaaaugcuucuuccuccuccuccuccuucuucuuuuaauaagaguuguuguggucgugaugucucuucguagcaucaggacacugacugugacacuccauuagagcccguucuguauggguauagcaagagcaucuuuagcaucuucucuauggacuguuccacguagaauguaaaagggagcuggacuggcuggucucgugugucaaccugacugaagugagugagacucaucagaaaggaaggagccucagcugagcacaugccuucaugagguccagcuguaagacauuuucucaauuagugaucagugggggguuggggggcccaggccuuuguggguggugcuaucccuggccuggugguccuggguucuauaagaaaucaggcugagcaagccgguaagcagaacucuuccguggccucugcaccagcuccugccuccagguucaggcccugcuugaguucuugucccgacuuccuccauugacgggcugugaucuguaaaugcaagcugaauaaacccuuuccuccccucccuccaaaaaacccaucauugacagaaaaugcaugcaaugauacacaaauaaaaaguagaaagggcgguggggggaggggucggaaagauggcucaguggguaaagccugaguuugauccccggaacccacuuaaagguggaagaagagaccugacucuaggguuguucucuagcuucauguguucccugugacccaugugcccaugcacgcacaauaaaaauaaauacaauuuuaaaaaaauuaaaaggggucuuuuugucucaaaacuaaaggugaagcagacggccaguggcacccuucccuuccugcucuggcuugucuaaaacagagggaacccugcuauuaaguuauccaaggcaaugaaugaccucgguacaaacauacacaugcaguauguaauauuuacauauuauuauauacuuauguaccacuuauauauuauuucuauauauuuauauauuaauguuauauuaauaauacuauauugauaauauuauguauuuuuuuuccucacugugcaaggaaaugugggaagccucaucuuuucacuuaaugcuuuagugcuuuuguuugggaggcagggucucaggaugccuuugaacuucagauccuacuggaugcuagaauuauaggcauccaccacuacaccugcuuuaucugaugcuaacuauugaacccagggcucacuuugcgcauacuagccaaacacuaccaaauaaaccaaaucacuaggacuucacucaaagaaaaaucuuuguaaacuuugugaucugcuagggucuaccucugucuucuaauuaguugguuaauuguuguguguuuaugguguguguguguguguguguguguauacaugcaucuguugcaagucccauaucuugcauguggaagacagaggauuagcuuuuuggaguugguucucuccuuccaccuuuucguguguuuuguggcucaaacuuagguugcugggguugcaaggcaagaacucuuacagacugaaccaucucacaggccccaagggcugcccucguucuauguggcagucuuaacagucuccagucuaggcugugccaguguuuuauuucucuggccacagcugggggauucugugguuguuuccaaucugaacccccuguucugaugccccacacugagggggcuucuugaaugaugugcucagggucaccccacggggcuggacugagcgcucuacuuucaucaucuuggcccagaggucccccugcuucuccuaccuugucuccagguugucccugugagucucacccagaggcaccccgagccgccucuucccacaggcagggugaauuauuguaacacgugugcccugaggucacaggggucaccucucuaauuuuagcauugcccaggacauccuggagaucuguuuacacacacugcuuuuucuugcugggcuuugggcuccuggaggucagggguguggcucacuaggaauaccaguuuaggacugagcguagggcuugagggugauggaguuagcccuguacccacagggcuaggauuggacccaggacagagcugagccuggccaguguguguaauuucuugcuguuggccagauuuugaggcauaacuucaaguggguuagucugaauucacggccagcaccuggcucucuagaaagccaagccuguuguugggucuccuuuuggaucuguguguguguguuuguguguauguguauacgugugugugugugugugugugugcuuguguguguauauauguguaugagcgggugugugcuuguguguguguauguguauauguauguguucauguguguguguauauauguguaugagcgggugugugcuuguguguguguauguguucauauguguguguguguguguguguauauacguguaugagcgggugugugcuuguguguguguauguguguauguauguguucauacguguguguguguauauauguguaugagcgggugugcgcuuguguguauguauguguucauauguguguguguguguguguguguguguguguguguguguauguguauguguauguguauguguguagugucguugaggaaucaagaagggaagaauccuguguaguaguggugaguggggaggguugguggcagaggucacaagugcaggaggaaauaauuuguaaugauaggcuagucuucuaagccuuuccucagaaucuuuuucuguucuuaaagauucguguauguauuuauuaugggugugugugugcgcgccuacaugaggcuaugugcaccgcgugugugcauguguguccgaggaggccagagagggugucagaucuauuggaacuggaguuacagguaguugugaacugcccagugugcugugggcgcugggacuggacuugggagcagcaaacucuuaaccacugagccaucccuccaucccuucuuuuccuccuccccgccccucccccccuuuuuugaaucgaggucucauauaguccaggucucaaacuccuauugugggugacggugaccuugaacuucggauccucuugccuccucuucccaaauauuccuauuuauuacaaguaugcaacuaccaugcccggguuuuuuaauguggugcuggcgagugaauccuggaaggaccgugcgcaugcucagugagcauucuaccucuagcacuagagucucgacucuacagucccuggaucuuuguauuucgcugucagagugugaacucugcacccaacggcggcaacucugcggauuuauccgugaaaugcauguuaagagcagagcacgcccagacuugcugggaguaaguggacugauauguaaaccgagcugggagccgggccuggcacugcaaacacuccacuccuuauauacacagggcacugcccagcgugcucucgccucaucucccugccaggcgcgccacggccucccugggacaggucccuaaagccccucuggagguccagaagaaaccagagucuggagcaaagugaggagcugccuuagaaugcucccccagaccaagaaauaggugucuccucacaaccuucaaccccccagcccuccagcccccccccccccccccccguagcucacaccuccaggguuagagugggaggugaccacucucggaggagucauccuccuccaccuauguccugguaggugauagcagauggaaagcaaagugguuucugcagauugucauugcuuguugcauuguuguugcagaaugccuagcccaggcuagccaggaagucaccauggagcccaggcuggccuggaauucccagugauacucuugucucagccuagagagcaaugcuuacaggugugugcuuccacaccagacucuugcagauuuuuucuuuuugaaaacgagcccuguuuuuuuugagaaaaaucauacaaguaccugacuauuuuuuuuuaaagcaauuuaggaaaacaugaagacaauaauuuaccuuugauccuaccccaguaugggaccucugucacauauugauuggcaucugucuggauaucuuguacauaugcaaagguuuuuacuuccggaauuguuuuuuucuccuugauucuuugggcagggcucguuucacauuccaugcaggugcuuuagagagaacccagugaaacuccagcuggaagccagcgaauggccuucccacagcccgggucugggccuccuuuagccugaaccagggugaggcaggauugcagcccucuagugucccuguuguauaaaggaacagcuguaggguccagaauucugcacaaggcccuguucccuccugcagaggaauggcuaccucaaccuguacaaccggacccagcaccuguggcuuugguucuaaagaaacaggcagggcuaccagcccuccuucugccucucuucucucuaggugauucacggggacacccaugggugggguucauaggaaaccagauaagggacugaucuuggaauuccagugccagccugcuccacccacagcaaagaugccuucugggugaacuagggcacaggacacagggaaaggcuuacccagaaaggacucuggacaugaguugguuuggguugacacuuuaguuggagacaggaggcuagaccagcuguucuuucuagggcagguagggaaaguacaguaauucauucugucaaugaguugacaccuccuguagaccagacacguacaguacaggacacaaccaugaacaagaaaggucuuuggguaaagccuuggagggacauauugcuaaggugggaauucgggagucagugggaaaggcuaggaauucccacuuuagguguucuggucaaagaaagucuucaccaggagcuggcuugggggggggguugcaauugacaaggaacaucccguagagaacaccccaggcaggcagggcaggcaggcaggugggcaggguagggcagggcaggcaggcaggcagggugcaaaguacaaaggccaugaggcaggcaaggcagggccgaggcuggugcagaggaggaaccuagaagaagccagauauggguggagagggagaggggauuugauuguauauggaguuuagggucagggucagagucacuggaaggggacguuucauugucagggcuguuggcagggacaucccaggagagcuaggucauugucaucuuuucugugugaacuggguaaaggacugccuuucccagaaccuucaucuguagacaccccucaagggcuuugaggggcuccuguaaaauaaagucuuuaagagccugaggaauguuccguccccuugcacagagagcgagcugaggagccucagaaccagucacguuggcagaggcugcuuuccaagaaucccuggcuucuagaacaggugguguggccucuagcugagagguucaacccauugagggugacagguuauggggcccuccugucuguauugcuugcuugccuucuugcugugacaaacagugcaacaaaagcaauucauagaagcaaagguuuguuuuagcucgguguagucuggcauggcagaggggcacguuacagccgcagucaggaagcagagggauggccagagcugcucuuccgcuggucuucuccauuucacgcagucuuggacuucacaugugggaccuuguugcccauguuccggagcccauguuugagagucuuccuaccucaauuaacucauuccagaaacuuccucacacaugugcccagaggucuaucuccuagaugauucuagacccugucaaguugacagacccugucaacgugacccuuugccaugccagacuacaccgagcuaaaauaaaccuuuguuucuaugaauugcuuuuguuggauuguucgucacagcaagaaggcaagcaagcaauacaguauuaaccaucucauuacccagggccuuggggguauaccagcagagaccgaaggccacacaaugggcccgugugaggaauguuccacuaggcucugagagucggucccagaacccagagaaauggacaaggcauuucugggggcucagggggacagggucuacacacaccaggagugucaggcagguagcugucaacacuguacauguguacaguucugagcuagaucccugggccaaggcuggcuugaccaaguagucuaagaugacaucucugugcgguuccuagggcucacuugcagagaagauggaauuuguagucaggcggcagcagccagugagcagagcuacuaugggaguccugaggccugaagggcuugugggggguggggagcuuagagagaggguccagugugagcuuggggggggguaguaugugagaaggcauugaccauccguugguuaccccuuuucaacacucaaggggccauguaacacacaaagggccauguagcuagaauguguagggaggcagaaaggcucagcucuguugcuagaaagagagaaauacagaggucuguuuagcugugugaccagagacagguuggggacaaugcucugucuugauguuuguucuuucuuaucuaucuaucauugauauauauauauauauauauauauauauauauauauauauauauggucugucugcugucuguuuagccaaggcuguccuagaacucacuaugcagauugggcuuuaaacuuugugugugugugugugugugugugugugugugugugugguguguuacuaugcccuuguagagauuagaggacagcuuugugaauccaguucucuucucccaccuuuacuuggguucuggggaucaaacucaggccaucagacuggccuggcaaggacuuuagcugcugagccauuuuguuagacuccuguacuuuaauuuucuuugcucuugaaaggaggugaugauugcaucucagagguguuggcguagauaggaugaaccuugcaggaugucucaugagauaccacgaucgcagcccccuuagcuuuccuucaccuuucuggguucuuggaacaacccagugaucuggguaggauggggaugcuaucccauuuuacagauagaaauacugaggcuugagaggggaagggagugacuuguuugcugccaccuuuuauaucugugccuguuucauggagagaacaguaccuaucauguauuucccuuuuuuuccagaagggacuuucucagcuagagacauacgugugucuugaccugcaagagaaaucaauauuugcuuugugaguagaggaacacagccuuggcagagggagucuguuuuuccguguuacagccuuuccgcuuccugcccaggacagcugcgugcaucagaaugggcacugccggugucccaggauggucacauggccuuucuuugcugauucccaguaauuagcagagagccggugcucuaggcucuccagcuacaccagguacagcguggaacccucagucauggcugaagucagagucacagcugacucugguguguguccucuugcuaugccaggacccugugcaggcagaaggaacaguguggcgggugggugcccaguucagagcagucgcugggugcaguggagcggagugcucucuucugagacugggucacuuaccaaggcuagcagacuuaccuucuccuugcuaggaggccuccugcccuuagagguuucucagauccacacagccacgcccaucgugauugcugcugacuuggguggaucuggggugcacgaggaguagaccuugccacuuucgguuaaggucacauuuacauucacaaguuccagggcguggggccaacuucuccaggugaaauuuuuuuuuuucuuuuuuuggugcuucugaaacagcaguuuucucuguaguccaggcuagccuugacauuucgggaauccuccugccucugcuuccuuaggguugggagcacagguaagcacaguugcuuccagguaauucugauaugugccuaacccgugucucucgaucacuucucugcuuggcuccgacucggccuuugacccgggaggcacugcuguuggucucgugacgagcugcaggacaggugagccuggcugagcuguauagcagcaugcugagacagcuguggucuugggugacucgaguggggccaguagaggcccuggcaguuggcuucucggaagcccugaugucuggcggaucauuuaucacagccaccucccaacuccuaacaucccugggagauacaucuaaaagaauuuuuuuaaagcagggacuuguaucuuaggguuuuauugcuaugaauagacaccaugaccaaggcaauucuuacaaaggaaaacauuuaauuggggcuggcuuacagguucagagguuugguucauuaucaucauggcaggaagcauggcaguacgcagucaggcaugguaccggagaaggagcugagaguucuacaucuugaucaaaggcagcagccagagucucugagccacucugaguguagcuugagccuaggaaaucucgaagaccacccuccagggcgacacccacuccaacagggccacaacuccuaauagugccacucccuguggccaagcauucaaaaaucucugggggccaaaccuacugaaaccauuaccccaggcuacccuggaauuggcuauguagccgaggaugaccuugacuucccgauccuccugcuucugcuuccugaguauugagaucaaaaguggguaucccuguguccaucugucugauccucuugcauacuagggaaacacccugccaauggagcuccguccucagcccccuaagcuaggccuucugcagccaggaaaccccccugugccucccggaccugguaucuucucagguccacauccucuuccuuugucuccuuggagcuaacaaugaagagcucuuccgccugucgcucccagcucagucgcuuacuagacaugcuugccuuugcaggccccagggagcagcuguuuguuccugcccuguuccugugagugugugcggcucugacaggacuguugguuggcuggcuggcuaccuagugucugcugcagguagccucuuuuguucugcguuucuuucuucgaggucauccuggcuugauggcuuuagucaucaaacguuucuuuggcgucugggaguuuuggauccucuggaggcuugacuggaagaagcugggugcuggaauaggggugguggcucuaccagggaaguacacugaccaugguccagugugggaaaggaaggagugggcagagcccuagugacugagguuccccggucugggucccaucaggcucccuggaguugcaagaagcagaaguagaaccagcuuuacugucaugaaaaugguucuuuuuucuuuuucuauuuuuuuuuuuucuugagaggauaugccagggcgugagaacucauauuccugaggaggaagggcagccuucgguggagacaguuggccugggagucgggagaacugggucacagcugcugaccagugguuaauucacugugugacacugugggggagugaucacugugccucagauugccaucugcacaauaaggggguugggcagccaggaucugccugcuuaucucaggaggucacagcacggucuugugguccaucuguguauuaagagcaguguuuguuacugaaaauaauuaagaggcuggagggauggcgcaguggguaagggagcuugcugcucuuccagagggcccagguucaauucccaguauccacacuggguagcucauuaguacaggcuauaacuccagcuccagggugucugucauucucuucuggguacggcauguauguagugugcauacauuacauucagauacauacacaucaaacaaacauuuuuuuuaaagaaaauaagaaccuugaauguuugauuuuauaggugcugguuggguuaggucugggacuguucagagaagacaccauuuuaaagaaaaaucuuauccagcagggugguucauaccugugaucccagcacucuagaagcugggaagacaggauuaccaacucaagccaggccgggguacagagagaaagccccugucucaaaacaaagauaaggugaagaaguaacacacacacacacacacacacacacacacacacacacacaggcaaaggcacguagacauaggcacacaauacauacacagagacauagacacacacacacaggcauaggcacauagacauaggcacacaauacauacacagagacauagacacacacagagagacagacauagacacacacguacacacagagagacauagacacauacauacauacagacagacauagauacacauguauacacacagagacauagacacuuacacacagacagacaggcauagacacaccgagaaacauagauagauaccccacacaugcacacacgugagcgcgcgcgcacacacacacacacacaccccuaauugauaagucuaagcagcacaugccaauccaaguccaagcgugcacaagguagggggccaguggacuugggacacauggaaauccccacugacugguuucuggcucuucuggagacucuugucauugugccaccuuguucugaaagagucaggauucuuaccaguaggucacaguucacaaagaaggcuggccaucucagaggagccuuggagugaccauugcauuuguauuuuagaguggagaagaagaacagagcucagagagggcccugguuuucccagcgccccagagccucuaaguaaugugggcuucugcuaucaggcucagagcagcucugucuggagggugggggggggggguuggguaguguucucaacggucucuucuuaucuucugaagcgggauuuuacacuguggcacagcuccugccccaccucagccccccaagcaauaggauaugcaggugugagccaccacaccugccuuguguuuguuuuucauuuucucaaagcugaggaggaaggauuaagaugccaggcgucuccucucuguuccccauccccaaccccuuggccuccuacuuaucucuaucucucucugacuuuucuaaagcccccagugucuuguuuucuagcucaguguguaagagggaaguucccguuauagucuguacuuagcuccaauuagcaguuggugaagucuccaguuuagccauuaauuugggagcagaagaggccacccaccuccggcuccuggcugucuucccugacacuucccugccaaugcuaccuuguaugcuaugaggccugagacuugcaacaggcuuccuggagagcauggggcaugguuuguucguucucucucucucucucucucucucucucucucucucucucucuuucuuucuuucuuucuuuuguuuuuugagacaggguuucucuguauaggccuggcuguccuggaacucacucuguagaccaggcuggccuugaacucagaaauccgccugccucugccuccuaagugcugggauuaaagacgugcgccaccacugcccggcuauuuuuuauuuuuauuuuuugguuuuucaagacaggguugcuuucuauagccuugguuauccuagaacuagcucaguaguccaggcuggccuugaacucacagagaucuaccuacugcugccucccaaguaugaggaucaaagacaugcuuauuuuuugagucaggggcucucucuauaaucuuaacuguucugaaaauuguuauauagaccuggcuagucucaaacucacagagauccuccugucucugccucccaagugcugggauucaaggugugcaucacuauggcugaccuccaggguguauuuuaaaaucuucuugggucaaaggauaccccuuucagguccacauuaaaacugcagcucacagcugucuuuaacuccuguuugaggggaucugacacccucacacagacauaaaugcaaucaaaacacuaauguguauaaaacaaagaaauaauuuuaaaaggugcuccaauuguaucuaaaacguuucucagacauuaaaaaaagaaaaaccuggccaggcagugguggugcacgccuuuaauccuagcacuugagaggcagaggcaagcggauuucugaguucgaggccagccuggucuacaaagugaguuccaggacagccaggacuauacagagaaacccugucucaaaaaaacucaaaacccauagucccuguacuauaacuuuugacccaagggucgcagagcaucuggaaacucacagaccuucagaucauuccuaugcacauucgaggucucugcccucugcccagagcaaacagccaccucuuugucuugucgucugucuuacuuugggucuuauugcugugaagagacaccaugaccacaauaacucuuauaaaggaaaacacuuaauuggggcuggcugacagguucagagguuuaguucauaaucauuauggcaggaaacauggcagcgugcaggcagacauggugcuggaggagucaagaaugguucaucuugauccgcaggcaacugagggagaccaucauuggcauagcauaguaccucaaagcccgccuccacaauagcacacuuccucuaccaaggccacacccacuccaccaaggccacacacucccuaugggccaagcauucaaacaaaugagucuauggggccauuucuauucaaaacaccgcagcucccaagucaugauaccugaucagcuacaaauuuuuaggcccggggguccugcuuggaugcuccuccgaggaagcucgggcccucucuucacccaaaugccaccaucccugauuacaguagauaauuggcuccucuuacugugacauuuaaguaagcuccuuagccugucauguugagaauagagaggggugcagagggaggccacuuaggagcucaccgaggugauacccuaccuauuuagucccagugccuggcacacgguggccugguugauggauguagaauggaccauaggaugugucguaguuauuuuucuuuugcugugaagagacaccaucaccaaagcaacguagaaagggaagaauuuaugcugggccucugguuccggaggguuagaguccaugacggaagacuggaggggguguucugcacgggggagucacagcugagcagcucacaucucaaucuacaagucuucugaaaccccaaggcuugccucuuccagugaugaacuucguccagcaaggccacaccuccuaauccuccccaaauacccaccaaguggggaucaaguauucaaaugucugagacuugcuggaguguuuccuugaaguccacaggacucuucccucccucuggaagguaaccuuggaucaaaguggcugucaugaaaaggugguugguuuuucuguuuguuauuuguuuucugacaucagaauuagguuuugagaugugugccuaacagugaccccugugugagcuacaggaaggaaguaacauuauugaacaccugcugggggcccagaacuuuggagaguccuuuugcauuguggucacuuggucauuguaagcugauuugacuaaucgccuuggcuuuugugguaagagcgugguauguggagaagccauucaacguccuguccauagauguuugggucuuuuuaguacauuugugauaaugugcuaugucgaggucacaguugguaaguggugcuggcuccugccaccaggccaugcacauaucuauggacugucuuagucaggguuucuauuccugcacaaacaucaugaccaagaagcaaguuggggaggaaaggguuuauucggcuuacacuuccauacugcuguucaucaccaaggaagucaggacuggaacucaagcaggucaggaagcaggagcugaugcagaggccauggagggauguucuuuacuagccugccucuccuggcuuacucagccugcucucuuauagaacccaagacuaccagcccagagaugucaccacccacaaggggccuuucccccuugaucacuaauugagaaaaugccucacaguuggaucucauggaggcauuuccucaacugaagcuccuuucucugugauaacuacagcugugucaaguugacacaaaacuagccaguacaguaaguaugguucauauugccaccagugagggcuuccuguuguugcuuuuguagccguugagaagagcagagagaucccuuuuacccagugaacuguaaggcauucccaggagaggagcgcucugagcugagcauuacaaauaaguaaauagaaugauuuggguuguuuuguuuuuuucuuuuucuagacaaggcuagccuugaacuucugauccauauuuggauuuuugcagguuuagggauuaaacucagggccucgugcaugcuaggcgagcauucugccaacugagcuacaucccuaagucuuguugacuguuuguuucuggcugucuggaugcccugggcuguaggggaaggcagucauggguggggugagaaggaagaagguugagccccggagacugucagcagaucucccccacccuguaaggcucucaucccuugggucucuaagcuccuaucccagaauucccuauucucuccuaccaucaguacaacucugucccugcaucugagugcuccugcaguggccugagucggggauuuucgauccccagggucagauguacggggguggggguggggggggaaccgcagggaacauggccuugugcucuguugggcucuuggcaaugagcuaucaaggcugaccagaaguagguccuuggcagccaccguuauccaaggaccauggagaugguuccagggaagcagggcagagaggguuagagagagcugguguguguguguguguguguguguguguguguguagguguaggugugguuauguguguguguaagagagagagagacacgggggggggguguuaggggaaauggagggcaggggguggggaaggaggggaaggugacuuacuuuugccccuccccucccucccauaaccaccuccgugauuuuucacauacucuucuguucagaaggggauucuguggagggccuuauuccagaagcaucucaggcuaugucagcucucagauuuacccucccaggugcauaacucagcgccuccuuccaggcuuacugcaguggacccucccuggacucccaaggacaaagaaauggcugcgucuugucucaguaugcgguuggguucuuaugacucccaccugucugucugggcuacacuuuguuguauggcugugaugguucuugauuagaaauuccacucugcccuggcuggacugaauaacugguuucacaaaccucccagucucucucccucgcugucuggaaugcguugugcgcguggggagucuuugaaaucaacuuucugccaacaggaggguagaaaaugauguuuaccuugccuccuaggcgggccuguuuugugacugccauggcucccaccccugggccaauucaggaaggcuacaaaaugcccccugaagauuuuauccagcgcaggaaagccugagcgaggaaaagaacccuauuccuaaauaagacucgcauaaagaaaacccacaagccaggcagaguugcaggaugcuccaaagggaggcaggcuaacauggggaccagcuucgauacccgcacccuggccugcacggaucugcacagugaagugaggcucccccucccuaagagucaccaauagcugccccuuugagaaaaguuucuacuuaaauuucuagguaagggaauaugggggugggggcggggcauggaucuggccugaacugguuuugagugcauucacagugagugaaacuguguucuccuaggaaacuuuuaggaaacguccccuacuugcagucuuaugcauauuucggugugcauaugugcugugggaaaggacauuugccgugaguagaagcauauauauauauauauauauaugccaagccugucagucaccugggcugcuccucuuagcaaccaagcuccuucucuuggaucccaucaaaggaugccucaaaggaaagccagggccuuugagagccauuugauucagguggcccacuguguagugugacaguguggcuggugucuucuaucacuuggcuucugaacgacauuuccuugcugcuuugcuggcucuuuuucuuuuuucuuuuucuuuuucuuuuucuuuuucuuuuuugcuuuuauuucaaucauuugauuaagaugcuaaaaucccagaaucaccugaucuugauguaacacuaguaacagaaguucagggagggucuuccauggaguuagcaccaggccagccugggccacaugacacucugccuuuaaaaaaggagccuguggcgauagaucagugguuaagggcaccggcugcucuucagaggaccuauggucagcaugcacauugcagcucacaaccaucuauaacuccagccccggaggaucugacucccucuucuggcuuccuugggugucagacacauaaauaguacacagacacacauguagacaagcacauacaugcauaaaaaagaugcucuguuacggcagcgggcuuuauuuuacuaucugacagugucauaggaaucagaguaaggaugcacccacaccaaggcaggcccagaaagcuagcuccugucuccugccucugaccgguccuuccugcucuguacggcugggacagaggcauggggagacaugcuguaauccaucagugaccaucaccaguacuguuaagucgccuccauuuguaagccuggagaguauauugcaauuagaggcaguguuaguccacgccacaguacuguaacaaguuaccugagcuaauuaacguggaaggggaaagguucauuugggcucacuguuuugggaccucugggccgugaucuaaugacuugguccaccuccucaaggcuccaccagcucccagcagccccacccuggggagcaagccuuuauuacaagaguuuuauacccugagagacacucaggguuaaaaaaaaaaaaagacaugacuuucccugcagcccaguguuccagagacucccugaauccauccaugggacagacauuugcucccuaucugauuuugaguccuuguggccugggugaagccuggcaguuuaccugggacacagcaggagcuuguaauguggauuaggguuggaagaagaccucauagacuccuuuaaguggaaggcuguuccaggugggaugagcuagccaggcaccaaccagaugcauccugaggaccuacaggugcugggcaccacacaggauggcccguuucccggcagcuuuguauagcugggccuggcucugcccaugagaaagcugagcuccaggcugguucugaaaagacccaguucaucuuggacaacagaagggcaaagaggcagcuugguccuacagccuaaggccuagccacagacugccggcgucacguucauuucccaccguauuccagcuguguguggccccaugccccuacccuaugccuguuuagcugaagccguccaguuugacaaaugaucuguuugcuuccugcacuggagcuggggaggcuggcugccuggggcagggcuauaauuagcgaaggaggggaccggauugcacgaugucauugacugaugacuuuauacccagaugggugaauugaugucaucagagauguaaauaucacuuggaaaauguuaaauucccaggaagauucaugccagcuucuuguccugaucagcaaugcuccgaacaccugcucagggacccuggguuagccugugcuggguuagccugugcuggugugaggacagugugaagggucacuuugaccuugagggaugggucuaugauggugagguguaugguagugagggaguuaggaugccugggcuuucuggucugcuguggaaauuuugcccaggguuuggaggccaggagcucuugcgacuggcuagcccuagcaaggagauaguaaugguguuugaggggguuuggggguggggcagggggaugcaaucagaccaaaggaaguuugguuuuacuggcagcaggacuguccuggaguggucccagggcuccaaggagcuuguaaaaauaaaagaauccacccauuguccuucugccgagggcugagaugggcuguguaugaaacugucccgcagcucugggauuuaagggauggguuuaaaggccaagcagaagcagagagucaggcgggagagagggguggggacaagccuggggucuggaaguggguaggagggcagccagcagaggggagauaccaggacccagagcccauccuguaggaaagaggaaagcuuuaggaccacgaagcuuacaaccuugcagaacauggaaucaauccugaaaauacuaacguggaugggcuguacaguuuggcuacaagaugagacucaaacuuuccccccacagacuccaugaagccccacccccuccuccccucaagaacacuggguccccaccuauuugaucgccucaaugccuggacucugaugaugccugggcucuguggaauggcaccaucuaugguggugugaagguuugauuccccagucuauggacuguuuaggaaggauuaggggguguggcccuguuggaguaggagugacacugggagacaggcuuugaggguccagaagcccaugccaagccuagccucacucucuucccgugaagugcauccacagguccgaggugcgggugucucgggcugacccacacaggguuagggugcagugagcagcccguggguguggagucauucgggcagguggcuuuuucagcaggugcucaacugcugaguuauaucuccagccacuucagaccuuuuuuucuuaagucagagauucauguaguccaugaccucaaacuugcuuuauagcccuggaucccaucucuuccugucucuuagcuucccacuguugggagagagcuggacuuaccucuucuucuucuucuucuucuucuucuucuccuucuccuucuccuucuccuucuccuucuccuucuccuucuccuucuccuucuccuucuccuucuccuuccccuuccccuuccccuuccccuuccccuuccccuuccccuuccccuuccccuuccccuuccccuccuccuccuccuccuccuccuccuccuccucuuuccuccuccuccuccuccuccuccucuucuucuccuccuccuccuccucuucuucuucuucuccuccuccuccuuccuccuccuccucuucuucuucuccuccuccuuccuccucuuccuccuccuccuccucuucuucuucuucuucuucuuccuccuccuccuccuccucuucuuccuccucuucuucuucuucuucuccuucuccuccuuccuccuccuuccuccucccuccuccuccucccuccuccuccuccuccuucuucuucuucuuccucccuccuccuccuccucuucuucuucuccuccuccuuccuccucuuccuccuccuccucuuccuccuccuccuccuccuccuccucuucuucuucuucuucuucuucuucuucuucuucuucuucuucuucuucuucuucuucaucuuccuccuccucuucuucuccuccucccuccuccuccucuuucuucuuucuucucucuucucuuuucucccucucccacucccucuugugcucucucgcuugcgcucucucucucucucucucucucucucucucucucucucucucucuugggucucaugaagcccaggcuguacuuguuugcaucccuuugcccagaguuucccuuaccugcucauacagaacugccagcuguuucccuccaugcugucagcccuccuggucauguauaccacagagaccuucuuucuagacgaggaggugggucucagaaaaccaggauguggcaagucuuugcaaaccaggaagacucagcuucaaaucgaagaggacucuggauccaagagagcugguuuucuggugaucaucccaucagcugcuucugugucuuagagguguggcuccuggccaugcuugucacuucucugagcucaggcggaagcaggcacaucccuuaacacaggauagccuuggcacuaugugagguuaccauaggcuauaaggagccucuuauggccacugaaaggcuggaagucauuguggagcagccucugugcuucugagugcuugcugagucgccagcguagcucgcuaacacuguuagugauuucccucauuucucucacuuuggacauggcuucuguuauuccuccuuacugcuugcuguggacuggaaaaguucauaaagcuaguggucguucccugcccuucagaauucagcucuggugccagaauccuuaguugugcagacuugggggaagugaugucugaccuugaagucugugggaaagugcagccuauguucuuuugcagacaugggguauagauacugaccaggcuucuucagugacaguguguguguguguguguguguguguguguguguguguguguguguacucugaacugucaaaaucuaccuguccuggaauuauguuuagggagguguguuaguuuggguuuccauugcugugaagagacaccaugaucaaggcaacucuuuuuuuuuuuaaagauuuauuuauuuauuuauuuauuuauuuauuuauuauauguaaguacacuguagcugucuucagacacuccagaagagggugucagauguuugugagccaccaugugguugcugggauuugaacucaggaucaaggcaacucuuacaaaggaaaacauuuaauugggacugguuuauaguuccagagguccagucuguuaucauaccaggaagcauggcagcauccaggcaggcaugaugcuggagaaggagcugagaguucuacaucuugaucugaaagcagccaggaggacugucuucuucuauaggcagcgaggagaaggguuucuuccguccugggcagagcuuacauaggaccucaaagcccacccccacacuuucuccaacaaggccacaccuccuaaaugccacucucugggccagguguauucaaaccaccacaggggguaaauaaaggccggugagguagcucucuggaucagagugccugccaugaaccuguuuaccugaguuccguauucaguucucgcaugguggaaguugucuucuggcuuccacaggcugccuuucuccccaaguaaguagauaaauguaaugcaaaguuuuaaaaauaaugucuauuuaauacuaauaagcacaaaucccagagugauggugcaugcagucaucccaguacuugggagacagagguggggagauuagcaguuuaaggucuuucugggcuacacagcaaguucaaggccagccugggcuacgugagauuguauaucaacaaaacaaacaaaugaaauaacucccuccaacauacucauaagcacaaaaggagaaaaaaauaagccaggagaaguuucauggggaaagaucucccuaucauaaaacaaacaaacaaacaacccuuuuaugauguguguguaggguuagggagggagagaaaaugggagaacgucucuaauguaggcugaccuggaacccucccacuuagcuuccugggagguaaagaucacaagcauguagaccagagcaguuggggauuuucagcguuuaauacuguggcuccccaaggcuucacgagacucauaacaaccgaacacacucagagaaggguuugggggaucgugcccugggaugucagggggaagcuaaggaggaucagaaggccaugugguaagcccguguggcuaaaauguguaccaugucucaguguuaaaaugcuaguaaguagagagagagaguguaccucaauccccuagaaaucucuccuguccuguucugaccuucagucuucucaacagucauuccgaagggaaauuccucccuuccuuugugauuuuauaccgagugaagugucugucucugaacagcugggaaacgucccuggggcggcaugccuguugaguaugcaugucggugacacugugccccguguuucuagaacguccaucuuuaucaucucauaagaccugucaacaagcuguggggugagcaggaacggaaugaguguguucauacccauuacucagaugagaauguagacuccuggugaaugucugucccggagcggagacucauguucucugacucugcgggcaguggcauaucccugguccaugagcgcuguccucuauaguuaguaccugucuucaggggcuuuuauagcacaccaccacagaguuccccuuccucacagucugugggucagagccuaagauuaaguucuggugaguuccaagcccucucccgggcucgcagggggaugucugccuuaugcaucuuccugugcccuuccuucuguaugugucucuguaauaaucucacuauuuccuucucauuccucuucagacagggucuuauguaucccaggcuggccucaagccugaauggaaccagaggggacuucugcucuuaauuggccagugcauaaaccaccacccggcuuaugcagcgcugggaauugaacccaggacaucugcagcacuugacuaacugagcuauucucccagccuguaauuucuuacaacgacagcacucaauauggauuagagccacguucgugacucacucuaucuaucuaucuaucuaucuaucuaucuaucuaucuaucuaucuaucuaugggagacagggucucauguaggccagcuguccugaaauucauguguggaugguuuugaacuucugaucuuccugaccccacuucucagugcuggggcuauaggcauacaccacugcuccuaguuuaugcucagcaguggacagaggaggaccuccugcaugccaggcaagcaugcuccaauggaacuaucacaccuccaugggcccucaccuucuauuucucuugcagcugauugggggccugguccugucaguggggaucuacgcagaggcagagcggcagaaauacaaaacccuggagagugccuuccuggcccccgccaucauccucauccuccuggggguggucauguucaucgucuccuucaucggggugcuggcuucccuccgggacaaccugugccuucugcagucgguaaguggcuccucccaacccucaugguacauagggagugguucuugcugucucugagaaagcugaagagcugucccucuccccuggccaguucaauuccuucugccucuuacacaguccagccacccuagaacauuuccugaaccaggagucauuggagcacagugguccaggucugccccaccuguaaacaucagcgggugcagcugacuugaauacugcugucacagagaugcugggaucucugugcucucgguugucaugggagaaauggcagucagcugcaagcaagcaaagccaggggguggggguggggugugaugaaucaucaggcucgcgcagccagggaugcuaacagcaccaaugggccaggcugggcagccuguuugccacugccugcuaccccuggucauccuugggcucagagucuuuauugcugagcuaagggcaucuuucuuggacacucuggucggagucccaguacacuggaggaccuggcucggaucacauguccgucagguggauagucuuagucaacacaacucaucuauaccugagggacaacaccccaaugcuggggacccggagugugaagacucacuuccucuguuaucugagaggauaccuuuauagucacacaagcaggaucuugguacugcccaaggcuggaaguugcuagaauauauuuggucaguaucuauuaacccggggugcugcggugggcaggguagaugggugguucccauagaguaacuaaagagaugagguugggugacuugggaagccuaggccaugaggcucugcgucaugaaaagggacugggcgggcugagaggcaggaggaaccucugggcaggguaagggaauggaguguguguccccaaaccucagagaccccuucuauacuugguugacugggaaaccucuucugagcuguuagggcuguuguggggagucagggacuggaaguggugcccaggccuguuuccucuggcguguuagagggaggaagagcccacuguucaucuagaccucacugaggaccccuggggaaaucacgagaggcagcucagucagucucuagcuucaaggcuucucuagcacagcccuaggaguggcggcaagacccagucagggagggcuagugccuuauuaucucagcacagguggggggucccuugagcccucccacaaacccccaaaugaaucucuucaccuuguuuuacaguuuauguauauccuggggaucugccuggucauggagcuuauugguggcauaguggcuuugaucuuccggaaccagguaggccuguggguucaucaucggccauauguguaccaagaucccaguggguaugcucugggcuguacccagggugcugccgugggcaggguagacagaugguuuucuuaagaagaggguuggguaaacuaggauagcccgggccaugcagcucugcaucaugcuaaguggcuaggagggcagaggugggcagagccucugggcagguuggcagaagaauguggguggggggaucuacuggacuaguagggugagguguggaggggaagauggaaggcgggguuggauggcuggcuccgggguguacguuggaccucagaggccaaggguuaggugcccugagugacuuugaaaggcagugaguuguuagagauguaugcaaggaagggcuuugccugacucacguccgucucacucuagcagccgaguggagaacaggcaguaggaaguaagggugacaugggaggcugugacagucacccagagaagacauaauggcggcucagauggaagugaagacuaauguccccagaccacagacggugguguuugaugcauguuuuagacauguacauaugauugaggggagggacagcuugagugacauccaagacccagcaguguuggugaaaugaggacccccauagcggggcacaagucucagagcuccaggaccucaauguaugguucagaccugcgugacuuaauacgguuccucguguuauggagagucgccucaccauaaaguuaguuuuguugacacaucauaacuguaauuuuguuaguuauacaucauaaugugaauauuuuuuuggagauagagguuugucaaagggguugcagcccauagguugagaggcgcucuacuagacccuucuuggcauuucuuauccaggaucccauuagugaugguguagagcugucuucugacuuagggaugcugggauggaacccaagaccuugcacaugcuaggcaagagcucuacuguugcugcacacagagauuccuucuguaaucuucuucuucugccuuuuuccuccuugggugguguuauggguagggcuugagcaagcucauugcagaagucuaggucuccuguccaccucccugaccuuacccugcaggucccugacaucuuggucccuggccuucugggaacugucaagacugugccucagcaggagacagaggcaggcagaucuuugugaguuuggggucagccuggucuacauagccauuuccaggacagacagggcuauguagagagacccugucucaaggcaacaugacugugucucaggcuacaggcaaaucaugcuagaaacucguugaaaguugaucccaagucaccaauuggugucugacaccuucagagaacaccaugucugaucccugguacagccugcaugagaauggugguuuucugacccaggagagaacaugaauagugggacccaacccugggcaagucugaccuacugaggaccucagggucugcuuccuagugggugauuuccaaggcuuucacgggagagggaaagugggacaguucccauuguauugauggagagucagcagugcucccugcccccccccgugugugugugugugugugugcaccugugguuuguuuucugagauaggaccucuauaguuugauggcuauguaacaaagaugaccuugguuguagagauuggaccuacaguuguagaaauuuuuucaucccaagccaggguuucuaccacuuaguuccuggauaaaagacacauacaaccucuauauuuacaauaagcuuugaucagcacaagagcugggcagaucuacccucuaugcuauuagaaucuacuuuccuacugauaaccccaaguuauuacuuacuauguuaacuccaguuggccagcccuuggugccauguuuucauaacuccuaaacacauggcaucucucuguuccuucuucccuuucuuccccuuuaugguucuccucagacccccaagcccagggauccuaaaccccgccuaugucucuccuguccagcuauuggcuaucagcaucuuucuccaccaaucagaaauaacuuggaggcaaguuuacaaagcaucacuuggaucuauagacuuucuugucucuagggcagcaaccaggguuugggggccuguacuuagcauuacaauaauacauagcaaaagaccucaacagccuacugccugcaucuuccaagagcugggauuagcaguguguaccacccauaccccagacccuuaaauuguuuguuuguuuguuuguuuuuccugcuucucagaccaucuacucugagcuggcaggaaugagguauugguucauuucccagaagccuuaaggagagagagguauuuauugcaguuguauauagcgaugcuuuugugugugaacagcucucaguuagccaguggccuugcaggggucuagguuagcacuuuccugccacagccccggggcuagcucauggucagcaccauucauggcuuuaauaaaccugcuccuaccaaaugagcugguccugguuccugugugccucuccaaggcuuucagauuugucauauuucagugcucuguaguucauuuggggccaugacauagcuuccuucuuuuagauggggaggcugagcugagugcuuuggagccucuugggaccuucaggaagccagggccuggucacaaaugacuuuccuguuauucccacacccucugggccucaugaccccugaaaugugugcuucacagugugugggggaaguucaaggcuaucccucaacuacuuaguacguuugaggcuaccucagcuaccaaaacccugucucaaaacuaagcaugccaaagaccaggugugguuuaauuccaguacucaggaagcagaggcagguggaucucugugaguuugaaaccagccuuggcuacacaaugaguuccagaacagccaaggcuauguggacagacucucaaaaaaacagaccaaccaaacaacaacaacaaaaccccaaugucaaagccauaguaaacaaugcagaagagguguuugggagaagguggaggcagcucccagcaccucccucagugucccauccuccaggacauuuccuguucagcucuucaaacuuccacugaaucauuauggagaccacugcugaugaaccugucugaagaugcuucagcauucucucauagguuugccgcaggacccucuggagugagcuuacagauaaggguggcucagagcagaucuuuguggccucccgaacugggaaagaugagaauuagaaccuaucggguuuuuuguuugcuuguucuuuuuguuuugguuauguuuuuuuguuuuuuguuuguuuguuguuuuguuuuguuuuuggccauccuuggagaauagggucaugagcaaggaaucaagaagaaaagaaagcaaacauauaaaguagugacacaugccuguaaucccaggccuagggggacugaggcaggagcauugcugagaguuugaacuauguacugaguacuagguuagccagagguauacagcaagauacuaucuaucuaaaaaaaaaaaaaaaccacaguauauucaucauaacauuuaaaguuguuagaauacagcaggcauagugaugcacaccuauaaucccagaccuugagaggcugaggcaggaggauugcaacuuugaggccuauguagguuacaaaguaaaucccuauuuuuaaaaaaaaauuuaaaagaaagaccugaagcugggcaugugguggaugccuuuaaccccagcacgugggaagcagaagcaggcagaccgcugaggucaaggucagccuaguccauagagugaguuccaggacagccagggcuacccagagaaacccugucacagaaaacaaaacaaaacaaaacaaaacaaaaaacaaucuggagagaaauuucuggaagcugaggaauauggugcauugguuuauucucuccuuuagauauauuuuuuucuagauuccaaauuucucucucucuuucucuuuuggugauaucuggaaaugccacauuaagcaacaacaaaagcagcagcaaccacaaaaacaaacuguuaugcuugccucuucuggcgcuaaugcaaugugauuuuguaagacaggagccaggccugugcugggcaugagggaaggagaagcuacuggaagcuacugggugggggaggugucagcgaggaugagaaggaggagggaaggagagaagaggaggggaggaggagggggaagagggagaagaggguacccaagugaagugcucuccaggaaaaggcagguuucuuuagccgucguagaacagucaguguccagcaccaugggccugccuguucauucugacagugugcuuuguggugacaguacuagucaccaggcuaggcucucggggagcagccugacguggcugaggccaguuagugagagguagaugcuugggugugagaagcaacugugucccugagccaggugaggcagcugcaagcagggggacccagccaccagagcccaguggcuccucggucuaugcacguguggugcguggugaggggucaacuggggggcagcagaaaaaugcucagugccuugaccccgggcaugggcaugggacuuggugaccucagaaccugagcuggauucuccauacuuauugcuguccuagcuuaccccggguuucaucaugaggguaucaggggugucggaggugacaaaacugagcagaaacaccagagggccuuggcauuagcugguaggucucccaggccucgugccacuucucccaauagaaacaaggugacugcaagccacuuucugucuugaucagaggaugucuuggucauuccugaugccaggucagagacuggcaggcagcaccaacuugguuaucuuaccugguauagcauuacuagccagcacuuaggaugccuugaacccaggggcaggagaaagcugguaguuccucagccccccuuggcuaagcacccgaacauauacauccucucccgcacagccugaggucccagaaacuuugcgcagccugcggggacccagaguaauucuauccccagaggggcuggauccuggggcagucagccugggagggacaccugucuacgcaggauuacacuacaugccacauucauugaaaauaguccacggcuucuuuggggagaugcagaggcgucugaggcuagaaaugcaaaccgaaaggcaaauucuggaaagaaaggucuuuguggcuuuaucugguggcuuaacacacuuugaaagucauguggccuucgauguuugcuugcucugggucaugugucccuccguggccugugacaguggcacuagagaaaggcaucuugcuagcuggaguugcuccuguuggugugaccugguugagagcuuugucuggggacagugguauggcuggcuuuuaggagcggaguuccuacccuaugugcccugcccccacugggccagaucaucuguacccuguguauugucaagcaagagguucuccucagagccuucuuccccagcagggccaaggcagcucacuagauggagauaggguccucaugggugugugggucugccuggucuguuggucugucuugaguguagccagcacauaccauaccauacuaguuagacuuaucaggagagggagggagggagggagggagggagggagggagggagggagggagggaaggagggagggagagagagagagagagagagagagagagagagagagagagagagagagagagagagagagagaauaugaaugaauaugaagacuccacuacccuacccuggccauccugcccuuauccauuccugagggaagagacucccuggagaucuaaggauggcugggggaggggggugcggaauggaaggucagggugagccaggucuccagcccuggugccuggagaguggaaagucacugcgcacgccacauuucuacccuccuggccuaggcaagacccuaaugguggugucacccauaagccuagcucagccagcggagccccuacagugcaucauucaaggcuggugagcucaugccguugccccacucgggcggguggcacacagaccucgcccugguguccuguuucuuauucauccccacuccaccccagccaucuggccugucaccacauucccccagaggcacaggauguggaggucaagcugagagcugacugguucugccaaggcaguauggcugacggguccacucaaccccugcccugacccgugaagggcuggcugugugcugaugaccucagagccucuccuagaagcccauggcuucucuuuccuuuugaagucugugcugcugcuggucaucauggggugggaaugggguccuccagacagcucacucugaguauugcgggucucaggaacaggcagucacaccugagacuucuuagcuuguaauguagaguguggcaggcagcagcugggaccuugaccuugaccuuggacaaguauauuagucucagggcugcaggugucucgggcaagcuccaggaugcucacacaugcggggcuaccgcucuugcaggaaguccucugggcaagcugugagccuuaacaccucuggggacugaggcuuccucugugacaccucgagagaucuguuucucacaugcaaagaugcaaguguuaccaggaccuacagugugaccagcauccacaaucacuuuugugggguucaaacuccggauaccuccagaaggcugacuguauuugcuucuucccuuuguggaugagagaagggggcuuggagauuaagagaugcugggguccgguggcaguggggacugugcccuugacuaugagacuugauguuccuucccccuuggcuuagccucuaaugcuuaauucugaaagguccccaggguugguucaccaaugggaaacaaaaccccaacagggccugggagcuggucccaccacccacaggaauugucuggcuacucuguccuguaccagagccaagaaugccccuuugugcccagucucugccucugcucugaaagcuucaauugucacaacaagccuguugcugggcugcccacucacccgccccagcagugcccgcugugggcucuuuguauuccagggaucucagcccagccugacugggagaggcuggcauuccagugcuccacucgcucuuccggguggagauuggucccucccaaaccggguggggacuguguggccugagggucagagcaccaagggaugaagaagggcccauguagggugucaggguaccuggguucuaguccugaccagccugcucugugacccagagcaaagucugucuucaucucuguuuccucucaguucucacccccauggucuucuuccccccagggacuguuuccuucuuuauaaagcaagagguugggugaugggagcagagaaugggcuggaggaccaauggucacggcugucgcuaggcaagggagagaaaaugccaggaucugggagggcugaggccuggauccagcauacugcuucagagcuggagccaggcggaucagccuugcagggccuggaccuuggaagccugaggagugaaugucuguggugcgggcagugccagguguucagggugggguaugucggggaccuucugcucagguaggugggaacuguugaucucaccuccgugcuaaccuggacuucuagaauaauccaggcuggccucugauguguauuccuuuuccuuggcaauuuuuccuuccggguagacuauugacuuucugaacgacaacauccggagaggaaucgagaauuacuacgaugaucuggacuucaagaacaucauggacuuuguucagaagaaggugaccgggcagcgggggaugaggggaagaggggggaccuccaggacccuugcccugaauucaagccucuguuacagagaguggggugaggggccagcugaccugagcguucccagugcagguggcugguccauggauggccccuucaaacaugggaaaacucacaacaaagccagaugucucuggucacuuuacagagccccagggcucacccccuggguggcaaggaucucccuuugggacuggcuggccuggugucuagccuguuggacccaguucuucuaguguggagagcuuuacuucauagguggugagaauauucucuccuaauuccagcuuccuccacuggacaccgaacaagaccccucccuuuucucugacacaucuuugaauguguccauaauuguguguccccuugagacacugcuccucucuccgaggcccagcccaguaugugggugaagcaguuacagcugcagcaggagccacccuuucccugggcuugccugccucccucuuagucccgaggccuggauuucuugucugcaccacaggagcugacucuggucucucccucuuguagcugagacucccuugguuuguuuaugacggugcuuagggcagagccagugcgguggggucacccucauucccuggauaaggacaguaaugguggagucuggcgauugggugugccugguucccugugcgagccuucaguggggaccagccucaucacaccccaggccuuuggcucugugcuucucuguagaagaaacaggugcagcuccugggagauuuguuugugccagcaaugugccugccagccccggcugggagagccgagucauacucuggguagaugcuuuuguuggaaccagccccuagcuggcucagggguuuaauuucuccuuggguggggguaggaggugacucauguucacugaaccucgugcagaaugcuucaugcaggacuccucuuacagucagaacccagccaggcgaaguuggcauugcucuuucuaguagauaagcauccgaggcccagagagggcaacggccuugccuguggccaccagcuggagcggugacguggagauuugaauguguauucaucuggcagcagaacaaauggcccuuguccaacauagcugauagauaggcauuuguggauccugagucccgaagggacuacagggcacuguggcaacuucagaagggugcccagauugugugucccaguaccuccuacaacaccgauccuucagccuccuaccuuggaacacagucccagagcucuguuugcucuggcugaucggucauuuacacauggcuguuguucccuggacgcagccuuguucccucacagggccuuugcacgugcguguugacugucuuuuccuuguucauguugcagaugaacuguccuguccucccagcagccuuuccuguccucccaguuauaaagcuaugcccccaccucuccacuucccugugcccagauacacagcaucccuuccuaggagaucauuccucucccaagguggaauugguauaauuuggggugguuuuuuuuuggggggguaccucacccuguaucccagguuguacuagaauucacuauguaguccagguuggcuucaaacuuguauuccuguuggcacaccggccugcuuggccaugguucuugucacuuagacaguacucuugucuccccagaugacuguacuuagucuaugcagagcccagaaggacugucccagcuagacuccaggacuguucucuguucuucccauccaagaagcugaccucugugcagcgaguagaggugggaggggagcuaaggggagagucuguggcagguacucgggucuccaaggucagggugaagcagggcuuccacaggcucuggucucugaggcugucuucucuagccaguccccugucucaggggguugagucuugaggagaaggugcagaccaguugccagggacagacaucccucccagagucuagucaccaccugguguccaacugaaguguccagccuuacuauguaagcucuccagaguggagagcucacccccuucuucauggccaugccgcucuugauagcucugacguaauaaaguauggccucauggggcccuggugcccccacucugguaccuccauccccaccuccaccccggacauacacaccuccucagccacugcuucccgcuguaugacccugaccuuggcagugaucacagcucuuccuuggugcuuuuccccucaguucaagugcuguggcggggaggacuacagagacuggagcaaaaaccaguaccaugacugcagcgcccccgggccccuggccugcggggugcccuacaccugcugcaucaggaacacgguaacugcaugggugcuggaugugagggucacccaguuugccaaacacugcucucacucugcccaaguggagcaggcagugggagugggugggacgugguggccggggcugagcuugccuuagaccaggggcccuagcaaugggagaugagugggcagcuuccucugggagugugucagugagcgugugcgugugugggccuggcccaggcgcuuugguuguaguuacuugguucuuacaacagcuuuggagggucucaauugggguaguguugcuuuagccacuuagggggacuugcccaagguuggcagggcucuucccagcaacagagagccagagugcccggcaggugcagcaggcucuacccagucacuggaggcagaguacagugcaggugcugugagcacuggcagcagagcccugggcagcggcaugcgguaauguaaaugccagccuccacuuuccccagugggagccucucagcugucaccucccagucaucugggaugcugagcugugaggucaccgccugucagcccugaugugugacaaguaugucaggaacugcccaguuuugagacuggagcagaaaagccuggcaauuacgacacacacgcgcacacacucauaacacacaccacacacacacaucacacaaacauaacacacacacaccacacacacacauaacauagcacacacacaccacacauacaacacacacacacacaacacacaacacagcgcacacaacacagcacacacaccauacauacaccauucauauacauauuuacucuccuggaaagucucuuguugaugguuucaacagcugugccuaccaccccagccuguaaccaugaaaaugggguacacguggguagggccucacccagagucuggaacaucaccaagugaaggugcccugugagagcugggguccucugcugcuccccucccuugucacugcagggacccaggcuggauccgggcugggccugagguucuaccucuccccuguggcugagguugggaccaagcagggcccacgcaguggugggcauuguccuggggccuaccugggaaggaauuugaugggggcuagagcccagucauugcgucuccagggauaaaagcucuggagagcggcccuucuuucagagaggaacuucuguggcucuuugauggugaagccagcuuugaaggggcaggggagcguggccagugacccaaccuugcccucagguaaaccacagcuggcaggggcccaguugugguuugagcaguuccucucugagagccaguaaaaugggaacagcauggcucagccacggggagccaugggggugccuccggcuaagagcuuagacugcugcugguggaggggugacccucacaugaacccccagggagggggccuacccaugguucuucacuggggcauuuccuggagguggucacuaagauacaggcuggagccugauccugguggcaggagaucucagcuccaucuguacccgccagacuguauacccagcccuuggcucuucugugagcccuucagauuacagccuauagaaucgugaccgauguguuucuguuucagacagauguugucaacaccauguguggcuacaaaacaaucgacaaggagguaacagccuggaaaaccuuuguccccagaaauggugcucccuuuguucccagauggugcuccucuuguccccagaaauggugcucccuuuguucccagauggugcuccucuuguccccagaaguggugcucccuuuguucccagauggugcucccuuuguccuacuccucagcuaauagaggguuucuagcagagggcuccuggcuacucagauuucccagcucuccuuggcugucacucacagaaggacccagggagccaggggaggucaucuggccagguuugcugagucccugcuccaggcaggcuuagcugagugagauaucguguccagggcuccucccaugcugccugcccagcccugcaguuuguugacagcucacacugguacuaccugccugggacucaggaauuccuggggaagagaaaguccuuggguggcucccagccucggcuuucuggacaagucuauguagccccguuugaccugcaauugcuauguagacuaggcugccucaaacucacagagauuccccugccucugccuccugagugagcacuaggauuaaaggugggaaucacugugcccagucuuuuuucuuucuucuuuuaauaacccaguggguccgauuaguccuacucauguguucaagaggguagcgccauccacaaauggcguugucuuuaauaauuuguacauggaacaaaguuucaaaugaugauguuuuuaauaauuuguacaugaaacaguuucauggcaagggauuguccacucgugggaggagaauguaacauaguaauucuagaagcuucacuguacauuaaaaccauguaggguuucccuccacauauaccuggaguaggcuuuuggcucagguaacagugcgcagcccuggguggcaucugggaggcaugcaggcacacucugccaguucccagcaguucucaccaccagagcacuaccacaguguccccagugccaucucgggagcagcacuagagaacccagggccaccuucccaugccgcugauccucucccuccucccgcacagcgccugaaugcacagaacaucauucacgugcggggcugcaccaacgccguguugauaugguucauggacaacuauaccaucauggcgggccuuuuacugggcauccugcuuccucagguggguaguccgugggugcagaugaagccaggcugaguguugaaggagaaggguucagaggcucugggagggcuggggucuggaaggagagccaaacagaguagucucaguugcucucucugcacuggcucugccuccaguccgccagugugguuggugcgacugauaagcacaucugcuuaguggcgguaguggaaauggaggauucgaagagugaagugacuuucccaaggguccccuggauaagguguggcagagcugggaucgaggcagaagaccagcauagaggggccaugcuaauguacaggggcaggaagucuccacguuccugggaaggguagagcagguccagccuggggcugccugggcagugggugcuggggugccuugauuuccccagcccaguucccagggagggaacugccauggaaggaugcccaugugccagcaggcucucaccggcucccucucuguccucaguuucuuggugugcugcugacccuacuguacaucacccguguggaggacauuaucuuggagcacucugucacggauggauugcugggaccuggugccaaguccagaacggacacagcaggcacuggaugcugccugugcuaucccgauuagcuaugcugauugagcuauccuggcccggcacagcagcucccagccggacuguacugcaaagugcaucuaagacuacacaagcuggacaggaccagcugcagcuccucugcccacccacggcgcugaccaaagcccaggguguauguaccugcguauagugucugauggccacuccuccuaggggaaagcugaacccugugggaucccgggaacagggauagcccagcuccgguucugaguccuggagaaggcagcucagggcuccgugugggcucuuuuucuuucuggcagugccuuggccaguggucauuaugccccuucaagggcaguuuugcagugauuauuuuuaaaggcaagaagggaguguaucuguucuauagggaaguccugggugcagcccugguacacuacucuagaugugacguuggacugugucucaaauucccaggugccuugaguccucuguaaggcuccugcuuugcccacccauuuucuacauauguuuuuuuucuuuuuuuuuuuaauaaccguguuuuguauacaauuaacaagaguuucuggcuauucaaaacuagccaccccugaccgaguccacucaccccuccccguuaguucauuaauugaacaauaaauauguguuuugggggguggucuuuuauuuguguuguuuggaagucucuugucagauugagagaaggcugccccggggugaagauugguauaacuuggggcgcuggggucagggagaaagaauggacagcauucguauuucacacucuaugggaaacuaauaguaagacuuaagaguccaugguuacauggagaaguagcugaguccagggcuccuguaggagaaugguaucacaagucuacccguguuauagaaaguaaccgagguagggcucuguagggacccaugccaaacaaagcuuggugcuugccgcccccugcuggagacauccggccuugcaggagcagucgguccaagugucaccccaacccuaccuggguuucuagguuuuucugugagaguuuuagacagggcaauagauauaaaacaagaaucucagacccagcuaagccuggguuagggaauuccccucaccagggaagcuuguguuccauaugaggaaggguggaggcggggcuuuaaaaagaacaccaugaccaugaacacaccagaggccagaccuaaacauucagcauagacagaaacucuuggugcucacagcuguuuguggucaucccuguaaccucaguuuuguauggaaacagaggcacaguuaaccaacauguugaggcaugggacuguguaugaagaaccucugcuugaguugcgucuguguauagacagacucucccaggugugcgaaaccaggcauggcugggacugcugcucccgugcucccuaacuaaucccccuuugguuguugagacggggucucacguagcccaggcuggccuccagcucacuguguagcugaggauauccuuaagcuccugauuccugggcugcuuucucgugaaugcugggaucacggugagucccaccacuccccguuuauggaauuuggggccugaaagcucuuuaucucguggcuccacugagccccuuugaucagggcacagggcuggguggugagccuucuggcccuggcucuagccauccucagaauccuguaguauagcaguauggcuggggcacucagaggggaucagaggcuggugacucugucauucucccucucucugccaucagggauggggguuggugccuacccagacccgaguuucuauaugcccucugaaugacaaagcugucucuugccucucaagaaaaauaaaaccacagagcuuugccagccggucucgggggucaccugcuauggcacguuucuguuacccaaugccaaggguaccaucuugccaccuugucucucaagaauagagaauaacuucaagggguuggagagauggcucagugguuaagagcacugacugcucuuccagagguccugaguucaaucccuagcagccacgugguggcucacaaccaucuguaacaggauccgaugccuucuucuggugcaucugaagacagcgacaguguauucauaaauaaaauaauuaaauauuuucuaaaaacccaacagaaugacccucaaaauuagucccuuucuucacucuucaguuuuugaagauuuuuguuacaagaaaaaugugggggcuggagagauggcucagcgguuaagagcacugacugcucuuuccgagguccugaguucaauucccagcaaccacaugguggcucacaaccaucuguaauggacacccacccuguucuggugugucugaagacagcuacagaguacacauauacauaaaauaaauaaaucuuaaaaagaaaaauguguuuaggaacccugguuuccugugaaaauuuaaaaaaaaaaaaacuguugaagaaacuuccuuuugaaauaugcacagcacaaguaaauaguaauuugcugagcaugggggcugauccaugccuguaauccagcacucaggggguggaggcaggaggauugugaggucaaaacauggaccaaaaauaaacccuuucuuaaauugcu

SEQ ID NO: 5532 - RNA, 20532 nt, Mus musculus
cgagcggcgccagugguccggauuuuccccggcuccauucgagccgcggccucaauguccuugccucgguguaccuugcugugggcucggcucccggcggggcgcggggcugggccccgggcggccccuugcuccgcccuucgcgcucucguggggucguucccgggggcuucaggacgcguucccugcuuggccgccuccuccucugccucugguggcuccaaagccccgaacacguccuuguucgugccgcugacggugaagccucagggucccagcgccgauggcgacgugggcgcggagcucacucggccucuagacaagagugagugcuggagccucccggcagagcggcagggucugcagccugggccuacauagugcaaugucuguuccuuuuuggagcccuuagcacccgagccuaagucauauuuagucucuucuguaguugacauugaccguucucuucggucgaggagguuaagaguuuugucccuaaguggugcgccgcuugugcuccuagaguccucauggagggauuaaacagugaggacuugccauugaccugauguggaugucuaacgauguuaaaauuccaucugguugccaagacaacgggucucagauccggauuucucaauaaauuuacucucccacgagacagaccugaauuuaaauacaagauaaaaguugauaaaacugucuuugccaaaaaguaguaucgucccagguuccagagaugaauaaaaaaaaaaccuuuagcaucacuggguugaagugaguuuuguccuaccugcauuugggugagcuugacaaugggagggugaaagguuucuuuucaccaaaugacauucuuagagacugaaagaaaaccacauuucuuuuaggcacaagcugucuuccuggcucuucaacaagcaauauugaugcuuccuauugugacuuuaaaauauaggcuucauguugggagucagaggcagaggauggcaaguucaauaccagccugggcuacagaaugaguucaaaacaggcuuggaaaacuuaagagagguccuauuucaaaauaaaaaaauuaaacaagguuucucuguguggcuuuggcuguccuggaaugugcucuguagaccaggcuggccucagacucacagagauaggccugugucugccugccgagucccuggaucaaaggccugggcuaccugcaccuccaggcagcagaguguucuuuuuuaaugugcuugaagauauaacccugggauauaugccuugccaagcacgcagugccguggggucauuucccaguacugugaaaucaacuaacaagguaguacuccuccucuuccccuuccuuucccucuacuuuuucccuccucaagauaagcucgagcuguucucagacuggggauugucauuaauuacugcacaggcuaccguugcuaacacugcucuuaguagugaauuacaucugccucucauagcaggacuugccuuuucuugguuacucaagaagagcuuugggcacaaggggagguuugauggugacucuguggggguggggggagggggacuggcucucuccuugugugucuguggucugucagggauggugcauugcuguacucuugucauuuuucuuacuccauugcacaguagcccaaagcuucacacucucaaagcauuccugaggccccggccuuuaguauuaugacuucaaauuccuuuuguuguagauuugucuaaauugguaaacaauuguuaaaaaaaaaucuuuuauagggucuggagagauggcuuacaagagcacucacuacucuucagguccugaauucaauucccagcaaccacaugguggcucacaaccaucuguaauggggucugguguaucuaaagagaccaauggugguguacucaugcauaaaauaaauaaauaaauaaaucuuuaaaaaaacuuauauuucuuuuuuagaugaaguaaagaagaucuuagacaaguuuuauaagaggcaagaaauucaaaagcugagugcugacuauggacuugaugguaaggcugacaauuuuuugagaguuauuuugaacaguuuuuaucaauuuaugugugugaguauuuuuccuacauguauguccauagcuacuuuugugcagugcccaugacagagaguauuagaugcucuggaauuggaguuagagaugccugugagccaccauucggaugcugagaaucaagcuugguuuccauggaagagcagccacuguucuuaaccacagaguucucucugcaucucugccaguaacaucuucauagaacugucacauuuugcauuguacuuuguuauguguauuauagucugaagaaaagucccucuccuugucuucugggggacucacaagcccagcuugccagccagacuccacaguacaggagugcguguucagccugccuuagugucuguccuguguaguuucaguuuuagcucagcuugugaaaagccagcugugcuaccaaaacgcugauaggggcugggguuugcuguggcauuuguauacuugacagugagagcuaaguaaagacuaagccuuguaugcuuugguuuuauguuuuccacagcucgucucuuccaccaggcuuucauaagcuucaggaauuacauuaugcaaucccauucucuggacguggacauucacauuguccugaaugauaucugcuucagugcaggcaagugcuuagagagcuuuuaaaaacauuuauuuugugugugugagagccggagggaggaugauagaguugaggggaggagaaggaagaagagguggaggagaagagaagaggaguaugcguguaugccgugacacucauuuggaggucagaggacaacuuuagggcgucuguucuccuuccaguuguagguuucagggacuguaugacacucccuucccuugcugagccaugucauuggccugcugagaggauuuuuuuuuaauuauuuuuauuuuauguguauggguguucuguuugcacuacaugcaugaaaugccugcagaggccagaggaaggagucagacccccuggaaccugaguuacggauggucguaaguugccuugugggugcugggaaccaaaccuggguucucuggaaaagcaaccuugaacacuggaccaucucuccagcccacugugaagauuuuuuaaagaaaugauuguguguguguguguuuuaugugugccuguguguuccuuugggugcacaugcagaaauaagaggaagacagcaggguccugcuccaccacugacucucacuaacccuggaguuggucugguggccagcaagccuccaaaauccuccugucucccugccccuuccccuuccaaagcugggguuaaagaugugcuuggcagccucacccagcuuuuuaggugugugcugggauugaacucagguccucaugcuugcacggggaacauucauguucucugagccaccucucaagcccugagaauuuuaggaauauuagugggggugcuuuuuguuacuucucauuuauuucuguagcuagcagagcuuccuuguuuuagaauagguccuggcauuguacucuauaacuaagucacugugccuguccaucgaaucccugcaucaguuaguaaguccgacauaggcugucuuugaucaucauccucugcucuguuagcauagagagcagcaugaauggaauagaauuagcacacggcaccuuucaucuguuucuacuauuggauucucucuccuuuguaaaaguucuguccugaaagaaaaacaaagcaguaggcaugguggcccacuuugucccaucccuuuggaggcugaggcaggauuucuuugaauuccaggccagccuggguuauagaguggcccugucucaacacagaaacaaaguaggaagcuuauuguuugguuuccauggguguccugguaccuuaauuauaguguuaaauguguuugacacuuagaucuuuagcuuguaacagacacugaaggagaaccugauaaauagccaagugagacauaugcuacuuuucucucagagccacugcaggugugcagaaaacuuaguugcuucucuguggucuuugacauuaaaaaaaaaaaaaaaguuacugaguuggagugggguagcucaggguuugauccugggcuuagucuguauuaacuccuggguuccagccccaacagcaacacuguccaaaacauuucacaaaaagaaguuccugucccucuaauguccaggcuguguguguuuaucuccugcagugcuaaccuuugcauauucacacugaagagcuuagagccugauggguggcagcuaguguuuuguuuugccagaccugagagguuuggagaaggaaggaauagagugugggguccuagggaaggggacaggagggggccucuugcuccaggcuuugcucuacaguccaggcaguacccacugagaagaaaugguuuccaugguacagggguuucugugcuggcaggacugcaagauggagguuuaguuaugaguaucuuacugagugagcgugcuaauguaugaugcuaucuuacagcucauguggacgauuuauuuccauuuuucuugagacaugccaaacaaauauuuccuguauuggaaugcaaggaugaucuacguaaaaucagugacuugaggauaccacccaacugguuaguucuuuuauuuacugacuccgaguuuucuaauuuggggaaacuaauguugaugcuuuuauuuuauacuagauaacaaaucauagaguuuaaauuuuguuugccccaaagacaaaacacaauaaccgaggaauugguucucucagacauguuacugguguguuccuuuccuccuguuggaacguaggcugagguuuucuugggguggauuucugauggagcucuuuuucaagguuguccuaaguucugaugcgucguuagcugacugccuggaugucaaucguucuuuccccauggcuagcacugugguaucuuugacauacucugcccaaauccugggagcuguucucuagaccuuaccaguucuaaccuuauguaggucuagcccaacccuuagccaaaacgccacagaaccaccacccugacacaccacacauggugacuugaggacuccacuuucuucaucaucucugcucuuucacauuuggccauuuaaguuccagcugccucaauccagauuggagauuguguucaguugguagagcaguuucuaacagggacuugaucccuaguacagcaugacaccauaugggauguagagccagauggaugguuaagaauucaaaggugcuguuuguggaggugcuguuaguccccacauucaggagacagaagaaggaggauuucuaugaguucaaggccagccuggucuacauagagaguuccaagacagccagggcuacauagagagaccaugucucaaaaaacaaaacaacaacaacagcagcaacaaacuaaagaagaaagaaaaaagaacgaaaaaagagucauucuugacuaucuggcaaguuagaggccaaugcagggcacaugaaacccugucuugaaaagaaaauuaaauucagcugcuaaaggcagcucuacagcugaccugcugccuguuagggcagcgguugcucuuggcucaguugccaccucccuguguccugugggaugcaauaaggaccaucuccauuacucccuuccugcgggaguuaguccucacugccuguuguuucuuucccaaacaguugcugcaauauuuugcccaguuuugaguuuacauauggugauaggguacaucucaccagucagcccgaguggccagaagcagagguucgguggcuguauuuauuuauugauacugaaaugacaaagccuggggguauuugcuuuggggucuuuggguucagaguugugggagugauggaaacauagcugugggaccaguggcagcuuaaauccgggaacacaggagauacccaaagcauuuacuugcauuugagguuccuguccuccaguaaaugcugcucuuggaagucuuguuauuuuuaagguggguuauacagccuucauugaguuuuucaaacacugucugcuagaauggauuauagggcuaauagaauuaagcacuuuaucugcucauauuuuagguacccagaagccagagcgagacagcggaagauaauauuccacucaggcccuaccaacagugggaagacuuaccaugccauccagagauaccugucagcgaccucuggcguguacugcgguccucuaaaacugcuggcgcacgagaucuuugagaagagcaaugcugcugucaguacucuacaggguauucacucauuuccccaguaacuucucucucuuggggugaaggcgcacacucuguggggaaggaaugcacagucccucacuguuggcagaaaugccuguuucugugcaccggagagcuggcaggugagagagagaggugauggcacugacaugccugcuggauccuuagcucagaggaaaugugacaaaagaccugggauccuagcacauggaacauggaggcaggccugggcuacugucucagaaaacauaauaagaucaucaggggugaaaacaagaccuaguucagagaaugaaauaaaguauuacugaauauuuucuguagagagaauugcagaagaucauaugaugccugcugucaaaagcucauauguuucauuucugucuuuuuuuuuaagauuuacuuauuuuuuguauaugaguauacuguagcugucuucagaaacaccagaagagggcaucggaucccauuacagaugguuguuagccaccauguggugacuggaaauugaacucaggaccucuggaagaacaaucagugcucuuaaucacugagcgaucuucccagccucacauaauucuuuuuuuguuuguuuguuuguuuguuuuuggcuuuucaagacaggguuucucuguauaaaccuggcuguccuggaacucacucuguagaccaggcuggccucgaacucauaaaucugcaugccucugccucccaagugcugggaugaaaggcgugcgucaccacacccggcugagacaggguuucucuguguggcccuggcuguugccuuuguagaccaggcuggccucgaacucagaaauucacuugcaucugccucugccucugccucccgagugcugggauuaaaggcuugcgcuaccaugcccggcucccacaugguucuuuauguauacauugugcauguuuuucuucacaacaaaaaccuggugcuuuguuuuguuuuguaguuuguuaacauaacuagagcauauuuaucugaaagaauauuuaguugauaguccacuauuauuuacuacuuaauucauauucaaauucaaguuuuguugggccagagaaacaacuccacuguuuaagaguacucgcuaucugaggacccauguaggguggcucacaaagugccucuggcucccacuccaggggaucuagcacccucuucagccacugugguacacauacacagauguaaaguaugaaauaccuuaaaauguuugugccugugucgcuugucaaguaaccuccucccucuucccuccuaggagcucgucuaaguucccacaugcugugaccauuuucuaguuuaugcuaaucucagaauuccucagucagucuuugucuccuguaaccuuuuuauuuuuuaaauacuguagguuacuuguggacuagacuuucucagauugagcacaaaacagccuucauucuggaaagccuugcauuccugacugaguaccccaguauaccauaccgcugauguugcuucuucuggggggugggggguuagaccaggguccuuuuagucucaggcuccacucauaguguuguucuugaguauggcagcaguucauguccgcuggguuaacuaacgccauuagugcugaaaugugcagagagaaacugaaagaugguaauguggcgagagaaagcucagugauagagcacuugccgggcuuaagcaaagcccuggguucacugcccaccacugcaaaggaaacugaccaaauccagagccagagcuguuggcugggccacguggugcaugucuauaaucccagaacuuuggaauuggacgaucgggaguucaaaucaucauuaguuauauaguuaguuucaggccagccugggcuacaugagacucugcucaagauacagaggaaccacuacaguuucucucucugcugaagguucugauugaacauuucuucagauuuaucuaacguauacaacagaguagcuagcugugugugaggaguguggaaguaaaaacauugggagucguggauucgguuauuugaauacauuugauaguaauggaaugaauccuuuucagaccuuggcuuuuuguuaccauuuuuaagucagagauaagacuggguuucuuuuuaucauuccagggugugccgugugacuuggugacaggugaagagcggcugacaguggagccugaggggaaacaagccacccaugucucuugcacuguggagaugugcaauguugcaacuccuuguauguaucugcuguucagaaaacuaggauuggggguuucaguaugguuaagcuuaaguuauaggacuuuauggugaaaagugaaaaaucuaggagaaaaugggugacuaaauacuuaccccuuuccagcaaaccuugcugugcuuguuuuccuuugucuuggaugaaacagaaucccagugcuuuaaucguaucguugaucaguggcagguggaucucugaauuccaggacagcugggcuacauagugagacuuugucuuccaaaauauaaaagucagacauagucuacuuauuaauauauauauauauauauauuaaacauauagguuuauccauauaaacuguuacauaauuuauuuuauuuuuuugguuuuucaagacgguuuuucuguguagccuuggcuguccuggaacucacucuguaguccaggcuggccuggaacucagaaauccgccugccucugccuccugagugcugggauuaaaggugugcgccaccacgcccggcuacauaaucuuuuuuuaugacaaaaauucuucauuccccuauuaaggaauauuuagguuguuuacauucugucauggguugggaauguagcucagugguagagcacuugccuuguaagugcaaagcccuggguucaggccucagugcuggaaacaaaggucuauauuauauaaugagcuucuggcuucauuuauggaacuacugaaguguaaguaaacaaagaaaauaaauaucuauaauuuucccaucccaucuguccccaaacaaugauuuuuuuuuuuuuuuugguuuuucgagacaggguuucucuguguagcucuggcuguccuggaacucacucuguagaucaggcuggccucgaacucagaaauccgccugccucugacuccugagugcugggauuaaaggggugcgccaccacugcccagcccaaacaaugauuuuuaauuaauccugugguauauauuuucuuaacuuucuguguuaguauucagauuuuguuauuuauauguaggguaugcacucaggugaauauauuaaauauaguaaagaucauaugguuuuacuaacagcuugcuuuuguuuuuaaaaucaacucuucaaauagauaguuuuaaguuuuucaguguguuuuaaaagucauauaguauuacaaugcaaauggcacacaaaagucaaaauguucucugcuuccugcuuuuuagccuauuugucuuaacaugaugaguaauuuuuaaucugguuuccaaauauaaauuagcuuuuuuuaauguucucaguucccugguauuuugaagauggaauuaaaaauaugacuugcagaagugguauaacacaggaguguuggggccuuagaaaacaagccaagggguugcuuugcucccaggugauggccugggcaugagcagagccggucugaggaguccuuccguccucuguguuuguugcuucugagcgcaguuuugagaauauguagccuugguuggccuggcacuugcuauauggaccagccuggugucagccucauagagaucugacugccucugccuggcuacugucaggauccaagaaguacacuaccacauaggacuaagauuuauuuuaaagugugugugugugugcgugugcgugcacacgugcgcgcucaugcauguguccuuagaguucagaagaggccaucaguuguagguccuccaaaaguacccucuguuaccugucaagcugaagaguaguaauaagguuguuccuaguagucggagucagcagggugugugagguuacagagauaaccuggaggagacugcucagaguguggagugugguguugagagcuaggaggcugggauuugaguucaucccuacuugucugggccucauuuuacuuuccugucaauaaacucagccccaauaccucuaaccauguuaccuuauggucacuacuuagaacaaacgccuuagagcaagccuguuagaaaagacacaccuaggaagaccugguagugaugcuggagacggggaguuucuguucgaguuuaaaagagacuuuugcucauggacacucuuuuuguucuaagaugaaguggcagugauagaugaaauccagaugauucgagacccagccagaggaugggcuuggaccagagcacugcuaggugaguagucuacugcuucagucagcugcugccucucuucuccagggaaguucacugaaaagucacaaguauaagcuuauguuguuuuaauaacgaagaguucuccauuuguguguuauaaaguuaacauaaccaaaugccuaaaguagaaauauuugaaucucugaugauguaaccaaugguacucuccuaucaugggagggcccuggcuuaauccuuagcaccaaaaaauaaauaaguaaaaauaaaaguuuggggcuggggacauacucauugguagagcacuuuccagcaguccaugcaugacgcucugggucugauucccagaauccuauaagcaggguaugguggagugacuauuccaaguguugucucagcgcuggggaggaggaagcagggccaucaggaggugggaggauuagcauggacuccacagcuaguucagagccaaccuaggcuaccuuaagauucugccucaaaaggaaaauggaaagaaggugucuagccauaguuacagucacugcuagcgucucaugugguucauggcagcuuuuuugugcaugugguguuugaaggacuuagaacucuguguuuuucuccuuugcaguuuuguuguuucauaggaauuguccauucuguagacgaguccuuguggguauuguccacugaaaagcacuacagcagcuuguuucaugggcugaaacauucucccaguuaccaacagcgcaguaguagaauuauugguggauguagcuuuucacuuuugguuuauuuuuaauuguuuuguaggaugggguccaagaauaggaauucuugaaguucacaggcaugaaugaauguuuaaugccugauauuugaagugauuuuuuuuuucuuuuccuuuccccaacuccuuucuuccuucuucccccugcccccaagcagggauucacuauguagcccaggcugacuuugaccucugggucccccugccccagccucuaaaguguuagucccaccacagcuagcuuggaaugaguuuugauucagcaugcuguaguagggcagguguuuucagauaaaaaacaaauggcugagcccagaguuugccugucagacaguaugugaaaguggaucugcucugacuaaggagcuuggagccucuuugcuuguuagcccuacacuacugcuuguagcaccacggcuucuguagaguucugauuugaacaacacaggcuuaugacugacacccaucacuaagcaucauggugccagcauccuguccuucuuggccucacccugcaguggugucagcuguguucagagcauguuaugggcuuguaaauuuguagagcugggcuccaucuuuacccaaaguaggcuugagucagagagccugaaaacacuggacaguuagagugagugccgaggaaggggacagaccaugugaacccucugugcaucuacagggcucugugccgaggaaguccauuuauguggagagucugcugcuauuaaccuggucucugagcuccuguacaccacuggggaggaaguagagguaagacaugucccuuccucucugggacugugugugccacagagccaauuguaccugugugccgacuuguaagcuguagccuggcccagucagaacuuaguacauaaugaacaaaguacugcauguguaugcagcuggcagaaggagaccccggauugcaugcugucuaaaagaguaguuuuauuuuuuaagacaaauugaaaaaaggaaaucuuuauuuucuuauagcugccuggcguguguguguguguguguguguguguguguguguguguguguguguguguguguguguauuugagcuucaugugggagauaguucauucucacacgauaccuuagauuccuuauuuguuuguuuguuuguuuguuuuggagggugaggcuguuugauuguauuuuuguuuuugagauauguccucacuguguaccccaggcuguccucaaauucauggcagucuccugccgucaccuccugagugcugggauuaugggcaugcacuguuggacucaguuuucaagcuuuugucuucuugaaacccuuuugugaacuuacuuauuuguggugcugggaauggagcuaagggccguaagcgugcucuguguaccacugagcugcauccguagcuccugaguaggugucauuagaacucagaagucagacuguuacagagucugcagcucagccuggguuuguaguguucuaagucuuguuuaucuuguguuggagcuuuuggaauuuaucaauugucagaucuaguuuacaacccuuuugcauguaugaaguuacaguuaaagaacugguuucuucuaaaaaacuguccuuauuuugccuucccaggauuccuuaagguaguaaaauuguacguugcuuuucucauugcuauugcaagguagacgaaguagcuuguggagggaaggaaggcgugacgguaggaaaggaaggaagagcgggcuucucuuggcucgcaguuucaggguuagagacagagcagcuggugcuggugcuuggccagcguugcuuuuuauucucucugacccccagccaugagauggucuuacccacauugaaggcgggucucuccugcuguuucacccuuuaggaaggaaucucauaaggcacauccagagauguguuucuaugaugauuucaaauccagucugccugauagugaagauuagcuuuuacagaaaugaagagaggccuuaaguugaccuauuacaacagccucaugcucuacuuugagggagauugaauggaaugcaguaggaggaauuccagauucaaaucuugaacuuugcugcuuugggcccugucugcagccgaccacagaaggcugaaaagaugagccucuggccucaccuuuauuggacuauuugacucugccauaaaaugaaaauaucaguaaucuuuuugaagcugccacuuuguccugaaaauuaguguacauuaaaguucuuuaaggaugucacacaguaauaguaauucaggagugccaagaguugacgguagcacagcaucugaauggagguuucugggcugccugccuugcaguccccuggcacugacuugaggggcuacuuuuccacguuugucuuuauugcagguucagaaguaugagaggcuuacccccauuucugugcuggaucaugcgcuggagucuuuggacaaccuucagccuggggacugcauugucugcuuuagcaagaaugacauuuauucugugagccgacagauugaaauucggggacuggaauccgcggugauauacggcagcuugccaccugguaaucacugacugacaucucaccuuugccauuuaggcugagauauagagagagcacagaaaaaauggaauugaugugaacuauuccuuccagggaccaaacuugcucaagcaagaaaguuuaaugaccccaaugauccaugcaagauccugguagccacagaugcaauuggcaugggacuuaauuuguaaguaauuuguuugugauaagcaguggguuggauggcagggguggugguggugguguuuuuaguuuuguaguugguuaggauagagauaaugauguagauuugagcuuuaucuucuuacacaccuugggaaacaaaagagaauaucacaguccugggguuuggagugcccccucucccagggcagaccaguugccuuugcuuuguuuuggguuucuuagucaucagguaugcaagugccuccugcuggcacucacuauaucuaaguagugaaaguggccagauuaaguucucaaaaacccuuguuuucaugguccaggccagcuaggcugcccaggcucacccugccuuaagcucaguauggagcccaugcugacugagcccuuggccaucacucugucuuuuuaauuuguuuugaucuuuuuaaaggauuuuuuuuuacauucugaguaguuuaccuacauguuacguacacgcaccacaugugugcaguccugagggggucagaucuguguguguguguggguauuugccugauguacacuugugugcuuggugcuguuagagaggugucauaucccccaggacuugaguggcaaguggucgugagccaccauguggaugcugggaauagaauagaauagaauaggucuccuggaggagcagccagugcucccgacugcugagccaucuccccagccccauuuccuccugguuuuuugaauaguugcaagauuagaggacauccuaaauaagaguugggcugagcacgucugugaugacugaugacccaagugacgggggcuguguauagucuguggggucacuuuuauuucuguuucaggagcauaaggagaauuauuuuuuacucccuuauaaagcccagcaucaaugaaaagggagagaaggagcuggagcccaucaccaccucccaagcccugcagauugcaggcagagcuggcagauucagcucacacuuuaaagaggggcagguuaccacaaugcaccgagacgaccuggcuuuauugaaggacauuuugaauagaccuguggauccuauacagguaaggcuuagcaugucaccagggugguggcggcugcugcugcugaugugugcaggauagucauuccuucccuagccacuugccucaaaugcuuggaaacagaggccugcuugagcuggggaaaccaugacaugaaagcucuccuugggccagagagaugccucuggaguugagagcgccugagauugcuucccagccgccaugccagcagcucauaagcaccuguaacuccagcuucacggacccucuguccccacucaacccccauccaccuaccuaaauugaaaguaacuagauaggcuuuucucuguuguuuuagagagacagcgauaccucauagagaauuguguacaagugaaagacccagguucaauggguuuaguuggccuguuuuccuugcugucagugcagagaguccugucaguaaaguggaaacguacagaagcuugacuagagaagaggcuuggcacuggguuguacagucccgagcaaggacugacuuaaauagguggcuauugaaucauuuuaaagcaagcuaacuuaagaauuuuaaguuucuagaucuacuuauuucauuuguggcuuauuucaugugucagucagauauaaaggaaagugugugugagguuaugggguggagguugcugacaugacguuagcuccugggggggaggggggggagguuucugguagcuccuguguaguuuauucucggccccucuucucuccuguguaccucuguucuagccuuuacaugaccuuuagggauuccaucuuuugauuccucuccccccaccuuucucucucuccccuucuuguacuuagcugugggcauugcuuaauacugcaguauagaaagccagcugaucuccagagaagaugccuucucauguucugucacccacuuagaaguaauugggauuuccuuguccauucuuauucaguggagagaauuauaauugggaaaauuauuucacuuuugauauuuuguuggaucauaauauacucuagaagucugacuaaaaaguaucaaagagcuacaugaucuacuucauuaaauaauccuaucagcuuuucugauuccaguaggugguuaaaauggucauguagcuuucucuauauuacugaaauucuuggcaugggacuuguuugguaagaacuuagccuaguguaggauguguuuggaaagaagaaaaucuuuuugaaaaaaccaaggaggaaaacugaguuagcuuacgacuguguuguccauucuuccgcaggccgccggucuccacccgacugccgagcagauugagauguuugccuaccaccuccccgagacaacgcuguccaaucucauuguaaguggaagcucuuucccuuccuucuugacaugccucgucaguacuggcucccuguguggacaggcgucugccuuugugcauugccacucaggaaauguauaucgcuggugaaaacuggcaacaucugggcgugcugggugugucagugcacaccuguaagcccagcucucaggaugaugaggcuggaggcccuagaguuggaggcuagcccaggggcguagugagccucugggucaaaaagaaguugagguuaggaagaggguggagaaaugccuuagcuuuagagcgcaguacaggaagcacgccucuccugagguagguccgcugggauuaaagagauguccucuguggacuugaguucuuuuuuuuuuuuuuuuggauuugucuguguagcccuggcuguccuggaacucacuuuguagaccaggcuggccucgaacucagaaauccgccugccucugccuccucugcugggaauaaaggcgugcgccaccacgcccuguggacuuuugaguucuuuauuccuacccacuaggauauuuacuccaggcuguccaaugacuucauucuauuucacccccaggauauuuuuguagacuuugcacaaguugaugggcaguacuuugucugcaauauggaugauuuuaaguucucugcagagcugauccagcauaucccacuaagucuccgggugagguauguguucugcacagcccccaucaauaagaagcagccuuuugucugcucgucguuguuacagguaugucuuuagcuccaugcuacuuugagcuguugcagauugaucugcuuuucuccaaacuaugcuuggaagaguacccuaaauaccagauacuuugugaaaacuuaagcauaaacuggcuugguaacuuuugaaggaaaaccuugccuuguauuugggccugggugcugucaccauuguaagcugagacaggcaguuaaauauaagcacuuggagggggauuagggcuuggugguacaguccucaguccugaauguaagggcugcaccucuuuuccucucagccauuugcuacucagucucagugcuguggugugacuuguggaaagcacgggauucuaggagcaagggcagcagagcugaacuguaugggggccucucaugccuggagcuccaugcugggcugcucgcuucaugccgcuaaacucaggcuucuucucuggacuugccauuucuaccgcaggccuuagcauucuguguaucaacucuauuugaacuaaauucauuacugaauuuaccuucuaaguuauuguaaaauuguauaaauaauacacaaauauuugugccaaauuaacgcauugcagauagguuaauuauagucugccauccccaccuguuaagaguuuguuucacauggcaucugccugcauucaugaaccuguaggaauucaguuuuguuuuguggauguuuuuguauaaaugcgaaaugaauuauucugcaacuaucuuccuuuccccuuaacguugugccuuagaggucuguguuuagguauuucucugcaaguauguuauuagugggagagccacgauaaggguaggggguguggggcagucuucagcuacugcaugcucacaugacugcagcugguuccuguggcccugguccuguuuaugccauuccucaggcaaaaaugaagcaggagcuucugccaggagggagggugacagccuugaacgugaaaucuagagaaugucuuauucuggcaucucaucuuuccugaacuguaaggagcucagucuugcugagggacucucguaccacuugggacagggguuuugagaaaucaguuggauucucaggccaucagacuuaacagcaaaugccuuuacccgaggagucaguguugauacccccaguuuaauuucaaacaaacauuuuaagcucaauauggugacacacucccauaaccccagcgcucagaaggcagaagcaagagagucaggaauucaaggccucucuuguuuagacagcaauuuugaggccagcuugaccuauauaagaccuugucucaucuaaauaaauccuuauaaaguauuaaauuuuuuaaaggaauuauuuauuauuuuauguauaugaguguacuguagcugucuucagacacaccagaagagggccucagaucccauuacagaugguugugagcaaccaugugguuguugggaauugaacucaggaccucuggaagagcagccaguguuuuuaaccacugagccaucucucuagccuccuauuaaaugucuuuucaaauauaguaggaaagcguuaaguagcaaugaaaccagccugucuuuugaaacaaccacagcuuacaaguuacacuuccuuuuucuuccuaauuacagaccuaagagauucuguuuacuuuaccaaacuuucuucuuccucuuaguuugccaggcaguacagcaggaaugagccccugaccuuugcauggcuacgccgguacaucaaguggccucugcuuccgccuaagaauauuaaagaccucauggaucuugaagcuguccaugacgucuuugaucuuuaccuguggcuaagguaccaacccuuuuccuuucuaugcucacaauuuucuaacucagggcaaauuaaagguugugugagugggcuucugcuccgucaagguagaaaguuuauuuagugaauagucuguauuauauuuuccauaaaggugcuugaguuuugcuuauacucauuccugaaaagauuucuagagucuguaagauagccuagugaggguguuaacccugcuaauaaauggaagagcgguccucaguccuguggguagaugggacugccaggguacauuauguuucaauggaagccaacuuuguggaguugguucuuuacauccauguuuucugugggcccuguggcucucacucaggacagcaggucugugacgcagucaccuuuaucaucucuccagcuccgaucccgaguuuucacaggguuuccagccugcugcccugugcaguaaugcuugagaggcaaucucugcaguggaguauauuagaaucccgucgggugggcugcggacaucgccucaggcacgggggcagagcgaaaggcugcacaaaggcacuguugguagaaaggaaccuagucagaauguggguagcuugguagagguggcuccgcugucgcuccaaugcucuuucuuucuuuuccuagcuaccgauuuauugauauguuuccagacucuagccuuguucgaagucuccagaaagagcuggaugccauuauccaagaaggcgugcacaacaucaccaagcugauuaaaaucucugagucacgcaagcuuuugaaucuggagagcuuaccaucgggggaccagucacgguugucaggagccuccaagagcccagcgagaaggacacguggcaccaaaagugcagggaauaaggccacagagccacucagccccagugacaaggagcugccccuugccucuagguuggugcagcaaggacuccucacugcagacaugcucaggcagcuccagaaggaguggcugacacagcagccagaacacagcagagagaaaguggggacacggagaaagaagaaggaccccgacuccgauuagguuuuuuuaauuuugcaaauaaaaaucaauuuuaaauccuuaugcacacggcauucucugccugaggcaggauuguggccaacuuguacuaucugguuuguuuguuuguuuguuuguuuguuuguuuuuuuaauugcacaaaaaaguaaauuccuaaagcuacuuaaauuacuuauuauagccuuuaaaauagagugucuuugagguuuuac

SEQ ID NO: 5533 - RNA, 39953 nt, Mus musculus
cguaaaugaagugucgcaacgcggaggccuccaguggcugcugguccacggacggggaggcggccgucagcucaggccgcgauggcgaacgcuccggggccagagauccgcgagaaguuccaggcagcgcuggcccugucgcggguggagcugcacaagaacccggagaaggagccguacaaguccaaguacggcgcgcgcgcgcuguuggaggaggugcgcgcgcugcugggcccggcgcccgaggacgaggacgagccggcugcugacgaugggccgggcgaccaggccuugggcgcgggugagccccgggaggcugagggccccggagcgcagcgggcgcugcgccucgcgguggucgaguuccaccuuggugugaaccacaucgacacggaggaacugucugccggcgaggagcaucuggucaggugccugucguugcugcgccccuaccgccugucgcucggcugugugucucucuacauccaggcgcaggugagaugcugaggcgggaguucugcauccaaaacgcuccuccuggcugcgcacgucucucaguugguucaguccccagcauugcacaacacccggccugaaauuccaguacuagggaggcugcggcaggaggauugcuuuggguucuuggcuagccuggguuucauagcgaaguuuagucccuuuuaauuugucauaacaccuacccuccaucugccuaccaacucccucugaguucucgccgccuacuccagccucacuugcuacuuuccguaauccugggcagaaaaccuaagcguccgaaucagcgccucccaacccaaugacaagcuuaguuucauucugugaagaaauaauccaacgggauucgaauggaaugaacaggacaagggaucgcaagaaugauccaaucuuaaauguuguuguuguuaauggccaaaaucuuaaaacuuuauucuuuaccacauucaucuuguuugcucagcaaggaauucguaccuuuuccuuaaacugucucgacaaccuuuuaauaacuuuuuauuuuuuguuuguguuuagacauccauuugugucugcaaugcuuaacuucgacugucuucaccuccugagugcuaggacccccucccccuuuuccuuucagagucuuguagcccaggcugccuuuaacccaugauccccccaccucagccucccugcugagguuaucggaacucuuguuuggacuaacucuaucugguccaaacugaucucaccuuccauccuuuacauuuuuauaagcagcaagugcgacuuucugcucuggagaacauaacauuucaaaauucaaauaguggguagaguuuuccaggcccuuggguguagcucagugguacagcauuuaccuagugcuccagguuucaucuccacacuaugggggaaaaaagacagauaaugucggacucuguugugccagguuacuuucuuaggguuauagaugguuucauccuccaguccagauauguguaccagggaauauuuacuaagcuugauuguuggguagguaggccuuucaggaaagucucaaaacuuagaagaaaaugguaugccauauucuuuuaugauggcucaauaaaauuaaaagccaaauacuaacaggcacugccugucccuuuugcucacagcuccagcagguggcacagauagggauauuuuccauguuuguuugggagcuaaagacauuaguaagggguucaguucaagcaacacuucagugugaugguggugcacgccuuuaaucccagaaauugaggcaggaggauuucugaguuugaggccaggcuggucuacaucgugacuuucaggacagccagggcuacacagggaaaaaaaucuuguuucagaaaaccaaagggaaaaagaauaaaguaaccuucuucauugauuccuaaauuaagcuuuaacccuguguugacuggauuuggaaucaaucaagagaugccccuugucaucugggaggguguuuccaaagagguuaaacugugaaugugaguggcugccucccuuggguaauaccagcaagugccgacauuucccucuacugaguguggauucagucaccccggccacacugugcuccuuccacaacacaacaaucucuccaaacugagagcaaauaaauccuuauuuuaaaaguugauuuuugucaggguauuuuggaacagcaacagaaaagucaaguuuuguuuuguuuuuuaaagaaguuuaaaaccuuuugaggucuuggagagguggccugggguaaaggcacucuucgcuugcccuggcaacuugaguuucauuucuaggacccguauguuaaaaggagagaauggacuccauuuguaauccuccauauacacaccucaguauauguagguacacacaaaauggauggauauuaacaugcagcuuuuugaaaggguaucugcaguguauacuguauuuuauugauuuucaaaugcaugcuugacaucuuggugcaccuaaaguaagaguaccucauggagggcuagagugcuucagagcacuggcugcucuuccaaagguuaaggcuuggauuccagcacccguaugaaggcucacagccaccuguaacuccagcagauccuauacucucucuggccuccacaguacugcauacauguguuccgcagacacacauguaggcaaaauacccauacacuaacauaauaacuaaaacuuaaaaauaacuaaguaguguuguuugcauauguaguaaugguguaccuaagagcucaguucaacaaacaagaaaaguaaguauaagguaaauguuaugcuaagaugcauagagccagggcaaguggcccacuccuuuaaucacagcacccgggaaacugaggcagcuagagcucugaguuccaggccagcuuggucuguacaggaagauucagaacaggcagggcuauguauuaaaaccuugauuuuaaaagaugcacguacacacacacacacacacacacacacacucacacacucacacucacucacccuaccugauaagguauaucaguaguauuccuguacguaagucauagcuaguuacaauaguuuugaaaguacugaaagggaggaauggucuguuucagguuuaguccaggcuggcuuggccgcauggacuguggcuguaguaacagacagcgggacagcucacgggcaggaagcgauguggugaaaacaaagagggccaagccugccguuacaaacgcugacugagacugugacucacccucacuggaugcguccaguuaccguguccccuuucucugaucuccagaauaaccugggcauccuguggucugaaagggaagagaucgaaaccgcccggaccuaccuggagucaucggaagcccuguacagucaguacaugaaagagguggguuacuugcagauaaaaauguaaauuuggauaaaaacuagucaagaaacggugggcuguggagguggcucccuuuauaacgugcuugccuugcgagcaugaagaucugaauuugacccccaggagccauagcaaggagcugggugaggugguacaaguaauacuuggaaugccggugcugagucagagacagggacaguggagcucaggguccagacagccuaggcaacucagcaagucccgagccaaugagagacccuggcacauaaaacgaggugaggaacacaagcacgugcacacacaggaauuuccuauuuaugagauuaaugggauuuaucaauauacccagaaacuucucuuuagaggugucugaaauuacuacugcauauugaagacagcuucuuaaaacuaauccuucuguacaguauaauggcaaagauagucuuaauauaacccuaaagggaauauucuaauguuccccaaauagaccauuugaguacuuuuguauuaauuuauuuuagauguauucauuuuguguguaugauuguuugcuguguguauaucuguucacuacgugcaugccuggugcccuuguaggucagaagagggcaucugauuucuuggaucugguuacaguuuugaaaccacuguuugggugcuaggaacuaaacccagccagauccucuacaagaacagccaguacucguaaccaccgagcugucuccagcucauuuuuguacuuagaugacagauuuuacuuuguuuucauuaaggacagcagugcuuugagggaaacaaacuaccugcacaacgcaucugaaaucuuuguggcgguggugugauaucagaagcacucaaaagauuuguuaagccucaauaggccauggaggcucuuauaaucccagcaacuuggaggaggaguucaagaccagcugugccaucaccaagacugucuuaaaccaagccccaaaccuuagcagaccuggcuucaggcuuuucugcagcaguucugggcugggccugagaguuugcuuuuuuugcaaggucaccuuuaugcugcuguugcgauuauuguauucugagagcccuguaucagggagccuguucugagagcccuguaucagcaagccuguucugagagcccugugucagggagccuguucugagagcccuguaucagcgagccuguucugagagcccugugucagggagccuguucugagagcccugugucagggagccuguucugagagcccugugucagggagccuguucugagagcccugugucagggagccuguucugagagcccugugucagcgagccuguucugagagcccugugucagggagccuguucugagagcccugugucagggagccuguucugagagcccugugucagggagccuguucugagagcccugugucagggagccuguucugagagcccugugucagggagccuguucagggccauguuuuuccugaugauguucacccaugucugaaaugcagcguaugcaucucuguauaagaagcacauagugggcugggcuagacccacugcagcuuccaaucuccccacggggugcaguucaggaagggcugaccaguuucagaggcucugcagaacucagauggaaauucucacuucaggagucacaguccucaagauggcaaaccagccagugaccaucugccucuccucuucuucuccaggaaagaaauuaucaaugcacaguauuuuucugugaauuaucacuguugcuguuacuggcuuuaaaacccauuaaugauaugcuacuuguuuuuguuugagacagguuucacuguguagccagaauuggucucaaacuugugauccuucugucuccagcucaggaacagugagugagguaccaguucugccuacgagacagaugucagcagcgcuuuaguucauaaacaguauuuagaguaccuacagacacucuuuauagguaauaacucccuuaaccauuguuacuguccuaauuuauagagugcccccugaaagcagacuguuuguaauagcaugugcuaggcuuuggguucauugccaagcaccacagaagccauagcaaggacagacuuguugggacuguccucacaaagggucagcguuugugcccacacagaagccuucauguuguaauggauuugugcauagucaguaauugagucacccugaagccguaugaaggaugugcuaugauugaaacauuuucauagaugaggaaccaucauagauaagagauuggcuccuaacacaguaaucauugugaccccugguucuuacuuagcuauugaaacaguaauguuaacacuuaaugaaucuugaguuugaggccagccugguuuacagaguagguuccaggacacccaggcuacacagagaaacucuauuucgaaaaauaaaacaaagcaaaacacuauccuuacuucccugaauugauuuucauuaguauugacaguuuaagcaccauuacccaagaagauauaaaucacuauuuuuauacuuuuguagauuuucuguuuuauuucauuuacuuguguguacaccgcacuauauaugcauaugggguugguucuuuuuccacccugugggcucuagggauuaaacucagguggucaggcuuugcaguaaggugguguuugugagccuauuuuagcuguuuuguuuguuuguuuucgaagcagcauuucucuguguagcccuggcugucuuggaacucacucuguagaccagguuggccucgaacucagaaauccaccugccucugccucccaagugcugugauuaaaggugugugccaccaccgccuggcguuuuguuuugagauuagaauuacaucauuucuuccuccaaaauuauguaggguuuuuuuuuuuuuuuuuuuuuuuuuaaagauuuauuuauuuauuuauuacauguaaguacacuguagcugucuucagacccuccagaagagggagucagaucucauuauggaugguugugagccaccaugugguugcugggauuugaacuucggaccuuuggaagagcagucgggugcucuuacccacugagccaucucaccagccccggguuuuuuuuuuuaaagauuuauguauuuuauguauuugaguacacuguagcuguacagaugguugugagccuucaugugguuguugggaauuuaauuuuuuuuguuuguuuuuuuuuguuuuucgagacaggguuucucuguauagcucuggcuguccuggaacucacuuuguagaccaggcuggccucgaaucagaaauccgccugccucugccucccaagugcugggauuaaaggcaugugccaccacgcccggcugggaauugaauuuuuaagaccucuguccugcucacucuggucaacucugcucgcuccagcccaaagauuuauuuauuauuauauguaaguacacuguagcugucuucagagacaccagaagagggcgucagaucucauuacgggugguugugagccaccaugugguugcugggauuugaacucaggaccuuuggaagagcagucagugcucuuacccgcugagccaucuugccagcccgaggguuuuuuguuuugguuuuuuuucuuguuuuuuuuuguguguguuuuuaagauuuauuuauuuauguuuaugaguacacuguagcuguauagaugguugugagccaucaugugguugcugggaauugaacucaggaucuuuggaagagcagucagugcucuuaacugcugagccaucucuccaucccuuguuuuaccuguuuauuuauuuuuaagauaggguuuguuuguguguguguguguguguagucuugcuauagaccaggcuggucuugaacucauagagaucugccucccuagugcugggauuaaaaucaugcgccaccauuggcugguuuauauagguuuuuaauagagccuuuuuaguagacaaagcaauauacaaaauacuaauuauucaacuaaagccagguaugauggcucacaccuuuacuucuggcacucagaauacuaagacaguaguauugaugggaauuugaagcuacccuggacuacauagugaguaguucuaggcuagcuuaagcuguagagugagacccugucuuuuuagagauugauugauuuguuuauuuauuuauucacuuauucuuaugugcauggguguuuugccugcauuugugugagggugcuagguccccuggaacuggaguuagagauaguugugagcugcccugugggugcuaagaauugaaccuggguccuuuggaagaacagcagugcucuuaaccccugaguuaucucuccagcucuaucugaaaaaaaaaaaaaaaaaaaaaaaaagcaauugccugcccauaguuccaggaaagaagaccaugaauuugaggccagccugaguuucagagucacaugguaaagcugucucagacaaagacaaaggucauuucugcagucccuccagaagagagcgcuugguguuuguguuuaaaguuauaaggagcuauguucuuuaaccacagauugggagcccgccucuugacccgacugagcauuuucuuccugaagaagagaaacuuacugaacaagagagaucaaaaagguuagucuucacagauagcacggggauaccucagagucucacuagagcuugcucaagacuacacacuuggagcuggagcuggcucagagguuaagagcacuagcggcucgugagaggacacggguucaaucccagaacccacaugguggcucacaaccaucuguaacucugucuccaagggauuaugcugucacuggcuucugcugacaucuauaaacauguggcauucacauauauaaauauacaggauaaauaaaauaauuauuuaaaacuuuaaaagauaagcugguuucuuaacuugauguaaauccaaaaauuaaaaauaaauaaauaaauaaauaaagaagaaugcacucauggugucugcugcuucguagugcuccuccaggauucgguguggaugcuucugugcauaaaaccuccauuugucaagccaggcgugguggcacacgccuuuaaucccagcacucgggaggcagaggcaggccgauuucugaguuugaggccagccuggucuacaaagugaguucuaggaaggacagccaggacuauacagagaaacccugucuugaaaaaccaaaaaccaaaacaaaaaaaucccuccauuugucgcuuacaagcuccaugauuuuguucaacucugagacccaguuuucuuguuugucagaucuaagggccaugugcaacacaauuauguaugaaauuuucuuauaaauuguaaaccauuauggaaaugucaauuuuuuuucuucacagauuugagaagguuuauacucauaaccuguauuaccuggcucaagucuaccagcacauggaaauguucgagaaggccgcucauuauugccacagcacacugaaacgccagcuugaacacaaugccuaccaccccauggagugggccaucaacgccgcuacucuaucacaguucuacaucaauaaggucuguguccacagcagcuacucagcggccuugacaguggucaggcuggggcagggcaggacuuaaagcuggguggagaaugcagcuagcugcugggaugcuugaaugcaugaaugcuuggaaucuuuaaaaaaaaaagauaaugguuguauuuaucauugagaauuucaugcaguguucuggucaggauccuuccccucccccuccauuugaaucuuugagugcugauuuuugucaugccccccugcauguugcuguccccucaaaggacaaguuaccuaacagcaguucaguucugugucagcacacggacauuuuacuucugggaugucuuaccuucaauugcacaguuuuaucuuccugcagauaaaauuuuaucuucguguaaugcuaaucuuacaacgaugagaauuugucugaggaaguuggcaguuaaaugugggcuuugauaaaagcaugugaugaguuucaguuacuuuuaacaauuagcugcucuccaauaaucaguuuugauguuaaaaauaugugcugaguuguagaguuccagauuuuaugacaaacuucugaacugucccuuugggacaaaugagagcguuagagcugcuuauccaaaucacuucgcauuauguauuuugaguccauguuuuccagucuuuuuuuuuuuuuuuuuuuuuuucgguugucugagacaggguuucucuguauagcccuggccguccuggaacucacucuguagaccaggcuggccucaagcucagaaauccgccugccucugccucccaagugcugggauuaaaggugugcgccaccacuccccggcaaguccuuuagucucuaauacuaaaauccuuugggguuuuuuuuguuuuguuuuuuuuuaauuugugugugugguggaggaggcugggugucacuguguagucuuggcuggccaaauugguuaucuguagaccagaguggccuugaacuccaagaggucagugugccucugccucccagagcugugaccauguaccaccacgcaccgcaaugcucacugguguagcucucauuccuaaagcucugacacuggguaaaucuuagccuaccagcaucacaucgcucucucaccccucaguggccugcaccuuccccucagccuuuuccuucuaagccuuuguuaguugguucugcaaaugugccccuaaguuaugucacagagugucacucagaaaaacuuuuagcagaagagaaagggcagcggugacugcggcaucacuucuaagaguuuggucuuagaucaagcguguaaguaaggcuuucugcauucagucauacccagccccuauaacucuguuucaucguggucaucauuuggaggccccucugcugucccccucccuccagcuguuggggcccccuuguuuaucaguuuuuuaaaagauuuauuuauuuauuuuauguauaugaguacacuguagcuguacugaugguugugagccaucaugugguugcugggaaugaagauugcucgcuccgaacuaaagauugauuuauuauuacaucuaagcugucuucagaugcaccagaagagggugucagaucucauuacggaugguuguaaguguuugcuagaauuugaacucaggaccuucagaagagcagucagugcucuuaaucacugagccaucucuccagccccuguuaaucaauuuuaaauguccuuguucaguacaacuuuaauuaacaccuaaaacuccauggauauucauaguacaaaaaugucuggauacuggcacuggauaccaugugccuuugaaguugcuaaacauuucuuuuguggagcaugugauaauuuucaugaacucccuuggaccccauacuuuuuggguuuuucuacaucacaacuagcuaaguucuguuacauaaagagagcuugcagccaugguugaaagugauguugauauuguuaccacgggcaucuguuucaguugugcugcuuggcgagucccauauuaaccagcuacccagagggcacaaggcccucccucugucuuuagcaguggcugcucauagaaagacaaucuggacagauccaaagugguaccaugguuaggagccugagcagagccaaguaaguuacuucaggugaccugcggcugcucauccuguuggugcucgugacacccagcuggucucagugauagcucugaacucagugugaaggagcacgaccacuauucaagcucacugacaggaagcaggcauucucuaacgagggcaccuuccaucuguggcagguuucauucugccgggugauccugcauguucaugacagauagcagguguuuggggcugacacagagauguuuuuaaaguguugaagacauuuucugggccuagauuugaaucaugaguucuuuacaggcauuggcaaaguaguuccagaaaauuuaucuguagaaaucuguuaacuuggaaauguaaggcaggugugguggcguacaccuuuaaucccagcacuugggaggcagaggcaggcagauuucugaguucaagagaccagccuacucuacaaaguguguuccaggacagccagggcuacacagagaaacccugucuugggaagagaaaaaaaaaaaagaagaagaagaagauagacuagugaaaaagauaggacuuuauuccuaguuuuugucugagugguagaaauagaaaaggggaauuuugggggguaggagugggcuggagagauaacucagugguuaagagcacugacugcucuuccagagguccugaguucaauucccagcaaccacaugguggcucacgaccaucuguaaugacuucugaugcccucugcuggugugucuguagacaguggcagugugcucacauauauaaaauaaauaaauugaaaagaaagaaagaaagaaaaaagaaauagaaaaaggaucucuaaaccucacacaaguccacaguccucuaacaguguguaaauggucuaaggauggacuguguauggcacuuuggcuauugaggcugaaccugagggcguggugagcugauaccacacaggacacucugugugucuaucacagugcagagcacugugacuggguggacugucagucuucagucaccuucccaucggagugugggacauuguuaguuuauucucugggguagcuuuucuuuuaacagauaauacuguucuccaccacaacucuacaagaccccuuuaguggggaacuuuuccugauaguauagcuuuccccauauuaauaaauauagaugcugcuaguuauaaacaaggcuuugucauaguuacauuuguuauugcuuauuuucccaacagcucuguuuuauggaagccagacauugucugucagcugcuaauguuauuuuuggucaaacuggaaaaauaccagcuacagaagacaguaaguuugcauguacauuucauuagaggguuucucacucagaugaucuugccuguguuggccuugaguucacgauccuccugccuuaguguccuaaggguuccagugacaggcguguaccacacacaaguuacuacagguuaaaaacauaucuggaauucugaaacuuuguuaacuuuuuuuagauugguuucuuuuauuuuaugugugugaguguucugucugugugugugugugugugugugugugugugugugugugcgcgcgcgugcacgcgcaccuauauauacauggugccugcagaggucagaagaggguucucaucccacaguacugaguuaaagaugguugugagccacggugugggugcugcaaacaggaccaggguccucugcaaaaguagcaagcgcucuuaaccaugaagcugucucuccaaccucaaaucugaaacugauuuaagcuuuagaaaagcuauaagaauacaauuaccauacaccuuccccuaaauccacugcuguuuuucauuuguuccuuuguuuguuuggguuuucuguuguuuugucuugguuuugcuugguuuuuuuuaaagauggaguuuuucuguguagcccuggcuucccuggaauucauuccuuagaccaggcuagccuugaacucaccugccucugccuucuaagugcugggaguaaaggcuugcaccacuacugccgggcucugcuguugguaauauuugugaaucuguacuuauuugucuuucugaccuaguugaguggagguuuuauacguuaggccuuuuuacaaauguaauacuccaaugcauguuuuccuaagagugagaauaucuucaggcuaggcauaauggcucaugccuggaauuucagcaccccagaggcugaggcaggaggagugccacaaaucuuaggccagccagccugggcuauguuucaaguuucaggucaaccuaaauaauagaguaaggugagcucgcgugcgcgccugcccucccucucucucucucucucucucucucucucucuuucucucucucuuuugugugcacgugcgcacacgcgcgcagacacacacacgcagauucaagacauguaacagcaagccguccugccugcagugcguauucugucucaucagcuguccugggguuugugugaugucucuguucuccaugacugacauucuggucucugcacugcuggcgugggcugucuucucaucccgucugucugagagguuggcuugggugcugcuuugugugcacgugaugcugaggacugaagugaggccguguguaugcaggcaagcccagcccagcccgaggccgggaggugugggaggaagguaagaaaugacggggccacggcucuccucaugcucugucccacacagagcacuguggauacggcaucugucaaaauaauuuggcagcuuuuauuuauuuguuuguuuguuuguuuuguuuuguuuuguuuuguuuuucgagacuggguuucucuguguagcccuggcugcccuggaacucacucuguagaccaggcuggccucggaacucagaaaucugccugccucugcugggauuaaaggugugcaccaccaugcccagcuuauuuaaauacuuuaaacuguauaaacuguuugaccuaguaaauuucauuucuagagaucgguccagauucuggacagauguacauacagagaucuguagccuagaauuguucauaauaggaagaauuggaaauagcauauccccucugcuggaagaaugacugaaacaggaagcaucuguuugauuguguguaaugauguauuaaaaacacagcuuaaggggcuggagggauggcucagugguuaagagcacugacugcucuuccaaagguucugaguucaauucccagcaaccccaugguggcucacaaccaucuguacagcuacaguguacacauauacaaucaaucaaucaaucaaucaaucuuuuuuaaaaauacaacuuaagaguugauaaagaauauauaugaaucuuauuugcuucauaauauaugaagaaaagcuacuaaaagugaacuauacauugugacgguaguuuuuguuuuuugugggcuuuuuuguuuguuuuuuuguuuuuucaagacaggguuucucuguauagcccuggcuguccuggaacccacucuguagaccaggcuggccucaaacucagagauccaccugcuucugccucccaagugcugggauuaaagguuugugccaccacugcccggcuauuuuguuguuguuguuguucucucucccuggccgcacucacucaagaccaaagauuuauuuauuuauuauauauaaguacacuguagcuaucuucagacacaccagaagaggaagucagaucucauuacggaugguugugagucaccauugguugcugggauuugaacucaggacgucuggaagagcagucagugcucuuacccacugagccagccaucuguccagccugugaugguaguuuuuaccugcagaugagacauaagaaaacagggagcaucugcagcucaacacugagugccgcgcggccggggccuagguaggccucugcuuagugagggucgcugagagcagaggacagugcacagugcagacgacaugaccgugaccuacaguccugugugguuuuagcuccugaaguugaaggagacgugccagagcuuuaccaucagaggaaaggggaaauagcaagaugcuggaucaaguacugccugacucugaugcaaaacgcgcagcucuccaugcagguaugcacguggaaguggccugcagcuucagugaggcucaucaucaggcccacuauguguuuuguuguuuugaguuuuacuuugugugugugugugugugugugugugugugugugugcacgggcauguagaacacgugaguguuuaggugccuguguguauaugcagguuugggggcauguauaugucugccuguggacagccuggguuuuuaagacaaagucucucacugguccugggacuaggugauuagguugggcaggguagcccagcaagcccccgggaugcacuuauccugcacccuagcaccuggguuauaaguacuugauaccgugcucagcauguuuguguagguccuggggauccaacugggguccucgugcuuauggcuggcacuuuccugauggaagucccucuccagcccuacucgcaguuuuucauuguaacagucucucuguagucuaagccggucauuccucagccuuuccucagccucuccauccuccuucggucuccaggugcugggauaaugagugugcaccacaacugguaaggaccauacagaacaccaccucauucuggaacccuuuccucagcuaggcugucaggacuauggaggauggggucagcaucaaaucccgguugucacaugauugucccaguaaauagugguuauuuuuaaaacuaauuguugaaugagcaggguuuuuuaauccuccacagauaccaucuuguuucuugaacuucauagucuuaagucacuuaaauucuauuuuguaagccaggcauaguagcacaugccagcacucaagaggcagaagcaggaagaucucuguaaguuugaggccagccuggucuacaaagugaguuccagaacagccagggcuacacagagaaacccugucucuaaaagacacagcaaaacaaaaaccagccaaacaaauaaaacugaguaaggccuucagagauugcuaggggcuaaaagcauuggcuacucugccagaggacugggguucaguucccagcauucacacaguggcuuacaaucaaauguaucuuaguuccacgggauccgauguugucuucuggucuuuacagauaucaggcaccaacccaguacacagaaaucuaugcacauaaaauaaaaaauaauuuuaaaaagaaaggaagaaagaggagaugggauuuggugugguggcacaagccuuucaccugaccuaaacaagugacuaagagcauacaugagacccuccucauggugcuccugucuuuuagucuuucccgaguuugugcugugauccuguuuggagacaggcucucuguuuagcccugcugcuauggugguccagccuggccucagaucuguagcacgccuccaacucagcccuccuagugcuaggaucacagagcggaccaccacacacggccuaauuaguguuagacugcagguccucaaaggcagggaguaguucucacucaguuuuaugucuuugcaguguugccuuuuggacugacaaaaucuuaaagguucaaaaucuuaaacauggccguuaagugcagcaguuaagugacgcacagcuccagagcuuaaaaacaaaacagaugauaaugccugcuuaacuuuguuguuaugagaguuaacauauaaaggccucagaaaguaccuaagcaggacuagugaguuggcucagcagauaaagcuaccaaaucuugagguccaguacaguagaaggagagagccaacuccugcaaguuguccucacaugugccauggcuccugcgaaugcacgcaugcacacacgcacgaacaaacucaucugaaauauaccgaguccuuauugaauauuaacuguaccuuaaucauucuuacuaaucuacgugggacccuaauuucuagccaccaagaagaaaaauaaaauaaauuaccuauuuaaaaaaagaaaauaaaguuuucuguuuuugugcuuuucuuuuuuucucugugcauggaaauaaaauaauuuuaauuguaaauaauauagaacuuauaaagcuguaaaaauaauaaaccaaaaagcuuaaguuugagaaaagaucauuuugggaaaagaacauuaagauaggacauucugugggcuggagauguggcuuagguaauaguguaccaacuuagcaugacagagccauggguucaguccccagcacugcauaaauacggugugcuggugugggccuguaaucccagcucucaaagggaggcagaaauaucaggaauucagagccacccuuggcuuuguaacaaguuccaggccagauuggccuacaggaacccuuaccucaagagacuugaaaggcugugggugcaguaaggagaagaugucuggugcaggguagguggcacguggguaggaccucggcacucaggcugugagagccagccugggucucccugggcaccugaaaacagaugcgcgcacacacacacacacacacacacacacaaguaaaaauaaaucuuuggugagaaaaaagguuuucagaucucagugggccugugguguggcuccuuagaggaacacucaccuaacauguucagaaaagaucauaaccugcuucagcuaugaugcacugucauuauuuuuugauuuuuauauauauuugauuuaguugauuuacuuuaguguguguauccacguacaugcaugugcaugugugagaggucaaaggacaacuugaaggacacuguucuucuaccaugaggguccuggagaacaaucucagguugcaggauccguggcagauaccaccauguaguaugugcuggccuggaacucacuguggaacccaggccucagccuugcugggacggcuuagcuaagagaacugaaauuacagaugugagccagccaccucgugucagaucuuauccuuagguuggcaauuuguuuguaaccaucaguguacaccaggcuggcuuugaacucacagaggucugccugccucugccuccugauuuuuuguucuuguauuuccuuuauuuuaugaauaugagaaguauacgagcaugucuguguacuauaugucugcugguguccaagcaagugaaaagagggcauuggauugucuggauuuuaaugaugguugguggccucggugcugggagcugaaccugagucuucugcaauagagccaucucuccagccccaacucuuuguucuuugagauugggccuugcuguguaccugcagccagcuuugaaacgugcuguuuaguccaggcuaguccauucugcaguccuccugccucugccuccuaacggcugggauuacagguguguuccagagcuucacugugguuucuccucuucauuuaggacaacauaggagagcuugaccuggacaagcagucggagcucagagcucuacgcaagaaggagcuagaugaggaggagagcgucaggaaaagggcugugcaguuuggaacuggggagcugugcgacgccaucucugcaguggaggagaaagugagauacuugaggcccuuagauuuugaagaagccagggagcuuuuccugcugggucagcacuaugugugugaggcaaaggaguucuuccagaucgauggguaugucacugaccacauugaaguuguccaggaccacagcgcucuguucaaggugcucucguucuuugaggcugacauggagagacggugcaagaugcacaagcgcaggauagccaugcuagagccccugacuguggaccugaacccacaguacuaccuguuggucagcaggcagauucaguuugaaaucgcacacgcguacuaugacaugauggacuugaaggucgccauugcugacaagcucagggaccccgacucacacauugucaaaaaaauaaauagccugaauaagucggcacucaaguacuaccagcucuuccuagacucccugagagacccaaacaaagucuuuccugagcacaucggggaagacguccuccgcccggccauguuagcuaaauuccggguagcucgucuguauggcaaaaucaucacugcagaucccaagaaagagcuagagaauuuggcaacaucuuuggaacauuacaaauuuauuguugauuacugugaaacucaccccgaggcugcccaggaaauagagguugaguuagaacuuaguaaagagauggucagucuccucccaacaaaaauggagagguucagagccaagauggcccugaccuaagccuuggucaaaggaaagagacgugcagcuugaagccacuccccuccccuauagcaaaugaggcccagccccacagucaccuucgccagggccagagggaugcacucugggcuccagaagcaggcagguacccgagucuaugcuaggaccuuaagcaccauaaauuaauaauuuauaccuaauuauguaaguugccuugcuaaagugacagguguuuugcauuuucgaucgcuuguuuuccuguuuaaguauaaacaucuccugccuagaguucuaaauguuaaguccuugcugacaguacuuguuagauuucauacuaggaacaacacuggguaguguaccugguagaagagccuguugcuguguugaaugugagaaagucacuucagaugucauucuuuguaaaauacuuacuuucuuaaacuccaaauaaaucuuucccuuuugaaaauacuaaaaacuuaauaauguuguaaaauggcuuaauuauaggacugaagaacuugcacauaauaaauuuacuuguuucaacuaguaauuacuuuuauuaccucuuuuuuccuuguaagaaugguucucuuuuuuuuuuuuaagauuuauuuauuauauuuaaguacacuguagcugucuucagacaccagaagaggggggucagaucccauuaccgaugguugugagccaccaugugguugcugcgaauugaacucaggaccuuuggaagagcagucagugcucuuaacugcugagccagcucuccagcccauaagaaucguucuuuuaaaaaaaggugugugggcuggcaagauggcucagcaguuaagagcacugacugcucuucugaagguucuggguucaaaucccgcaaccacaugguggcucacaaccaucuguaaugaaaucugaugcccucuucuggugugucugaagacagcuacaguguacuuacauauaauaaauaaaucuuaaaaaaaaaaaagguguguguguguguguuugugugugugugugugugugcauaccaagugcaugacuguggaucaugugccugcaaugucccuggaggccaguagagggcaucagacuccccuggaacuggagguacaggcagcugugacugccauguggguacugggggccaagcccuggucccuagaagaggagccaguucuaagccaucucuccauccuguuuucuuguuacaaaaaaaaaagaaagaaaaaaaaagucuuauuuuugacacguuaaagguauugccuuagagaauaauauuuuaauguuuuuauuaguacauguuaauuauucacaguugauuucacuuuggcauuuugauacauauuccaaucacacugauccuguuaccuucuccugcaccccucccucagucuccuuccucagagaagacuauuucucuaauaagacuguacagugaggaaauaucaaaauagacaaucuugcugggaguacugucgcacuccuuuaauuucaguacuuggguggcagaggcaccagaaucucuugaguucaaagccagccuggucaacaccaggcgucagguggaggaagcuuuguagguuggggacaguuuacauuuuauucuaggcucaauggcuccuagaauuuuagcaagaugacuggccaaucuaauuggauuuguuugcuuguuuguuuguuuguuugagacaguguuucucuguguagcucugacuguccuacgacucauucuguagaccaagcuggccuugaacucacagagaaccgccuguuucugccucccaugugcugggauugaagguguacaccaccaccucauggcccugauugagaguuuuuaggagaccagcuccuaugggcugggaacauggcccagaugauccgcgcuuguccagcaugcucagagucccgagcucaaucucagcaccgcauacacuagauaugguguuccuucccugugcucuuagugcucaggaggcuggagaaacauacguuugaagucuauuugaacuacccacugacugugaggcucgggcucuaugaggcccucucuggaagagcaagaaggagcaagaacaggggcuucugcaggggauggguugauacaguugauccaagucggagacaagacgguuuggaccaggaugauggggagggaaggucacccucugguuuuaaagcagaagccacgggccaugcuaaagguuuuuaagggggaggaaccaagagccacaguggaggcggcacacagacagagcauguuuuaagugaggccuguaggguuagaagccagaacucugcuuaggucacguugaguugaggaaguuaagccugaguugaaacaaccucuguuugauagcuuuucaugagagagaccuuccuuaaaagggaauggaggaagcuuaaaggagccauagagggccgggcaguuucuugaggacacagaugugacagggaaucuguucuuaagggaaacugaaacgcaccucccugucuguuucaagucuugcuuuuacugauguugauguguaugggugauuuucaugggugucuaugcaccacguggguacaguauccuuggaagucagaagagggugucagacuccauggaacuggaguuaaagaugguugugagccaccacgugggcucugggaaucaaaggguccuuugcaagaacagcaagugcucuuaacugcugaaccaucucuccucaccacuccccucccacacacacgcacgccaagccuuuccugauacggucauuuucauaaccucauuuuagugucugcuuaacaaguaccugcugggcuuuggauaugccacagcucacugucuuuugccuuugccucucuucuuucccggcagugcuagcuugauuucaaaggggaaaaggccaaauaguaccagcagugaccggaaaacuggucuucauuccuuugucacuugcucucuguggcccuucacacugggacacgucucugguuggcaguagagaucccauccuguauucuccugacacacucguccugaaggcacuggcugcuucccuagagagcccugucucccauguucuguucucaaagcccccugacacucacaauacagagggcagcagagagcugguguucaugggguuuaaacaugcuaugaaaauggggcagucggugaguggcaggcauguuugaaccacagaucucuuacaaaacuaagcuacugguccugccaauuccaugagaauggaccuugagaaaaauuccucacaaauggaggggaaaauugaccugaaauuccacauuaucuaaaccauaauuaaaaccauaugaagaggauuuuucaguuaccaguuucauuucuuuucuuuuuucuuuucuuaaaagauuuauuuaucucuugugaggcuaugccagugccuggcaaauauagaaguggaugcucacaguugucuauaagauggaacacagggccaccaauggaggagcuagagaaaguacccaaggagcugaagggaucugcaacccuauauguggaacaacaauaugaacuaaccaguacccccagagcuugugucucuagcugcauauguagcagaagauggccuaguuggccaucauugggaggagaggcccuuggucuugcgaagauuauaugccccaguacaggggaaugccagggccaggaagcaggaguggguggguuggggaacagggcagggggaggguguaggagacuuucgggauagcauuugaaauguaauugaagaaaauaucuaauaauaaaaaaaaaaaggaaaaaaagauuuauuuauuuuguuugugagugcucuaucugcauguacaccugcaugccagaagagaacauuguauuauagaugguugugagccaccauauguaugcugggaaucgaacucaggaccuccagaagagcagacagugcucuuaaccacugagccgucucuccagccccaccaguuuugucccuaaguagacauuacauguuaccagucuuuccauaaccacuuuucauuuauugggaacaguuucuaaucaugaguugugaaaacagaacccucaaaucuuuggacgacaauaguauuuuuuuuuuuaaacggcccaagacauauggggaugcauuucuuuuccucuuuuugcuuguuuuuagccuuuaauggcugagucaucucuccagcccuguguuuuguuuuauuucauuaguugguuugauuugacuugauuuuuuugggacacauucacucucuaauccuggcuggccuagaacucacccuggaaaccagacuggccucuaauucacccuguagcccuggcuggcuucgaacucacagagauaagugcugggauuaaaggagcgugccaccaugcacagcuacaguuauuuuucaucaucauuuugacauguuagggccuuccgugcauuaagcccaguguccguuguacuguaccuccagacccuauuagcauguuuaggaaaaacuaggauggaaaacaguuucaagaaaguaacccaagccagguuguggugguacaugccuuuaaucccagcacuugggaggcagaggcagguagauuucugaguuccaggacagccagggcuauacagagaaacccugucuugaaaaaaaaaaaaaguaaguaaguaacccaaaacugggcuggagguagagauccuauugugcacaagguuguagguucaagucccagcacugcacagaccuagugucgggacauaugccuacaccccaacacuugagagacagagacaaggggaaugggagcucgaggucacauuuggcugcacagugagcuugcccauaacuuuaggcucuucaggcggguccucccuuucucaggaaggucaugacccaguguuacauguuuaucuaccggaaaugacaagguuguauaaugauguucuauguaaaaaugaggcucgaaaauacaguuaagaaaaccugagguugccugcuggguguggugagcuguugggugcacugugaccugcagcugucgccaccagcuguauccgugccgaguucuggcuggcuuccuucugaacgucucacuuggggucccugagugucuuccuucaucuuugcuguuaucagcagacuugucacaaucagugaucucugauuuggucacccaacagcuguucugcagaggcucagaaagucacccaaccgugggaagucuuaacagagaaaauccaagugaugcccucugccugcugaugugcgcggcacuggggugccuuacguuaaggaccugcugucccucuguauggugacucaagaggugcagacuuccguuccuacgcaguuagucauucauuuccuccuuaacauggugcucauaaagaucuaacuucuccccaccgacacauaaguggaagugacuugucagaaaguagccuaaauuuugcucauuugaagagaucucagagucccagauuguaaaaaaguagauaacuccuggggcuggagagcugguaaguaaguaacccaaaacuuaacaacaguuaagagccucacuggcugcucuuccagaggaccaggguucaauucccagcacccacauggcagcuuacaauugucugugacuccgguuccaggggcucugacacccucacacagauaugcauuaaggacaaaacaccaacgcacauaaaauaaaaauaaauaaaucuuucuuuuuaaagguaauuccaaagccucccacucuuuacuucuuaguuaaaacaaagcaaagcagaacaaaccaaaaaacccaaugugugagacugucaagauggcucaguggguaaaaccuggucaaguucuuaaucagugauaggaggggcagcccacuguggguggucccaucccugagcugauagucccauguucaauaagaaaacaggcugaacaagccacgaugagcaagccaguaagcagaaugccucaguaguuuugcugcauacaguagucugggcuggccucuguggucuuucagagcuuguauaagcccuucuggcuuuuacagucuccacuaagaagcugggugguacucuaggugguaaggcuaccuuuaucauaugacuuggucuuuuccuuugcagcugcuaucguucuuuguucuucgugaucacugcuuuuuaaauuaaguuauuuauuuuaacguacauuuggaguuugugugugucugugugagggugucagauccuuuggaaccuuuggaggggaggggaggggagggaaaaugaccuacaggccugucaauagcccaaucuuauuggaacauuuucucaguugagguucccuccucucuagcuugugcuaaguugacguaaaacuagccagcacauucucuacauggucuggcuguccuggaacucacuuuguagaccuuugcuggccuugaacuaauagagaucugccugcuucugccucccaagagcugagauuaaagauguacacugucaugucuggcuaagacuucuauaauaaaaacuuuaagacacugaagaaagaaauugaauaugacaucagaaaauggaaagaucuuccauguuuguccaucucuuaccaaaagcagucuacagauucaaugcaauccccaccaaaauuccagcacaauucuuuacaaaaauuaaaaaaaauaaaaccuucaguuucauauggaaacaacaaagauaaggauugcuaaaccaauccugaauaauuaaaagaacugccagcaguauuacaauuccagauuuuaaguuguaccucagagcuaaaguaauacaaacagcaugguauuggcagaaagacacauuaaucaauggaauuauggaauugaaccgaagacccagacaucuccacaugccuagggacaucuaaauuuuuaaaauuuauucauuuuaugugcauaggugcuugugccugcaugugugagggugucagaucuuggaguuauagacaguagugagcugcuaugugggugcugggacuugaaccugggucaucugggcccagagcagucaguucucuucaccacugagucaucauuccagcccggacaccuaauuuuuaacaagccaaaauacauacuggggaacugggggggugggggaccgcauccucaacaaauggugcugguuaaacuggcuauguguagaagaauguaaauagauccauauuuaucacccuggacaaacucaucuccaaauggauuaaagaucuccacauaaggccagauccccugaaccuaauguaagaggcagugaggaauagccuugagcucauuggcacaggaaaagacuuucacagcucaggcaccaagagcaacaauuaaugcaugggaccucgugagacugaacaacuucugugguaggacaccaccagucaggcagcagcaagcuacguaagagggacagaucuuuauauauuuuuaagauuuuaaagauuuauuuauuauauguaaguacacuuuagcugucuucagacacaccagaagagggcauccauucucauuauggaugguugugagccaccacgugguuucugggauuugaacucaggaccccuggaagagcagucagugagugcucuuaaccgcugagccaucucuccaguucagcucuuuaucguuauacauuugagagaggguuaguaucuaaagcacauuaagaacagaaaaccugaacaucaagaaagcaacccaauucaaaacugggacacagaaguaaggaaaggauucccaaaagaugaaacucaaaugacgggggcccagggcggggguugcacaccuaaaacuguccugcauccuuacccaccagagaaaugcaaauuaaaaugagauuuuaucuuaccccagucacagugcccaagaucaacgaaacaaaccacaguucaugcugcugaggauguggggucaggggaacacucauccaucgaugugggaguacaaacaugaacgaacagucacuauggaaaccaguguggcaguuccucaggaagcugggaauagaucuaccucaagauccacuagccuacucuugggcaucugcccaaaggccucugcauccuacuccagagaccgcuugcucaucuguguucagggcugcuguauucacaauagccagaaauugggaacagccuagccguccaucagcugaugauggauaaugaaaauauggugcauuuauacaaugggauauuauucaguugcuaagaaaagugaaauuuguaggaaaauggguggggcuagagaccaucaucucgggugagguaacccagacccagaagacagacaucgcauauuguauauguauauguuagcuuuuaaguuuuuacuauguguacuucauaaccauaaagguuaggaaccugguaagggacccgagggaggaagagaccuuccaaggauggagaaauagaauauggugcuauaaagagaaaggggaaacuaaaacaggaggauuaaauggagagggcggugggagagccggguaaagcgcuaagaaggaagcuagcgcuuucauagaacaaggaccuggaaccagaaacuccugagcuuuugguucccaaagggacccuagccuggggacagaaggacaaaccaaacauccuuagaagccuccugucaccuagcagcugccagccccccuuugcacucccuguccugaggggauucugcuggcuccaucacagcccugggucucagcuccgaaggguagguuucccaggugacaagaagacacucccucaagacuccuaaagaauauucuagacugugccccaggaggcaaggaaagaaagggaaagcagauuauuuagaaacagcacacaagcagcaagucucuugaacucgaauggaaaaugccaauggccaccuaaugguggcaccaacuauugacggcagguaaagccggacugucucuuaagaacauacuugaagugaagcagaugcucuuggaucacccauucauaccuaauaagggauauauauggucggucuaguguggucugacccggacgagcacccuuuagcaagugcaguaccuacacuguccucaagguggagcucaagggugaccaugucuucugagcaaacggagagcuucagggaacguguauguguguguguggggggggggggggggggaaagagggggaagggggcgggggaagggggagagggagagaccaagcugcuguccagcccggaggaauggauccaccagcgacugcuucugacacaguugccacacuguagagaaagaaccauccuugggcucugcugcccaacaguuauuaaggcucacccagggcagacagugccaaguacuccugagcgccugggacgugagcgcuccaaaccacuaagcacaaguuguaaucaaggcccgagccaaagcugaugggugucuaagagggugaacguccuggggugggcugccuaggcucuggugccagcugcuagagcaaacguuauucugaggcugaggcuguaacuuagugguaacuuaacuggaauguucaagacccggaggaacacccugacaucucaaaacaaaacagaacccaaacaucguuucuguguucaugaagcauuuggaagauaguauuaauuauuuuuaauuaguggacuuugaguaaaacagauuaccaagaugugguagacaacggucaucccuacagagguucaaggucaacugcgacuacauuugaguuucaaauaaaaaaacaaaaagcagauuuccuucccaaaugugguggcccugguccaauuagacagucuuuuuuuuuuuuuuuuuuuuuugagacaggguuucucuguguagcccuggcuguccuggaacucacucuguagaccaggcuggcuggucucuaauucagaaaucugccugccucugccuccggagugcugggauuaaaggcgugcgccaccacugccccaccaauuagacagucuuaaggcuucaucucccugggaggaggaaggaccgggcucccaggugccuuugauggcagcuuugcuagaauuucuguccuuucugcaggcuucagauucaucaagccccaccacagcacggcccauuucccucagacaguuaagcugggugucauuaaagauagggacacagauccaggcaucgccgcagcauacauuuggaauccuggcccuuuagggagguggaggcaggagcauuggaaguucaagagagcucaagucucucuggauuugaggggaagugggucaucugggaguggggcucauuacugucuuaaggcaguagucuccaucuguguuagaauguuaguguggugcaccugucgugucacaccuaguggcugaggcaagaggauggugagaggucagcccgggucacaccaagagagccaugucaggaacgaaugaaccaucaauauucuuuuagagcagguacacaggaagaaagccuucagccucugcccugggagugcauccguccauguuugcccucucuguucccaugcauggccuuuugagugucacacaagaaaucaagguuugggcuggugagauggcucaacgguuaagagcacugacuguucuuccuaagguccugaguucaaaucccagcaaccacaugguggcucauaaccaucuguaaugagaucugacucccucuucuggagugucugaagacagcuacaguguacuuacauauaauaaauaaauauuuaaaaaaaaaagaagucaagguuuaucaccaagaccucugccuguaacucagccaugccaggcaacagcugugaccugggccucaagccuuuugcucucucagccuccuaccugggacaguuuuaugugaacuugacccaugcuaaagucaucugcagggaucagaccucaguuaagaaaauaccucugaaagauccaacccuaaggcauuuucuuaauuagugaugggugugggagggcccagcccauuggguggugccaucccugggcugguagucuuggguucuauaagaaagcaagcugagcaagccauggagagcaagccaggaagcagcaccccuccauggccucugcaucagcuccugccuccaggauccugcucugugugaguuuuuguccugacuuccuuuggugaugaacagugauguggaaauauaagccaaauuaauaacccccaccucccacccccccacacacaccuugucucacacacacacacacacacaccccuugucugagucaccguguuucacuggaauaauaguaacccagagggagaugccucccuuuccuugucuguaacacaaucuuuagaaaauaauaguucugagcuuuguugaaacaguugaggggcuggugucuuacauggggaccuugcagaagggcuauggagauguuggucucugcaagguugucuccccuuuacuuaccugucacugagcacuggaagcaggggccauuucagacuccucucucucucucucucucucucucucucucucucucucucucaguguuuugaaaagaagaaggguauugggcugaagagauggcucagugguuaagagcacugacugcucuuccagagguccugaguucaauucccagcaaccacaugguggcucacaaccaucuguaaugggaucugacgcccucuucuggugugucugaagacagcuacaguguacucauauacauaaaauaaauaaauaauugucuugucuaccccaugcugguggucucaacucucggucagucacugggauuaucccacccagggccaccgcccccaguauuccuucucauuuuaaacagagcuuaagacgaauuccagcaagugaaccagaaaaacccugggauggaaugagccagagggauacagaaacggaaacccucagggagcagagcuggcaucaagcuuacugcaacuucugagaaagggggaacugcacaguuacacaacuccgugcugucguccgugagguaaagacagcuaacaguugcaggagaaacccaacggggcaggacccccuuccuuaucuaccuugugauucccacaaaacgaaauuguuucugagcccaagggaggaccagucauccucagaggucccccuucccaucuccagcugagccaacagagaagguccucuggccagagaccuaaucucaaaauaaagcuaaaaccuuuaguuucugaaacuaaaaguucugaaacgauacaugguacacugcaguuagacuguugguaaccacacgguucaucuccgucucaauucaccauucagaggaaccuugacccugaguucaggcugauccaggguccgucugggcuccaaucagugccagcuaccauugaggccuccguacacuuuauccgacucagcacucagcaguuuuucugaguauuucuuucaugagaggcuccaaugccaagcccugcucgggaacccgagcccucagcauccgggaauucagaggaagccugccaacucaggaacugaagcgguggggaaauuucaggggcaagugggacuuucugcauaagaagggaccaaccagggcaccaggagcaggagagcuguguaugaugagauuucucuggggucagacaucagggggugcuugcccugcuuggagcauaggugccgagggagauucagcauucuaugggaagauggcccuucaggcgugcuccuuacaaagagaaagaacucagggaaucucuaagaguugccaaucuggaacuuucugaagcaguuugucacuugagaauuuauguaucuuuguguguguguguguguguguguguguguguguguguguguguguguguguugggggcaggucucacuauauagcucugauuauccugaacucacuauguaguccaggcuagccuggaacacacagagaucuacuuuccucugccuccccagugcuaggauuaaaggcaugugccacccugccaugcuagauuuauguacuuaaaaauauuucuuggggcaggagagauggcucacugguuaagagcacugacugcuuuuccaaauguccugaguauaaucccagcaaccacaugguggcucacaaccaucuguaaagugaucagauacugucuucuggugcaucugaauacaacuacaauguacucacauacauaaaauauaucuuaaaaaauuucuuacugguuaguauaaacaauugggauuuauuacagcauuucccuccaugucucacacuuguccuggcaauuuaugucccauuagaaaugcaucaucgagcuggggauguggcucagcuggagagcucgccuaucauugcuuugauggccuggguuugagcaccaucauggcauaaggcugaugguauaugccagugaucucagcacucaggagguggaggcaggaggauuagguauuuagggucaucuuuggcuagaugguaaguuugaggugggccuaggauaccugacgaaagaaagaaagaaagagaaagaaagaaagaaagaaagaaagaaagaaagaaagaaagaaaagaagaagagagagagagagaaagagagagagagaagagagaaagaaaaggaggaaggaaggaagaaaaagagaaaaagaaaaaagaaaaacaaaaaacaaaaccaaaaaagcccaaaagccguaucucuggguaugggacacucucucauuuucaggauguuuacaagucaagguuagccugggccacaucgacuguaucucaacagcaauagaaaggacccucucuuagggaugguggcagagaguccauaugccucuucccaggcaggggauauugccgaggcugagccacuggcucugagggaggccuugcagggccaacauucggugcuuauguuguagcugggacuggaccacgaagcacuauuaggcuucauuucaaggcuuccagguucgagcuguaguuuucugugccuugucaucuuggagacguguucugguuuaguucucaaaugucccccaaaagcuuauguguugaaggcgugguacccaauggaacuguuuaaugugggccuuugggagcugacugcauccugagggcuccaacuucaugaguaaauucacccauuuaugggguuauagcuuaauggauuuaagggacacucccccaccgccaagcuucuacaccagugguucucaacgcuuccuaaccuugcagaacaguuccucacguuguggugacccccauccauaaaguuauuuucguugcuacuucauaacuguaguugugcuaucguuagggacugcuauguaaauaccuguguuuucugaugggguggaggggcggggggaacaguugagacccacagguuagguuaagaaccauuguucuagaagguaagcaguuuccagugccccgcacuuccgccaggaugugcugucuucacacauguccaaagcaacuuggcuaagcaacucuaguccagaacccgaaacugucaaucaaaacacuuuccaucuuacagauucuaaaaauacagaauggguaucuugucccagugaaaggugcugaugucugacacaucugguuucucuucaaaccaccaggggcacaguccccugucaccuagaagagaggcagaggcagagggggugaaguggaggaaggagguccugggggccugaaaaccacacccagccccucuuacaacugugaauaauuuaauucacauccucuccaaucuuuguggaaagaaauagauucaaaaggguaaaggagccaggcugagguggcacaugcauuuaaucccagcacuugggggucggggugagggugagugugacggggugggaggaggggagggguggaggcaggcagaucuccaauucaaggccagcaugguuuacagagccaguuucaggacaacagggcuacacagaaaaaaacucugugucaaaaagaaaaagaaaacaaaaaacaaaaaaaccaacgguaaaggaagucccccacaaggucacaaggucacaaugcuagaaaguggcaguuaucuggcucuauugaagggaugcccaaagccaggcucacccacaccagggccaccuuccuuaggaaccugcaaaccaaagacuccacagcagaagcagggagagaucccaugaucagccgggugugagggaaagaaccuuccuuaagguccuuccucaagugguuucuacugggagccugucucuuucugagcgcuaggugcaagcucacaccaaacgagcgaggccuucgugaguaaccacggagagaagaaaagaggaagccacugcaguucuguggaaacuucucugagaacucuuggguacaggaugugucacuggucugugcaggagguugugauagccacgaugguuucagugucuccccggccccuccaguggcugaugucaugcagagaaccccagccuuccugguccugggaucugaagggcgggagcaagcaggcaagggcgguucugaagucugacuuccccagagacauaaaggggcugugguucacgcccugagcuagcgccuguccuaguuuaggguuucucuugcugugacgacacaccaugaccaaagcagguuggggaggaaaaggggucuauuggacuuccgcuuccacauucuuaaucuaucauugcgggaagucgggacaggaacucaaacugagcaaaccuggaggcaagagccaaggcagaggccauggagggugcugcuuauuggcugcucggccugcuuucucauggaucccgggaucaggaugcucagggaugguaccacccacaaagggcuggguccuucucuaucucuauccaucacuaauuuagaagaugccuuccaggcuugccuccagcccagucuuauggcggcauuucucaauuguuugguucccccccccccccagaugacucauagccaugucaaguugacagaaaucuauccagcacagugccccauuuccuggccccaaagaccugucuuacacaaggaagacacucucggucugucaacauguggccaccacucagguucucuggccuuccgaacgcccgucgggaauuuaauaaaacuguccaccuaugucuuaguuaaaagcaaguacccaccuaguccuggucagcgauucggaaaaguucacgggauuccccccccccaccccccccacccccccacccccccacccccccccgcucugucaggaagccgcgaaggcccuugggcuuuuugguaaaccccugcuagcccuccuggaagccccuguuucugaaucacccugugugagaagcccuugagcacauggaacagcgcacugagaggcgcugugagcgcggaagguuuagggucaaggaggaacguagcugaggggcacaacccuggguuuaacccguagugccaaaggaaaaggaaaaaaccaagccugagguacacaccugacacuccaacacugggaggcugaagccagaggacuaccacaaguuuggggcuagccugggcugcacagcaagaucauaucucuaagaaaacaaagcagagcuauuuuuuuuuaauggauauaggauggagcauagaauucugaugcuucaaagguggaggcaagagcaacuguucaaggucauccuucacuauaagcaagcucgaggcuagccugggcuacaugagacuuuuuuuuuuuaagauacagaacgcuuaaugauuuuuauugaugcauuaaaauauaaguugacuuggaguugaaauuuauuauuaaaauguucgggguguggugguacaagccuuuaaucccagcacuccaaaggcagagucaggugaucucuaugaggucaaggccaaccuagucuacauagugaguuccaggauagccagagcuacauagagaggcccugucucaaagacaaaauaaaacaaagaacugaaaaaaauuaauuugugucugagauacagcucaaugguagagugcuugcuuauaugcagaaggcccuagguucauacacacacacacacacacacacacacacacacacagagucauuuauuuguuuuugcuuuugucuuguuuuggguuuuuugagacaggauuucacuauguagucugggccuagaacucacagagaucugccugccuccacuucggcuucugccuccacugagauuaaaaguucgugccacugucucuggcccuuuucaguuucgagccaugucuuggguaccggagacuuguagcccucggaggcuccuuugugagccuucacuuccccuuucuggaguaugagguugugagagugggcagggagaucauugcaagaaccugcuguaagucacguguuugcaacaggcugcaaaguuccccaacagcaagauguccugaggauccaggccccccaccccagggauggacagccagccgauggaaugaugaaucucuagccacugaagagaguccugcuccagaggacaucgaucggggcuuugguuuccccgaguugcucaagcaagguaccgcaagcuagacagcucgccaucauaggaaguuauaaucuccucauaugggggcuggagguccaaaaucaagauggcggcagggcugugugccugugcucuaggggcuuaagggacuaucaccccucggacuuuuuagccacaacccugacauucuuugccugucuggaauccucuuccucuguacaaauuucccuuuucguacagagaguaguccauucauuagggucaccuugguccaggaucccuucaucuugccuuaacugcauuguguaaaaccuacuuccaaauaagguuccaucuuggagucccaguagccaugucuuuggaaagcaugccgccccacuuuggaacaguuaaugaguauuuuugugaaaagcaaucugguguguguuuggguaauuucccagcaguuucaaacccaaagaaaggggguguggcaugccuggugcaugcugggagcugcucuagaugcuagaaacacaaagauaucuaauacuggggaugugauacagucucugacuccccagagcccacauucuggugacagaggcagaccacugauaugucaacauucacugauagcugacgugcuagacuguagggaguggccagagcaggcuggugcaauggugggcuguuuugauaggacaggaggggcucuugagaacagagcuaagagagggccaguuaggggcagaaguaucugaggguagaaauccacgucaggggaccagcaagaugucucaauagacaaagacaguuacugucaauccugacaaccugaaccuauauagaagguagggagaauccacuucuaaacuuucuccuaugacuuacacacacacacacacacacacacaaacacacacacacaaauaaauaaacagucauaaucaaauuaagucauugcaagaaucugccguaugugacauguuugcagcaggcuguccugcgaguuccccaagagcaggauguccugaggguucagacccccaggauggacagucaccagauggaaugaugcaucucuggccaccgaggagaauucugcuccaggggacaucggggcuuugguuuccugggcagaaaugagagaaaguacaaugucccccaaggcgggaauguuugaagaguucauaaaacacccauuccacaaaacaccuuucuaccaauggggucagaaccaggugggaggagggagagacccaggcuggaagcugggcaucuagcgggcuccauagcuaguguugcugggcucagaugugaaggaugggcucccaagcuucugcaaguggugaaggagugaccugcacuucuuccagcccggcaucccucaucaaggggcggaggcgcccuuggcgcggcgagcauuggaccagucauacaccacugucgucuccuccacacaguaagaacggaagcgagguuucuccgcuaauaccuuuucccuguuucuucuuucuucccagaacugugccugucucuucucuggguagaggcuggcuucugcguuccucccggaaguggccagcagugccagggcuccuaccccuggcagcagaaggacaauucuucccugguuuccuuaaguacuuccggucccaccgugaugagccccugcccuccucaccuaggaagcaagcacuccacugcugaacaucggccuuacuguguccacagaacacaccauauagcuuguucccugguuuguugagccaaggucucaccuagcuggccucgaauuugaacuuucgauguggcuaaggaugaccuugaacuccugauccuccugcuuccaccucccaaggaccaggacagccagggcuacacagagaaacccugacuugagaaaagacggaguacgugacccuaaccuuaacaaauguguugcagcuuuagaauauguguguguguguuuguaugugugugugagugaguuccuugagaguguguguuuguguguguauaguauguguguguggagagaucuguguguguaacuauguuugagaguguguguguguauguggauguguguugaguguguguguguuuguaugugugaguguauuagagaaugugugugaguguguguguguguuugagaguguaugugugugaguauguaagagguugggggugcaugugggugcuggggacugagacuggagccccacaagcauucuaccacagcuagagugacaaagugaccauggaauccacgaauugauggcaacaaauucuagcuuacuuuucuccagccucccccugagccagagcccuuccuucuguggaugcacagugucaaucagguguggcucccuuaccauggagauagccccacagauagcaggggcauucuagagcauucugcaguauuccucaaguucaucuguacuguacuucaaaaauaagguaucuaacauguaaugcuacaugaagacuacgagagagaguuaguucuagguaguaugugaguuugagcacacacaaaguccuggguucaaccuuugaugguuaguguuaauuugcaacaauggagaacagugguucucaaccuguggguugcaaccccaucagcaaacugugacccccuucagcaaacuaucuccaaaaacauuuaugcuucauaauaguagcaaaauuacaguucugaaguagcaacaaaaccuaauaauaccguuaggaggguugccaugacacgaggacauguauuagcaauucagaaacuucgagcuaccuugacgucccugccuugauagacuguccccaaacugugagcucaaauagacccuuuuucuccuaacuuaaucuugacagaaguccuuuaucucagcaacagaaaaagaaaugaagacaaguauuuccauuaccacaauuuuuguuuaaauuuaauccccagaaaaaaacuaagguaauuuccagacauaucugcccuuagauuguauuauuuagugcacuaauaaacaguacagacauaucacuauacuauccucucucucucucucucucucucucuc

SEQ ID NO: 5534 - RNA, 1377 nt, Mus musculus
uaagcaugagaauuuaaucauaggcuacagaauuuagcauuacaauacauaucaacacuggccccugugucagccugcagauaauuggcaccaugccuagcucagagccuuuauagaauuuucagggacugggcggugguggugugagguggcucuaguaaguaaaggcugcggaggcugagccugaggaucugaauuugaucccugagaccuggguaccuggguuguaguuuccuacaacuauaauuuuuaacugugauagcguaauacauuaguggugaaagauucuugccuaugaacuugagcaguuaucgaaagauguuaguguuaaauuucauuuaagcuagggauugacuuuacgauaggcuaguaccuuaccccuaagaaucauucugauucugaacauuuuuguauaaacuacauuuugggaugaagcaggagaagccauacugcucaaggguagcagcggaaggcucuguauucccugacagcuucguuuccuugacgacggcuguuguggcgaccagaacauccucccauuggcugcugccgagcgucuagcgcuccccucuaccgacuucauuggucggcgcuccacagucacgacacgucguaaaugaagugucgcaacgcggaggccuccaguggcugcugguccacggacggggaggcggccgucagcucaggccgcgauggcgaacgcuccggggccagagauccgcgagaaguuccaggcagcgcuggcccugucgcggguggagcugcacaagaacccggagaaggagccguacaaguccaaguacggcgcgcgcgcgcuguuggaggaggugcgcgcgcugcugggcccggcgcccgaggacgaggacgagccggcugcugacgaugggccgggcgaccaggccuugggcgcgggugagccccgggaggcugagggccccggagcgcagcgggcgcugcgccucgcgguggucgaguuccaccuuggugugaaccacaucgacacggaggaacugucugccggcgaggagcaucuggucaggugccugucguugcugcgccccuaccgccugucgcucggcugugugucucucuacauccaggcgcaggugagaugcugaggcgggaguucugcauccaaaacgcuccuccuggcugcgcacgucucucaguugguucaguccccagcauugcacaacacccggccugaaauuccaguacuagggaggcugcggcaggaggauugcuuuggguucuuggcuagccuggguuucauagcgaaguuuagucccuuuuaauuugucauaacaccuacccuccaucugccuaccaacucccucugaguucucgccgccuacuccagccucacuugcuacuuuc

SEQ ID NO: 5535 - RNA, 2125 nt, Mus musculus
aggcugcgguucgcgcggcuuugggugagacccgugugugcggcguggaggugcucugcgcggucuaacgacagcgggaucgccacggcuagacuuggagaacggccuugaaucuuacccugcugccuccgcuugccgagucugggauuaccagcuggcaacauuuucccaugaaaagcugcgauguguacgcuaccuguggaaaacggcuggguggugacagauaaacccaggugcuuuggugagcaccggaauucagggaccggcgagauaccacaguucuggugaccugaauuugugaucccuggaaaacagaaccagcugugcaguuuuaucgugcacgcgcucaguggcacccaggacacgcauaugcgugcugcacaauaugaacaauuuaaaagaaccagaauaggcagggcauauggggugcacgccgcuaaucucagcacccaggagccagagguagauggaucucuaucgaguccagcguggugcacauaguucaaggcuagcccgacacaugaugagauugucucaacagcucucuccccgaccccaaguaacaacaaaaaauacccacaauucacaagucuggcccuuuauucaugugugcacuuuauaaacuuccggguauucuuguaugacggacaggguucguuuuuuuguguuuuguuuuucgagacaggguuucucuguguagcccuggcuauccuggaacucacuuuguagaucaggcuggccucgaacucagaaauccgccugccucugcuuccagaguggacagacaggauucuaauaacauccaagcccugcuuguccucaagcacuacagaccaaaguuucucaagggggucgacacuccguugggguucaacgacccuuuuaccaguggucauauaucaaauauuuacauuaagauucaauagcaaaauuacaguuuugaaguagcaauuuuuuuuuucagagcugaggacugaacccagagccuugcgcuugcuaggcaaacgcucuacagcugagcuaaauccucaacaacuaaaauuaauucauuuuaugguuggggaucaccacaacguaagaggcauuaaagggcuacagcauuaggaagacugagaaccacuguuauagacuaauguaagagauggacaguuaucacuggguuugagggcacacucagccccuugacagggccuugagacuaggaauggauucccaaagaugccuaaguuggagaguuuacuacuaccauuggauaagggaaagaggccaauugaaugaucagugacaaugcucguuuugagucaggcuuucacuguacacccgugacugcccuugaacucagagaucugccuaugcugggauuaaauauuugcacgaccacacugguaauacguuuuagaacuucuucugaagaaccagugauucggggacuugggagacaguuuaucacaguaguuugaaaaaugaaagugaaaccgauucucuucuuuaugugaguucuggguaucgaacucaauucuucaagcuugcaucaagagguagcaaacaccauauggacugaaccaucucacaggcccuaagauauuucuaaauggauccauuguaauguaugcuaauuuugaggagacaacggaguguagugaaagaaacucuggauucaaaucuugagcacugcacugcguuuggacuuggggucugaggugagccucagaaggcugaaaugcaaaauacucacggaaaaaagaaaauaaaguugugugucaccccugcccagcuaagauuuuuuuuucuuuuaagauagaagcuauuauuuaauuuuguuagaagcccuacugauagaaaagguaaccuuuagcagguagaucguugaaaugcaccuugccaacauuuagcuacaugcuuaucaccacacuugaagugaugauacaagaagccuuucaauagcugaugaaaacaaagcccaggggcuggagagauggcucagcgguuaagagcacuggcagcucuuccagagguccugaguucaauucccagcagccacauggugacucacaaccaucuguacugggaucggaugcccucuucuggugugucugaggauagcuacaauguacucauauaagua

SEQ ID NO: 5536 - RNA, 35440 nt, Mus musculus
cggaagugacgcacgguccuggccggcggggccgcccagcccccgcuuccuuucacgcucucgguggccguagguggucgcggccaccgcagccgggcgggagguugcgacggccaguaaugcccgggaaacuccucuggggagacauaauggagcucgaggcacccuuggaagaguccgagagccagaggaaggagcggcaaaaggugugcugcggcugggccgcgccucccucgggcugcgcuggccugggcggggaggggagcugucuaggaaggggaaagaccugucaggaccgggggcgaguuuccgagggacagcuuccccuucgccgagcucagcccuccgaggucccagggaccauuccccaucgccgcacucccggaccuggaggagaacggcccggcuuccgugguacuucagccccacgucggccucugcgcccggaucucucccgagagaugggcagacuugagcucccaucgccguggaaucugcucguguucccuuucuuaggcggcgagucccuucauuugguuuuccggggccuucgaagaguugagacagagaugaugauggcuuugccuauguguugccucccggucgcggugucgugucugcagcagucucgggaaaagcuauccuaggggguuacaauccuccaugauuggguaauagaggcuuaaggaacagugucaaagccaggcuugccagggguuggcugugauggaguucguggggguuguauuacgaauagcccuuacugucaguauuuucaauccacugugguuuuuauugaggcuaaucgugccagacucuuagcugaggaccgaggagauaaaacuaauuaaguaugcagaauagucccugcccaccaggagccuguagagguucuauccccaccuccguccaagacauuaagaaagaaagaaagaaagaaagaaagaaagaaagaaagaaagaacccgaaaaauagaggaucuuaugguguuaagaaaaaaugcagagguaaaauuuuuacuggagacauuugaccuggagaaagaaagcugaaugaggaugaaaaugacugugggaaagaugacacuugauaaaauauuuacucuguagagugcuagagaugaggaaacacccccuaggaccuaccacgaagguaaauuuuaaauucuagccacccuuuuaugucaccuucccagugggcauugaagugaggccaccacuaugcccgacaaaugcccagcguugagcucuauucccaacucucguuuuucuguuuuuguagaacguacuaaauuuggaauuuacauuugagaguuccauuuuucagugcugggguuuaaauucgaccauggcucaagguuuauuuuuuuuauaccauuuuaagcgugugacuugaugucauuauaauagaauugugcugucacgaccaccgugaucucuagaaccuuuucaucuucccaagccaaagcucuuugccccuuugaauuuuacuacuguaggcuucuaggguagacuauaaauguaaccucaagccguuauuuuaguuuuauauuuaauuuaguuugucuugaauaaccuugcauaccuaaauccugcuucugacauggucuagguaauguuucuuucuaaccauacuuguauaguaugagauaaaaacauuaccucauuugccuucgaaggcuuguucuacuguuaucuugugauuggcaguuuuaugugcuccuuguaaaguuagcuuauauauauauauauauauauauauauauauauauauauauauauauauauauauauauaaaaucuugaaauaguuuccaaagauucuugaggaaaguuauuauaucuuugugcauccuuacauuucacuauguuuuuauauauugguagcuuucauauuguaaauucuccagaaauaauauacuuauugauugcccuucaugaaaaagaaguagacauuuggaaauggaauggaauaccaaauagcagaaauagaauauuaggcuaagucuggcauucaaugaaaauaauucuaguuuggauauauugagauagggaauuuguguucuuagaaaaggaaugaaaguagccaagagagucuggaaguguguguugacacagacuugagcuuccacggaaggguaaggagaaggaaacacuaaagaagguugagagcuaagagauaaggagaugaacagagcucagcaaacaggaggcuguugggcuugagcuccagagggaguaauguuaguacuuagcacucuaggauguuacaggguuuggacauagacguguuacacugacaugcuugcucuaucuucucccuaaagugcagggcccugaagcaauccaaacugcaugccugacugugagcuuguuuuucuauaggacuuacuacuuuagagagcugugggcuggcgcaguuaagaucaaaugauguagaacauuuuaaaaggcauuuuuacauauuacucagcuuuuucaacuauuuaugaaugaaaauuuaugcuaaagcacuucaaaaauuauauuagcauugugaaaguuuggugcuuguaguuuuuagugaaaugaaguacugcuauacaauuuacuagauuccacugagguaaaugaguuauuuauuucacuaagugauucuaaaggaccaaguuuucaaauaauuucuuguggucaauaaauaaauaaaaaaaagaacuugccuucaguuugguauuuuaaaaacuaaaaaaaaaaaaauaucuuuuuaguguguauggguuuuaugccuguguguaugucuguguacuauguguagaccuguccugaggccacagaaagcuguccuauccccuggagcuaccaugugggugcuggguuugaaccugaguauuuuggaagaggagccagugcucuuaaccacugggccaucuuuacagucuuaguuuugcauuuuaaaauugaaguuacaaaagagugccuugguguuugacuuuuuauuguucuguuaaaccagucuuaguuuucaguguuauaguccuucauggaaguguaacaguugguuuauauaaaugacauuugauuuucuuuaucaguuguucucaaggagagcugcaucuacuaacuaguacaugccuguaacccaugcacuuggagguggaggcaggcaggucagguguuccaggucacucugugcuacacgagcccgucucgaaacagaacaaauaauugaaggaggacacgugcugugagaagaacauagacuuugaggucagacagggcugcauuccaucccuuccacuuccaccugcagaagagccuuuaggaccaguucucuuucugcaucuuaaaguggcaaagauuacagguucaccaucccuuauccaaaaucauuggagcuagaugguuuuaaaauucucauaagcuggaaaugguuagaaggguuggggaccugcagcuuuauuguuaaauauggaugguaauacuaaaugggauaaauacagacaguaaguugcuugacauucguuguaguuaaauuuugccaucaagugaauucagaucagauaagguucugucuccauauaaguuacaaaaacacuuucgguuuucagagcuuuauggauuucggaauuucggauaagggauuauggaccuguacuucccugauaggguuguuaugaagauuaaaacaagauaagacgaaaacauuacacaauaauggguagguacucaauacauuuuuuuucccuuuuggagauguuagaaguuuuuauuuguauuuuaauuuauaauuucgaggcuuuguucuuuuccugaggaagaacuauuuaacuguccuaaaacucuuaggaugggauuagagauguucuauagacugaaucuuaaaacagaagcagguaagaugcagacuucaucauuacuaaccagccuggauuucuugcagguagaguguugaguauaauuguagguugagcuuagcugguuggggaguuauauuugagcgucuuugggaucuuagaaggagagcuugucacuguuucuuuuugucuacagagugauagaaggaagucaaggcaccauucugaaucagaggagagaacagaaacaagagaaaaugguguuacagaugaccuggaugcucccaagcccaaaaaagcuaaaaugagagaaaagcuaaauggagacaccaaagaaggacuuagauuuucagaugaauucuccccaucucauaagucaagaagaaaagaccugccaaauggagauguggaugaguaugagaaaaggucaaagcgagugucauccucagaaaacucucacaagucaagcgauaaagcagaggagguacacagcagacuauugcauguguucucuuugaaauguaggcccgcuugaccugugagguucauuaggauugauucugugcuguucucugcuucguggcaaguguugcuauuugaaccauagaaccaguauggcugaaaccccagccuuuggcucuuguuucucucauugugcuguccuuaaaguaaacauuuauuuuguguagaggucagaauauagcuugugggagucauuuuuccuucugcuguguaggucccaggaaucaaacucauguuaaguuuggcagcagcuaucuuucacugaaccaacuugcugcuaccccaccucuuuaucuuucuugggguagaauuucacuggauauuaaauuuugggaaguauaguagacucuacuucaagaccuacuuuugauuauucauuuguuugagaugggggucucauaguagcccagacuugucucaggcuugccagguagcugagggucuuuacccuccuaaugcugacuuccaagugcugagauugcagguuccuaucaccauggugaguuuuuauuuuuuauuuuuguuuuuguuuuauuucuggagauagugccaccaugcccaguugugcuggguuuauaucugcuguaucuuuuagaauaguuacuuucuuaaguauaugaguauuuuguuugcaugcauuguguacauuuuugaugccuacugaggccaguaggaggguguaagaacuccuggaacuggaguuacaaaugguucuuauaggcucaaagaaaggauucaccugccucugccuccuggugccaaaccuggcuagcuccuuauuuguuuuuuucuuuuuugauauuuauuuauuuauuuauuuauuuauaugcugggaauucaacuuaugcuuccugagugcuaguauuaaagacauguacuauuguuauugugccuggauucuuuccuugauaaaaacauauacucuucaaaucugauaauagcuaguaauuuaagcccucauuagggaucagaccugggauagucagugagauccauggaugauuguaggcagagacucuauguauugauacuuguaaauuuauuugccaagaugcacaaauguuaguugaguuuaguaagggccuacaaaucuguuugcuaguagaauguauagguuuuuugaaauuugcugaaggcaguguaauauaauaacuguuggcuguuguuauuauuagugugugugugugugugugugagagagagagagagagagagagagaaagauugagagagagagagagagagagagauugagagagaacaaacucgagcgugagagcaugccacauggguguggguguccagggaagccagaagagggucuuggauccuuuggagcaauaccuguaguuacagguauuggugaguaccuaacaugggaacuucaaauuaaacucagguccucugccagagcagaauuuguucuuaaaugcugagcuguauuucaagccuuaguuauuucguucugauauauuagauuucaggauuuuuuuguuguuguuaaagauuuauuuauuuauuuauuuauuacauguaaguacacuggagcugacuucagacacuccagaagagggagucagaucucauuacgggugguugugagccaccaugugguugcugggauuugaacucgagaccuucggaagagcagucgggugcucuuacccgcugcgccaucucacuagcccagauuucaggaauuuugcuuuuaguaauuuaugcuaagacuaugauuaugcuguauacaaagcuauauaaauuaaguauaauauugaucauugcaaaaagucuaaauagccuaaagucuaauaaugagaaguuagauaaauaugcugucuaugcaguagaacacagcuauucugagaguguauaagaauguuagaaaguguauuucacuaaacgaaauuaugaaacaauuuauguaauauuuuuccaauuuuuaaaaagacguuuuuaaaaauuuaaacauuuuaauuuuuagggacaggguuucucaguggcacaguccuggcacucauuuuucaaacuggauuagccucaaacucacagagauccaccugccucugccucccaagugcugagauuaaaggugugcgccgcuaugguugucagaagacuuacuuuuaaagauuuucaugugugugugucuugccuaccuguauguauguauguaugaauguaugccuugugccugaggaguccagaagagggucuugguuuauuacuuagagcauacuuuauuaguuucuauugucacaaucauguagaugguauuuuuuuguuguaguuauuuucagauugaaacuugaggacaauuuuauuuuaggagcuuacguauuuaaauuuagcuuaguccauuaccccuguacaaauggagaauagcuaaagguuccagaaauucacauuauagccagguguggcaacauaugccuugaaacucagcacuagagaggcagaggcagauggaucucugaguuugaagccagccuggcccucuagugaguuccacaccagccaggacuauguagagaaauccugucucaaagaacaacaacaagacagaauuaaaauuauacauaccaugugucuauguauguauauguguauguguguguguauauguaaacauauacacacacauauauauaggccaguaauaguauguuauguaucaauguagaaauagcuuuuccugguucugcaaaaucaucugaauaagauuguagagacaucuagcauauucugucaaaaaaucaaaaaagaaaaaaaaaaauagcuugccaggaguggugauguaaucccagcaacuaggaggcagaagaaggugaauccugaguuugaggucugccugguguacagagugaguuccaggacagccaagacuacacagugaaaucuugugggguuugggcgaguuugggagaguagaaaaauggcuuuguaguuagaguacaugcugcuucuagaggacccagguuuaguuuucagcacacacacugauacucaaauucuguaagucuaggggaccugaugcucuuucuggccacaaagacacuaaaggaugaauuucuauuuugaagauauuuuaugggacugggcaugguaguguaugucuuuaauuuuaacacuuggaaggcagagacaagugaucucuagaguuugaggccacccuggcaaauuccagaacagcuagggcuacauagcgauuguguguguguguguguguguguguguguguguguguguguguguguauacaugaaaaaaauaaguaaguuugcuacuuauauuugcuacuacuauauuuagucauguacagaugugaucacaguacuccagagguggaggcaaucagaauuaaggaccauccuuugcugcauagcauauuugagaguagcccaagcuaugugagacacuaucugagaagccuccucuuugccccucaaaaugauuaaaagguaauggaaacucuauuauuuagaauuuugguuucauuuugacagacucuaacacgugaacaaaaggaaggagccuucucuaauuucuccauuucugaggagaccauaaagcuucugaaagguacugaguuucgugucuugaaaaucugcugcugacuuuauacaacuuugaugccuuuucugacaaaaaggagaauauaaagauaaauaucacccucuuuuuaauugcaguuauuucuacaucauucuuuucuuuauucugacuuguuuuaacuaaaagaguuacauguguuugucaaauuagacaauuucacucuaauucuugcuugggguaggaauaacuguaaauguuacuaaguaguguggccauaggcagucauggaggaauaaggauugucauuuucaaaugaauuuauuuuuuccuaaugcuagucacaaauuuuaaugaaaucucauuuuacaggucgagggguaacauaucucuuuccuauucaaguuaaaaccuuugguccuguauaugaaggaaaagauuuaauugcucaagcccggacaggaacaggaaagacauucucuuuugccauacccuugauugaaaggcuccaaagaaaucaagaaacaauuaaaaaaagccgcucaccaaagguaacgguuauuaagggaguaaaagcucuuaacauuaauggaaagggauaggaacaauaguagucuuuggguuugguuuuuuuuguuuguuuguuuuuguuuuuuguuuuuuuucuuggugcugggaucaaacccagggccuugugcaugcuaagcucaugcucucccacugagcuggacccuggacccugaaagaauaacacuagacucaaagucagguauaucccgccccuuauggagucagugccccuuuuucauaaaguuaaauuuugauuccuaaaguaagagauuguuuuucagauagggaaauuuuaaucaaucaaagucaaagauuagauaaugagcacaaauuuaauaucucuggauguuuagauguuuuccauaacuuuguauuauaaagucaguuuaccuuauagguauauuuaguauacuuagugacuuuucucuucauccuugaccuuuccuuuuaaauaaugaauuuucuaauaagguauuccccuugcaauucaguaaauauuuaguauuauuucacggguugacuuuuuaugaagauuauuauaucagugauauacuguuauuugguacuagaaauaugucuuaacuuacaaauaguaaaaaucaacuauuaguugagggaauuaguaaaauucuagucuaaaauuugacauuuuuagaaccugugugcacuuuuaagguuuguaacagugaagaagaaaagucaucauauugauuggaacagguauguuugugcuuuuaaauauuccuaauguuacacuauaaaagcagauuuacauguauaugaguagaaugaugacauaaugacuuaggaucaacuaucucuuauguuggcuguauugguuuacaggauaaaucauuuuucuuuguugaaauuuccagguaaugcaguaguaaucuuuacacaguugcaaguaaugcagauaggaaauaguugccccugccuuagucugucggaagcugcuucugagauaauagccauugaucaguuccagcuauugguucuugggcaaggcuuacaaccucacugugacucaaguucccugucugugaugaaauugggauacuaguguaaccucaucuguguuucaugacaaaauucacuaauucacugaucaaauuacuacuucauauagagcaaaagcacucaguguaugaaccaucuuuaccuugacaaauauguuuugaguauuuguucuguaccagcuacuucuuaaaguccaaagaauacagugacucgccucucagaaacuuauguauucauugacucuacauuugaguagaggagcuagacagcagauaauguacauuguuugucucucugucuguagauacauaacuauuuuaggggaguaauauaaauaugaaggggaggaauagagagagaggcuugggaaccucauuaacugcucuuuuauuuauuuuuuguuuguuuguuucuuguuuguuucaugagauagggucucauguagcccaggcaggcccugaggucacuauauaauugaagacaauccuuuuaccucuaccucccaaaugcuaaaaauguaaggguacauuaccaugcauacuaagcaaacacuuugccaacugaacuauccccaacccaggaaagugacuuuugaagucugauaaaauacguuaaucuaaugaaauauaagccguucuuauuuauauuuguuuucucugcccccacucccuagggcuagggaugaaacccaguuuaugcaugcuaggugaauguuuugucauuaacaguacacccagcucugucguuaagugcuuaggaaauuaauguugagauucuuacucuaaaugcaucuuuacagaaauguccuuucggggaguuuacaucagucuuuagaaaagguguauuuuucuuuuuuaaacuucuugcucagguacucguuuuggcuccaacaagggaauuggcaaaucaaguagccaaagauuucaaagauauaacuagaaaacucaguguggcguguuuuuaugguggaacaucauaucaaagccagagugaguaaauauagacaaauccaaggcuggauuggcuaauccucaaucuaaagaaauaguauaaaggcauacauuuguuuuuaacauaguuuugguguuucuuuccuugcaguuaaucaaauucggaaugguauugacauccuuguugggaccccagggcguaucaaagaccaucugcaaaguggccguuuggaucuuucaaagcuacgccauguugugcuugaugaaguagaucaaauguuagauuuagguuuugcugaacaagucgaagauauuauucaugaaucuuacaaaacugguacguccuaguugaaaggaauauauagcaaaaaaaaauuaguuuuuuuuuuauaaaagcuugagaauucauuucauaauuuuuauuaccuugucuccugguauucuaacaaaauuaaaguuauuugguauucuuuaaaaaagaaaguccaaagcguacucugaaucuucuuuugauuauucuguaaucuuccauguagauuuacuaaaucauccauuucuuggguuacuguucuuucuuaaguucuuacuuuucuuccuaguucaguuuuauuuuguuucauuugaaaguuuaauaguugcauugauguuuguauguuaaaaauuugccccaaguuuauaauuuuucuuuuuuuuuuuuuaaccuuggggugauuuuuaaaagcuagccuacaucaugggacauuaagaaaacauuugaauucuuuuuguuuguuuaagauucggaagacaauccucagaccuuacuuuuuucugcaacuugcccacaguggguauacaaaguugcaaaaaaauacaugaaauccagauacgaacagguugaccuuguuggaaaaaugacucaaaaagcugcaaccacuguggaaguaaguagcuuugucagcauguagauuuuagcuuuuuaguugguguuuacuuuugaugaagcuaaauucaaguuugagguaccucuucaagccuuaccucuuuuccugcccuuagaaagauacauaaggagcgcugcggaccauaccuuaauguuagagcacuugguuagcauuuaugaggcuauaaguuaaauucccaacucucaaaggggaaaaaaaaaaggauuuugaaaccgaggaacagcuagaauaaauaggagugucaugagugugugaacaagggaagccgaguguaaaagccacuguucagaccagccaggaguguuuguuguuucaggggccaggagugccgguccaugcgcaggagacggggcuaggggaucucauuaaguugaagucagcaaaggcuacacagugagguacaaguuagccugaauuacggugugacagucugaagaguugucucaaaagcaguaauacauccaaaaugggagagaagaacagaaugcaacagaaggcaguucuuacuaauggggaaaguauuuauuacugggaccugugagauggcucaguggguaaaggggugaugaccugagucaagaccuauauagcgaaaagacagaacugacuuuuguaaauuguccugacucacacauacauugugguaugcagacgcacaugcaugcucacgauaagaauaauuaaaacaaaucuuuaaguaguauugagauaguuagcuaaaauguagcaggagaagaaaagaagaaaguaggacauacuggaggaugggugugggcuuuccugagaguugccagagacuuuucuaaacauagauaaugugaugucaugagaugaaaauugagaauguuuauaauaagaaaaaauuagaggugcuaugugcaguauuugugacuguaagguauauacugcauauauaucacuuuguccauuugcuaggcaaaacagguggcuagaauaauagauaacccagagugcaguacaguaauugauuuaaaugauaaaaaucaagucagauggguucuguucuagcaccacaaaugauugaaaauuacagaaugcuacacauagaauccugcuauuuuuuuuuaaaaaaguaauucuuagcaccucaaaauaucaaaaacaugcaauguuaaaugaauuuauuugguauauaaaguguaaguucaaaaaaaugaauaccaauaugauuauuucuugaaaaggggacauuguaaugcuagauagucaguggaagguuuguguaguuuguaauuuuagugguuuuacaauaagaagguaaaauguaccagugaagaacaauuuaagacauuugcagacauucagagauugaauggcuuaacagauaaacacuauuuucuaggcuuuaaccauuuuugucccccuuguauuuuucauuccugcauuucaaguauuaccaacuguacuggcuaguuuugugucaacuugacacagcuggaguuaucauagagaaagaagcuucaguugaggaaaugccuccaugagauccaacuguaaggcauuuucucaauuagugaucaagggggaaaggccccuugugggugggaccaucucugggcugguagucuuggguucuauaagagagcaggcugagcaagccaggggaagcaagccaguaaagaacaucccuccauggccucugcaucagcuccugcuuccugaccugcuugaguuccaguccugacuuccuuggugaugaacagaaguauggaaguguaagccgaauaaacccuuuccuccccaacuuguuucuuggucaugauguuugugcaggaauagaaacccugacuaagacaaauugguaccagcagagugggguauuccugugacaaccugaccauguuuuggggaggacuguggaaggacuuuggaacuuugggcuugaugauccaucuguuuuuaagagcucuguuggauguuguguaggagcuuggaagauaacguugagaacagugcagaagauggaggccuggcuugugaaauuucagagggaaaaauuaaagacucuuuucagggccauuccuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucauugaggugacaucuucugggaaguguuuucugagagcacaguggcuguguuccagauaaagccaaaguuguacauugugcuguggcuggacuugguaauauguaagggucacccaggugguacugguuuugaaggcaugaaggggucacgcaaagcagcugaggcucggcacugugagaggccauggugaaggugcagccucaguugcaauugaaggcccaggacugaaggggucaugcaguguuuuggagaugccaguaccaugagaugaccaccaagagcagcagcagcaguggaguacaggcaucuggagccuagaggaugacgcaugugcuacaaagggcauggcuggcaaagugacccaagcccuuggaggagcccagaagaucgugaguuggaucccagacauuggacgguuggagauugacuuuugcuuuugauugugacugugcccugauguuuucccuccugaaggaagaaacuguuuuaguggagcccacaguuaagagacuuuuaauuguaaaaaagacuuuggauuuuaaaagagauggauauuuuaaagagauugaaauuuuaagaauauguaaagacugugggacuuuuaaaguuauuuagaucuuggggaugaauaagauuguaaggguugaggcuuacuagugauguuuuugugugucaaguugacaaggggucaauugucaccaaccaucuuuccauuaucauguaucuaggacugacuucagacucauuuguuagcagaacgugaccuuuaacuucugauccugcugucuuuaucucccaaguuuugggauuauaggccagugcugcuacccuaggugucuauggcacuggguauugaacccagggagggcuucgugcacacuagauaagcacccugagucguccccguccccgucccccccacacacauuuugagauuacaggcaugcuugcaacacugagauugaccuuuuauuuguaugagguuuugccugcaucuguggcauuaaaucuucuagacauggagauagaugguuguuugggugcugggaacuaaaccaagggucuucugguagaacaaaaugcuuuuuuaacuacugagauaucuccccagcccugcuuuguuuuugggaaaguaucucaccuguagguggaacuacaggucuggucuggauuugaaucugguugucugugucugccucaguagugcugguuuugaaggugugcaccaccacauccagcuguuuguuauugguuuguuuuuuucaagacuguuucucuguguagcccuggcuguccuggaacuuggucuguagaccagguaaaggugugugccaccgcugccuaggccccagcuguuuguuuuuaggucagugucucaguguguaggccaggcuaguccaugucuugucauccuacccuacuuguugguuuugaacugcuggugugcuuuccugucugcuuccccuucccacuuuguacuuuuuuguacaaaaacaacaacaacaaaaauugugauuuauaguaaaaucuuaagugugucccugccauguuacuucacauguugguuaaauuguggguuuggucugauuuagguugucuuuuuucuuuccuuuucuuuuucuuuucuuuucuuuucuuuucuuuuucuuucuuucuuuuuuuuuuuuuuuuuuuugagguagaagaagaacaagauuuuguuuauaggugguacaaacauaucuuagucuuuguccuuuuuaauuugcuuguagguagucuauaauugccauaucauauuuuuuaaagaauauauauaauauauauucucuauauauauaucuguacuaagccuggcuuggugguguaugcuuuuaauucgauuauuggugaugggaagcaggugggggaugggguggggaggggcauaggcagacagaucugaguagccaguuccaggucauucugggcuacuuaguaagacaacaaaaacagggagagaggacuggagagauaacucagaguucucuuguacuguaugcacuuuguauacagacagacaaaacauccacaugcauaaaauaaaaauagguaaaucuuacaaauaauaaaauuuauauagauagauauagauaucuacaugggauaggaccagugagcugauccaguggguaacggugcuugcagccaaccuaaugaugaccuggauuugauuccuggcaccugcacgguagaaagagaacugacuuccacaaguugucucucuuguucucuccauauacacugagguuugugcucaugugcaaacguauacacaaaaucaaugaaagauaagcugaaugacaaaagaaugcagcuuaaccuuacccuacuuuuuuuuaaaaaauauuuauuuauuacauguaaguacacuguagcugucuugagauacuccagaagaaggagucagauuucauuacagaugguugugagcuaccaugugguugcugggacuugaacucaguaccuuuggaagagcagucaguguucuuaaccgcugagccaucucuccagccccuuucccuacuuuuuauugugugaaauuuguaagcauucagacagguugaaagaauuuuauagugaauauacuuccauguagauguauccagcauguagauccuauuaauacuuuacuuacauuuuuauauuuuuuuuguuuugaaacagggacuuggaacuuauauguagcuaaagauggccuugaacugaucuuucugcacccacuugaauuacgccccccuuaucuucuuuuaagguugaacccuggcaugagcucaacaaucucacucucuuaaaugcccagacagcagauagggagguuggacugcaucuggcuuaaugcuauaguuauuuuauuacauauaugucuaucuuggcuuuuacuuuauuuuauuucuuguuuuuggugaugagauuaacuccagggccuggucguauguauaauucaguaucauuuaguauuguauuucggauccauaaccacacuucugucuuccuuaucccagaaggcagcucuggaacuuagugaaucgguccccauucuguccuucccuagucuacccuggcaacagcgaaucuuccucuguggauauaucuguuauggauaguucauauaauugcaguuacauacaauaugauacuuugugucugacuuuuucuuacauaaauucaaguaauacauauuuucauuuucuccagccacuagggauuggccccagagcuuacgcauguuagugaaauggucuaucauucauuuacaucccuaacccuucugucuguuuaggacuggguuucacucuuagacuaggcuagccuugagauuauuggccagcuaugugucacugguuccggguuugcaguguuagggaucuaacccagaacuaaauuuaugccaggcacacacuaugccagcuaagcuuguauccucaguuucuuuaaaagauaauuuuugauaaaauagauauuuugccuuuucuuuugaagcauuuggcuauccagugccauuggucucagagaccagcaguuauuggagauguccuucaggucuacagugggucugaagggagagcuauuaucuucugugaaacuaagaagaauguuacugaaauggccaugaauccacacauaaagcagguaagcuuucuuuaugcuuuuccuagauaauagagacguacguaucucuagacaaaaaugcacauuacucuuuauagaccaaaauugauagucucuucaaaauagaauaauucagagaggcauuguagcaaacuuuuucucauauauuaagucauaauagguauuuuuguuuauuuguuuuuucccuucugcuaacaaucaaaccagggcuuucugcaugcuaggcaagaaguauaccacugagccagccccaagaaauuuaaugucauaauaugggacugaagagaucccuccacccuuaaaagaauaaaccacucuuccagaggacucaaguucaacucccucccaacacccaaauaaguaacuccaguuccaggggaauccucuuugggcaccuguacugcucauuuuuacaagccaaacacagacaugcacauacacauaauugaaaguaaaauaaaucuuuaaaguaaucacaauaaaauuuuauguuuuugaaguuuauacuaugauguuaggagggaauucuguuaaguuuucauuagcaaaauauuaagaugcuauuuuuguauguaugugcauauaagcauguaugcacagacccacagaggccggaggaggaggacaugaaguauccugcucuaucauuuccugccucagucacuugaggcaggugucuuaacugcuaagccaguuaguggcauucccucagugaucccugucacuuguccuuaccauacuccccuaacacuuguguuacaggaugagcaccugguuuuucacauuggcucuggggauuugaacuuaauucucaggcugacgcagugagccaucccuuuuacaagacauuuaaaauaugauccagaaaauaugaaaguugacaaucaauuuuaguugguaagaaucaguaaaauuuaagcuuguauuauaagagugaauuauaaggugagugugguuaacuugccaaaucucugaauuaaaggccaucgaauugaauucugaucuccacaggaaugccauggccuguacauucccuuauacauagaauaagugaauaacuauuaaaaaugauugagaaaacaaaaaaucaagcaaucaacaaacacacagaagugguguugccuaaauauuuuuuuuauacacucacaaauuaaacucccaaguaguuauucuauauaccaacuaaaaguaauuucugacuuaguaaugacuagaaaauuucccuaacauuuuggaggacauauacaagauaugauacuuuuuuaugagauaagaaacaacuacaggaaguaguaauuuguuucauguaaccagugcuuuugauggaacaaaaaauaagaaaucccaaccuguccauauuuaacauacuuuucauaagcauauaguuuuuuucuauauuaguaauuuacugaucaagagccaauauauguauagauggaaauaauuacugagucucaucuucugaacaagaauggacaguuuuguugguuuuuguuuguuuguuuguuugguugguugguuuuugguuuuucgagacaggguuucucuguauagcccuggcuguccuggaacucacucuguagaccaggcuggccucgaacucagaaauccaccuggcucugccucccuagugcugggauuaaaggcaugcgccaacacuggcccggcuucaguuuuguuuuuuaaaaagcaauuuuaaauugaggauauuucacauuugccucuuugucaggaccaagucugucuuuucugauucuagaacauaaauaccauuuuccucugcucuccagcaugaacucuuagcaccuacaaagcugcuugguuaucagcaucaucucuucaguuuucuguaaccagucacugucagauaaggauuuuguuuuguuggggcuggagagauacuuuagugguuacggucauuugcugauucagcagaggacaugagcuuuguuccgaacacucauagugggccacaacugucuaacuccaguaucagguaaucugacccccuggcuuccaaaggcauccggcaugcgcuuggaguacauacguacaugcaggcacuuagauguacacauaaaacaagcacuuuuuuaaaaagaugugugaaugaguaagccaggcaugguggaacauuugggaggcagagauaggcagaucucugaguuugaugccagccuggucuacagagugaguuccagaacagccaggccuacacagagaaacucuuggaaaaacaaacagauaaauaagguagucguauguacaccaugcuggccuuaggcucuggaguguuuggauuuaagcucuguacuaccacacuggcuccagggucuuccuccucaauguaaauuuguccaugauacuguucuccuuacacucaguugguuguuuccuguuguuccaggaccacguucuuuuguuuguuuguuuuuugagucaggguuuuuuggggggcgguauuuugguuuuucaggacgauguucuuuaauucuauucuaucucaaaucucuuaacuauauauuuuguaguuuauaacccagguagcauuuauguauaagauuuuucgcccaaacuucuuagucaaguuucuucuuuuaugucagucgauuucuuaacagcugucuauaucuccauuuccagggacucugacacccuuuucuggccacugggcacugcaugugccaucccugcaugcaaaauaccuguguguauguguguguguacacaaacuuaggaaaaguauuucuggcacaggugucaguauagcauaaguagguuuagccuaguaaaaauugcagaaaauacagaguuggagagauggcuuaguaguuaagagcacacugacuguucuuucagaagaccugguuucuagucuuuuuuuguuuguuuguuuguuuuugguuuuucgagacaggguuucucuguauagcccuggcuguccuggaacucacuuuguagaccaggcuggccucgaacucagaaauccaccuggcucugccucccaagugcugggauuaaaggcaugcgccaccacugcccggcuccugguuucuauucuuauucauguagcaguucacacccaucuauaacucuaguuugagggaaucuguugccuucuugaacaccauuuaugcaugugguacccauacaugugugcaaauaaccaugaacauuaaaacaaacgucaaaaguuauacaaaagcagauuuuugacauaauauugaccuauuagauuaacaaggauuaugauuuaaaauauacuggcauuguugguuagaguaugaugaaauaaaugcagaacauuaaaagguuaaguggguacaauaauuuuuuuguaauaguuuagcaauaguaauuaaaaugcaaggggcuggaaaugugguuuuacaguuaagaguacuggcuaaaggacccaggcccuauucuccucacuuacgguagcuaagaacuguuguaacuccaguaauggggaucuaaaggccccucccccuucuggccuccauagacacuauacacauucuguucacagacauacauauaggcaaaacacccauacauuuaaacaugaaucuaaaauucuucuuguucuggauauugaauccaagagcuuagccauacuuguuaauacucuuucaaguauggauuacucguucaaauacucauuauuuuuaacccagaaauucaauuucuagguaaguauccuccugaaauacauauaaauggccaaagaauuuaaguaaaagguuucacauuguaacauuguuugugugaaaguguguguauaacacagauguuuaucgguaagauacugauaaaauaaguuuuugcaucuauaugaaaaaagugcuugcaguuuaaaaaauucaaugguacucuacuuacagauagcaaaaauagcuuauauuaaauuuauaaauuagauuacaaaacaacauguguaggaugccacuuuuauaggcacaaauuuguagccuauacaaguuaaugaauuaugugacagaggguauguauguauuugcuuuuuuuuuuuuccuggagauacgguuucucuguguagcccuugauguccuggaacucacucccuagaacaggcugggcucaaacucagagauuccccugccucugucuccuuaguucuuggaaaggcaugcauuaccaccaccuggcuguauuuuguuuuuauuaaaagauucauguuuauuuuguggguaugaguguuuugcauauaggcauguauguguagcacaugcaugcaguaacaacagaagccagaagugagcauagauaucacagaguuucaguuaugagccacuguguagggccugggcacugauucgggucuucugcauuaagagcaggugcuucuaacuacugaggcaucucuccuaucugucucuguguguguguguguguguguguguguguguguguguguguguguguguguguguguugugucugagagacaaugaaugaaugaaugaaugaguaaauaaauauucgguaucuguaccaggaugaguuauaggacaacuguggaugucagugcuuuccuccuuguuugacagcaucccuuguugacuagauuagcagacuagugagcuuuugccauccauagagaucugccugccuuggccucagcauguugggauuaaaagcguuuaccagaaccuuggccuccuauauuuauuuuuaaaagaacaaagaugucccaaccacuuaugacagcaaaccuauaaucccaguuuugagaagguagaaguaggaauguagcaaauugaauaccagccugggcucauacucaaaaaaaccuacuggggcuggagaaauggcauaacaguuaagaacaauggcugcuggucuucgagagaaccugaguuugaaucccagugcccacaggguggcugacaaccaucuguaacuccaguuugauacccuucugacuuuugagggugcaaaaugugaugcacaggcauuaaugcagguaaagcaccgauacacauaaaaucuuuaaaacuauuaaaacuuacuuuuugugugugguuuuauaagacaggguuucuguguguagcucugguuguccuggaacucacucuuuagaccacguuggccucaaauaugcuucugcuuucuaaguacuagaacugaaggcaugcaccaccacgccuuguuaaaauuuuuaauagaccuaaacaaacagaaaaccugggcaugugguacuuagaaucucugcauuuaagaagcuaaagcagcaggauaaugaguuugagacuaguucaggcagcaacauuuuaaggcugucuacaaaaacaagguacuagacaauuuucagucuagcguguagcucagugauagagccuuuuguuaaucucuaggcaguauuugacuaggacgacaaaggauucaaacccuggcacuguggacauacaauagaaguuauagacuauccuucuaaugauuagcaguuauuuuuuaggaggcugauauuaaauaagacauauauuaugcaguauauuuucugggguguuuuggguuuugaauuuuuuuacauuuacuuauguauuuaguguacaugcaccuggacacaugccacagugugagugugggagauagaggacaguuuacaagauucugguuuucccuucuaccacaugggucccagggauuuaacucagguuggcagucuugguggcaaaugucuuucccuacugaacauuucuccagcccuguuuuguuuuguuuuuguuuuguuuguuuuaaagaccucauacuuuguagcuggagagaugguucaacaguuaagggcacugacugcucuuccagaggacccugauucaaaucccaacacccacauggcagcucacaacuguccccuuaucuagaucugauacucucauguaguaaugcaugcaagcacaauaccaaugcacauaaaauaaaaguaaauacaucuuuuugaaaaagguuuuaaaaaacaucauucugggcuggagagaugacucagcaguuaagagcacugacugcucuuccagagguccugaguucaauucccagcaaccacauggugacucacagccaucugucgugggaucugaugcccucuucuugucugucucaagacaacuauagaguauucauaaacauaaaauaaauaaauaaaucuuuuaaaaaauacauuguaauuaaagauaaaauuggaaaagaacccacaagaguucagacugaaugguguugggauacucaguuucagguaugauccauacacuuaauuuuuuucuuuuuuucuaauagaaugcucaguguuugcauggagacauugcacagucacaaagagaaauuaccuugaaaggcuucagagaagguaguuuuaaaguuuugguagcaaccaauguggcugcucguggcuuggacauuccugagguugaccuagugauucagaguucuccuccacagguaggacaugggaugugguuuuagaacaaguuuuauaaguguugccuuauuuacagaguauugcuuaagauguggaaccuccaucuuucauguguuguugaucguaauaugucuuguuagcaugguauuacaugggcucagauggccuucccuugucaauaaguagcugcauuguuugcaugguggcacauacaacucuagcacucuagaggcacaggcugaaggacacuguauaguccaggcuguguaucgauacauaccgaaucccaagccaaagaauguggugacaacaugcagagcucaaaguuucauauacugaacucuaguguauauaaauaaguagucuuuuaaauuaaaaugaaauuauguaauuuuuugcuucuuuucccuuccucuaaccuuuucuagauacucugcuugcuuucccaaauucauaaccucuucuuuuuguauacacacacacacuucuaaauacauaaauauaacugcucaguccuuaugcuacucucauguguaugauuuuaggauugaccuuggugcuauauaaccaaacuggaggccucuucccugagaaagacgauuucucuugcucuuagcauuccuucauugucuguaguuucuuguuuagggcucugugagauuuccuucuucccuuuuuggcauggcuguuguuguccuuguucuugucuuggauaauaucuuuuauuuauuuaauagaauuuuagcauauaaauuacuuguuauguuguuaaaguauagaaggauugaauuuauguuugcuuuuuuugagaaauggucuuagaccaggcagccccaaaagucuuuuucaacagccacccaaguacuggaauuaaagaccuguacuaccagaccuaauuuuuuguuguuguuguuguuguuguuuggguuuuuuuguuuuuuuguuuuuucuuuugugacuuugauuguuuuguuuuugagauaggauuucucuguguagcccugccuguccuggaacucauucuguagacuagacuggccuugaacucaagagaucugcaugccucugccuucugagugcugggauuaaaggcacuaccaucaccuggcuuuuuugguguuuuugagacaaggucucagccuuagauggccauaguuuuggauuaauccucuugcuucagccuccuuaguacugauuacaauuauggcuugauuugcuugucaaguuuguaaaaugaaguuucuuuuuguuuuaauaggauguugaauccuauauccaucgcucuggacgcacagguagagcuggccggacaggaauuuguguauguuuuuaucaaccaagggaaagaggucaacugagauauguggagcagaaagcuguaaguaaauugaaauuguuucaugcuuguuaucuaaaugaucccuuagaagagaguuuuuauauuuguucucacaaauaaaccuucccaucauuccucagcuucagcugcaucucgcugucaagcaucuggacagcuucauuuauauuggcugcaagacuuugcuuuacacagcuucuauugugaagccagaagaucugacauacuccuuuuuucuuuuuuuauuagauauuuucuuuauuuacauuucaaauguuauccccuuuccuggguucccauccaaaaacccccuauccccuccuugccucccuuacucaccaacccacccacuccugcuccuugguccuggcauuccccuacacccgggcauugagcccucacagaaccaagcuccggggguuuuuuguuuauuuguuuguuuuuuaauuucucccuuaauacaaaaguugaaaguguguuaaugguuucaguaucaucuaaacauuauaaauggguagcugauuuaauuagcauugcuauuuuagauagguugauaauacaauagccaguuuuauuaaaaaauacauuuuuuauggucuguacuuucuuguaguuuuucguauuuuaucaauuuuguuaauuuuuauauacuauuauauuuuaugaaaugaaaguaguaaacaauguugacagauugaaaugacuuucuuuucucuuuuugaaucagcuuuguuuugcaagugaaguuccaugauauaauaacuaagggacaauuuuuaaguuuuuuuuuuauuuugucuuuuuggaauugauuauagaugguuuguuagaaaaagcauuucuuuuccucugcuagggcuugguaaucuuuuaaguccaaaaaauggaaauucaacaaacuauauuaauuuagaaauuaacaaugacgacuuccuuuuucuuuaauauaauucuuucauuuucagggaauuacuuuuaaacguguagguguuccgucuacaauggauuuaguuaaaucuaaaagcauggaugccaucagguacgcuuucugaccuugcugaguaaccccucuucuguagucgacuuucaucuguaagcucuccuaguccaaacuugagaaaaugcuagucaagggcuuuaccagaagacauuuaguuacauuauucuaugaaauguuacuuuucccauuccugauuuugucuuuaccuuuuccccuguauccugaccaagaacauuuacuuuuuuuuaaaccacaggucucuggcuucuguuucuuaugcugcuguugauuuuuuccgaccaucagcucaaagacugauagaagagaagggggcaguggaugcauuggcugcagcauuagcucacauuucuggugcaucaagcuuugaaccacgaucuuugauaacuucugauaagguagaaaagugugaagugguauuuggcuagauaugguuaaaacuuagcuguagcagguuauagcacaucacugaaaugcuucauugauuucuucaguauauugggguguuguugcuguuguuucccuuuuucggucuagaaaacucuuccucuucucaucugauauacaagccugcaauccaagcaguagggagaaauacuaguaaaauaaacaccauccacauuaauucaacagcuguuaguauucuguaaccuauguuuuacauucauucuucuguaaacuauuugaaaguugaaacaugaaggcauuauucuuaaauauuuuaauuuguaucuucaaaaaauaaugacauucuacuuaauuaaaauaucacagucuaaucugcuaacaaagauaguuccauguuaauaauaucuguagauuugcuucuguccauacaaagcauagcucucacuccaaagggaauaugaaguaguuuaguuuugagcuguaugccaguuaccaugauuuggauuuaguuugacaagaaggauauguaccaccacagaaguggucucauuuacuuucaucgucacagaagaaagucaugucagaaaauuugcuacauacacucuuagggacaucagguaggcggguuauagccaggugaggaaaucauuugaugauacagcuaucagauucauagaagcuauggucugcugagauugugaaguuuguuggguuuuguuuuacuggacuguugaaagacuguuaggucaaauacagagguagguguugaaaggcuaguaggaaguugaaguggggagauaaaaaaauuccaaauauaauuuuugcucuggauuugcaauauaccaucuuacuuaaguuuuuaucugucagccacccugauagaaucuuaagcacaggcauggcuuguggcuuccuugccuccuaggaauuuaguuuauuuuaucuucacaaaagugucugaaggauuucuagauaaagaaaagaaaguccuuauuuuguaccgugugguaccaacugaagcuggaguuuucauuuuguuaguugccaaggaucugcaaagugaggcaaaguaaggaugugcagggguguugacgugcuugagugaguauaugcguggcacucauauggccugccuccagguuagugucagauagcagauauaccacaccacagccauucguugcaaaugggucacagauuuguuacuuuaacugggauauaagugggguugagguaggggguaugagccuuaaaaggggacaagggagguaggaauaucaguugccuuauaaaacucauuuuaaaacuauuuuacucucugaauaguaauguauauggucauccuuuagcacugaguagauagaccaucccuaaaauuucaucaaauauaaaauauaaauauuauauaauauacaauaaaauauaauauauaaaauauauuuaccaggagaaaagccagaaaagguagcucauauuuguaaucucaguacucaggaaacagagacaguggacuuccaaauuugagacuagccuguugaacauaaaaaguuuuaggccauccggggcuacauaccgaaaacuugugccaaaaaagaaauaucaaccccauggguaccccuggcuggccuggaauucacugugcaggcuggguuggccuagaacucacagagauuccccuugcucagggaugcaccacuguguaccaucugguguauuuuauuuuauuuuagagauaaagucuuauauaucucagguuggacuugaagucacaacaguucuucugcuucagccucucaaauacaaaaacaauuuuuagggcagauggugguagugccucucccaggagacagagucaggggaucucugaguucaaggauagccaaagcuguacagagaaauccugucaaacuaaacaaccaaaaaaaaaaaaaaaaaaacaauuuuuaaacuguacuuuuaaagacaauguuaagguacuuuugaggucacuuauagcuaaucccugucccgugaaaauucuuugauuggccacagaaaugcuuaucugcauucacaguacuuggcaagcagagguaggagaacugcaagucugaggccagccugaccaagaaccaaccauuuauuagauaggucauuugacuuguaauuaaguauuuugggaacaagguauuaauggcuugaaauuuuuccccuucccucccucccucccucccucccucucaccccaugucuaaguuuuugccugaaccuuaugcaugcaaugccuuaggaagccaguggagaguaucaggucccugggacugcuaccuuauagaggcugggaauugaaccaggguccuauggaggagcagccagugcucuauaaccacugagcugucucuccagcccugauguuuacaaugaaugaccuguagugcauguccugcgggguauucugcuugcuacugguaugacuucauuuuuuaucacucucuugacuucuccaguuaucugaaucuauuugaccuaccuucuucauuuaccaacucuugcaacucuucaugcuuacccauuuucucggcccccuuccucuuauuuuggcuuccuccuuuauuuuggucucuguucagauaucaccauaugagagaaaucuuuccugauuauccugguccucuucuuccuuuuuuuucuauuucccagcccuuuuggguuacucuuccugccgcuuaucgccgguguuguauaaacuuucuuacuaucucuaccucaacuccccacaagaaggcuauguccaggagaggaaggucuguuugucauaaaaucuuuauucccuaugugguuucugguacauuguaggaacucgucacuauuuuuaugugguaguccuccaaaaauuuaaagauauugaugucuuuuuuucacugcuaaguaacugcuuuuuuaacauuuccugauuacuuuacuacuuuuccucccaacucuuccugugauguucugaucuaauucugucuuguaauguguaggacauagucucugugugcucuauaagagcaguguacagaacauguaaauaguagucuucuaguauaguuucagugaaguuaguuuucaauagccauguugugcuguuggcacucagauaccacacagauauugcaugggaccuguguaguugacucaggaagcaccguagucaaacuucauuguccugcugcugauuuucucccaaaucuaauaggacuuuuauuucuaaagggguuugugaccaugacucuggagagcccagaagaaauacaggaugucagcugcgcuuggaaggaacuuaacagaaagcucaguaguaaugcugugucucacguaaccagaaugugccuccugaaaggaaauaugguaggauuauguucauaagacuuccaugaucagccgggcgugguggcgcacgccuuuaaucccggcagaggcaggcggauuucugaguucgaggccagccuggucuacaaagugaguuccaggacagccagggcuauacagagaaacccugucuccaaaaaccaaaaccaaaacaaacaaaaaaagacuucaaugaucugucuccuccucuuuuuauggaugauuaauacgauuuuaucacaguuuuggauuguucccaacaauuguggguuuauauaaaugauauauuccuucagagcuucaugucauucuguuuugacuaauacuuaaguuuuuguugcuauaauuacuuuaagacaggguauuccuauguagcccagacuggccuugaacccaggaccauuuaaugaauguuaggauugcaaguagauuaacccuaagacuuaagugaucuaaauuccugcuauggcauacuuacuguguguguuuauuuuuuaagacuaauuuauguguguaacguuuaaacagcucuuggaaauacagauuauuuauuguacucugcuauugguuguuaacaagauuaaugauaaucuuuuucugugaggcaauauuucauuauugcccaggcuagccuugagcucuugcuuaauuucauucuacuucuaagauaacaaacauguuccugaguaacuuucaguaaaaugaacuuguaaaaugaaaacuuacaguaaaaugaaaagcuuuuuuguuuguuuuuccuuuuuuggcacugggucucuuuacauagccauggcugcccuggaacucacuauguagaucaggcuggcacacucagauacaucugccucugcuuucugaguuuugggacuaaagguguggcuaccuauccaucuuaaagcuuaaucuuagugauuaagauuucuuuuaauguuuugagaacuguuauuugucugaaauuacuauagacuuguuguaucuuaaaagcuguuaaccagauuguuuauuagaaauuauuauuaucucucaacucugugagagaaaaacuuucuuaucccuguuuuaacuuuuggaaucuuagucuuuugcagugcuagggucugacccuuugacuuguauaucauaagcaaguaccauuccacagaccuguguucccaguucucacuaauauuuuaaagaaaucagaaggaccauuuucauuuggauuauuuguuuuuguuuucuuuacaagacaggaaaggguuucucuuugcaucccuggcuguccugaaacccauagaucaccugccucucaaugcugggauuaaagguguucuucaccaccacccggcuagaagaaccauuuucuuucuuucuguuuuuuggaggggagagguggggaacauuuaagacagaguuucucuggguaguuuuggcuguccuggagcucacucugucgaccaggcuaucuucaaaacucccaagugcugggauuaaaggcaugggcuaucacuacccagcuagaaggacuaauuuuuaagagaaauggaacaacuauagugucuacgauaagucuucuagagaauauucuagguauuuaaagagucuuacuaguuauauuuaauuuuaucucagauuaaaaacuacauuauguacuaagucaucuaugcuuauuuguuaccuacagucauggaauacauauuuuuuaagaacaaaauucaacaaauauuaauuagaaaaauuaacucauaucuaaauaaaaaucuuuuuauuuuccuuuuaggguguuugcuuugauguuccuacaagugagucagaaagauuacagguauuuaaauuuuuuuuaccuauuaaauagcugagaauguuuuuuaaaauaguuuuggaaaacacagacacagugucauuugucauccuuaaaucaguuaaggacguucuuaauaugaaauauugccugacccauaauuaaaaauguauuaaagauaauuucaaauguaacggugaauugggagcuggagaaacagcucagugguuaagacuacaugcuacucuuacagaagaccuggguuccauugccagcacacacaugaagauucacaaaaccagagaucugacaccuucuaaccaccucugauacucuacuacccguguacaggcauacauguaggcaaauugcuuucacagauaaagaaacucuuuuuuuaaaaaauuguguaauugaguucccauacauacauaaccagcuucaccaauuugauaauuguguggauaguucuguuucaucuccuuacuauccauugccaguguuuacagacaaacuccaggcauuauuucagucuuaaguauuccuucauauuuaaauguuagggacuuaaacaaucauaauaccauaauuccuucuauacaacugucuuagucaggguuacuauuccugcacaaacaucaugaccaagaagcaaguuggggaggaaaggguuuauucaacuuacacuuccacauugcuguucaucaccaaggaagucaggacuggaacucaagcaggucaggaagcaggagcugauacagagcccauggagggauguuacuuacuggcuugcuuccccuggcuugcucagccugcucucuuauagaaccaagccuaccagcccagagauggcaccauccacaaggggaccuccccccucgaucacuaauugagaaaaugcuuuacagcuggaucucauggagccauuuccucaacugaagcuccuuucucugugauaacuccagcugugucaaguugacacaaaucuagccaguacaacaaccaauuuuuuuuuuuaaguuuuguuuuaagauguacuuauaugaauacacuauagcuaucuucagacacaccagaagagggcaucagaucccacacaugguugugagccaucaugugcuugcuaggaauugaacucaggaccucugguaaaacagucagugcucuuaacuguugagccauuucuucagcucacaaccaauuuuuuuuuuuuuuuaauauuuuguauuuaaaacugggcagugguggugcacaccuuuaaucccaucacuugggaggcagaggcagguggauuucugaguuucaggacagccuggucuacagagugaguuccaggacagccagggcuacacagagaaacccuaucuuaaaagaaccaaaaaaaaaaaaaagcauauauuuauauuuuguauuuaaauuuucccuguugucucuugauuauuacuuuuugcaguucuuagguuggaagcuaagacuuuacacaugauagcuagguuaacacugagccucuuuucccgccuuacugaauuauuugcagggauugggagguguucuguguagcccugucuaucuuagaacuugcucuguagacuaggcuggcuuugaacccagagaucuguuugcuuugccuccugagugcuuagugaguauuuuuaaaauaaguccaucaaguucagacauuguaauuugaugcaauuuguaacuuucucuaaaauguuuuauuagauuuauugaacagagaaguccacuaaauucuuauaauccaaauuuuuauuuuuuuuuuuuaugucuuugcuuuuauguacauuuuggggagguaguauugagacagaguccugguauauagccuaagcuggcuuggagcucacucuauagcucaaacuugaucuuuauaugagcccaauaucuagcuuauuuauauaccuguuuuuaaauuauuggcauugcaucauuuauuacauuaucuauguauggaguaggacauaugcacacuguguccauacguauaaguucaaagacaacuugacaaaauggucucuccugccuuguuggucccaggcauagaaugaagucaucagaguugcuaacaugcacaccuauccacagagccaucucuauacuuauuuuauagagucauuaaaauauuguggauaugccaggcagugguggugcacgccuuuaaucccaauacuugggaggcagaggcagguggauuucugaguucgaggccagccuggucuacaaagugaguuccaggacagccagggcuacacagagaaacccuuuucgaaaaaaaacaaaaaaaaaaaaauguggguacaaguggccagugaaauggccuagugguuaaaggugaaagcugcuugaugugaauuuguucccugguauucauauaaagguggaagaagagaacaaacuccucaaaagguuguccuuugaccuccauguaugugccuauacaaguaugugcagacaaaacaucuacauacauaaaaguuaaaaaaauaaguuuaaagaaauauuguggauccuuuuuuaaaaacaaaaauugggaauugaacugaaagcucuuaugaaugcuaugcagauguuguaguccucuucuuacuucuucuuauuuggugacaaggucucacuagcuugcccacacuggccuugaaguaacucaguaguagcuuaagcuacuucaauguuucugcaucaaucggccucaugucugauuuugcuucuaguucuguugaugugguugcucaaaauacuugacugcuuuuuagaggucuguuucacacauugcuuuguccugagaaagggaaugcugccuuuuagaaaacaccuggguagacauugagaaucuuggaauggaucugaggguuucucuauacuugaucuuagccugaugacugagaaucgaaagaaacuuucuuuuaaggauuaaaauuugagcguguugcaguuuugccuauuuugugguuuucauuguucuagacacugagcuaguagcugaaggagguaaaaagagcaucuucuuggcucgcuugcugguguguggguuuacuguacaugucuuuuaaucuggcauauuguuuuaacaggcagaguggcaugauucagacuggauacucucagugccagccaaauuaccugaaauugaagaauauuaugauggaaacacaucaucuaaucccagacagaggagcggcuggucuggcggcaggucaggccguucaggacggucugguggucgaucugguggccgaucagguagacagagucgacagggaagucggucaggaagucggcaagaugguagaagacgaagugggaacagaaaucgaucaagaagugggggccauaaacggaauuuugacugaguguuugauaguuaaucuuccagugugagcuugccuauuucugucuaaucauguauauuauucaccaaaaauuagaucaucauaguugagguauuugucuguaauuugcaaagaaguuggucguauuuuuuuaaaaaguauuucacaagaaugguucuaaacaaaucuacuuaucuggcuauaccuuugaauuaaaaaaaagcccuuuuauugucuguuuuuauucuguguuaagaguuuucucaauguaauuuuuuaaaauuucuaagaugugacagucaaguuaaccuuaagguuuccuguaauauauaaaauguggcauauuacaccauucuuucaugugaugaaggacaaaacccuuucuacauaagggcugguagcuggugacuuguuuggugaagauuacugguuuaacuuaauagacauauucagguagauuggugugca

SEQ ID NO: 5537 - RNA, 2556 nt, Mus musculus
gcuaaaauugaaaccugcaaggcaguuuuagucacuggaucuuauaugcagacagaguuucuuuuccuucuccucauuuucaacaaucucauucuguugaugggagccuguuuccuaagguaaauuaacucuagaaguucuucagcuguacucgucccuuaauaauggcccugauguacugcaaguaggauccugucuccaaccccagcucagacaguacagccccacauccuuacacauaaucuaguuucaaacauaaguccuuggugaugagcuaccagaaucccuggugaggaagucauggggauuaauaguucuugucugcccucuucuaauuuuaacugaaaauaggugaucuuuugacaauaaauaggacaugaacaaaaaacaaaaaacaaaaaagcuuagcaucucucccuaggugugaugugcccaucuauaauucagcucccggggaggcagaagaaaugggaugggaucaugucuucagagcucuuugugggauuucucaccaguacugaacucagaaagcaguucagccgccagcgagaauagccaggagcuuacuccaugucacacagcaagucaaguaauacgagugaaauguaguugccugcauguaugugugugccuuguguguugucuaaguagagcugauaggagaaaaacagaaaacuuauaagccuguuucauuuccguuguuuagccagcuguugcacauaugaaagaucucaaauccuuauuuaugcaucaaagcuuagguuuaugguuuugugaguguguguguguguguguguguguguguuuaaaacagguucacaauguugcucuagcuggccuggaagaugcuguucuguccucagguugcuuugguccuacgucagggacugcagguguaaaccucuccauucagugauaauaagcagagagagagagagagagagcgugcgcauccuguugccauuaauaggaagacacuuucaccaaguaauuuucuaaauaggaauuuuaaagccccucauaaucaaaguuuaauauauuuaaguaugcugaaaugaagguuucuugaaggagauggugcuagcugaacaauuuuaguuccuagcccuucauuauaaauaugcaaaauuguugauaacagguuuuauuaacucuggauuauaucuuuugucuuguuggguguuuggcuuuuuguucguccuggugugugaguguucccucugcuuugcugguagccauaucaaucuuuggagcaaguauccuagaguuaagagugcugagauguauuuguaaaguuccuagugauuugucuauagguuauuuuaacaaccucucuauauagagguauauuuugacuauagugauacauucuuuggcacaaauauaagggaagaggccaaagaaccgugaauauucaguauggccuccucuuacguuggugagucgucuugccaacaucaguuugugcugugauaaaacggcugacugacuauauuugacuuuacaaacacagcucauaggaaagauuaaauauuuuuauugcgauguauggucauauuuuuuuuagcuuuauggaguuaacauugugauaggugcuuuaagagaaauauuuuuccagaaaugguuuuauagcuaaacuaugggcagcuuuugcauugugaugugugggucgauggcucuauuuggguuacuaggaaaucaugaaguguucccuauggagauaccuguccgcauccauggcagagagaucagcaugaagucucaguugacucccuuuucucucauagagugagcuagcacguaaaugaccauguguggcauuacuugguuuacaggacucagcgggcugguuagcgguggugggaauaaggcaucaauucacauuccucaccacauacaguggggcugaguccguuuccagucucuuaugugaaggccuccccagcagucccuggaagaggcucgcuguucauuuugaugguuacaauucuaccguugcaucucaguaauugaaggcuuuuaucuuuggaaaugcuguuaaaauuccaaaaaccaguuuaguucuucaccuaugaggaaaauaguuaaagcacuucaugacauuaaagggaaagagaauccuauacccaugauaguuucaauaccuaaucaauauugaguccucugcacagaaugggacgcuucguagcaguacuugaauaccugugaguuggaauugcauguuacuugaaagaucuaauuaagcuaaauuuuggugcacagcaguuguacaugauuucauguuuauguagcaaaauacauugaaauguacuaggauugaaacauaaauguaaaaauaguuguggaaauugucuuauuuuccuuaugucucauuuguuuaaagcauaaauuuucuuuuaaaaaauucuaacuaaggauaaaggaauacuguaauugaagauauauuuuaaaucuuugucauguuuuuuuuuuuaaagcuauugcaaauuguaucauuccugacuauauagaacuuugugggugguauaaaauaaauuuuauacuucuauuuugcac

SEQ ID NO: 5538 - RNA, 4383 nt, Mus musculus
ucauguccuauuuauugucaaaagaucaccuauuuucaguuaaaauuagaagagggcagacaagaacuauuaauccccaugacuuccucaccagggauucugguagcucaucaccaaggacuuauguuugaaacuagauuauguguaaggauguggggcuguacugucugagcugggguuggagacaggauccuacuugcaguacaucagggccauuauuaagggacgaguacagcugaagaacuucuagaguuaauuuaccuuaggaaacaggcucccaucaacagaaugagauuguugaaaaugaggagaaggaaaagaaacucugucugcauauaagauccagugacuaaaacugccuugcagguuucaauuuuagcagcuggagauggaaaaggccaaaagaaugggaauaugaaacuuaaguuguacuuacuccuaauugaaaaguucugcauacacauccuugguccuuucugcaguacuagggauugcuuccagcaagguuggcaagcaccacucuuucaugaacucuauggcaggcagcucugcgcccugcugguguuccuuuucuuucuaucauccugucucagucccucaagcaguugggaucacacacacuugagccaagcaugguguuagacuuuaugacacaugguugaaaaagauaagccaaggugcugaggcaaaaggaaggcagagaaauggaaaacuggaacuaaucagauauauuugcauaugggaugaucugggugguggagccaggguguacauacaggaguacagaagauuuuuaaucauaaggaaaucugaauguagaaaaggaauaaauaaauuauuaaccuuguaauuuugaagcuggaaacauuacagacugccacaagguaauuuugaucacuggggucucagggucaaugugagauuuaugaguaacacauauuuugaacaaacugauuaucugagaaaagagcugggcuaauacaaauguacauuagcugggcagggagcccugugucuauacccuagcaaucaauaagagaucaccugaaccagaagguucagaaaaggauuuggcagcaugcuaagauuuuguagagcugaaaacaaacacaaaugaugauucccuacggaaaaaaccccaaggucuaggaugggagggaauguugaugguguuuaccagacacacaaaaaggccugguucaaucccagcaccagagaaacuaagaguggcacagccagaggucagaaagaacccuugcagguucaagagcaacuugaucuuuguccuggccaggucuguauagugagacccaguuccagaagcaaagaaagggaaaaagacguucucaacauccuuagccauaguucaaaacugugcuauacgccaccaugagauucuuaaggaaguccaggcucacaauuuaauaaaagcccaacuucuauuacacaaagacaaaucaaccaaccaaccaaaaaaacaaaacaaaacuuaaaaaaccaugcuuaggaauuuuaacaauuuugaagaaaauauacagaauuagguuuugugggaggauacagugacuaucuaaauggucuucacaauugccacuguuuucugaugaaauacaauaugaaacacccauuucauuugaaaaaaaaaaaaaaacuuagucaucucaaaccacuaagcaaugaccacaccacauggcuaaauaugccaacgugaccagcacagagaagugaagcagcgcgccuguuuauggugacggccacaucacagugagcugccagcacugaaguaggggaggggcaguagggacugugcaaccgcggcuacagaguauauacagugaaggcaugcuucccucaaugguucccacagccaguccucaagaacuccuuggguauuuauuccuaauacuagguuccagagggaauggcagagacaaggauugccuucugcaucgggaagaguuaguagguuaaugucauagguucuccuggcaaagccuaggauagacaguaaaggcaaucuugaccuaaucucaccaaugucuuucuuguccugaaccucaccagaggacagaaaguuguuuuauuuuugacuuggacaaaaaucaagauaaguucuuaguaauauaauccucucugagugagaaaaguaguuugucuugaacagcucuaagagcagaauggcccucaagcaauuaggcgcugucugucccgagaacucagggauugagcucugccuucuaaggagacuauuggugcagcaacagccaccacacuauccuuugucauaauucuuguuauacauuucuaguauagaugaaacucaguuguauuaaaucuagacucaaaaagauucccaugcauugagggggugaaacucaggguagcuuuguguuaagguugcauacacuuacuuguuuggcacaaagguaaaugcacccacaaucgauagaagaggucaugugaugacaugauagcuugauagcuccaccccacacagaagucucauuuuauauauaugaaugaauaauuugggguuaguuuuguacauguucuugugaaaugauaaucagaaguaguagguuaccucaugugaaucaagccaguacaucauuuacagaauaauagccacucaguuaacuguuuaacggggugaauggaagugaauggcuuacgguuuucaccuaaugaaguucugugucucacaaaugcaacguuaugcuugggaaaucacuuaagauguggacuuguucccaaaaauuugccucuauuauccucaaguccaaacacuauauuucaaugacagugauaacagucucuuuaguaccuggucuuauuugguacuuuguagagaacuggaaacaggauauacacgaggcugacaagcacaagaacaaaagaacuaggagaguggaggaggacaacuuuaaucccagcacauagguaggagcaggaagauaguucugugaauucuaggauagccuggucugcuacaugaguuccaggacagccggaacuacauagagauccagucucauaaaaccaaaacccaccaaaaaugguuuuaagagggcaggugaugucuaauucuaaagcaggcaggaaugaauuguagcaucaccagggcuacuguggaagucauauaacaauguauccaauguucacagcgagaacagucuuagucagagcuccacaaacgaggucagaggaacgcaaucuaauuaaaacaguagagguguagaaagauugucagauaagugacugucaucucaaaccaauguauuuuacuuuuugucuuuuugagacaggguuucucuguguagcccuggcuguccucgagcucagaaauccaccugccucugccucccaaguacugggauuaaaggcaugcucuaccacuguccgguuguauuuuguuuuuaagaaaguccauucuuaaagccguguauagccagcagauggugcaguagaacaccaaccaaguagaggaugccuacaaagcacaucagagaccaugaaaguaauauaaugaaguccccacagagggcuguuggcugaggcacuccaucucugaugcuaacucuagcgauggaaugacaacauuuuuguugaaagugguuaguuucauguacuuauuuugucaaacugcaacuagauucauaaacaccaacagucccauucaucaacauugguguauucaacugauuaagcaccaagaauguggccuuaucauuaaaaacacaucagcuugaauauauauuacuguagcucuucauuuauagguaguuuguuauguucuuagaaagcaguuccaagcauucguuauaaguuugugugauaagggguaauucaagggaaaacaaacuaaucgagcggacagaugaauggacaaauaaaggcaggaagaggcgauucuaucccauaauggcaagaaaaugauuucuagauaaggucugaaaccucaaagguuaacucaugagggaggauuucugauggucuacacuaacaaauaaauaccuaacugaagcagacacagcaagaaaggaccacauucacauaccgacauaagaaacuuaaaaaaagguuuauaaacagaacucuaaggcacacagaacacuaacucagauccacauguguauggaucccaagagcauccagcucccugugcaggaugggaugaaagucaguggacacguucuuauuuacagucccuuccucuuccugaacgugccucagucagaggcugacacuuugcaccauguauuguguuuaauaaguuauucccuaaggaguuuacugcaacggcuuacauuugcaccaagauugugguaguugugggcuucuuguggcaucucugagaagcaccaucagggucccugaaggaca

SEQ ID NO: 5539 - RNA, 38875 nt, Mus musculus
aggggcgcuguggcagcgccgagccgggccagacgcgguggccgccgcgcgccugcggggagcugcugacccgcuccgcgagcccgugucccgcacgcaccgccgccauggguaagggcagcagccggggucaccauccuucgcuugggucacgcagucacccgggaaccgggggcucccggggucuccauggcaacguccgcccgcccgcaucccugcgccccgcccgcccuggggccuggcggcuggggucggcggacgggcggggaccagggcguccagggacagggauggcuucccagucacgcggaugcagggcggaaggcuggggaggggagcgguguagugccaggagcgcgcuccgcggggcccccuugcaggcugggggcgcagagggagcggggccgccucuagggacugccgaggagccccaccugcggucgcugcugcacagccgcuguccuaggcuccuccggugcagguuacagguugugaugaacacucuuaaaaagagaauucugccgauuauuaaacgucaggugguuucacuucgggagcggggguggacggagggaaucacaccucgacggagaguggaggaaaagauguggccauauccuucaucacccagccgggcuguuucagauugcggaggaagucagccuaagagagcugggaugcaaaccauagccaagugccagagcaaggggacucuuguuuuguuauucgaaacggguucucacugcauaguccuggcuguccaggagcuagcuauguagaccaggcuggacucgaacucagagauucccuccugccucugccucccaaauucuggaauuaaagugugucgcaccacgcccagcuguuuuguuuuguuuugagugggccacuaaauugugaacgcacugaccaccuggguuugucauuuacuugaagguuguuuuugagacaggucucucuauauagcauuggcugccucagaacacucuguuuagaccaggcuggacccaagaaucacagacgcugggacuacagaaacagcuacauggcagaguucucuggagauuaauaaauguuagguuugguuuucacaucucuuuugcuaucuucgcagaaaaauauuugugccacucggcaguguuuagaguguugggggaacagcugguuuaaaaaaaauuauuuuuauuuuuaaugaguguguaccugaguguaggggccuccagaggcgucgggucucccuggaguuggaguuaagcgcuuaccacagguauggggaauuaaccucuuuccagcccguacuagaauuuuuuucuuuccuuuuuuuuuuuuuuuuucuuuucuuuugaccugggaguuguguuuuuuucgagacagggucuuacuguguaacccuggccggccuggaaccaaucuccuaguugcuuaggucaaaggcacagaagacuaccuuggguuugucaaaauauuuugauuuuuuuuuuuuuuuucuguuguuguuguuuucccugugauguuuguucugggagauucuggaaucugauaacuuuaccuuuuauuuuguugcuaguguauuuugauuuuuuuuuuuuuugagacaguuuuaauaugugggccuggcuguccucacucuguagacuagacuagccucuaacucaagugcuaggauuaaagaugcaagccaccacugccugauuuugaaauaaagguguguauguguguguguguguguugaccucagaggucaaaagagggcauuuggccaccuggugcuagaguuacaaguaggugugaaccaucuuaguggaugcugggaaccaaauuuuggcuuuuuggaagaacagcaaaugcucuuaaugacugagccauuucuuuagccucuuauucuugcuuggaaaucauuagaccuagaccaugccugcuacccaccauuugcaaaauccucaaacauguggcuuguacuugcaagcuuaucuuuacugaaagccauuuuaccuuaagauguguguaguagguaggcacagugggccguggcuagugauugugugcgugcgugugugugcucgagcacgcaguagguagacacaaaugugcugugccugauaaaugacggucagagacauucucuccggcuuguggguucuggauggagcucaagugguccgucccgcacauccucucuaagcaaucucaccagccagaaaauaaagcuuauuauucucuguguggagucuugaggauaguucauaagcauggccacagugggcguggauggugcuuugcuguggcuugugagagagaagaaagaggccguguuguggcaaccuggccugaggagcuauccggcugccaagcacgggagagcagacuuccacggggaaggacagaucuguggauucgccacuguugucuuguccuggggaugauguugggcuuucuugcauuuuuucagcuacaaaggaccccacagccguggagagagccaaccuguuaaacauggcuaaacugaguaucaaagggcucaucgagucugcccugagcuucggccgcacgcuggacucugacuacccuccucugcagcaguucuucguggucauggaacauugucugaaacacggccugaaagguaugacgagacccccaaaucagucggccuuccgcucccuugcuucucacccuugauguccuuggagaaauaguuuuuuuuuuuuuaaagauuuauuuauuuauuauauguaaguacacuguaguugaauucagauacaccagaagagggcaucagaucucauuacgggugguugugagccaccaugugguugcugggauuugaacuucggaccuucagaagagcagucaggugcccuuacccacugagccaucucaccagccccggagaaauaguuuuaaggccauaguugccgucauuauuuuugcauuuuauuuuguuuuauuuauuuauuuuuuuaagauuuauuuacuuaugaguacacugucucugucuucagacacaccagaagagggcaucaaaucccauuacagauggcugugagccaccaugugggugcugggaauugaacucaggaccucuggaagagcagucagugcucuuaaccgcugagccaacugagacagcccuauuuugcauuuuaaaucugaauguugggccaauggaauggcuugccacgcgagcuggaagacuccacuuugaucuuuggagucuagguuaagguguguugauuucaggagaauguauuaauuacuguugugauuccuaguacaugaucuucagaaaaauuuuuuuguuuguuuguuuguuuguuuguuuuugguuuuucgagacaggguuucucuguagagcccugacuguccuggaacucacucuguagaccaggcuggccgugaacucagaaauccgccugccucugccucccgagugcugggauuaaaggcgugccucgccacgcccggcuguuuguuuuuugagagaggguuucucuguguaauaaacagccuugguugucucagacucacucuguagacaaggcugggcuggaacucacagaucugcugccugccucugcuuccccagggcuagugcaccauuaugcacugcaaaaaagaauguuuuuucuucuaauaauuggugaaaaacauacuugauuacucuuucuuuuuuucuuuuuuugagauggucucauauagcuggccuugaacucacuauauagaccaggcuugccuuaaacucacagagaccuggcugccucuuccucccaggugcugagaucaaaggugggagccaacaugcuuggccugauuacaugguuuuuacauauuuacccuuuaacggguuuccauuuucuuggguaauuuuuuuuaaauuacauuuauuuacacacacacacacacacacacacacacacgcgcgcacacacacacuuuuaaaaaauuauauuuacuuaugugcacgccuacacgugcacgcucacacacacacacacacacacacacacacuugcacacauaccacaugaacauaaagauuagagggcaccuugccggaggcugcuuccucuccccacugagccaucucagccgccuuagauugcuuuugaaacugaaacugaguggagaugcuggcgugggcucacugauaguuugaacucaguugaagaaauuacaccaacguagaucaggaauguuuccgugcauggggaccugcauggcaaaguguccucugaaccagguuccuuuagaaaccgagguggucccggaaaggaugguucucugcuaugcagaucccaccagagguagagacgaggaaaauguguggguuuggaggcucucuacguagcgcuggcuauccuggaacucacuguauagaccaagcuggcuuccaccucagacaaguccacuugccucuaucuccugagguuaaccaggccccuucaugcacaggugguaguuauguuuugagagaaggaucuggcaaguggcccagacuggccugguacuugcugcguagucccaaggacagacguggugggugccagguaccuucucugcacagaggugagagagcuuuuucaaggacucaugcagcucugaaguauguuugagaugaaacacaggauagcaggcuggggagaugacccggugugaggacugaguucaauccuuagugcccacacagaaagcuagaugugguagcaaguuuguaaucccuaaacugggguugggggugggacugggggguguggagacaggaggauuccuggagcucagcuaguuuaguuaccauccauugguccuauggggagacccugccucagaacacaggguggauggcucuugagcaugccucccaaagcuagugucugaccucccucgcacacacauaccccaaguuaagaugacacccuagcuguguaguuuucaaugcuuaaauguauacuggauaauaauaauucuuuuacuuaagauaacaauuaagcugggcgugguaaugcaugccuguaaucccagcacccgugagggcagagacaggaaguccagauguuuaaggccgccuucagcugcagagcaagucugaggccagccuguguuggcuggagugucuguggccguacaacuucaaucccaguacuaggaaggcccaggcagucaacuaucugaguuugaggauagcaugguuuacauagggaguuccuggaugacauagugagaaccuguuuuaaaaaaaaaaaaaaucauccauccguccguccauccauccauacguacauaaauacacacucggauuugggggcagcuuugauggcuuucuaguaugaucagcguuuguguaguagugggcuaggaaagaguuggacacccaaccugggggugugcucuguugaugggagugugugcuuagcaugcuggcuuugaccuccagcaccucagaaacaccacaggggcucguguuuuuaaugccagcacuugggagguggaggcaggaacaucagaaguagagagccaucuucagucaccuccgagcagaaccuacucuccccggugagcucagacuguucccaauauuuuccagauuacaaagugccggaagagcaucuugggaauauauaucgggggcacguguccuaggauugcuuccugugcacccuccucccccaaagauagauagggucucucuguguagcccuggcuguacugcaacucaccaggcuggccucuaacucacagagauccgucugccucugccuccugagugcuggauuaaaggugugcaccaccuagcgcccggcuguuuuaagauuucuuuagaaguuacaggcaauggggauuuauggagguggaguuaggauaccagcuagcaguggauaggagccuuugcuuugucaugucuuugcccacuuugucuaaaguacucuccucugggcguuugagaugagacuucaguguugcuguggcuguacuaugauucuuagugucaagcaaucuuccugcccuggcuuccucaguagcugggaccauagauguaugucaccaaguccaguuuccagauaccuuaaaaaaaagauuuaauuuuuuaaagaaauuaugugucagagcuacagagucagacccggucuugaaacaaauacaaguaaauuauguguaggguugcgugugaguguaggugccuauggaggccuggagcugaguuucagaugguugugaacaccugaagugggugcuaugagcugaguacaggcccuuuccuggagcaguguauucucuuagccaaugagcuacgucuccagccccaccccugauacuuuauuuuuaugugcauguaugcaucucuaugccguauguguucaguuacccaaggaugccagaagagggugucugguccccugaagcaggaguuagagacaguugggagccuccugaccugaauacugggaacugaauucuaaaaucuggaggagcagcuaaacugccugcccagcccacagauacuuuuaaaaaggauuuuuaaauuuuaaaaaaaauuaugugugggggagugcguauuucugagugcgggccaucgcaggccuaaggccuuugaucccuggaacugguguuacaggugggcugggugagggccucugggagaacaguauauauauucucuuaaccccugagccgugucgccagcucagcucacaagcccagcucacaggugcuuuuauugugucaggaaauuaccaauuuugugccagggugugaguguggguggguuugggggagggugugugugugagagagagaaaacagcuugcaggaauccagucucugcuuccauuguguguccuggcgaucaaauucugguguugggcuugcagggggguguuuuuacccagaagccaucgcuccagccugcucccuuuauuuauuuuuugaaaugguagugauaaaaaucuuucuucuccccuauguugcugaauuggaaugugaugaucauggcccaaacagcugaacuuuggauuguuuucaggaugcauuaucuuuuauuucauaaccacagugaauuaggugucgcagucauaggcuuaucuuaacgcaucacuguaaagcuguuuagccucugagauuuuccccucacaguaagguugcucuugguggcuggccuugcuuaggcaguaccuaugacagccacauuauaucugcagaaggccugauuaguaagggaaaaaaaagguguguuuuucucuuauuuuaaugacugcauguaugucuaugugcugccugcaugcaguacucaauguuaccagaagagggcgucggauccccuggagcucuguuguugagaagcgagccuucucagaagaggagccugagacagggucuccaauguagcaagcuugcugauaacugagcaugacugggaacugauuuucucuuauuuauuuauuuauuuauuuauuuauuaugacuuuuugagggacucuguguagcccuggcuguccuggaacugucuguguagagcaggcuggccucacagaaaaugggcucagggaugcugggguuaaagucgcgugacgcuucgcccagcaaccuugaacucuggacccugcugcuuccacuucccgacuccgugauggcagacaagggcuauggugcccaguucuuccuaugaugcuagccaggcucaaacccagggcucccugcuugguaggcaagcagucugucaagggaacuauacccccugcccaaguguuucucugucaccugauaucaaaauaaaagcuacaauuguuuguauuuacaaggaaaguacuuuuauugugcuuuuuaaaaauuucaauacaagggccuugugcccccuagguuggcguucugccucugaacugugucucucacgccuucagagcucucgucauugcuucuaaguuuugagacagauagugcaguuugucagcugaucuuccacuuucucuggaggccgugaaggugcaaacgugagucucccgcuucagccucccuggcgccccuaugccugccucuuaguagacuuuacuuaguagacuuugaagauguuuuuacuuugguauugguauaguuacguaccgggauguuccugauacgaaggaacagccaagauguguguguguguuuguguguguuuguguguguguguguguguguguguguguacguauaauguaugugugcguuuacuuauucuuggugguacuagggauuaaaccuaaaaccuugugcaugcuaggcagaugcuuuuuuuuauuuaaagauuaauuaaagauuuaauuuuagugauuuuuuuaaagaugaauuuauuauagauaccauauucugccugaauguauaccugcaugccagaagagggcaccagaugucauccuaugguugcugggaauugaacucaggaccucuagaagggcagucaguacucugagccaucucuccagucccaccuucuuuccuuucuauugagacaggaugucacuaaguuacuuaggcaguccuuaaauuucugauccucuugcuccagccucccauagagcugagauuauguguguguguguguguguguguguguguguguuucuguugcucucuguccuccugucuugagccaggcucucucacugaacuggaaacucacaguuccacuugagcuuuaggcagcaagcccucaagggcugcccuucuccauccucugaugcuggaugcuggggguccaggcacacaccaugcccagcuuguggguacugggacugacucaugccuuaugcuuggugaggaagcacuguuagccacuggacugacucuccacaucuauacguagcuagguauuuaaagaugauguugcucccauuuuaugaguugaaauuacaaguuauauauuuuuuccagggagaaaaucauuuuugagcuauaacaaaacuauuuggggcccccuggaacugguggagaagcuguacccagaagcagaggagaucggggcgaguguccgggacuugccugggcuuaaguaaguaugguggauguuccugaaguacaucugcccaucucucgaugcucacaggcugcuuuaccacccucuugaccugagccuugcuccccuuuccuccugcuguucauuguucacuauuccagcucaccucauaguuucccucagagaaacucugucuggacaacaacuagaaaccccgaaagccggugcauucuagcucugaaaucauaaacguggaaaacuguuuuucaaguuaggaaacuguuuuccuuauuuauuuauuuauuuauuuuuugagacagaguuuugcuauacaugucuuacugucuuggaauucacucuguagaccaggcuggccucaaauucacagagaucccucugccucuacauccugagugcugggauuaaagaugugugucagcacaccuggcuccuccauuuuuuaaacuuauauuuuggugugugugugugugugugugugugugcucgcaugcauacacacauaaacacauguguaugauguguaugugggggcuagagagcaugugggugucauuaugcauauggaagucagagaaggacuuucagggucagccuucuccuuauguggugggaucugaggcuggaacuuggggcuugucucagcagcccuuaagccuuaggaauaagauguuguagcuguuuuuauuuuugccccaaacguuuaagucugugugugugugugugugugugugugugugugcauguucaaguguguguguuuccuuauagacacaugugccaugguguaggugugaaggcccagcccacuaauauaccucuaauagaaguaacauuccagagcauucuuucuuccaaagcuuacagccuggaauaacuuggccuggagagacagcaaugguuaagagcacuggcugcuccuccagagaaccuggauuugauucccagcacccauaugguggcucauaaccauuuguaucucuagucuuaggguaccuaacacccucuucucaccuuggugugcagguacugcaccuaugugaagauacauuuaagcaaacacuuauauacuaaaaaaaaaaaaaaaaaaaaaaaucuuaaaaaacaaaaacaaacaacaaaccacccagggggagaauuacuugcucaaaaaacuagcauaaggggcuggaaagauggcucagcucuucgagaggacaagaguuugauuucccagcacguaucuggcggcccacacucuucauauccucguccagcucuaggggauccagugcccuuuuuuggccucugcaggcacuaugugcauauagaugcacauaaaacacccauacacauaaaauaaaauguaaacacuacccuaaggaccacggagaucgcucaguggguaaaguguuaacugcacaggcaugaauuccugagucuguacccucagaaccccaguaaaaacucggugcccuaggugagaaggcagacaggcucacugggcaagauaguuuagguucggugagagaccauguccaaaaauaaagagaagcgggagagaaaagccaugccaacgccaauuuuugguuuccggguuuguccgcuuggucaaaggagcacaggcgcgcaugcgcacauccuucccccaccccccugcucccuuagacaugggcaucacgcucuaaaggugaacagcauuuaucaauggauagggagcgcuuggccagugaauuuagcacuaagguucucuuguaacccaaugcuccucuuucuaggacuccgcuuggccgugcuagagcguggcuccgauuagcccucaugcagaaaaaaauggccgauuacuugcguugcuuaauuauccagagggagcuccuaaggucaguaucauuaggucauguuuacuuuuuauuacaucuauauguugccauccaaaaaaagaagcgaggaaagaugaaauccgggaaaagagaaggagcgguaaaaugaggacgcgaaggacaggagagggacaugccaccgacgagcccccagccugagagaaagcccaucagcucuuuaucgcugaacacgggguaaccucagcacgauuauucuaaguugcuucccuucuuccgaguuacaauuuuguggauacaaguuugcagcggggcuuggggguuugaagauuucuuuuuaagaucuuuaaugagcguuucagcuguaucaggagcaauguuuaacugaaggucaaaagcugaagacagcuuucugagcagcgcagugaaucuucaaagggagcuggcccccggcgaccccuggcaacccccggcgaccccuagcaacccccggcgacccuuagccuggguucucuaugccccagccucugcuauuucggaacuaguguucuguguuugguuuuauuuaugagucuuguuucacaucucagccuuuugcaucugugaaaugaaaaugggcauagcuugaagcacugagaguccuuaccagucuucugagaaccaauuaaagccguaggugaaacacggaaggaacgcuuaauggcaccugcgcucuuccugauuauaaagagacuuaggaacgucaguuuuagacuguucucuuugcaagucucugugucucccucccucccccgggucucacauagcucagacuggucuugaacuuacuucauaacuaguugaugaauacguaggggccuagagagauggcuacguaguuaagagcacaagcuguucuugcagagagcuaggguucaguuucaguacauccgaggcucacaaccauuuaauuccgggggaauccuaugcuuucuccuggccuccaagggcaccaggcuggugcacauacguguaagcaagcaaaauguucagaccuguaagaucugucugugacagggcaucacuaguagccauggcuggcuuggaauuugcuauguagaucaggcuagccucuaacuccagaucugccuacuucuaccuccuuccugagugcugagauuaaaggcaugugccaccauagccagcuauuccaaaggucuuagugaguguggggacugaaaugucagcuguaauuacaaguguuauaaucagaucagcagcaguuacugagucccgagaguccagcaucccaggccuccuggucaccucccuucugacucuaagacaagcuggagagauggcucagcagcugagagcacuggagacucacccagaaaaccuggauucaguugccagcacccacaguggcagcucaggaaucagacgccuucuuacggccucugugggcacugugcgcauguguauuauauauauauauacacauuggcaaaacagguauaaaauaauaaaacaauaacuuuuaaaaaaaaagccauguucuaacuuucugcccaggcuggccuggaacuuacuguguaauucaggcuagucuugaacucauaggaauccugcugucucagccuccuggggauugaagccacaagcuuucaugcacagcauuaccccuuuuucuuucuuucuuuuuucuguuucucuguguagcccagacuguccuggaacucacuuguagaccaggcuggcuucgaacucagaaauccgccugccucugccucccgagugcugggauuaaaggcaugcgccaccacacccggcuuaccccuuuuucuuuugcuuucuguuuuucccucaaaaugucucucuuuccugccuccaucaguccuuuuguuuuuuauguggacaucgagccuuuucccagguuaaguguugagaaugucauuuagaggaauuuagguagauucaggaacuuagguagauucaugccuacgaggugggagacgagguugguaaggagguaagguuucaaagcugaguuguaagaguuaguuugugaugauggucucugauuucauguucccagugaguucuaugaguaccaugcacugaugauggaggaggagggagccgugauugucgggcugcuggucggcuugaacgugauugaugccaaucugugugugaagggagaggaccuagacucccaggugagugaucguggguaaugcagaccugugucuuccuugcacacagcucuuccuggguccuuguuagcucuuagcucuaagugcuguuagucacuugagcaaaauucaguugcauguugugggauagaguccuaauggugggggaggcgcgccaugcccacaggaacaugaaauggaguguugcuauaaacccugauagcuuaccaggcuggaaggagguuccauaaccucuccaaagagugacaccagcuggggaccaagugguaaaauacacgagucuaugggggcuacgugucauucaagccaccacacaggagggagaguguuauuuaggcuccugcuuuucgagguuucuggcagacuggauucaacuaugggccugugguguugagggaacgauauggcagaaaggguggcgagaaagaguggcaggcaaggccccgggccaagauguauccuuuagaggccuguccucggcagugcccuccuccagccaggugccagcugccgcacuucuggcuccuuguagucuguucaugcuuuaaguaaagaagggacaaaccguuccuuagcccagagcuaaggaccuaaacauccccggaagcacccugagaccccagcggcaggcuucccagaccucacaucccucaagccaaugaaaacugacaggacugcccgucccgccggaccugcugacccaguacuugucguuaaauaaaacuggguuuauuaacuucagguuggggugauugacuucuccauguacuuaaagaaugaagaagagaucggaaacaaggaaagguacguccauccucccccuccucccccuccccccacccccuccuccuccuccuucuccuccuguccggguuguacuuuccuugucgcuauuugcgaaugggcgagccgucuguucaggguguggugucggcuccucccucccuggagcccugacuugggcuuuuccugugaaagcuucuccuggacagaugaagaaaagucccuuagaggucaacguugguccccagcaggagucuuggucuuaucugcccuugcugagagagaccuuaguaaccauuuugugccaguggugacauaguaucuaauuggcucuacauuuaaaagguuuaauggcccacuagcaaguaggucgcucagcaggguuccgggugcucaggucacugaugcacugcaccuguuuucaaagcaaagcuguauuuuaucacuguggugauuuuuacacguuuccagcuuauaucucuuuuuguuguuguuguuuuuguuuuuucgagacaggguuucucuguguagcccugguugucuuggaacuaacuuuguagaccaggcuggccucaaacucagaaaucugccugccucugccucccgagugcugggauuaaaggcgugcaccaccacgcccaguuuccaguuuauaucuuaagcuccucuuuucuccuaucauaggaacguucaaaucgccgccaucuuagaccaaaagaauuauguugaagagcuaaacagacaacucaagugaguauucucggcgccuuacuaacgaaucccacuguagggucugcuucguuuccagcugagucuuuauuccuuucuccuuagcaccuucuauugcuaagcacuuuugagaggugcuugaggggcuggcuagaugcagagcagaaauaauaauaaugaacugugucccauguguguaauaauccccaaagagggaaguagagguagagucagauguucaagguucugcuagucaguuugagaccagccuggcccugucuuaaaaaaauaaaaaaaacccaaagcuaaaacccgccuuaccugcucaaggcccugggcugagucaguccaggagaaaucggaauggaaauguugauuguuuugcuguguucuuuguugcuguuuuagcucagcuccaguuaaccagguuaaugaaauuguuccccucuaaggauuuguugugggucacugguagccaugagucgggcgggggaggugcgccguccuagccuuucugaacuugugugauuuugaaugaguuuucccauugccaauuccagcagcacagucagcagccuccauucaagaguggacucguuagaaaagucaaacacuaagcugaucgaagagguacaguccccagcaauggaugcuuguuuucugaguaccugcugugugcgauccuuucuguuucaagcaugaauuugcuguuagcaaccgccacaccauaacauacacacagacaaucacauacucaccccccuucacacacacacacacacacacacacacacacacacacgguggggcauugcaguccaagacugugaguucuagagaacccacauagaccuuaaguuuccaguugcauacucugggguacuaguauuugugauuguaacuggaaaucagccccagagacgaaagucacacagaauccuaaacucauggaaugagauucucguucaucuauguguagauccagcugucauugucuggcuacucagauauuucuccucaugagcaggacuguauaauccuggcuucacacacaccagaagagggcauuggaucucauuacaggugguugugagccaccaugugguugcugggaauugaacucaggaccucugggagagcagccagugcucuuuucuccaguccaggcuuuaaauaaaccucucuaacaauucagcucuucuacuuguagaguugcuucuugagauuauuuauuugaguuggggucucacuguguagacugggcuuuccucugccucccaaguuccaggauuaaaggugcaaacuugauuuuuuuuuuuccuuaagucugucaaaucuauuuucuuuuuuuuuuuuuuuucaguuuuuuuuauuagguauuuuccucauuuacauuuucaaugcuaucccaaaggucccccauacccacccccccaauccccuacccacccacucccccuuuuuggcccuggcguuccccuguacuggggcauauaaaguuugcaaguccaaugggccucucuuuccagugauggccgacuaggccaucuuuugauaccaaaucuauuuucugaaauaugguagaugcaugaaguaugcucgaagucugucauuagcacuaugacccuauuuuuccacguuacuuagaauucuuuuuagaauuguccucaccaggcagcugugagaaguugaauacuugcaaauaagaaauguauacgugaggccuagcaugccggcacacaccuaugaucgcagcucaugggaggcagggaaaugguaggaaguucaaggccagccucagcuacauaucaucgaauuugagcaagccuggccuacaugugacugucucaaaacaaaacaaccccaaaggaacacuuaagaaccccauguaugcauugcuggugggauuugauguauuaugcauugcugaagcuucccacgagccuguguuucuuuuuggccuuccauacacaacaagguuugagcuguuuccccagaguggucagaaguguacaaacuccugccacuuucagggaauggccccuguucuacucguucaggauuucccuuuucauucugggcuucagagcccagguuccuggguacuaguguaaagcccugaucuaaaguugucugaggggacacaguuuuggaguccugccaccugucacauccaugggguaggaguccuguugagucaccaugaacauuugucacauuuuucaaacccagcaccaucucuuuccacgcgcacacgucuuuacagugugccugcuuuacacaucacucuucugggcuuccuccccacuccacauacagugagucugacaagugcaccguuucucacaagcagaugaggaugugcuucagcuguggagggaaauaguaugcggggcuaagaagauggcggugguuaggagcgcuggcugcucuugcaggagaccagguguccaauucccagcaccuacaugguggcucacaaccaucuguaacuccaguuucaggcaauccaacacccuuuuuugaagucuagagaccaggcacacauaugaugcacauacauacaggcaggcaacacacacacacacacacaccccucuaaaaaagaaacggugaaaagaauaauauagucaugagugguagccaugccugguaucccagcacucaggagacaggcaggcagaucuggagucaaguccacccagggcuguauagugaguuccugucuaaacgcgcuccaccaaaauaaacaagaugagcauaccuauuuuuauguguaugauuguuuugcuugcaugcauaucuguguaccacaugcauccuggugcccauggaggccagaggagggcaccagauccuuggaacuggaguugcagaugguugugaguuccuguguggaugccgggaacuggagcucaguccacugcagaacaggaaaaacacucuuggcugcugagccaucucuccagcccacagcacacuuuuacaauggaaucuuccgugcagugugacuguucuuagugguuuuaggguuuucuucccugcagucugcagccacacacacagccuguacagaaagucuacccaaagaugcucggagugacucuguguuuguguuucacaauuugcaguuagcaauagcgaagaauaauaucauaaagcuccaagaagaaaaccaucaauugcguagugaaaaugagcugaucuuaaugagaacucggcagcaccuggaggugagucaccccugcagagggcugggauccugggucauggaggcuagguaugugggacgacagagccccaugugaggugugaccuuuucucccuagguuaccaaaguggauguagaaacggagcuucaaacauacaagcauucccggcaaggccuagacgagauguauaacgaugccaggaggcagcuucgagacgagucgcagcuccgacagguaauuuaaccucucauuuacauuagcagaauucuggggcugguguacucaggcaacaccacucaggugucucagccucagccucuuggagguggaguagaaccugacacccaucaagcauuuugacacuuuguuuuugccucuguucuguaugucugcacacaugccagggcacauguguggaggucagaggcuuagcuugccacaggcaguucuaucaugugggucuuuugaacuuggcuccucgggcuuggcagucaagcuccccacuguucuaguccucucuguggcugugaugaaacacugggaacacacggcuggagccugaagcuuuaugcucacucagaggugcucagcuagcuuuauuuauauagcuuaggcccacauggcuagggaagugcauuauacacagugagcuggguccucuucuaucaguuaaccguccggacauccuccacccccaccccgagcccccagacacaccacaggugguucuaggcugcgccauaaacuaaaugaugccuauagagccauguugcuuuaaaaacacaucuuuuuuuuuuuuuuuuuuuuuuuuggguuuucgagacaggguuucucuuuauagcucuggcuguccuggagcucacuuuguagaccaggcuggccucgaacucagaaauccgccugccucugccucccgagugcugggauuaaaggccaccacgccaccaugcccggcuaaaaacacaucucgauguuuuuaccuuuuuuucuuuuaaaugggggagguugcaagggaagaggguacauacuaggggaugggaagagagaaagacugguguacaugaugugaaacaaugaaucaaaaaguuugggggaaaaaaaaaaaccuggucuuggugacacacagcucuaaucuccagcacuccggagguagaggcagggggauuucuguauguuugaggccagccuagucuacaaagcgaguucuaggacagccaggacucucacacagagaaacccugucuugaaaaucaaaacaaaacacccaccucucucaguauuuuuaaaacugaguuaccaucugugguuguuagugugacugcagaccaccaucacaaaaacaauacguaagaggacagaguggaguauguauguuagcaacaucgcacuuaaaacuucagauuucggauugugagacacacacaaaaaugcacacaugcaguuuaaugaagcaaaaugcagauacuuauugccuaggcagagaggaggcuacugcacgccuuucagugugcuucuccugucggucuuuagccuuaggaaacaucuucaucugguugguugguuugacagugugcuaguuuuuguuaacuugacaggaacuggagucaccgaggaaauacccccauuggauucgucuguaaacaagucugugagacauuucuuuuucucaaauuaaugaucagugugagaguccagcccaguguggguaguagcauuccagacaggugguccuggggauguuagaaauaaggcagccugugcaggucauggggagcaagccagcauuccucucuaggcucugcuccaaguuccugccuuugacuguaacuguaagccaaaucaacucuugucucugaaguugcuuuuguuuaguguuuugucacagcaauagaaugcaaacuaggacagaugagaucucacucucuagcucuggcuggucugggccuucuguguagaccaggcuagcuucagccccagagauccuccugaggagugcuagacugaagguguacagcaguaggcccagaccuuguuuuugaaacagaccucacuguguagcccaggcugcccuugaacucaaagcagucccccugucccauucucuucagugcugggacuacaugugggaaccaccacaccaggcaggcugauguugaauaauauacuuaaacagaacagaggaguggaacagugcucccagccuuguuaacgguugcgguugcacccaccugauuuugauaaccugaaauugaagacacugugaaauugcaggauguggagaaugagcuaucaguacaaguuggcaugaagcaugagauggagcuggccaugaagcuguuggagaaagacauucacgagaaacaagacacucucauaggccuucggcaacagcuggaagaagucaaagcaaucaacauugagauguaucaaaggcugcagguacucaauguucuuugacccuugguauugcuaggaaguaaacucacggcuuugugcaugauggacacugaccauucacugagcccccuccaccuugauuucuguuucaugagacaggguuucuuuauauagcccuggcuguccuggagcucacuauguggacaaggcuggccuccuaaacugccccugccuccuaaguguuggaauuaaguuugugccaccacgccuggauccuuucuccuuugagaugguacauucuccuucucaguguuggggcagacuacacgguuugaugcaccgucagucaugccggggaaggcagugggggaguggcuggcagcccuagcuccugaagcugcuugcucccgauaggguacaggcgggguggcccgccuaucugacucuuucagcgcugagacugcaagccacacuugcuaaggcuugcuaaggugcaaguguggcuggcagucagaggaugcucugugggagucagcccuuuccuuccaccacaugguuuuggaaaugaaggcauguuggcaagugcuuuaccuccugagccaucucgcuggccuauuuuuacccccaagacuuaguugacuugcaauuguuauugcaggcaauaacuaacuuguacauuucagcuacaaauucacaaaaaguacuccccaccccuuuuuugugccaagauccaacccuaggccucaucagauuagggacaucccacccagccagucccaaaucuauuuucccuucuuccucucucuucucaauuuauaaauuucacuuuuuaaaaaaauguagacuguaugaauaugcaccacacauaugccuugugccuaaugaggguguggaacccucugagccaucucuccagccucucacuguguagccuuacuagccuagaacuuacuucuuagaccaggcuagccuugaacuccaagugaucugccugguuuugccucugcagugcugggauagaggccugugcuccacaucuggcacuuaggaaugaauuacacuuauuuuucugauguguguguaccacagcgcacacacagagaagucagaggauaacuuguggagugggcagucuucuuucaucauauagaucuugaggauccaacuuugauuuuccagauuggcggcaaacaccuuuacucacugaacgaucucacucuccugguagcccuggccuugaauuuacauugccugccucuaucucauucaaaauguuuuaaaaugcaaacccccaacccccacccccagauaggauuccucuggcuguccuaggacucacccuauagaccaggcuggccucaaacagagauccgccuuucucugccuccugagugcuaggauaaaggcauaagccaccaugcucagccuguuuuuuuaucaaucacauugaaguaugaaagguuuuuuuguuguauuauugugagugggcuguguaugugccuuggggcauguguggaagucagaggacaguuucaagaguaaccccuccuucuaucaaaugggcuccauaggucuacuccacaggucagcuauguggaucuucugagccccuguuuggugcauacaguauuuugguuauuuuugagagggacugaugccuaagcuggccucagugccccuguguagugaggcugguauugaacccauaauccuccucugucugccuccugagugcuaggauuccaaggcaaacgaaacuauacuuagccuaauguuuagguuucaaaaucaaaaucaccauaguuguuuuguuuuuauaaauagggcucugaagauggcuugaaagaaaaaaaugaaauaauugcccgacuagaagaaaagaccaauaagaucacuacagccaugaggcagcuggagcaaagguaggacccucacaugagucucuccuucuccuuccuuucucccucugacaccugccacggaguuguuagaaagaccucacccagggccugugucugccaaggccaagccaggccuugucuuuuuguuuugguugcugcauggaaccaaguugcuuuacuuagggcgauucauuugaaguugccuuuuuggagauaauuuaaaggcacaauaucuguaguuucuugucauuucgucugugacauaaaacaaagacuugaaaaacugaacuggggccggcucagagggccugcccccugaaggagcugccccaucccucgaccguggcugucuccucucugaaagcggcaugcguuaacaggaagcugcuuccccaaggcaggcucucuugucaguggagcgcuguauccuggccuuucauuuuacuguuggaaaaccuucuguccccauugcccugucacguugagucaacaugugucaccauugcuuucuuugaacuuagggaaaacauaacuacugaugcuuuaugacacaaauauucuuuuauugacauccucuuucuucuuuuuucuucuuucuuuucguuguuuucuuuauccccacuuuuacauuuggacaucuuuauuaccguuucuugucuuugauuucuguccauuccauuaugaagcgacaacgacuuguuaacucagacuaggacaauugcagugucauuggugaaaagugcuaguagugacccucaggaccaguacaagcuggucaaagacaucuccuucugaagcccacuccaagagcagaacccauacucacauguuaaauggaaaagcauuuaugcuaucucauauguccaggcugcagggacccuccauggcugcugugagacacggcgggcgcccuggcgggcuccucacgugcacuccucagccuugugcacaagggcagaucugagucccaccuucgaggauggcaagacuuuuucaaaguucuaucuuuuuagcuaccuuucgauggaagcuagaaaccuuuguuuucaagcuguguuggcacagauaaaacauauacccacacccgcuggcauacucugccuaauggcuccugauuuuuaaguuuuuaaagcaguucucaaaccaggcuggccacugcccugggcuuuagcaccuccguuuucuaauccucccgcccucuugugauagcacaacugcaggccuaccucacuuacuuuacuuccuguaaccuuagaagagagccgaguccagcccuaccgccuuaauccuuucguuucaauguagaccuagagguaacugacucccucuccuuucucggaggcuuuuauacucgcaguguguguggccuuauuuaggguguuggaggcagauaugaagauacaagaguucucuugugacuuccugugaagaguuagugucccuugaguucugggaaauauuuucuuauaaaauauugaagauaaaccucaaaucuugauggccaagggaggcaaggaguguagcugggccuggggacaaacagugacuuaaauacgaacagggaaaggugacauaguaagcuauucuuuaagauucaagcaaagaauaaaaauuguauugcuggagaugaugugacaguuacagaggacaggaccuggguucacuucccagcacccacauggugugguuuccaguuccagucccaugggaucugacaccugcuucugaccuccgugggcaccaagcauauauguggugcauagacauacaugcaagcaaaacauucauaaauguaaaauaacuaucuuaaaaaauucucucuagggaaugccaagcacuaaauauuuuugaaucuuaaaaauauacauauacacacauaaauauacagcuuugcauaguuaagcaaccguacagagcucugauggaagacuccaucccugagaacuguagcuguugcucuuugcucuuggccuugcagugcacuugauuccuggcacacacaucuuagcaucacauacagcagguguguucugcacuuacuagagacucaagcucacggcuuuguaaaaaggcaguaucguaccuagccauauuugagauugaaaucauccuccaacaguaaaaaacuguauugcuuugcauuaauuaugaacaagaaauaaagcaaauuuaaagauaguuuucugggcauauuauaucuuauguugaaaaaaaaaaagcacaaaacaauuucuagacauuguguggcucuuucacguuugaguuugugaguucucccccaaacuuuguuuucauuuagaaauguuucuauuuccccauuuuucuuuugucuucuucacccuuuuacacccuaguucuagccucaguuuuacccaaaguugauuugaauuacaccagauugcagcaagcagagaaggcgcaaaaggaagcagaagccgaggaugagaaauaugcccaggagugucugagccaauccgacagucugcagagacagaucucgcagaaggagcaacagcugugagugcuuggucgugagaucaaauucuuguacuaacacggucuccacuagccaguacaguacaaguaccuaaagaaggugugugggaugcuugugauggcucgguauggaaacgcaguuaccagcaagcccgaguucagcuuccaggcccuaugugguggauggagagacaaugacuccuuaggguguccuccugcacacgucucaguuccucacucaguggguucaaacuccaaacacacacacacaaagggagaggagagagagagggguaggggagaaagaaaauguagugcaggucuacauaauuuccuucauaaggaagggcgacuuugagcuuuugcucucccugcuuccaccucugaaugcugggauuccaggugaguaccaucaugccuggcuuaaguaaugcagggagucagaccccagaguguguuuaaguauucuacccacugagccgcauccauuuuuaguuacauguaguuguguaucucguaacugcugagccauccccuccagcccaucuucuuugaauagcagaggcagugagugcauggucccggggaggagcauuggugacccuuguagagcaagggcugaaacccuuucaacuguucugggcuacaguguaacucauugguagauuaugugcuucuuaguuugugcaaagccccagguucaauaaaauaaggacaaacuaagacuuuucuuuguacaugcagacauaggcaaugcaugguuuuacucuguguauguauuuaguccguuagcaagcaugugcuggaguaugcaugugaauguuacagaccuacuugggagaguugggacuguggggucaaauucagguugucagacuuuugguagaagagaggcuuuuuacccacuaagucagggucucaaaaacaaaacaaauaagagaucugucugccucugccuuccaagaacuaggauuaaagguguguggccuaaauuugggucuuggcuaauacaggcagagucaaaaggaccagaaauuaaaggucauuuuuggcuagauagcaaguuucuggccagccugagauauaugagauccugucucaaaaaauaaaaauaaagggauuggagagauggcucaguggcauaguacucuuacagaagaucacuaguuccauuucaguccauagcaccguaucaggugucucacuaccacuagucauuaaaacauaagccuuuaaucugggcacugguggcgcacaccuuuaaucccaacacuugggaagcagaggcaagcagaucucuuugaguucgaggccagccaggacuacagagaaaccuugucuugaaaaaaacaaaaaaaaaggggggggggcuggaaugauggcucagagguuaagagcacugacugcucuuccaaagguccugaguucaaaucccagcaaccacaugguggcucacaaccaucuguauugaaaucugacucccucuucuggagugucugaagacagcuacaguguacuuacauauaauaaauaaauaaaucuuuaaaaaaaaaaaaggaucuuuaaaaaauaauaaaagagcuagguauggaagcacacaauuguucuggugguguuuuucuugaguuuuuccauguagcuuuuggcugucagggaacuaacucuguagaccaggcuggccuugaacucaagagcuccaccugccucugccuccugagugcugaaguuaaaggcgugggccaccaggauggcccugcacacuuguaacccagugcuuaggaggugggcgcaggagaacuaggauuugaaggcuacacuuagauacaggagacguuaucacacacugagcuucuauguuugccauucaagggugcagcuggaaacggacuugaagaucgagaaggaauggagacagacuuugcaagaagaucuucaaaaggaaaaagauguccuaucucaucuuagacaugaaacccaaaaagucauaagucuuaaaaaaguaaauagugguaaaacuuuaaauuuuacaacuugacaaguugcuggaagcaggauuucauaauauaguucagacuaucuuugaacucuagagcaaaaucuggcuuugaacucacagcaguucugucucugccucaggagugcugggacuaaggcaugagccacugugcccgacuucucguuagcuuuuauaaaugauuugggggcggaggggauggcugucaguaaagugucuguaggaccuagucucgggucugaggaggcaucccuggcacugaccagccagucuagccuacuuugugagcuucuggccagugaaaggcugugucucaaaggaagugguaggcagucuuaaguacaaccagggcuaucguccaaccuccacacaaagacauacaucuuuuaagacaagauacuuuaaacaauuuacauauauacgaauaaacaggauauagugguccucuuaggaauaugaugaguaaggagguuguacugaguaggcugaggcaggagaaucgggaaguugaggcuagccuaguuagagugacauccaggacaguuugagcuaggauuccagcucauacacgguaguucagaaccaucucuagcuccagcugcaggucugaugccuucuucuagccucugggcaucaagcaugcacauggagacacacgcaugcacgcaggcaagaacacucacacaugcacaucuuuuuuacaagagagaaauggagggagguagaaagugucugaaaauuccuuccuuauccgagcuugacagaauacuccuguaaugccagcacucgggacauaaaagcacaaucagaacaaagauauuuacacuuuccuacuuagugauacauauguaauuuggagggcuuuuuucuccuuuuaaguuauauuuucuguuuucuacugaaggaguuucuuaaccuccaggaugaaaaucagcaguugaaaaggauuuaucaggaacaagaacaagcucugcaagaacuuggcagcaaacucugcgaguaauuccucucuuccuucagcuaagugcucacaaacgggugaaaggcacacacaucagcugugcagagggcuacuugaguauggggauaaaaaccaaggcuagauacuuuggagggauuucaguaguucugugcauuccaguagacacuggcucugaaggguuccaguaagugagagcaaaaacuauugcuugaguucuucagugauaaagacuccagaaacuuaauuuugucgggacaacaaaagcugaauuuugaaaauguccagggcuuucagacuauugacagagcagguuuguugggaaguaaauguaguuucuauccuacaggggucagugugauucuguaguagaaugcuauugggauccauagugaaaaggaagccaggaaaggcuguaaucucagcaccuggaagggagacaggaagguccggaauucaagccauccucaguuacacaaagaaucagggccagccuugagagcaugccuuuaaaaaaaaauaaaauaagaggcuggagagauggcucagcaguuaugagcacuggcugguuacucuuccagugauccugaguucauuucccagcaaccacauggugacucacaaccauaugagaucuggugcccucuuuuggcaugcagguguuauguuagauagagcacucauauacauaaauaaacaaaccuuaaaagaacggacuugcugcucucgcacaggaccuagguuaaaucucuagcaccuacaugguagcucacaaccaucuaugacuccaguuguagacaaucuaguggcuucuuucugaccuuuggacauaaugcauguauaugguacacauacauacaugcaggcaaaacauucacauacauaaauaaguauguauacauacuuuaaaaaagugaguggaggugggaaauaucuaagaaaccauuucaauuuuuuuguuuuaggauuguguucccccucucuuuacuccuccuccuuccgaggaaugauauuguauauugucuguagguauacuguaaccauuucguauaaugugacaaauguucaguaacaacuaguagucucaagccuucaggauccacugcugagccgagaacacuugcagaugagagcuacugaaaaugcaagcugguugggugucacaggccuuaucuggaacgggacuugaggccagccugggcuauggaauuucagugguguuccaaaaacaaaaaguaacauuuauacaaguagccaagaauggccuugaacuucuuuugaucuucuugcuauguaacuucccaagaacuaggauuacagauguaggcuaccacaccuggguuuauaugggacuuuaauagagggauuuguacagcacuuucacaaacauacacagaaguuuuugaaaaauucaguuguauauugugagacuauuucaacaaaaaccaaaauuaaguuguagaaaucucaaacacugauuuuuguuuuaggacauuuagaaaacaaaacaaaauauccccuuagucagagauugguaaucugugaaguauuagguguuuuguauuuacaagcauacuaacauuuggacccauuuguaauguuuuuagaucgaaacuuaaaauagacgauauaaaagaagccaacaaagcacuacaggugaguaaucagguuugggaguacaguugaaagcuuuuuaaaguuggcaacccuggaagguuggaaaugggguguugggggccugugguuuggucucagcaucagacauuuaagggcuggcagcccuguaggggaguggguggggcagccacucuuuuaucccauuacucucuccauccuuacugaaggaaauguuacuaccuguuaaaggauguauaaugauccuggugaaaaaugauacuauaaugcuacuuuaguagcaacauguccuucuagaaaaggcuucugaugaauacaaugcugcuuuaacaauguggugccugagagaauccuaugaccugugagucagugauggcuuucuacuucuaaucaccccacccccacccccacacacaggguuuaucugugugguccuggcuaucuuggaacuuuuuguagaacaggcuggccuugaacuuacacagaucugucugccucugucucccaaaggugugcaccaccaugcccaacuccauuuaacuuuuuaaucaaaaugcucuauggagcaguggugcacuagaggcagguggaucucugugaauuugaagcuaaccuggucuggucuacagagcaaauuccaggcuacacagagaaacccuguuuugaaaaacagaagaacaaaaaaaagucauccaaaaaguccuggaacuuagguuauguuguugcuguaauaccaguacuccgaacuagguaaaaaauaguccuagagagaccagaagaagggguuaauuuggaaugggguuacagaagauuauggccauguagaugcugggaauugaacuuggguccucuggaagaacagaaacacucuuaauggaugagccucugcccuagaccccuccauucuaaaaagauuccaaacaagaaguguuagcuccccuuugccuuuaaccugcuauuaugaaagccgaguugcucccaauucuuauagcuguuuccucuggcaucuagcucuguacccaaagcaacaugugauuuuuaccacguuccccuuuuguagugcagggaacggaacugaacaggccuggcccaugcuagauaaacacuguacugagccacacugugacaugucuuuucacugugcauggauguggugggaccuguuugcucacuccaacucaucucuuccuuacaugcccucaauaaacucuugccuagacagggucucacuguaacucuggcugauccuccugccucuugagcgcugggauuaaagauaugccaucacacaccuggccugaacuuuucucuauucuuacuuuauuaauuauaugugaguacacuauagcuguccugaacuuuucucuauuuuauuuauuuauuauaugugagcacacuguuauuaauuaauuauaugugaguacacuguagcugucuucaaacacaccagaagagagcaucagauuucaauacggaugguugugagcuaccaugugguugcugggauuugaacuugaccuucagaagucgucagugcucuuagaguggcugagccgucucuccugccccuauuauuuuuugaggcaggguuucccugcagagcccuguacccagagaccaagaagugccacagccuuccaggugcacccacccucaucauuucuccagaagccaacugccugucagcuauuuuauuucccgguguucuacuccggaccagaauguuaccauucggugacaacccagcacauuaucaacuguucccuguagaagcuggguuguucauuauuuugucuucaacucaggcccccugcccacaucuggacacgcuucuguccaggcaugucccgaguuucugacguaacucugagagcuacugucugagccuugugccuucuuuccuucauuuugaacauaaguggugaaaaugagucacaggaauugugcacaggagaaugccuuucuauuuucauacuucugaaguaagagcagguguuauugauuugaacauuaacauucaucuuuccauauuagggacuggucugguuaaaagacaaagaugcaacccacuguaagcuuugugagaaggaauuuucacucuccaaaagaaagguagguaagagaagugaaaaugauuccaaacguuguggcaacaaaaauggcuucuaauuugguuuuauuuuccccggauuuuuccauuuaauagcaccacuguagaaacugcggagaaauuuucuguaaugccugcucugacaacgagcugccuuugccuucuucaccaaagccagugcgagucugugauuccugccaugcaaugcucauucagagaugcuccucuaacaugccaugacuuggaacuccauucuccugcacagcaccaccugcagcgagggagggcugugugcccagucaguacuguaccuugccuccagcucacaaacagguuucuaaguuauauggguuaguauuccgucccuguacuuaaucagauuuuaagauagcauguuuuagcacuacuucaacuaucaaguaaccuuuaacaaaaggucagauagcagagcuaaugcacauuugccuuaccuuauagaggccuuuuugagaacaaggccacagcuuauuugcuucugaacugaugaguaggcacuugaaggugccugucucuuaaugcacuuuagaaagcgucacaauucucagagaaaaacuggaaaugcauucacuuuauguuauaugccgauuuaacgguuuuuaaaaugguggcccacgccuucaaucccagcacuuagaugcagaggcagguggauggaucugaguucaguaaggccacccugguagaaagaggaaguuccagucaggacagccagacuguccaggaagacagacugaaucaaaguuguuuauuuuuuaccauaagcugucuugccuaagcucugaagugcugggauauaggugugugcuuccaucccaggucuguguagucuucauugucugguaagaugcuaauuuaguuguauuuauuugcuuguucuucucccuucucuacaauggaaaagaccaaugauuuaaucccuuccuuuccuuuuuacuugcccacaucuuucauauaguggacuaaaggaccaguggucuggccucuagcuuuuccuucacuuauaaucaucauccuuaucacaaauacuaauuuuuauaaagggucagauuccaaaggagaaaacauuccuacccagggaacaaggggaccgaaugagaccacaggccuuuaaagauugauucuaagcauuaaaauuaagaggacugcuaugaaagaauuaaguuucuccacccucaguucucuuaagaauaacuucuaggaagcauuacacuggcauauuuacgcuugcccacaguagaauuucacccucuauguguauuagguacuuuagauaguagcuccuuauuuuuucaagcgggggugugugugggagacacggagcauuaaguuacuuaaaucaugaccauuuaggauaggaucuuuaauauauuaauuuccagccuuauacuuuuaagucuauaaagccuuucaaaacucuagugauuuuacacucccaagaacacugcucagugacuggguauuuuucugauccccuuuucugcaggaucuuuucauuugcuacauuucaguaaguuuuuguaaauugccaaaauuacaaaaccaguauuuaccagcuucuguggucaacuuaaauucacuccgacagauuucuagauguuucuuuuggagacagggaaaccccaaguuggccuccaaccuggugugcagcaggggaagaccuugaacugccugacuuccacaucucccagcugcugagauuacagcuguugaguguuuguauguggugcuggggauggagccccugauacuuuguacacauuggccagguacucuacuaacucaguuacucucccaaccccagaugucauuauauauauauauauauauguauguauguauguguguguguguauauauauauauauauauauauauauauauauauauauauauauauauauauauauauauauagugaaaaccugcuggcacacacacaaaaaagagacaauuuaacugcuuuguacugauggggauuacuagcaucuuucuuucuuucuuucuuuuuuuuuuuuugaguguaaaugaaaaacuucaaauacuuuauuaugugcuuuuuauuaccacucaaaauuugugucauaaacaugggccuuuucuggagcagcacuaacgaguuccccugcugugugugagauaagaauagagcugagugguagaaugguugcuuaucguggcuauuaagggccuggauucucaauucacagcacuaccaccaaaaaacauaaaaccacccaacuuuaaauuuaggauauccuauuuauuacauaacauucacaauucuuauuuugcagaaaacucgugucauucccuuacuuaccuagccaguacuaccacaaagaugugaucauggugccaaggaauugcaaauguaauucugaucuguaauguuuuuaaaauaaaugugaauuuuauaaaucgaagaucuaagaaauuaacacuuacuuauauugcuuuaaaagacuuguuuguaucugcuuaugugugugugaaugugugccaugugugugcaggugaccaacgaggccaggaaaaggcauuggacuuaagcgaggcugaucaccugaugugggugcugggaaccaaacggcccucugaaagagcagcgaguacucuuuauuuauuuauguauaugaguacacuguagcugacuucagacacaccagaagagggcaacagauccuguuacagagggcugagccuccgugugguugcugggaauugaacgcaggaccuggaagagcagccagugcuuuaaccgccgagcaucucuccagcccgcagcacguacucuuaaccacucuaccuacugaaguacucuuuagccaccugcuuugagauguaagaagcuugaagugcuugugacuucugugcgaggugugcaggcaccaaguuaaacccauuaagacagaaacucacuguuucaggccgacaggcuccaagugacaugcuguggcaacucucucuucuuagcaugggggaaaaaaaaaucacgccuuuguaguuacuugaucagaaaccucaauuuggcauccaacaguauauugccuuugcuucccaaaugcugggauuaaaggcauggugauacuugauaccaauaacuaacacaacauauucuaggacagacaacauucccauguugacauuuauuacauuaauaacauaucuagcaaaaaacaaguaacucaauaacugagaucacacugacagguucauuuugauccauuagccaauuuggggaaaagucuuauugagcaaaguaauaaaaagauuaguagaaagcacguuuuccuucuacacagggcacuuaacuacucaaagccaguuucagacgcaaaaccagcuacagcauuguuuuauagucuccuaaauguagucauuuauaccauuauaaagacccuguuuucuugggugagaaacugaaaauacaaguaagcauauacccauuauaguaaaugcccguguauuuacagaguuuuucugucauuauuaagaauuucaaacuacuccaacaaacucaaguuuugggaaccauuuuugguaucuuagucaagugcuaugaggguuuuauaccccuacccccauucauaauacaauuugugaauauuuagaauccagauacgucuugaauuauucagagcuaugcuugauaaaagagaccgaaaagaauacagaauuagcuuauguuccugaaaccaccugaacguaucuuuaggcuuuuuauuuacaguauguccaggggugaaagguagugcuacccuagaugccuacuuaagacucgcugucuugcccucuaucacugcacuaugcuaacaguaagauacauuaucccaaaucuuaugaaggcagcacaucuuuaggaguaccuauauauaaaaaguagcaacaucagugguuugaauauaaaaauuuauuuaagucaaaguaugcaacaaaugaaacaaccuacagaaaacagauuuucccaucgcagucuguugcuuuaccaaauaauauaacacauuccuucagucguuauaaaguucuugaaauacaaaagaaaugaaaucuguaagaaagucuaguagagcagguguguuaggacguguacguuggggugguguugucaguacaucccacgccauccaccuccacucauuccaccuugcccauaguaaccuccacugccuccaccaccacgaccuuaagaagacaguaagaaccguccaucaggagacauccaugucuuuaaaugaaggacacuaccacaauacagaaacaacuacuuaccauagccucccaagccaucaggagcaccguagccuccgcuguagcuguuccccauccccauucucccaacagacccguauccuccuugauuaucugcacacagaaaagaagccacagaggaugacugccuuguggaguggccaacacuugcucauucuacacaauuuacaaaccuagguuuggaaggauaugcugaagcaucaaggagaauugugaguuuugggccauccuguguuacagugaggugcuacccaucacaaauacaaaacuauacauacccauuccaucucugccauagccucccauuccagaaccucccauuccagagccaccuccaggaguagaauucaagaagaguucaauguaucgauguucuuuuaaaaaaaaaaaaaaagauggguggaaaagguaagaggauuagagaaaggaaugcuagaucaaagguauuaaaguuaauuuauaaaacuaauucaaacagccacuaaaguuuaagcauuauuaguaggucaaaugauuuuaaacccuagggucuacuacaggcacuuuaacaguauuucauaaacugcacacaccuguaaaacaagcauaacaaagauaccacuuacgcauguuguuuuuaucuuuagacauggcagcuacugcaucuucaugugucacaaacucuacaucugccucgccuguugcucugccaucggcuccaaugucaauaugaacacguauuggauugagcggugagaagaacuaaacagaaguuauucauuuuaaaauuccaguuauuuaaaguuagcauauacuucaauuuuuuuucccuaguccacuaaaguaaacuacugagagucuaaaagcugcaguauuguagagguaggcuagucauccuuugcuauggaaguggucaacuuagcucacacagggaaggaguacauauuuuaaaaugccaaaagugcugcugcuuuaaacuaagguaauaguacauuuuaagugaaaacuguccaacugugggauccagcuccccuuuagagaaagugugcauuaucagggguaucugaguuugggaaugcuucagagccuacuacuaaaagcaagcugcuuccugacugacucuucuucacacauggguguuguuuauuuuuaaugcauuuuuuuuaaccugcuuaaaauucucauuaggucagcauauaaugggcacaaaacaucuaugugcacauuaggcaaauaaucaaucacuaagugacaaccuuagccugagucucaacaaauaaaaaagaugagucagcugggcaugguggcugccuguaauuccaacaugcucaaagccaaguuagcauuagcaaauucuagcccaguuuggccuccccacuacaaguaauuacuacuaacaaaaaaaauaauaaauacccacuauaaaagcacaauuacucacauuagcaauaucauuuucagucgcacgaaaaggcagcccucucaugugcacaaaaugaccaccauggaaaccugaacuugcaucaccagcuccaccauagccauguccucccaugccuagauuagaaaccauuguggguuuacauaaguguauccauauaaaucuccagagcaguacccugacacaaguucucauuaaccuaucaaagcugccuuccuacuacuggaaaguuaccuaauuacuacuggaacuuuacaaagggaacaguaagacugacuucagcaugacagugcucuguuuaccucuuccaucucgcauccugucaucaaagccaucguuuccauagccauaauuauuauagccaccauagucaucaaaaccuccauagccuguauaaaauggaaggaaaaagaaauauaauucugagccauuguuuuguaaaguagcuuacaaaaucauuuuguagucaacugucuuagcuucuucauuaauguuugcagcugacugcauaugagaaaaaguuaacacuugauggaaauuuacagagauaaauucaaacaacaugaaaaccaagucucaucuuuaugccaggaagaaaacaugccaaucaucuuuauuuuuauuucuacauuaaguucucuaggugucaauauaugcaucaaucaaguuccaccagauggucauggacaucccauaacucaugaccagguuuugaaaccucauagguacuggaauuacugccauuucuguauuucuugaccaagugucaggaacaucaagaaaaugacaacagagccuuuguucauuagacacacauuccaccaucauauccaucaccuccucgucgcauucugucauacauacuuccacgcccagcuccauaauaacccccucuuccuccuauuggucuaucauauggucccggucgcugucccagcaaucuucuugguggaucauaaaauccuuugauuucacuccugcuacuccugaagaucucaauauaccuauuuaaaaauguuuuaagguacagguuucagcauagauguauuagagaguaaaucagauacugggcaaaauauaguaaguuugucuauaucuaaguacauaucccaauuuaaguugccuaaauaaaccauaagguuaacauuuuuuacaccuacaaacuuaaauauuuuaaguuuuacauagacaaaucagucauuugaaaacacugaaucaggaauauauuuuuagcuuguuuccuuuguacaagauagguauguaaaaaaacaaaacaaaacaaaaaaaaccaaacaggugauuauacaaaaacgaauuuaacaacauccuacaaagaaauggaaacaaucuaauuuuaauuuaaacuauaagcauuaauuccccucccaaaucuguaguuuccaguuaaauuuagguaauuaucaauucuuuaaaacuaccccagaaaaauguuaugcuuacccaccccauuuaagcaacagugacccacaacccccaaaaauaaaaauguaauaccaucccaaacucuccauccccaccugugcccuauucuuuccuuguguuuccccagagcauuuucugcuaucuccuuugaagcaaacugcacgaaggccuccccugugcuucuccccugguaguccaucgucaauguuaucccauuuggcacgauuuccaacccuuuaacccaaggacaaauaccccaucaaggggaacaguguuaaaggcugaaacauucccaucugaaucaauuauuuaaaacaaaucuaaacaaaacaaaacaaaaaggcuuaguuucccaucaccccauaauacaaguggaauauuuuucaaauaucauuggauuaaauauuuucugugaccagugucuuaaaauua

SEQ ID NO: 5540 - RNA, 1867 nt, Mus musculus
cuaggaccuguuccuuccuugaacucuggcuacucacugaaaugcgccagcccugucccacccaccuaaagcuuccucaaggacgugugaagagaugaagguggagaaggcaaguccucgcccacccacccacacacucagaucuuccaccccuaucccccacccucaccucuaccacccguugccccuucucagaucagaaaagucaaagggaguuugguuuuuuuguaguaagcuaaggcaaacauaaggccgggugcacaggaggcuccuucccggcuccgcgcuccagacucacugaggacagggaauaaacaccuguuguucccaucaaggccacagagacuuuaguccgccuccuuucagugagaucgcgucccuggggaucggagcccuacuuugaugcucagcuaacguagcuucccccagcuggagcuccuauucugugcaccugagucuuaugucuuuccuggggaggcugggccuucaggaggccgagucacagucucgccauccugaaguccacagcagggcucugucucaagaagcugcgagcauuugaaggccucguucaauacccaagcacucagagagaaggagaggaagggcagggaagagcuuucuuaccucgcauuuccuucuuccccagcuccucagaccaguaggggccaagaagaguguggguggacccuaaaagaagugacaaguuuugagagcaggugugauguuucucuaacuguauccacaauuacaaccaaccauccaguuugacuaaaccuuagauuggaugucaaggcagccacagcacagugugaagugagguaaggggggagagagguuuaugaauaagcuuuugcuaaggaccugucaaaucugugucacucucucugaaccugcgcuggcgacaggguuauuuucguuuguuucuuuguguuuuuucuuuugagauagucuuauguagcacaggcuaucccgccacuagcugaggcuaaucuugaacuucuccuugugcuguaaccucccaaguguguguaccaccaugcccggcaggaccguggguuucaaugcuuguccgccaacuuguggucaaaucaaggccuucaugugaaggcgucuacaucuuucagggacaauaacuccaucuuccugcuguguaaauggcagggaaaggggagacugagauaacaggcaaccauccagggcuuuggggacccaaaacacauucuguuuaaucggaggguuuauuuauuuauuuauuuauuuauuuauuuauuuguguuuuggucucggcaguacuggggacccaauauggcacucaaguccucuacaaacuagaucuccuuguuuugggggguuuguuuuguuuuguuuggggggguuguuguaauuuuguuuuguuuuuaguguaauuuaaccuagaacuagaacuagaucagagauugcauaugaaaaugaagaaccaaagccagauggguggugguggcacaaaucuugaaucccagcacucaggagguagaggcaaauggaucagaguguguugguguguguguguguguguguguguguguguguguguaauuguaauuuaaagacaugugcacuacucagaguccugucccguggggagaagcucgccguucugcauggacacuguggauauucucccgagucuucagcugugcuuuggaucccuguuuuauccucaccaaggacucggugagccaggcuggcucucggcauuuggagccucugcccaucuccuuucaacccugauccugcuuccccuggcaggcccuccaucgagcaccccacccuuggcuaccuagaccacuguccucaaggagaauaaaaauagaaggcaccccau

SEQ ID NO: 5541 - RNA, 1877 nt, Mus musculus
cuuuuuugagaccacaacacacacagauuuaguaucaagaugauguuaaaauuggccugugaaaucuggauuucguuuucaugaagcaggaacuguagcuguaagcccuguuuuucucugagugaaagaguuuggguaauuuaaccucguaucuuccaagaaguuagcugaaaacgugagccaacacuguuccggaaccugaagcaaagauguugacauucaguaagauuagacuaagccauugcuccauugcuagcaauauaucuuacauguucaaauuagguucagaugaguuuaaggguuuaaaaugagucaucaucggcuuuucuaaccguauuugugaugguuucgucugcuacuucaaaaccaaaauuaggaaagguagaauaaaauuaugaaaaggcuaaaacccuccaagcagaaagacaaaccaaaaugaaauuuucacuugucaacgccgaagcauuguuaaaaacacacggacaagaacaaaaaaaaaaaagaagaagaagaagaagaggaagaaagaaaauacauuugacagcuucuagcccuagccggcugcauuagcgucuuagagcagggaaccgcaacacugcgcaggcuccuggaucagacgaacccugggaggucucccgcgcaggcgcacgaauggggaagugggcggggucgcgcaugcuccccggcucacuuccggccagccccuccccuccccccucccccgcgaaaccaccgccccucucccuugucgccuggcucucccucgucgccagccucucccucagcucucuccaccccucguggucuccgcccugcucaccgccagcccuuccccucccgcuccauccgggucgcugacggcuugucucucgguccggagagugcuggcggcagcguuucucggaggagccugggaaaguuucacgggcgagccgggcagcagaggcagcggagcugcggucggggacgucggaggagccgugguaaucgccgcggccggcugaaggaggaaggucuugggagcuggagagccgcccagagguccagggagcguccguccuccaucgcuuagggcucucccugcccugagagacccggugagucguugccccccguggguucgggguagugugacggaggcgagcuccgcuggggccuuggggaagggcgccagcguccucaacguuuuccggggccggaguggugcaccgcccucggggaaagggucucccuggggccgaggccguggggcugagcccgguggggugaacccucuccccggcucgcccauagguagcugcgggaguuuggcuggccggcccgugaggcugggugugugcagaccauuccucugccccgggccgcgggagcugaucgugaggugcauggucagagaaagaggaaaccaaacugccuugcguucuccuaccuguugcuggcgagagaacgucuuucccauacugguucugacuuuuuggaggaaaaaaaaaaggguacccaaacgaagcgcauugaaaucggagcuauguuccugucugaugcuagccuugaaaacacagagagagagauagggaaagacaaugcagaacucucuggaacuuucgaguuuuggugucccaaacuuuuucugauaggaguggagugagacagcuucggcacuuucuaaauaaacauaaaugcaagaaaauuauguuuugaaaccucagauucagcgaaaggaauuuaggugauuuuggacagcaaggauaagacugacuucuauuaaugcuucuuaaugcaccaugcuuuuuaaagaaauguaaaggguuuuuuuuuuuuuuuuaauguuaauggaggauucccucacuuguuugugcaccaugcgugcccguagugca

SEQ ID NO: 5542 - RNA, 1877 nt, Mus musculus
ugcacuacgggcacgcauggugcacaaacaagugagggaauccuccauuaacauuaaaaaaaaaaaaaaaacccuuuacauuucuuuaaaaagcauggugcauuaagaagcauuaauagaagucagucuuauccuugcuguccaaaaucaccuaaauuccuuucgcugaaucugagguuucaaaacauaauuuucuugcauuuauguuuauuuagaaagugccgaagcugucucacuccacuccuaucagaaaaaguuugggacaccaaaacucgaaaguuccagagaguucugcauugucuuucccuaucucucucucuguguuuucaaggcuagcaucagacaggaacauagcuccgauuucaaugcgcuucguuuggguacccuuuuuuuuuuccuccaaaaagucagaaccaguaugggaaagacguucucucgccagcaacagguaggagaacgcaaggcaguuugguuuccucuuucucugaccaugcaccucacgaucagcucccgcggcccggggcagaggaauggucugcacacacccagccucacgggccggccagccaaacucccgcagcuaccuaugggcgagccggggagaggguucaccccaccgggcucagccccacggccucggccccagggagacccuuuccccgagggcggugcaccacuccggccccggaaaacguugaggacgcuggcgcccuuccccaaggccccagcggagcucgccuccgucacacuaccccgaacccacggggggcaacgacucaccgggucucucagggcagggagagcccuaagcgauggaggacggacgcucccuggaccucugggcggcucuccagcucccaagaccuuccuccuucagccggccgcggcgauuaccacggcuccuccgacguccccgaccgcagcuccgcugccucugcugcccggcucgcccgugaaacuuucccaggcuccuccgagaaacgcugccgccagcacucuccggaccgagagacaagccgucagcgacccggauggagcgggaggggaagggcuggcggugagcagggcggagaccacgagggguggagagagcugagggagaggcuggcgacgagggagagccaggcgacaagggagaggggcggugguuucgcgggggaggggggaggggaggggcuggccggaagugagccggggagcaugcgcgaccccgcccacuuccccauucgugcgccugcgcgggagaccucccaggguucgucugauccaggagccugcgcaguguugcgguucccugcucuaagacgcuaaugcagccggcuagggcuagaagcugucaaauguauuuucuuucuuccucuucuucuucuucuucuuuuuuuuuuuuguucuuguccguguguuuuuaacaaugcuucggcguugacaagugaaaauuucauuuugguuugucuuucugcuuggaggguuuuagccuuuucauaauuuuauucuaccuuuccuaauuuugguuuugaaguagcagacgaaaccaucacaaauacgguuagaaaagccgaugaugacucauuuuaaacccuuaaacucaucugaaccuaauuugaacauguaagauauauugcuagcaauggagcaauggcuuagucuaaucuuacugaaugucaacaucuuugcuucagguuccggaacaguguuggcucacguuuucagcuaacuucuuggaagauacgagguuaaauuacccaaacucuuucacucagagaaaaacagggcuuacagcuacaguuccugcuucaugaaaacgaaauccagauuucacaggccaauuuuaacaucaucuugauacuaaaucuguguguguuguggucucaaaaaag

SEQ ID NO: 5543 - RNA, 74089 nt, Mus musculus
ccaccgccccucucccuugucgccuggcucucccucgucgccagccucucccucagcucucuccaccccucguggucuccgcccugcucaccgccagcccuuccccucccgcuccauccgggucgcugacggcuugucucucgguccggagagugcuggcggcagcguuucucggaggagccugggaaaguuucacgggcgagccgggcagcagaggcagcggagcugcggucggggacgucggaggagccgugguaaucgccgcggccggcugaaggaggaaggucuugggagcuggagagccgcccagagguccagggagcguccguccuccaucgcuuagggcucucccugcccugagagacccggugagucguugccccccguggguucgggguagugugacggaggcgagcuccgcuggggccuuggggaagggcgccagcguccucaacguuuuccggggccggaguggugcaccgcccucggggaaagggucucccuggggccgaggccguggggcugagcccgguggggugaacccucuccccggcucgcccauagguagcugcgggaguuuggcuggccggcccgugaggcugggugugugcagaccauuccucugccccgggccgcgggagcugaucgugaggugcauggucagagaaagaggaaaccaaacugccuugcguucuccuaccuguugcuggcgagagaacgucuuucccauacugguucugacuuuuuggaggaaaaaaaaaaggguacccaaacgaagcgcauugaaaucggagcuauguuccugucugaugcuagccuugaaaacacagagagagagauagggaaagacaaugcagaacucucuggaacuuucgaguuuuggugucccaaacuuuuucugauaggaguggagugagacagcuucggcacuuucuaaauaaacauaaaugcaagaaaauuauguuuugaaaccucagauucagcgaaaggaauuuaggugauuuuggacagcaaggauaagacugacuucuauuaaugcuucuuaaugcaccaugcuuuuuaaagaaauguaaaggguuuuuuuuuuuuuuuuaauguuaauggaggauucccucacuuguuugugcaccaugcgugcccguagugcaggaagccaguagagggcguaggauugauucccugggaggaguuacacacagagagcagccaugugggugcugggaauugaaucaggauccuuuaaaagagacaucucucagccccuuaauguaugucuuucaagcgcagaaguuauauagauuuuccuaucaaaaguuaacccugccuccaaccuggucuuguuuggaaaaaaaacucagcaguccugugauuguuuuucaucuuuaaguaauuuuccuagagguauguauuauaaucacauugauuugguuuuaaaauuaaauuaguagagugaguucucgaccuuagcauuuugacuuauaaaauggagucgauuguuugaaauuacgacuugauaauuucuaauuuuguacauagcuuauuaguacaaauaaugagaauagucuacuuuaaauuguuauuuuuuuucuaaaguuccauuauuguuuuuauuuauguuacagauaagaacuuccauuuucuguugauguggagguagguaucagauuguucugugggggacuggaagauuauguuucugcaguuggcuggauacuugcuuguuugggcauuggacacaugccuuauuuacuguucucauuaaauguauguaaacacgaaaaccuaauuucauuagaguacuuauauagcagaguuaaagccaguuacuguuuuaaguuuugcaaagaauaguagaaggugaugucauuuccuaaacauuuguauauggcccuuuaaaacugagagaacugacugucaccccaagcauauuauaaguauuaaacaagugcaguccucauuuuagcuuaacacucgaugagagagcagcuugcuuugaggucuuacuaacuuuuguuuuucuccucagacauaggguaccucccaguuuccaguguuucagaagggacuuuuguauugaaacuggaagaccaaggucauuccaagcauguugugcuggggcaaugcauccuauggacaacuagguuugggaggaauugaugaagaaauuguacuagagcccaggagaagugacuuuuucgugaacaaaaagguccgagauguaggcuguggacucaggcacacuguguuuguccuggaugaugggacuguguacacauguggauguaaugaucuaggacagcuaggucaugaaaaguccagaaagaaaccagguacgggacauuucucuauuucuaauaauugaucauuuauuucacucuugaaaugguguuuuguaugaccucuguaaauccuaaacuuacaggcuuuuucaagauuuaaaagcaaaguaaaagugaaacauacucuugaccuuccugugcugcuuaagaaguacauuguguguguguguguguguguguguguguguggugugggggggggugugggugugggugggugggugggugggugugggugggugggugugugugugugguuguuuguuuguuuuuauuuauuacuacuacuagugguugaaaacaguaacaaaaaacccuagacuucaguguuuguuuucuuuuauauagacuauaaaguuaucaaaaucuuuaauaaguucagcuaccuugaacagauuuugaauuccuaauuuguucucugugaugauucuguacucauggggggaugguaaaagcuuuuuauuuucauuuacuuguguaaauuauaauucuuccauuuuauuccccauuuuacuuuagguauguaauguuuuguugcuuaguuagaaguacuguuuaauccccuaguugcugcuuccacguuuucagugcuagcuuuuaaaggguugugaaugccaggucugacuauggagagagaucuaagcacaauguaaaauaauuuaucagguaauaagcauuggaaacauuuggucagauuucaugguguuuuucuggauguuguauuuaaaauuggguaguaacacauuugagguggaauuauuagauauuuugcucucaguugugauaacccaaagcuccuacaggaaggcaguaaauucagaggagaaagcugccgugcuguuugucacaguaacacacuuaggcguucccugugguaauccuuguucucugucaucccauuguaggagguguuuaguugguugguugguuuucuuuuugguuuuuuuuggguuuuuuuuuuuuguuuguuuguuuuugguggucuuguuuugagagaucaacauagguauaaacacucaggcaauuaauugaaguaucuuucauaccaucucuccaccacugccauccuuaacaccuaguacucuuaauuugcagauacuguaccuuuuauucuuuguggguaggaucuuaaucucuucucauagccuguaacuuauuaccucaugauauguaacuugauuuuaaugaaugagagcauuuccuuaauaaagugggucuaauuauuguagaacucaaagcagaugaauuuucuuguauuacauuucacgaaagaaucucuuaauuauaccagauuuucauaaucucgggcacugaggugguugugggugguaauuuacuaucuguacauuuugcuuaugugggaaugcuacggcagguugagguuuucaugguguuauuuuaguguuguuuagaucagagcccuccugucuccccaccccaccuccacguguaccaguaggaaguauaacuuaaaccgcagggauguguuuggggaaagcuggguguguuuuggucuuguugacauugugauggcuguauugugacaucucugucuucugugaauucaucccggaagcauuauuucguaaugcaaaguugaagagugugcuuccacuuuagauugacucguugguguccaggacguagcaaacagucccuagaaaaggaaaaaggaaagaaaaaagagcauuguuuuucagagauuuagaguuucaauugggaguuaagacauacauaaauggaaguaacugaagagaauugaaauuuuccaugauauuauauguauuucaagccuugggaauuugaugagaaaaauaugugugauugagugaaaggaauaaugguuuaauucugucuguaguuguguaaauagcuaguaaauaagucuggugcuauagaauuuuauuuuauuuuauuuuuuauuuuauuuuauuuuauuuauuuuuuuauuuuuauuuuauuuuauuuauaaaagggguuagugggggagcaggagggcucugaucuaaacaaaaguccugguucucugguaccuugaaguguaacuagagauggaagaacucaaggaggugugauugcucugacaggauuucagcuuucaaccucaguuuuuguuucaagugcaugagugguaaaccuuaauaauguuuuaacuaaaguucucuuuggaaugguucuucaauguuuuaaaugugcuuucccuguuccuuuuauaaauugcuaaauuugaggggugaguuuaaagaugagggauugucagaacuuaauuuaauugguuugaaagacuugauaauugacuagucuuuuuaucugucugagucacaggcaguucuuuuaucagagcuuuacucaagucuacaaagaaaguagagaaaagccaagaauuauuucuuuacauagacuggcuuuauaaccauagcaaauaguuguaaugaaggaacagaauuuaguaucauuaaggauuaguuacucagccaggugagguggcucacgcaggcggauuucugaguucgaggccagccuggucuacaaagugaguuccaggacagccagggcuauacagagaaaccuugucucggaaaaaaaaaaaaaaggauuaguuacucaagucacguggcuuacuguaggaguuggccuugcuguuuaguaguucggaccuguaaccuguugggaaaguuuuccauucuggauauuuuaggaaucauauaaacacuuucugacacccuuuuauuauacuaagaguguggguuaaguccauguccaucucuggucucuuacauagguaugaaccucuagcuggccuugaacuugcuauauagacuaggcuugccuccaauuuagcgagaucugccugcuucugccuucugugugcugggauuaaagaaaggacaccaccauaccuaucuuauuuagagaccuuuccgaauuagugcuagaaaaaugaaugucuuuuucaccuucaugcauuuuuuuuccuauguaagaacuucuaaaaauacuuuuaaaagcuaguuucucaguuucuuaauucauagcuuacaaauaaauacauuuauucaguguguuauaucuguccauuuaaaugaauuguuuuauucacauacuucuagauuuacuuaggacgauuuaaaaguauauuuuuccuaacagguuuauuuacucacaauauauuuaguuacaacuuguugacguguuuuuacugguuucaugguagaaguaauacuaagcuauuuuaugauuguaaaugaugcuauaauuuuguuaaagugauuguagguagcuuucugugguucuccaaguucuuucaaauguaguaucucauugaggcucgcacacugccugcuguuagucauuagucaucccggcgaaagcauuuuggucccagcaguagcuacuugcuucccuuucuugaguccucacguucugaccuauucuuucuguucauacaacauaagugaaauguccuuuuauauacagcuggguuucuuuaaaacaguguaggaaauacauaaauaugguaaauuauuugcagauuagaauaccaaauuaucucacauauuucuuauuuuaucaaaacauacaagauugaagcucaauggguuuuauaagucuuaguuuucauaauaccuucuaaggaagagaaagauguagguuauacaaagacuuggaaaaaagaauuaccuaggucaggaugucagacaugcuuugagcacuaugagaaucagugcccaggaaucacagcgcagguguaggggaaagucauaguacaaacagaugcuacuguuagagagauguauaauaauacuuuacuuuguauaggaccccacaucugaggaaucucaagagcauuacacaauaauucaugguuccuuucaaaaugcuugugacacaaauugcaagaauuauccucaucuuaggggauaaguuuucggagaaauggcagcacaaguugguaaguaacuugucaaacagcagguggcuggugaagagcuauagauugaaucugaaagcuuaacccuaccagucuccuacuuuauucacuaaauugugcuuauguuuagcguuauuuauaauaauagcuucugccgaggcagaucaaacacuaaugcagauuguuccuuugccauucuauuagauggccuguugaagugaaucaguauuucaccaagauugcauuaugccacugugugguagaagcaguauuuuuuacuuuuuuguuacgcuguaaaucaaaccuagcgccucauacauguuaagcaagcacucugacacucaacuacacccaaccccaagaacauuuagacaaacaaagcucacuuuucuuauuucuguuuuguuuuaucauauauuccuuuauugucuugacuguuugcugguccaucagaaggcuguagugauugcagugcaggguugauuggguggcuggcauucgaacuuaggcuacuuaguuauguugugucagggcugucucugggaugcauagguuuaugcuuuauaaaacacgcucucucuuacacacacauacacacacagagacacacaugcacaaaugucguaaaauuugguuucacaguuugggugaauaccaaggaauaacaucagauggcagccugaggagucaguucguauuauuacucagauuuuguuguucuaguuuuugugauagggucucacugugaaccuuuggcuggccgugaacuugcuguauagacuaggcuugccuccaguuuagcagagaucugccugcuucugccuucagugugcugggauuaaagaaaggacaccaccauaccuaucuuccuuagaggcuucuuaggcuuccauucucaguauucuguauauauguagcaugauucucaugcacucuguguuaaaaguuguugugaagaaauaagagugauucccauuuuucuaaacuauaaagcauauuauugaauguugggauauuuaaaaaaauaucccaacacagacauugugacaguacacaugauuugggugagauuguguaggauaaggaucaguaaaaggagccauauacaguagcaagccccugcucucuccuuucuguugcacucacacuuuguugcuagaaagcaaggcaauaauacaaacaaggaaaacggugcugugucuagacaacauauaaaaauauaaaacauuugcuagucauagugggauucacucguaauuucaacacuggguuuacagcaaaaggaucaagacuuggauaccagacuauguuauauagagauacauucucugugguagcugaucugacugucucugacuguggcuugucccuccugcaagccuguguguccgcacuacugggagaccaguucucuuggggggaauuuggauauggagagcuguggcauagggucagcucuggggugcacacagaaaccagaaggauccuguucccagcuguuccuugguuccuguguccuuauggcucugggcgggucccucaaagcagaagugguggucuuaccugugcucacagguguguuggcacuccugggagaccagcucucuccuggcaguauuuggagcucugucacgggaucagccuagagauacauucucaccaacaaaaaucaaaacaaauuuguucuaguuauaaaaggggaauuuccuaaccauuaguacugcuaaaauuuuauuuaucuggacuuaaucuucugucuuauuuucuagcaugguauuguuuuauuuuuuauucuuaagacucuuuaguaacacauuuucuacauacuauucaaaacuaauacuuucuuacuguaauuugaagugcuggagagagagcccagggucuaauauauauauauauauauuaaacuaauauauaccauacuaauaaguaaguauacaguaccauuguucuauacccuagguccucgauccuuuaucaguauauagguuuagacugauuuguuccuuuuuuauacaauucugaucuacgguuuuuuguuuuuuguuuuuuuuuuaaauaucuuuuucugguuaaaaaguaguacauauucuugguggaaaaauugacaagucuaagaaggcaaaaaucaguguaaugacaucuugcaaaaguauucuuuuuugcauacuuucuuauguuucugauuacaaauuaagaauguuuuucucaaccuguuuucaaugauaguuaaauaauuauuuuccauauuaaaaaaaauuugaggggcuggagugauagcccacccuuuaaguguaccuggcugcucuuccagaggaccaucuguaauucuaguucccuagguaaaucaauacccucuucuggccuccuugggaaaccaccuccuuugguaugcaugucauacccaaacauacauguagacaaauauaaacaaaauaagauaauccaaaaaauuugaaauuguugacaagugauaauuuaauauucaagauuuuuuaaacuuuauuuccauauuuauauaucuauacauauuugccaugacuguucauuaucaguuuaguucuuguuucaagugcacaugcucacaagaauuuuguuuguaaaugaaaguuccagaauacauucuucugacaagcuucugacuacaauauaaugagcaucguuugaaagucuaguaaggaaaagaaaacaagacacaaaucauaggagugcagauaaauaugagcagugcuguuuacagagugacuguauggaaugguagcucccaccuguaaucuucagacucaggagugcuggacaguggaguccagucugaucugguuugcaauaguuggguccuguuucagaagucccuaaucccaaggacggugcuagaaccuugugaaacagugugguuuacaggggugcguagcagaggugaguaggaaagauagauauucagugcucuuagagcagagagugggaagugcaucagaggcaaacuaguucaaaggaccacaggcaagugucuuaccuaggguuucuguugcugugaggaggcaccaugaugacaacaacucuuauaaagggaaacauuucauuggggcuggcuuacaggucagagguucaguccauuaucaucauggugggaagcaugguggcaugcaggcagacauggugcuggggaaggagaguucuuuguccaaauccacgggcagcagaagaaacugugagccauaguggguguagcuugugcauaugagaccucagugcccacccccacaaugacacauuuacuccaauaaagagaccacaccuacuccauaaggucacaccuccuaauaguaccacucccuaugggccuguggagaccauuuucuuucaaacagccacagcaaguuuaaugcuuucuagggaauggaaaucuuucuaaauggaaugucugagaauagagaacauaaaaauuauauacaaucauauauauacacucauucaucuguucauauaugauguucauuauauuguacccagaagcuuggaacugucauuuaacaaacauccucacaagcauaggcacuuguaaaaugaucuacaacuguguuucaacaggucgaacuuuuaauuuggcuacuaggcacuaauuauuuuuuuuaauuuuuaaucuauuuuauguauaugaguacacuguagcugucuuuagacacaccagaagagggcaucugaucccauuacagaugguugugagcuacugugugauuguugggaauugaacucaggaccuuuggaagagcagucaaugcucuuaaccacugagccaucugucccuccugacauuaauaguuuuuaaugguauucacugauuuuaucaaggaagaauugaaggaaggagaauuuggaaaguaauuaguuuaacugugauaauauuucuuuaaaacacagaagagagauuggcagaccaaagauggacagccuuuguuaacuuacuggaugugaauugugucucaguaaauauugagcgagccagcccuggcccagguggggucacugguugggaauagggaaugugaggugugagcacuguuaacuauuugaagagagaagauccggugagguagauuuuauugugaaugugagagcaguauucaguggacaguauggaauuaaaagagagaaaaucggaacuaaauucauaaaguguugauuuuccaguuuugcuucucccuauguguauuuaauuagguagucuguaaauuuuuccauuguuccaauguaucaaauaauuaauaacaaaguuauuauuuugugguuagaauucaaucuuuuggaaacuguuaaaauuuaaaguaacuuguaaauuuaaagugucauaaauggcugucuacuuuaucugucuucuauuuuguuauuuuuuguuccuuuugagaugccugguacucauggcuacucuccugcuucagcuuaccaaguucugagauuauagguguaaccuguacccuuaguuuuauuuguuguuuugaaguugaauuuuuauaaaaugauaagaaugucuguucgucagguaccauuugauagcuugaucacuugaauuuuguauugcuuauugcuuaacaaacacaacccuaucaguuaguuucuguguuugacuccaugcuuucuggguuacucguaguugaaauaaccaugaugauaaacuguguuuuuggcauaggagagaguuccucugcuguacacucuuuugugacaugaaaguaguggggaaggagcuagaguaagacagagguucucaggaguggagggggcaggagcaucugaagcgcagcugggggaagguggccugcuuuucuuauuaacucguaggaauuugggauuuuauuuccuuuuaauauugucauguaagccaggcagugguggugcacaccuuuaguccuagcacucaggaggcagaggcaggcaaaucucuugaguuugaggccagccugguuuaucauccagagugaauuucaggacagccagagcuacacagaaaccccgucucaaacaaacaaacagacaaacaacaaacaaacuaucaaauugagugcaaaacucagauugcuguccagaauugacccaaaguacuuaugaguugguacauacauauuuucugcuuaugaauugguacauacauauuuucugauccaagcauuugcuaguuauuuccuaacuuuaacaacagucaugaaccugguaaaacuacaauuaccuuuuuaauaguuuauuuuaaauuacauguaugugucuuuguguggacaagcaguauguaguacaauugcugucagaugcccauggagcuggaguuacagguggcugugagccaccugguguagguucugggacucaaacucuggaagagcaguaguacuugcucuuaaccaacaagaauacuuauguaaaaagcuaguuaguuaucucuguaugaacauauguuuacacauauacucaggugagcaguugaguaagucugcaaauagaaauaggaaggaaagcauuuagaaguugacaugggagguguauagggaggagggaaaaaacaugggaaacuuuaaaaaaaggaaucuuaauaaacuauuauuuuacaaauaugcugauauucagaacuaguaauagcaaccaccauuguguaucaugcccuguggaauccuucuguauuaccccauuuauuguugucugagaccgacgcugcccuugaguuaagcagugaugggauuacagguuugcgccacuguguucugccuuguuuuuguggguaaggaaaauaaggugcucuucuaaaggacugagucugguuucuuagcauccauagaacuaccuguaacugcagcucauggguguuucagugcccucuucuggucuccacagggaccuauacacauguggcauauucauucauugucuguaugucugucccuccaacuucgcacaauuaacacagugaaaauaaguucaauggcauaauagaagaaaacaugccuuuuauaauaacaguaaaaaaaaguaauaacuccgggucauuauaaaacuguguaaaaguguaagaccuagaugaagaauugaaagcccugucugugcuuuuuaucugaaaauuucaguuucugggacaccgccuguuagcuggauuuuauugcaacagcauuuuauggagauuagaaauagcuuuaauguuucuuuuggaaacuggcaaaauuauaauuuauuccuuuuggaaacuggcaaaauuauaauuuauucaaccaccguaauuguagugcuauguaguugaggucugguauggaagacaucuaauauacuaggaaagaaauaacgagguauagaagaauguaggaaguuagaucaaucaaaagaaaacaucauuuguauugacuuauagauguauucaaacagguacucaguaguuacuguaggugcagaggugggaggaaaacaaguaggcugaugaaguacgugaaggacaggcuucgcuuuguaucuguuuggaaauacaguguuuaaaagguaggaauugaagaacuuagauguaguccuggucuguugguuguaggucuauuguuuuguacauugcuuauucuguaugucuuaguguucugaucuauuaaauuaggauaaucaugauaaguucuugcagguuuugggguuaggaucaagugagaacacaugcagugcuuggcauguggugagggaguauucaguagacgucugcuuuuuaaauaaagagcuacuaauggugcaguuggggagggcacacagcuagucugccuaauaccaaguaggggauuagauugucuucacauuuaccugauaccuguuacauguccuugugagaaacugugucauucacauauuugcuuccagauagcuuaucucuuuauuauagcuaaaguuuaggcauuuauucaacaaacaguuguucuuaugacuuggcuacaccaagcacaaaaauacuucuuuaaagaccuuguuguaacuuuuauucaagaacugugcuaaaauauuaaaaaaccaaaacccugugaugcuguauuugaacuagacaaaauggaugggguuccuucaccuucagauguaaaaggugacuugggguaggggagcugugauacuuccuccugugagaagcauggaaaugacagaguuaaaguugguuauugauuaucuuaacuuaaacacuuguuugguggagacaagugugcaugugcagguuuacauggagaggucaguagagaaccugcagguguuggcuuucuccucccauuguguguguagguccugugaagggagcucagcagacuuaguggacagcccccuuuaccuuggggcaucuuguaggccuagccauugauuuuacaaacgauuuaaugaguaauuacgaucgauguauaguuguguccugauauuuuagaaaauaaguauucaaauuacuauuauucagguuuuuaaacauagcugaacugaaaugaugaacugaccuguaagauguaggaacaaaaaaacauuugaucaugccucuuguuucugaguguauacuucuuuucacaccgauaugaauauauuuuuuucuuacuuacuauagaggagaaauuuauaugucaagaaaauuaaagcuuuucuuuccaguacucagggaggcaggggcaggggagucucuggguuuuaggacagccagggcuacaaagagagacccugucucaaacaaaacaaaagaaaacaaaacaccaagaaagaaagucgagguguauauguguggaguuacaacagauaagauugugagaacaggaaaggaguguugaaaguggaagugauugugauuuguuagucuguuucauuuucuccaaaaccacuccucaucccucuauuaucugccccuugaccucacaccugagauugaucuugggcuccuuuccuugucacaggaucgguguuggcuguguugccaacauuuggcauuuuacccuauagccuguuauuuuauuuccuuugcaaauggaugugacccuuagcucauuacuuuaaaucuuaggccauuguguguauguauguauguguguguguauauguguauauauauauauaucuguguguguauauauguauauguguguguguguguguguauuuacauauauauauauagcuagagagagagagagagagcgagcgcgagccagcuuaccugugccaggaggaugauguacaacucacauaguaagacacucucucaaacaguaacaucaacaagaaaaucagaauuauucaccaaucccaaagugauuaauauccuuauuuuuuaaaguaggaauaaaaaaaaaaccucuauaaacuuuuguguuuuguauauuauaaaauucaguuguuuaguaauuaagggaggggaggaggaaagcacagauaauagaguugauaguuuaguuugcaguucuucucuguauaaaaguuugggcuaucugguaguguuuuuaagugaaaauggaauucuguaugugguacugaaggaggcaggguuucauaaaacccaggcuggagaauggccuugaacccuugauccucuugccuccgccuuucaaguucugggauuacaccaucuaacauuaaaaauaaaaggauuuugaucauguucuuuacacacacacacacacacacacacccugcagaucuucccuaguuucccacccaacuuuauguuaagcagcaucccucccccaaucaaacaaaggaagaacuaauaagguaacauggaugcaaaagccaugaagucaguuuugugcugucaaacuacuccuggccuugggaccugcccuggaauguggucgauacgcccaaugaacccucccuccauuggagaaaauggacuuucccuuucacugcagauagcuucuugguuggggguggacuuuuuauccaguuucucuucuuuguguugggauuuucucuggucugaaccuguguaauucuugugaguucugucacaguauccgaguucaccaguccuauugugucuggaagauuacuuucuuggagagucacccaccaagucuggcacuuaauaccugucugucucuuuugcauggauuccuaagccuugagggggagggcuuugauagugacauccuguuuagggcugagugcuccaaagucugucucucugcccguuguccagaugugagucuguguuaauuaccaagaagcagcuucucugaugagggcugagugauguucuucucuauggauauagcaguagucauagucguuaaggguuguuuuauugcuauguuccuucagcugaauaaaagcaguagguuuucuucuaaagcccacaaccuauccucugguuguuggccacuuuuuauuuagcaauggguguugucucauggagugggccuuaacugcagucagagagugguuggcuacuccuacaauuuuugugcuacuauuuguaccaccuuaucuugcaggcaggucacuguuguaggucaugggauuuguagcuggaagacacugauuacuuuuccgcuucaguagcgugcaaaguacauuuuacauuucuaaguucuauauuugauguagguaaccugcuggguaucacaguuuaacaaaaagaacaugcgggucucugucuguuuccuguuuucaauguaauugaaagcugacugcaccucugccacagcccagcaaucacaggaacacaacauaccuuaucccuagcucugggaaagaucagaacaguaagugcaguuuccacaaguuaccuauagcuuuugcaacauuauaaaauuggaaauuuauguguuuaacacuaucuuacuuguuauuugguugguugguugguugguugauuuuugagaccuggucuuccaauauuauauaacauuggcuggccuugaacuaaggacaguucguuagccucucaaguguucaacauguagcauuugccaccacuucagcucuguuuuuuuucccuccucgauaaagggguuuuuauuauagcuccugguaucuggaauccaugaaucucuuguaggagccucugcugugucacugugcucaguuucugauauguuauuuuuguugucuuaagauuuauaauuauuuuaucuuuuacuuuuuucuuugaccuuuuaguuguucaggaguauguuggucuaaauacccccagacagacucucccuuuguaacccugacuggcccaagaccuguuauauagacuaggcuagccuaaaacucagagaucugucuacuucaaccuccugagugcuaggacuaaaaccaaucacuacgucuauuguuuuugucuauuuaucaagauugucuccuguuagugauuucuacuuucaugcuguuugugaucaaaaauaacacuuugguaagauuuuugucuuguugaaauuuuuuaagccuuauuuugugguuugacgaaagaguguuccuuuuguauuagauauuaggacuauuuagucuaaguuaaagucccauguagucaguucaguauuucauggguguuuucuguccacuugauuaaucuauuguuaaagggaagggaucaagucccuuacugcuuuuggaguucuuuuugcauguaugucucuugauacuuacuugcuuuauauuagguguuuugguguuuggcaaauguucugugguaauugauccuuuaucauuagauaaugacguuuagucuuguaagagauuugauuuaaagguguuuuuguuuuuguuguuguuuuuaaucuaauguuaaguauagccacaggugcucauuuuguuaguuuacuggcagucucugacagccuuugacuuaccuauacccccagcacaguagauaaaauauguguuaagacuuaguucaugcagaagaaaguuuuauucauuuugaaauguaguuugaauuugccuuuuuuuuccucuuggaguugagcaucuuugaaauaauuaaaggcuaaugguuuuucugagugaaguucuugucuuuacuccaguuuugauaugaauuacugaucuuuucccuaggaauuucccuuuaagaauuggauugggcuugguggugcccacaguacucaagagaugaggucagaauauugugaguucaaggucaaccuaagcuauauagugaggcucugccucuuuagugaaugaaugaauuaggaaaguuauuucuuuuucugagauguguauaacauuuucccccaucugucuuuuuacuuugauuuaucuuuguuuugcuguaguaaucugaauuuucuuaauggauacucggaucuucuuuuuccugucugagcuuauggcuuaaguaucacugucuuccagaauccuuccaaauguguuuggaagccugaaugagcagcuugugcucacaagcugucuucucaugucuguaaccuuuaucccaauccuauuucuucuauuucucucagacuucacuuuuguauuucagcaguuggaggacaaacguguguauuucgauauuaauguacaguauuuuauauuagaugcucauauuacauuugauauuaauguacaguauuuuauauuggaugcucauauuacauuugauauuaauguacaguauuuuauauuagaugcucauuacauuugauauuaauguacaguauuuuauauuggaugcucauauuacacauuagaauuugaugcuuuugguuucauagucauucagauccaauuuaagugcucuuaauuuguuaauuggaaaagcaaaaagucuuauucauuuuuguauuguuuucuuuugcuauuuucuuugagaauuguuuuaguaagauaauugaugauaagccucuguuauugauaacagauuucuuuuuuuuuccuuguaauuaagauuuauaggacuguuuguguaagcuaaugauucuuaguuuucuugauuuuuagaaagggguuauguuacaucuuguuaucuuuuguguguauguguuucuguaaugauuuuauuaaaccauauacaaaguaauacaaagagugagaaauugguguaauaaacuugagugaguguacuggggcaccgacuugaggaauucucgacuugcugggcugguuaugcacaccuguaauccuagcgcuugggaagugggaggcagaggaaggaagauugcugcaggcuuaagcuggccugaucuacuuaguaaggucagguauacaaaaaggucuaaaaaauagguuauccacucaagauacucuaagguaagugcuuaguguaucaguagaguuguguggauuccuagauguuaccuagcacuauacgccuacuuaaaaaaaaaaaacaaaaaaacaaaaucuuaauccagauauaauuugaaaugcucuacaugcaggaaugucaguuugcaugaugcagucaguuucauuauuggauagcauuauuuacugugcucucugguugauggaguuugacuugcuuuugucaugaggcuucugguguauugaagaugauaauuauaacguucuuauuaaucuuuuuuuuuucuuccccccuucccuucugccucucuuuugcccugcuugcuccaggcccgcucgcuuauuccgggcccauucuuaauaaccuuauaaacuuaauuuuaaaugucauguuaaaaaguuguaugcugguaaaacacuaccaaacauuguguauauuuuuauuuuuguguguacggguguuuguccugaauguuuaugugucuauuguaugcauucaggccuuuggaggccagacagggcaucagauucucuggaauugaauuacauaguuugcaaaccagugugugcaugcuggaaaagaacccagggcagcuauaagauaccaagggcucuuaaucucugagcuuucucuacagcccugacacugggcaucuuaaagaaacguugguugucacuggcuggcuacuuuugauuuaaaacaagcauauuuugaccauauaaggggguuuauaacuguuggugcuaaaauagaaauccauaaacuaagacccaccauuuauaguagcccuacuacauuuuacuucucuauucagaauauccaaccuguuuuucuauuuuaaaaccugagccuggagugauggugguauauuauaugcuguagucuuaguacuugggagugagaggugggaggauccaagguucaggccagccugggcugcaguagugaaauucugccucaaaaaacuaacaagccaggcgugguggcgcacgccuuuaaucccagcacucgggaggcagaggcagguggauuucugaguucgaggccagccuggucuacaaagugaguuccaggacagccagggcuauacagagaaacccugucucaaaaaacccaaaaaaaaaaaaaaaaaaaaaagaaaaccuaacaaaaagaaauguuaacgaauuaccaguucagauuauuucauuaugaauacuauacuguaguguguaugauaaaaauaaguuugaauuguaauuauagugcugaaauucccauagcccaguuuauuuuuaagugauuucuuuuucaguguugauuuuaaguaagaguacagucuucugagaugaucuugauaaguccagauuucucuaggauguucaggucauuuauuauaccuuaucauaauaauuaucacagugagaguuucauaaugagaauuguauaugaaacauauuuguuaauuuuuucaaaacaacugguugcauuuuauguuuuuuuuuuugggggggggggggguccgagacaggguuucucuauagcccuggcuguccuggaacucacuuuguagaccaggcuggccucgaacucagaaauccaccugccucugccucccuggugcugggauuaaaggcgugcgcuaccacgcccggcugcgcuuuauguuuuagcaucuccuuauuugauagaaaaugagaauugaauauauuuuaauccucaauucaagcucaaaauuagaguguaauguuucucuuccugacuuuuguucuguagagcagguuguugcccuggaugcccagaauaucguagcuguugcguguggagaagcucacacguuagcgcugaaugacaagggccagguguaugcuuggggucucgacucugacggacagcuuggccuacagggaucagaggaauguaucagaguacccagguaacaaaggugaccgcacagagguccuuaagcuucuauaauaaauuuaucuaucuaaaucauuuuguuuacugugcucauguauuguugccuaauuauuucucuccuuugaaucuuucaagaaguuacuaaguugguucuuguuaaugauuuggguugaaguauuugguuaaguaugaguaauacuuacauaacugauauuuacuccauaauggauagaauuucuguucauaaaaaaaguaggaauuguuuucuuuuagaauuggauagacugauuucagcugcugguucuacucugucagaugucccagcuauugaaauuuuuauuuauuuauuuauuuaucuauuuauuuuuuggauuuucgagacaggacuucucuguguaagcccuggcuguccuggaacucacucuguagaccaggcuggccucggacucagaaaucugccugccucugccucccaagugcugggacuaaaggcgugcgcugccaugcccggcugaaauauuuauuaaauacugauugguugcugagcaugguguccaaugccuuuaaucccugcacuuaggaggcagaggcagauaaauaggcugcucucugucaguuccaggccagccuggucugcagaguaagcucuaggacggccagagcuguguagagagacccaaucucaaaagcacaagcaaacaaauaaaauaccuagugguugcauguuucucugauuuuucuuuaaaaaaggauuuauugguuuuguuuguuuauuaauuaaaucuagaaguccauuaaaauggaaacccucaguacuggguauguaccaccaugcccagcucuugguuuauaucuuagaaggaaaccauuuagcuuuuauccacuauaauguuaacuuuugcuuuuguuguuuuuuaagaucuuauuuuuuuauguguguguuuuuugccggcauguauauauauguauguaccauaagaguaccuggaacccagaaaagcagaagagaguaucaaauucuauggaacuagugcaguaguucucaaccguccuagugcucccuuuaauacaguuacucacguuacagugacccccccaccauaaauuucuuuuuuuuuguuuuguuuuguuuuguuuuauuuugagacagggcuucucguguagcccaggcuguccuggaacucacucuguagaccaggcuggccuugaacucagaaauccgccugccucugccuccugaguucugggauuaaaggcaugcgcuaccaacgcccggcuauaaaauuauuuuuauugcuuuauaacugugauuuugcuacuguuaugaauugcaguguaaguauuggauauguagccccugugaaaggguuguuugaccaucccuaagcguugagaaccacugagcuagagcaacagaugguugugugcugacaugugggugcugggaaccaaauaugggucucucugcaagagcagcaagugcucucaaccacugagccaucuccccagcccuuuguugaauuucuuuucuuaucucaacauaauaaagacuuuuuauauaugccccccuugcuuuugugaaacagggcuucucuguguagcccugacuauccuagaacuagacaagguuggccucaaacucacagagaucugccugccucugccucugccagaauuagagguaugugcuaccacugccucaugcaauaugcccgguuuauaccucuguguucagccucuagcuuccuuuuuuguuguguccuuacuugugauuaguaucagaguagauggauucauuucucugaguuuuuugaaauaggagucaguaagaaagacuuuuuuaagaaucaguaucaguucuguaaauguuuuuuagaauuuagcagagaagcucuuaggucugugcuuucuuuuccauggacacauuaguauugauucuaucuugcuccuguuacaggucuguugaguuucuugaugguucuguuuugacaaagcgcuuauguucagaaauugacuuguuucuucugggugaugagguuuauuguguagaguuguuuguaauagucucuaauguccuuuguaauuuuguaucacuuguaaugccucccuuuucaucucugauuuuauuuuaaauaccuuuagcauuucuuuugcauguauguguauaugugggugugcauaugcagcagugucauguguggaagucagaacaacgugcaggacauagugcuucuccgucgugaguuccaggaguugaauucagaucuuuagacacggcagcaagugcugcaguacugaaccaucuaguuggcccaugacuacuuuauuaaucuacuuaggaggaugcccauuuuugucuguugaaaaacuuuguacauuuaaacaaaaaaaacaaacaaaaaccaacucuauuucuuuauuucuacugugguaccuauuuuucuuuccauuuacuaaaguugggugcuuuuuguuuuugcuuuucuugaucuuugagauaagaauggauguuugcaggguuuuuuuuucuuuuuuuuuuuuggucuuauuuuaacguaaguacugauugcugaaaucucaguacagcuuuccuguaguccauagguuugcuguguuuuuauuuccccccuuuuaaagaaaauuuuuccucuuuugauccauuugauuguuuagaacuaagcuguuuaauuuuguauaguuauuuagucucuaguuguuucuugcuacuaguuucuaguuuuauuguauugugacugaaaaagauaagauuuuguaaaaaaaaaaaaaaaaagaagauuuugucggggcuggugagauggcucaguggguuagagcacccgacugcucuuccgaagguccugaguucaaaucccagcaaccacaugguggcucacaaccauccguaacgagaucugacucccucuucuggagugucugaagacagcuacaauguacuuacauauaauaaauaaauaaaucuuuuuuaaaaaaaaaagauuuuguuuuuuuuuuuuuuuuuuaauugaggggcuagggguagagcuuauuugagagauagugcuuguugccuuguugcaacauggcacccgcccccccccccccaagauccaauugcauguucuucuaaucccaguaccaggguggugacagaagcuuuagauggucguccucagauuaauaacaacuuugaggacagcccagaauaauaagugagaccuuuaucaaacuaagaaaagggggaagauacauuauugagaauugguuuguggccuacuagguaguucagccauacccuggagaauauuccacaugcuguuguguagaagguucugagguucuguaguugucugcuaggcuaguuuggucuaggguaccuuuugacuucugauuuuguauugaguuuuucuuggcuauccugucaacuacacaaagugggacauuagaguccuguguuacuguguuggaguugaucucacuuaggucuagaauaccuagaggacguguuuugcauauuaggaugcucagaugauauugaauuguuuucugaguugacucuuuagcacugcauagugcuccugccucucuuuacugcuuuugacuuaaagucccuuucaucugacagaaguauggcuacuguuuucuguuacuucucuuugccuagaguaucuuauuccauugcuucaccuugcauuuuguccuuagagguaaaaugaauuucuuagaagcagcucuuaggaucuaauuggggugguccacaccuucagucccagcagugaagagucugagccagaauugucauuuaggugagcuuggaccaccaagugaggcugucucaaacaaaccaaaaagaaguaguagcagcuguauguguuuggauuuuguaauucacucaguuacucuucuuguuuguuugaagagggacuguccuggaacuauguaggccaaacuggccuugaacucagauccacucgccuuugcugagauuaaaggccugcuccaccaugccgagcucagucacuuuuuuuaacuagagaauuuaguguguugucauuuaagauguuuguuuaauuuuacagugucucacuuuguaguucugacuggcuucaaacucuguagaccuugaaaaauggugcauucaccaagugauauuuggcugugacuguguuaggcuuugggagucccguggauauaggauauaagaugaauucugccuuuauagaguucauuguuuagcauaugagacagacacuaaaugaauauauaguagugauaacuguaugaaaacaggaaaacgugugguucuuugagaauuuaguauuuugaaauguuuuauaugaacuuguaaauugaaguuaauaaugaaaagaugaauguggugugggugguacccaccagcaggagcaguuaauaccaacuuuagcacaauuaaacacauccauguguuuuuguuucuagcucuuuugcauuuauuuuguuauagcauucuguuauaccguuaaaaacuuaagguacauuagaaccugcuaguuuaaagcagcacaacucucagguuauauauguguguguguguguguauauauauauauauauauauauauauacuaaauaaaaguguauauucuuaugcacuguggaguuagagcuaacugccccuuuuccugcucacaauaauauucacugcaacugucuuuggaaaucauagggaucaaaacucuguucagaauuugcuccagacuuugaguuggcagagucaggucagguggcaguaucagcuaaagucagauaagaaaaauuccucuuaccuuucccuugagaaaccuguauuuagaaaagcaggagaagauuggucaggugaaggggaaguguguaaggugcuugggauguagcagccagcccuccccaacuccccaggaacgcauuguggcuaggaaaagcugagagugugauagcauuacugauuauugauuaucauaaaugacauugauuaucauaaaugcaaauggacuaaauuucccuaguugaaacaggagugccacugauguggcuguaagcagaagaguaggugggggacuaggauccaucauucugauguuggagauguggaaaacaccagguuccaaauaaacugccagguuuuacacuaaaaauuaagaaaagucuuagauaauggaagaaaaugcuugagugaucaacgcauccugagggauguuuaucuauaagcaugguuuaccuugcuucuauucugucuuuuuaaguguuuucucagcauaucuuuuuauacuuguauauucugauuauugguuuuaaccugaaguuuugauaauuggccgugacugaaagagacagcaugcccugaaaagucagcagacaacuagccagugaguugcacaugaguagcacguaagauccacuuguuccacagagggaauuaagucugcucucuuuucuuuucuagaaauauuaaaagucuuucggauauccagauaguacagguugcgugugguuacuaucauucgcuugcacuuucuaaagguaagcacuugucccuuucuaacuaauuacuucuugguacucugaacaaaaggccgcuggguuuucuuuuacaagauuuguccugauuucauuuccauguauuuuaaaucagcuguuaguuucuauguuuacaaagcugcugaaauauuuguugagcuuauggugucuauaaaucaguauuaggguaaucuuuacaguguuaaguuuuccaacacaugaacaugauacuucugcauguacucuguuucucuuacuaggcuuuuuuccuuuguuuauucaagaccgggucuuauauaucaauacggcuauccuugaacccacuauguagaccaugcuggacuugaauucacaaagaucuuccugccucugccucccaagugcugggacuaaagaagcacaccauuacaccuggcauuaguguuuucuuuuaucugcaaauaccuuauaugccuuuauuauauuuuuuacuagguauuuaacuuuuuugugcauuauguaauuuuuuuaaccauauaggcuugaaauuggguuauuacuuaauuacuaaauauuuagaagcaauaacuuauucauaugccaguugaacauuagagaaugaauuagagaaucuuccaugguuuuugccuuaucauuuaaaacuugggggcuggagagauggcucaaugguuaagaguagcaacuguucuuccagagguccugaguucaauucccagcaaccacaagguggcucacaaucaucuguaaugggauuugacgcccucuucugguauguuugaagauagcuauaguguacucagaaauaaaaugauuaaauaaaucuaaaaaagaagaagaaaaagaaaaucuagggagaaaggggagauaaauuugaagaggaggaauggcccaguggguuuaugacuaccccgcccuuccagaggaccugaguucaguucccagcacccauaucagguagcucacaagcaucugaauuccagcucuaggagaucuaaggacuuuguaagcauguacacucacagagacauguacacaugaauaaaaacacauaauuaaaaauaaaaagauaaauucagccuggcauggugguacauaccuauaaucucagcacuugggaagcuaaaacaggaagcuuucuacaugguccaugucagccuaggcuaucucagaaauaaaaaaauacauucuggugucuguuacuauuuuaguaaaugucucgugggguccacugugaacaaaacauuagguuuagcucuauaaaaacugauaaauuaagaaaguuuucuaucuggagcugauuuuucuuucuugcauuuuauagcuuuagguagugucuuaguuaggguuuuacugcuaugaacaaacaccaugaccaaggcaagucuucuaaagaacaacauuuaauuggggcuggcuuacagguucagagguucaguccauuaucaucagggugagagcauggcaguauccaggcaggcauggcgcaggaggagcugagaguucuaugucuucauccaaaggcugcuaguggaagacuugacuuccaggcaacuagggugaggauauuauacucacacccacagugacacacccauuccaacaaggccacaccuucagauggugccacucccugguccaaggauauacaaaccaucacagguaguauaaugagaaacguaacucugaguauuuagugugaguucacuaaacugugcacaccugaguguguagugugcagugagugagaagcuaugaccacuggcccucacagcaucacacaaagaacauaaauaguuauguacggugagaggggcuggagaggaaaaaguugguuucuauaacguuuagugggaaugagauuuaaucugguauguccaagagugaagaccagacuugagcugaacaaaacucaaauuaggugcucagggcggugagagcagcgggcugagugcugaggaugaugaguguggcuggagggucgagaucaaggaaguguaaacaaccccccacaggcccuccuaaggagccuguccuaagagcagugagaaaccaugcaacgguuuuacucuguagcccaggcugucuuuaaacaaggagcaaucucucucucucucucucucucucucucucucucucucucgcucaaagauuuuuuuaaaggguuaauuuuuuuucaaagauuuauuuauuauuauaucuaaguacacuguagcugucuucagaugcaccagaagagggcgcuagaucucguuacagaugguugugagccaccaugugguugcugggauuugaacucaggaccuucagaggagcagucagcgcucuuaaccacugagccaucucuccagcuccaucucuucucuuuuuuuuaauuuaaauuuuuuuguuguuuguuuuucuagacaggguuucucuguguggcccuagcuguccuggaacucagucuguaggucaggcugaccuugaauuuagagauccaccugccucugccucaauuuuagucagaagugcugcccagcuaaaagcagucuguuucccucucucaaggguugggauuguaggcauuagccaccacaccuggcugcaguuugcuucuuaugcaaauacagacaugcuugaagaagagucagagacuuaauauuuuaaggguuagauggaaguuuacuuuaaaauuucuuaauuguuuguguauagauuuggauccaaaggacagccuugggaguuauuccucugaagccaucuauaucuuuuuuuuguuuuguuuugugacaaucugucacugcccuggagcucaccaaaugagugcugacuagccagugagccugaggggggggggggggggaggagacuggcucuggcuccuccucuuccuccuccuccuccuuccccuccuccucuuccuccucuucucuccugcuccccagugggugagauugcagagcaggccacuguuccuguuccaccuggcccuguccuggggacugugaacuuuuaaauuugcuuguuuaaauagauuauugcuaguuauuuuaacaaaaaccaucugaaguugcuggcagaugaaucagaacuaacaaguaguagagaaaaugaugaaaggaaauaagaaggaugcuaaaacagaucuauuuaccagaaagagaaaaacaaacaaacaaacaaacaaacccaaaccuguaacauaguaauccuucguagauuuggaguuguugaugucugagaaggaacgacaucccggguaucugaccucugcuggugaagggcaacgcggggaggagagcccugaggauuggcaaugggguggaagccauauucagucugggcacagugaguuagaaguggcucuggaacauccuuguguaggugucagauaaguaguggguugcaggguguuucuuaguuuagauuugcauaugcugauagcugaagccuugagauuagaagaguaccucuuggggaaagcuuagagaguaagagagaugaagaauguuagagaguccucuguuguagggcauaaggaaaugaguguauuccuagcuuguaugacugguuaccaguguguugcugaaacuuaaccaguuucauaagacauagucucuaaguaguaguauguuuucauauaaaaaaaccaaacuucuucguucaguaaguauguauuuucaucuaaugagagaaugucucaaaaggguaguugaucuucaaaugauacuguguguguguaaaauaauuuuaugauuuuugucuuacagcaagugaaguuuucuguuggggacagaauaaauauggccagcugggucuaggcauugauugucaaaagcaaacuucaccacagcugauuaagucuuugcuuggaauaccauucaugcaagucgcagcaggaggagcccauaguuuuguacucacccuuuccggagcuaucuuuggauggggacguaacaaauuuggucagcuaggucuuaaugaugaaaaugguaggugugcuuuauaguuaagcauauuuuuaaaagaugaucuucugagauaaaugagugauucuuagagcauuggagaaauguauacccaaacauucccaggacuaauagugguggaccugaggauguuaguuuaacauuuuaauguguuugggaggauccugggaaggcugaaaauuagcauguaauaaauuggaaaguuuguugggaccuggagauaucgcucaguggaaaagcucacgccuaguacgcacaaggcccuggguuuaauccccagcaccuuuuccccacaaaaaaaagaaggaaaauauucuugagaucacuuguacugcuauuauauguagguccaugguagacugcuugccuacuacacgggacugugggguuaauccccagcacugaaagaaaagcaaggcugugcuguuuaugucuucauuguuggaugccauuaagagacaguguauaaauacugaguuaaguugguaaccaguguugcuccaggauuggccaccauuaauggaaagaagcuauacaauuaauuagccaagaagcuacgucuaaaguuuccuuuuagaacauaugugcaguagcuuagccugguacugaaaaauuuuugcucugggaaaguaacaugacauauuuaguugauauuauuguuucaaguuggauuuauaugaucuggguuguuagauuauuuuuugauugagcuucuuuuuacacugauuauugucuugaaaauaaacauuuuaauuuuaaacaacuauuugaaacaagucacaaucuuuuuucugacauuucauacuuaccaguuuuugaaugcgaauauuuggcauauaagucauagguuguaacagucaguauacuuguaaugccugagauggccaaaguguguuuuuaccuaauaauaaugauacguaaauaauucucucauagaauuagauaaugguuuuuauucugcauaaaaauauacucauguuaugcuauuauuguuuugccacaaagugcagaaaguagaucaggcuauugaguagaaucucugaacauggccauuacagaauaaagaauuauacacauguagaaaaucugaaaacaccaaaguccuguauuguugaacccuguguacauugguaguagggcaaucgaaugcucaucuuugaguccuuacuuuaucauaagaccuggaaacccaguuuuauaggccuuuuuucuuaggaagucuuugauugauaguaaaaauuauuauuacagcuacugaauuuggaaaucuauaaaggaacacauuuuuaguuaaaauaucauuaacgucuuuuauuggaauuuucagauagguauguuccuaauuuacuaaagucacuaagaucucagaaaauaguuuauauuuguugcggagaagaucauacugcugcauuaaccaagguauuguacuuaaaaaacuuuuuauuauuugcaguaauuuuucauaauuagugaaugcuuuugugcuauuuccauuaagcuugaguaauguuuguauuucgggaauaguuuauauugaaaacggccuaaauuauuuuugaaaauaauuugccuuaauguucaguuuugcuuaggguugugaacugugcauuugaucggcugucacauucaguugcagcagugcuuaaauguaguccagacucaccucagacuguagacgugcccucucugugcuucagcagugcuggggcugcagccauucaggaccacgcuagcacuuuuuggaggggcguuugucugugguauugauaauagaaauuacagcucaggaucuuguguauacuaggucaccucucuaccacugggccacaucuccagcccccuuuuuauuuuugcucaggcugaccuccaguuuuuaauccuauuagccuccugaauagcuggaauuauuaagcauuuugagugagauaacuucauuuugguuccccaugcgugcagugcuguguauccgucacacuuguguuuauucacacugcccaguuugcucuaagcuuccauuugguuuauaaauacuuccaccauguaaagaagcagcagaguuucguuaucuauauuuaaauauuuuauauuuuguaaauauauuaagcuaaaugcuguauuuaggcugaacauuaagcuagcaaugacuguuuuuaauacagccuugucaauuguguuaacauucauccucaucuucugggguccuuggguggugaguagacgucaggugaaaaugaacaccuucagauagugcaguaguuaaugugcugaucucaguuugauccucacuguauagaaacaaaacaaauugcagcuaauuuuuacuggaaaauaauguauuuguucauaguaacauaaagauucugagaaauuguuuuuuggccaaauuagaaauugauguuucaaaaggucuagggauauguacugguugguagagugcuugucaaauauacaggaguuccuggguucuaucucaaauguaccacagaaacugaggucagaaaaugaagccucucuuuacagcuguguaggucucccaccccuaccccauugucauuauuuugucuucuauauuuaguaaaagaaauuaacguuuuuuucuuucuucuccucuuccuccuccuccuuccccuuccuccuccuccuuccccuucuucccccuccucucccucuuccuccucuccauuucuuccucaucuuccuccucccaccccccaccccccuacugaaacagaaccucacuguguagcucugguugggcuuagaacuuacuccacuauccaguguuacagcuggaagccaaagcuccauguguagccaagcacucuaccaacuaagcuguacccugucuucugcucuguauuugauguggaaaguuuuuuuuuuuuuagauuuauuuauuuauuauauguaaguacacuguagcugucuucagacacuccagaaagagggagucagaucucguuucggaugguugugagaugguugugagccaccaugugguugcugggauuugaacuccagaccuucggaagagcagucgggugcccacugagccaucucaccagcccgauguggaaaguuuuauacugugccauuauacuauauuuaaaagauuauccuguuagauauugaaaccagaguguaaaauuacacacacagacacacacauacaacuauaguuaaaaacaaagugucaaauugaaaaauacuauaguuauguuaggcuauuacaugucucucuuuaaaauggccuuagcauaagaggcggaggcaggcagaucucugaguuuaaggccagccuggucaacagggcuacacagagaaauccugucuuccaaaaaccaaccaacaaacccaacaaagcaaaaccaaacccauugccuggugaguuucagucaugaacauuuaccgauagccuccuguagcaggucuguaugugcacacgucugcucucugcucacaugcacuguucaugggggcuuuuuaucuguauugacuuuguuuuuggcuugagcucccuauguaguauggguuggccuugagcucauuaucuuuuugccccagcuuccuggugggaggacaucacacucugugcagagcauuugucuaucuucaagcauagcuagcuugcuaaugaaagauaacauuuuuuuuaaaaaguuuuugugaaauguuagaugucuccuuugaauuaaaaagaaggaaagagagaaagaaaggacgaaaagaaagacagaaaaauaaguagaaugauauuucaaagcaaugcaguuaaguuggucgguuuaauagugguuauuuuguuugauaggugaggugucuccuguaguccugccucaucaaacuguugggcaguauuuuaaccucuccuuaagugcagagauuucaggugugcaccaccaugcccaguagcaauuacuucuuuaaugaacacuuaaauauuuuaucauaaugagaacguuauugaguauuuacaucugucaaagccugucuggugguucaguccuguacaguuacaaguaccugagaugcugaagcaggaggaccuuaaaguucaaggccuuccucaacuaagaacaaguucagggucagcuuugaugucuauuuaaaaauccuauuuuaaaauaaaagguggaggcuggugagcucgcucagcagauaaaggugcuuuccaaguguuucugguaacuugaccugaacucagguaaagguggaaggagggagccaaacuuuagagcgucguccucugaguacacguguuuacacgugugcagcaugcacguccacacuaagacgguuugccaguggcacacgccuuuaaucccaguacucaggaggcagaggcaggcagaucucuugaguucaaggccagccuggacuacagaaugaguuccaggacagccugggcuacacagagaaacccugucucggaaacagaacaaaaguagaagaagauaugcggguguagacugagcuguagguggaaccuuaucgucuaucaaacaugaaauuauuuuaucuucguuaguuagccaucaucuaauuucaaagauaggaaagaaaacacugagucugugucaaaagugaacucauuuuguaaacauuaguuuacuuguuguugagcuucucauaaguuaauuguucuguuugcuuguuguuuuccaggaagguggaguguuuaccuuuggagcugggggcuauggccagcugggucauaauucuaccagucaugagauaaaucccaggaaaguuuuugaacucaugggaagcauuguuacucaggucgcuuguggaagguaagcugugguaaagaagagaggacuuugcucucuagacugcuuguugagcugcugaggaugguaacacacacuucuaauucuugccauaauagggagaaucuguaacaaaccaccuaccccccacccuaaggaaaaaauucacaccuuuuaaaggauuguauaauaaauugucuuaggguucugguaggcugaggugaaguaguucugagugucugguuggcugcugaggaguaacagcuguuccuggugauucuguuucaguuucuuagagaagaggucauucuccauuauaauggcaucauuuuuaaguauuugccaacaccgcuuucuccucuuaccagcuagccauccuaucauguauguauguacggaagugugaaccauuuacacaucuucaaggaggagugggccuucuacugccucaugaguuaccuuaauccugugggugcugccucaugaaccuucuuacauaaagaaauguuucauuaccagcauuaaaaaauacugucuucuuaaauacugagcugucuucuaaaaccaaaaucugggugaaaacaauccccaggcagacuguaaaaccagccgaggcugccauuuggcucaauuuggggcuuugacuuuugaucauguaguugcuuuuggaagacuucuaaaugcaguguguuuucuaaagcaguuuugcaagaaauguucucaaauaaguagcuagcauugauuuaccuuauaauauaauucuaagugcaaaauaugauucugcguguggaugaaaaaguuguuuauaacaaaugucaguugggaaggcuggagacguggcucagagaguuagaauacugagggccuggauuugaaucccagcagccacacgccaggucuuugcugucuguaacuccagcuguacggauguuguugcaccuuuuggcuuccuugaucacuguccaugugugccagauccacaugcagacuaaacacaauuauuuuaacaaugggauccugggggacuagagaaauggcucagcaguuacuggccgcucuuccagggaacccacccgaguccuguucccagcauguauguugucucacaaccaucuauaucuccaguugcaagggauccaacacccuuuucuggcuucuguggauaccaggcaugucuguguaccgcaaagcacuuguauacauaaaauaaaaagguaaacauuuauuuagcuggcaugauggcauaucccuuuaaucccaguccuugggagacagaggcagggagaucucugaguuugaggccauccugaucuacaaagugaauacaggacagccaaggcuuuauuacacggagaaacccugucuggaaaaaaaggaagagagaaauaaaugggguccuguaacgggauggggggugggguggggucagauacuuguuaguaaguucuugccuugcuagcacuaggaccugaauucaauuacgucaucacauauaaaaugccaggcauggugacacaugcuuguaagucugacauuggugggacagagacaguagaauucuuaggauuugcugaccagccaaucuagccuaauuggugagcuccgggccagugagagacccugggucagagguggucccugagcuuguccucuugcuuacacacacacacacauaaggagagagcagcucacuguguugccaagguuggccccaaaggccuugacauaaaugguccccagcccucucggauuuccuaauaccuagggugugauuaaugguaugaaucuaucuggcuaauaguguuuuuagguagacauacacauuuaaauuucaugaauucuaauuuguugccugugacuauuauaacugaggaaauauugcccaaauccaauguguuuuauccuuuggucuuuuuucuuccaagaauuuuuauagguuuagcguuuagauuuggauuuugaccuguuuugauuuuuuuuucccaauuuggaggauugaaccagggcaucaugcauauuagaaaagugcuuugccaacgaacugcauccccagccuuuguuuuugcgacauuucauuuuguagcugaggcugguuugggacucaucguguagccaacuuggacuuggaacaacagucuucaugugucggucuugaaagugcuaagguuaauucuuguauucaguaagucagcaaagguccagcuucacucuucuguguguggacagacagucuuagcagcuuucuuuguauauaagaguuuccuuuuuaugcagaaugauuuuugauguauuguugagaagcauuuggucuuaaaaucuaggacuuaauuuugggccauugauuugagugcacgcacuacauacagcuuuagcuacuuaaaguccugaaguaugagcccaccagucuuguuuuucuguucucuccccuccacacucuccuggcauggcagaucuucuuucccuuucccuccuccuggucccaagcccuggaauccuaaaaguccauuggggggacaagcagcguuagggcaaaccuacuacaaaguucauuagauuauucucuucuguaucagauuggaugaucaugucuuugggaauuugguuugguuuuuuuuguuguuguuuuguuuuucuuuucuuuuucuuuuuuuuaaaauuaauuuauuuuuuuaauuagauauuuucuucauuuacauuuccaaugcuaucccaaaaguccccuagcccccccccacacuccccuacccacccaaucccacuucuuggcccuggcauccccccuacccccccccccuacugagaugggaauuuguuuuaauuagaugugugcaacuguauucugggccacccugcauuaccugaaaauaaucauaccaacauaccaucuuaguaugcuguugaauucaguuuguuuugagaaugucucacaaggugccucuaacuggcuaaaacagaccccugcucccuggugcuggcaguacacaagugccaccaugccuaaguuuccacuuucucuccugauuuuaguaguuugaauuaucuuucuaagucaaucuagucuguaguugauuagauacuuuuaaaaguuguuuuguuuuaagucaggcucucuguugcucucugucuguccuggaacucuguauugaguuaaccagaccucugccucccaaaugguaauacuaaagacuuguaucaccagacuuggcaauuuaaggcaaacaauaauaauuguaucagauucugccaguacaguccuuacccagaugagagacagauucucaguacuuacuacuuaucuguuuucccagaaucuacuguccaguuccuuuuuugaaaacuugaccuccuugcuuugugaugacacaguugcuauaaauuauguauuuauaucgcuucuuaaaagugcugucacauuaaacuuuuuuuuuaagauuuacuuauucauuauauguaaguacacuguagcugucuucagacacuccagaagagggaaucagaucucauuacagugguugugagugaucaugugauuccugggauuugaacuuaggaccuucggaagagcagugugcucuuaaucacugagccaucucuccaguccaccucauuaaacuuuuauugauaaauuauuuauguucauagguguaucuguggcuuucuuucuguuaguugugcaaaccauguauauaguugucuuaauguguuggcuaguaugcuagucuaaucauuaaaguacugauaaucaggcauguuuuguuucuuuguuggaaaacucaguauuucacauuuaaguaguaugucagucauagauuuuuguagguuuuuguuuuuguuuggucuguuuuugguuuugguuuugguuuuucgauacaggguuucucuguauaucccuggcuguccuggaacucacuuuguagaccaggcuggccuugaacucagaaauccugccugccuuugccucccaagugcugggauuaaaggcgugcaccaccaccgcccagcuguuuuuguuuuuuuaaacaggguuccuccuuauagcucuggcuauccuauaacucuauauagaccaggcugggaucugucugucucugccucuuaugugcuggcaucaaaagugugcaccacugugcccagcuauuuuuguagguaaucuuuaucaaacaauuucuaguuuaugucuuguuuauuuucagugcuaucgauuggucccagggucuuaucugugauagcaagcacucugucuuugagggauaucccagccuauuccuaguugcucuucguggaccuguuaagaugauuugugauuuuuauuaagugugugugugugugugugugugugugugugugugugugugugcauauuuagaggccaaaacaggacauuggguauccuccucucugucacucagugcugcauugcccugagacgggggcugcagugggcuggaaggaaguucaguauuucagcaaaacuggcgguagcuaaagcucucaggaucagcgugacguuccuacccccaugcugcauucacaggcacucugccauuccuaccuggcugucgacaggauucugggugcucuggccaguuccuggugcuggaugauggugcagacacucauuuccccccagccauuuucccaacccugguuuauuuuuaagaggaucguguugguuaauuuguacuuuaauucuuuggaauuuaaccuuaagucagaaguuuucugucauuuuauucuaggcagcauaccucugcauuuguuccuucuucaggacgaauuuacuccuuuggucuuggugguaaugggcaguugggaacugguucaaccagcaacagaaaaagcccuuucacuguaaaaggaaacugguuuucuuauaauggacaguguccacaagauauugguaagugcuacuguauuuaacgugugcuacauauauuacagcucuuauuaaaaugcuggucuucuguguuuacaugaacuguuaguaaaguaacagauuaggaguauagugcuaagaggaggaauauugaguuuaucuauccuggacucaugguaagaccccaaaggcauguguguauguuaucuacaucuauacaugcagagaaauucuggccgggcaguggcugcacacaccuuuaaucccagcacuugggaggcagaggcagguggauuucugaguucggggaccaccagggcuacacagaaaagcccugucucgaagaagggaaaaaaaaaagaaaagaaaaagaaaaagaaacucgggucauacagaaacucggguuccagugaaaagggugauuugaacugaugucaguacauaaaacaagauuuccuaauugaauuguuuuaaaauuaaggaguuguguuaucacauuguuuuguagcacucuguggaucucuuuucaguuugcaaaacuaaaacuuuauagucauuuaagcaaauguacuggcugguuuugugucacuuuggcaccacaagcuggagucuucaaagagggaaggguccucaguugaggaagugccuccaagagauaaaaguguaaggcaagcccuucagggcauuuucuuaauuaguguucaguugggggcaggcccagaccauuguggguggagccaucccugggcugauggcccuggguuccaugagaaagcaggcugagcagguagaaagggucgucuacuacugagaguuaguuacaucuucugauuuuuggaaagaaaaccuuugaacucuuaaaucaugguagucuaagccagacgaaccuuacuucauggugggucgaggagugacucagcagcugagaguacccgguacguugcuaguucucaggacccagcucagcacccgagucugcugcuguucuccagcuucaggaaaccugauggucuucugcaccacacacaacacacaugggcuacacacagaugcacagaaaaaugaaaacucaauauuuaagccagugguggcagugcaugccuuuagucucugaacucaggaaggcagauggaucucugaguuggaagccagccuggucuacagaguuccaggacagccaggguuacacagagaaacccucucuugaaaaccaaaauggcaacagcaaaacuauaauuguauuuuacuguuacauaucugauuucucacugaggauuuuuuuaaugauguuuuacuuaguuguaagggaguaaucaaggaaauuaaaacaauuuuucuuucucugaaaaaguagguagcauaccaagguuuaauaaccaaaaagucaagccaagcauacuuacauacaccaguaacuacagugaaggcaggacaguauaaaugggaggcagaguuaugaagucuuuacucaauuauuugaacuuuuccaugguuuguuuuuuuuuuuuuuuuuuuuuuuuuuugguuuuucuagacaggguuucucuauagcccuggcuguccuggaacucacuuuguagaccaggcuggccucgaacucagaaauccaccugccucugccucccaagugcugggauuaaaggcgugcgccaccacgcccggcuuccauauucuuuuuaaaaaugacuuuuucuguuugcuguuuugaggugagugagucuugauguguaacccaggacggccucugacucugcaguucucucucugcccaccaaaugcuggaauugcaggugugcccacuuuaaguuuauuuucuuuucaucuuuuauaauaguaaucacuauuucauacuauguuuaaaccaaaaugugagauacagauuagaaaacaguguuguguguguguguguggugguggggaggggguuaguauguuucccauacuuggcuaucuccacagggaaccuuccagagggguagcugagccauuucugaaucagagcuucguucacuguccagaucugcuuggaagggagagcaucuaaagucaucuagagguccacaguucuaaacguuaaagugaaagagucccaugccucaaaugucugugguagagcaaaggcucacaaacuugccaauggugccuaggcuugcggaacucucucauguucacguuuggucagcucauccuggggagucaggcuacuuauuccuaccuguuucugggaugaagggaaggaggccugauuauacaaaccccauggcaaguuugauaaucuagaaaauguaauaugaaucuuacaaucuaauacuuuacauauuauuuuuauuguagguucugaagacuauuucugugucaaaagaauuuucucagguggagaucaaagcuuuucacauuacucuaguccucagguacuaacuaaucauauacauaauuaguucagauaaguuggaguaauuuuagaaauuuaucucccucuuuuauauguuauaggucaacuguccaaauuuguuuuccuacucaaauguacaaaaaaauauuuuuucucaaagcuaucugcuaaguuuuuguuucugguaguuaggaaaaauugacuucugucuucaacaaaaccaaacagauagaucaucgugguucuuaacuugguauuguaagcgccaucucuuccucugaccgaucucuuucacuuuaacguuuagaacuguggaccuccagaugacuuuagaugcuccgacccuuccaagcagaucuggacagugaacgaagcucugauucagaaauggcucagcuaccccucuggaagguucccuguggagauagccaaguaugggaaacagucuacuuauacauagcccugugaagaaauuucauuucaauauuucauugacugucauuuucuugaugguuuauauauaaaaauguuaaguacuuagaguuuccauguuuuuaagaucuuaaagcucuaguccuuucagacaggaaaaaacccuagcugaugacauggcacaauguggagcagccguuuucagauucuguuuaaacuguguuccuuuguugcuuuaaugcuccuuuuuucaaaaauuaauauuuauguauuuugcauauauguauguacugcacauaggcuguuguacacauguggcagucagaagacaacuuuugaaaauucauucucuuccacuuacauaaagauuauuugaagauggagcuugguuuaguggugcaugccuuuaaucccagcacugagucagaaccaggugguucucuaugaguucagggacaacaccgucuacagaacaaagucuaggccaggcaaggcuacauagugagacuuugauagauagguggauggauggaagggaggaaggaaggaaucuaguucuucauuuccuugaauuguccuuuugugguggaggguggugggugugugcacagaugucugcagaugugcauuuacuucugugugcauguggaaacggugggucuaugcugacuguuccucccaucccugagcauuguagguuuugagagaugaucuugggccuuccacccacccucccccauccaccaccaccaaaguuacaaguacgucccacacccagcguuucauguggguccuggggaauccaaggucauuucuucauguuccuuccugcaccaggcacuuuaucaacugagccaacuuggcugcugaagaugaaugcauuuaagcuuaagucaaauaguuaauaccuuuaucuaguauuguauaaucagucuuuauauuuaauuuuuauuguauacuauauuuauuuaauauauuuaauuuaauuauuauuauguuuauuuaauuuuaaagaucaaguucuuuacuaaaccuggagauugcuggacuacaagggucuuggggaucuucuugucucugcuucccuaguucuggucuuauaagcucacacugccacucaucggucguaggggguugggcuugagucccgcuuacagagcaagcagucacuaagucaucgcuggccccauuaaaaaaaaaaauaacagucauaacucuguagcauagguuggccuuaagcuguagauucuccugccucagcuucucaaaugaucagauucugcuuauaugccaccauauccaggccuaaauugucauuuaaaucuuuauuaaaaacaaaaggcaaguaguaauauauaucauuuauuuuauuuuuagugagauagauggaacauuuucuucaucuggcugccuaaauggaaguuuucuggcuauuagguaaguggcaguuccuugauugacugaaccuuucaaacuugagugauguauuaaagaacuaauuacuacauacuuguaacagucggcaaguuuguacauauguauaguguacuuugaugagacaaccccucauugcucucucguaccuccuccccacucagccucucuuacuuucaugcccucugugucuguguggugccuacugaguuuauuaaguuacuugucugagcaggcaugggguuauaauacuggagccuggggacugcugaguggcuacagcucugcagaaaaugacucucccucucuuuuccauuuuuagcaaugacgaucacuauagaacagguaccagauuuucagggguugauaugaacgcugcuagacucuuauuccacaaacuuauacaaccugaucauccucagauaucucagcagguuuguuuuuaagugcuuguauauuuacuauuuagcugcuggauuuuuacauaguauuuuauguuugcagccuaauuaauuaacguuguguuuuauggauuuauauuauacuucauaauaaaaaauuuaauggggcuggcgagaugacucaguggguaagagcacucacugacuugcucuuccgaaggucaugaguucaaaucccagcaaccacaugguggcucacaaccaccuauaaugagaucugauguccucugcuagugcaucugaagucagcuacauuguacuuacauauaauaauaaauuuuuuaaaggggggggggcuggugagauggcucaguggguaagaggcacugacugaucuuccgaagguccggaguucaaaucccagcaaccacaugguggcucacaaccaucuguaacaagaucugacgcccucuucuggagugucugaagacagcuacaguguacuuacauauaauaaauaaaucuuaaaaaaaaagauuuaaugccaggugcaguagcacacgccuuugaugccagcacucaggaggcagaggcaaaagcagaucucugugaguucgaggccagccuggucuacagagugagcuccaagacagccagggguacacaaagaaacccugucucaaaaccaacaaaacaaaacaaaaguaaaaguuuuauuuuaaagcuaaacuacaaguuuagauauuaaagaggcauaaaucuuuucagauguuuguagcagacucuaaauacuuuacugauuugggucuguuaauagcuuuauuuagccauugugauaguuuaaaugauuauuaaauaaaguuguuugaaauuucuucgcaaugcuuaggcaacuguuuuuauugcguuccaacauacaucacugaaagauguccauuuuauguuucacucauuucauguuugucauaguucuugauuuccuuuuuucucucuuaugugugcauaugugugugugcaucucugugaagugcauucauuuuaaaugaaguagguuuugcuuuuugucaaaauauagguggcagcuaguuuggaaaagaaucuaaucccuaaacugacuaguucccuaccugauguugaagcucugagguuuuaucuuacccugccagaguguccccugaugagugacugcaacaauuucacaacaauagcaauccccuuugguacagcucuugugaaccuagaaaaggcaccacugaaaguacuugguaagaauuuuaguauuuuucuugugcaauguuuucuuucucuuuaaaugacaguguuaaugaguauuuauuuauuuauuuauuuauuuauuuugcuguuugaaauuuuccugccuugcuuauucuugaugagacagaauuuucucuuuuacuggcuuuuauuggguguuuaauucuaauuauuagaguugcugaaggcaaaucauguuaaacaguuuuaauccaacauaacacacagaaaauaagagaaaaauugaaaacuuacccauauuuuucucccuuguugccuugagugauuuugcuguuaaagaacuaagaagagccauugaaacugaacaacauugguuuccaucacccugggccccaguaucaacccgcuuucccucuaguuccuucccuugcuaauuaauugccuuuuguuuuuaucucugcuuauucacaagauuccugaauucacaguucagucucuauuuugcucugggucuugggcuuccuaugcuuaauccaguuuuuugcuuucucagggugugugcuaggcauguggaacugaaauauauugaaguaauaaaaucacacaagaacuucaaggaugaaagugaaaagagcaggaagucagggauggguugcugggacugaaggagugagccaguguggacagguaaagccacacgcugcucccaguguagacggggucauuggcucagguaucuggaguuagaaacucuaaguaagaaacaggaagaagacaguacagguuacagcugcauuauuaccucucuaguuuugauuucccagagugcuucagaucuguaaauacauugcuucacaauauuucaguuuuauauguuaaguugaauaguaaaaccuagauuuuuaaauauuuggauuuuuaagguauauuuuguugaaaaauaauugauugcuaaaacagcuuaauaacugauuuuuauauuaaguguaguaaugaauuuuaacuauaacuuaugaauuuaaauauaauuaaugauaccaagaaugugaauuuaguaagccuuucauacuuuauuuuuacuuucgagagauuucuaagaacaauauccuuuaucuugguagugaggaaaguuaucuauaagcccuagagauguuauauaaaguauugcuauguucaucuuccugaaauguucaaaggguuaaaaaccacugcucuagaagaaaaguuaguauguuuuuuuuaauucugauuuuuguaucauuuuauuugcauguucacccuuuaauaacagaaaacugguggucaguacuugaaccuccacuauuccucaagauaguagaacuuuuuaaggaaguugugguacaucuuuugaaacucuacaagaucggcauucccccuucugaaagaagaauuuucaacaguuuucuucauaccgcauuaaagguuuuagaaauauugcauaggguauguccauuaguccuuuauuuuucucuuuccccauuucuacuaacacauugauaauguucauuuuaacauuaauauuagaauggcauaaaagauacauauuaaagaaauuuagaaguuauucauaguuucuccuaauuuccuuuacaagaaguaauauaucuauacuuuuuagcuuuggguuuaguugucuuuguuaggcaucuguagccuacaauugggcagaacaauagcauauuaaugaauuagaauucuuauguuuucuuguaaagaaccuaauguguuaauuuaauauacauuauuuuuaguuauaagugguuaucauauaaaagugacugggcccuuauaauuuuugaacauuuaaauuucuauucuuucgguaucagguacuaauggccucaaucaaaguagaauguuucauuugaaacaaaugacuaauuugaaaaugaaacuauauauaauucauuaauuugccuauuguucuuuccugcccuuuuucccaguguaagaaauaguacacuuuacacuguagaagugcaaaguuacaugaagaaauagagucucagcugucugauuaaagauggauuugagucaucccugacaguugguagguauaucucuguuaugccauuugguauuuuugaguugcgacuuaaaugagacaugaccuaagggagaagcauguguccauagcccgcaauagacugaagcguccauaugcuacagucucuuccauaacgacucuuugcgcuugcagaugguugccagaguaaccauaaagggaguagaggagguagauccucucuggaucagagauuccagacuggggaccguuacuuuaccugcuuuuagggaagcuccugggucuuuuucuucacuacuuaacuuccugauuuuuuuccuuuuguauuuaguauguccaagauucguaggcaguucauuccucuucucauuguaugauuacagagaugauagcaguuucuuuccaagaaaacaggucauuccccagaacaagacugucuugcagugcguguaccaugcugcaguugugaagaucuucucacgugguagcagggcucucugccucucugccuuuguguauacuuuugccuaggacucaagagaugaauugauuugcuuuugucucucggaugaacuuuucccugcuguuuuauggccguccuucagcuggaccuuaugucugcauagccccacuuugacuccuugucugcuuauccucuuaaagagcacugcuuuucuuuagcccucucugcugucucaggagaaagggaugccuguaauuccagcaagcuggaagcuagagcaggaggaucagcaaaagccaggccauugugaccuacagagaauggcccugucucaagaaaggcguggcaagaaggacuuuaaaguccuagcuaggacuucccagcccgaaacugcagucucuacugagagcccuauuaagauuccaucgucaccuuuuuuauaauuaguuaauacuucaguuuuuaaaauagaauauauguucuucaaggauuuugggucucucucuguguguguguguguguguguguguguguguguccccuuugccccuuuauucucugggucuguggauugaacugcacaugcugccuacagucugacgcuuagguucuggggauaggauuuugugguauauagucccagcaggccuuaaagaucacaauccuccugcuucagccuccgggacccugagguugcaggcauucucuaccaagcuuggcuacagagaccuuuuugauggagcugugccagaugcuaggauuggccuccuuguuaguucaagguugagaugggaguggugucuuaacaucuauuguuugccaacaguuauuagaaacgucuguauauaauacaugugagcacuguguauauagaauuaauuuuaaaaaagauuuuucuuaaaauauacuuguagaguugguauuguccauuuuuguaaauuuagaaaaugauguccucccugccccccagaguuacuuugccaggugguggugguacacaccuuuagucccaguacucaggacucaagaagccaaccuggucuacagauugaguuccaggacagccagggcuacauagagaaaccaugucuagaaaaaccaaaaacaaaaucaaacaaauaagcagaaaacacaaaagcaacucagcauuaacaguaagaagccaggcaugguggcacaugccuuuaaucccagcacucgggaggcagaggcaggcgaauuucugaguuugaggccagccuggucuacagagugaguuccaggacagccagggcuacauagagaaacccugucuugaaaaacaauuuaaaaaaaaguuaguaagagagaaggucagaucugcuucccaagccccugcuguuuuucuuucacauuagugugucaacgaauuguugguaguuggagaacucacauaucagguggcucacaacuuccuacaacuccagauccaagggauucuaacaacccgagccucuggucgccaguacugugcucacacacagagacuuagaguggcuugcuuugucuuuagaucuggagauuuaaauucuguagagugcauuaugucuauuaucucaaauggguuuuguauggugugugugugugugugugugugugguguguguguguguguguguguguguguguguguguguguuaguguguuacuaaggauugagcucagggcuucuuuaacugaacuaugucuguuguccauaucaguucugugcuuggacuagaaauuauaugaacacauuuuaaucucuuaggcuguuucuuaucaaugugauuuugaauaagaucuuuaucauaugcaaaugaauaauuaucaauaaaauaucaccuugauaguuucucaagauugauauauuguuccaaucacaugacagacaguuauuuauuuauuuacuuacuuacuuacuuacuuacuuuugacuuuucaagacaagguuucucuguguagcccuggcuauccuggaacucucucuguagaacaggcuggccucaaucgagcucacuagagauccacuuaccucugccucuugagugcugagauuaaaggaaugugcuaccacugcuggcuaaauuauauaacuuuuaaauacuguuuuucuauguauguguugaaugugugcauuccaccguauauggaacacuggcugucuggcuugaugacaaaugccuuuaugugcuaaguugucuugcugguccugaguuaccuaauuuauauguuauacauucugaaggcagggauuucauaauuagaugauuugaauggggaaaaccacuacuuuuauuuauuggguuagacagaaaauagguucuuauuugaaguuguuaauauuugaaagcagaaugauaguggaguggauuuccucugucuuuuccguuuugcaggggguugguccaaggccuuucacaugcuaggcaagugcucuaccgcugagccguguuccucgccuugggauaauuuuguuaggcagcuccuggaucugcuuggagccauggucuuuucuauacaucugcuuugaagaaagcuuuccuucauucuacucugcuguaaauaaguacguguggauaguuauuaucaggaaugacugauuuucaccuuuccacaaaacccuuaccagaaguuuuuuucaaagacacuuaggccugaaggugagaugccucagugguaaccugccaccaagucuaaugaccugaguucagucccugggaccagcauagcgcaagaagaaccgauucccacagguuuuccucugaccuccauguguaugcuuaugguaggcagcacaugcauggacacacaaacacacgcacgcauacacacauaaauuaaucugaaaaaaaagaaagacugugugggagcuauguacuuauucuuucucucuucucagugauugacaccuaggggcguuuccucagguuaccccgugaccugaccuaggagcagggacaccuaggacaggaaaccaacuacagcuugugcucacugugacugcaggaugugcuuguuccuccccuacgucauguccuugggaaauauuucuaaugcucuaaauggcgucauggaaaauaccuuugaugucugcugucaggaaugggucuguaaucagaaaaauaaguuuacuggguaguaauuggguuauuugaaaucuuacacaguacauuguagcgguacuaaugcaccaaaagaaaagggcuuacuugguacgucuagcuuaguggcuauguaguauacugguuuucaaacauuugagaucagggccaggaaccuucagacugaauggauagaacauagauugauucauuauaauuaccccauaaccaaaauacugaauuauaaugugaaauaaaaacauuguaaucaaaauuuauacauuuuauuuugaacauuuuuaguaaaaaauuauaugcagauuuuuugaaaguuaugugauuucugucuuuccuuugcaaauauuuauuaucuacuguaugcuuguuauuauauucggugcuagggauuuagugauaaggaaauuauauaauuuacccccuucuuaagcuggccaucuagaaagauuauguauguacagauaagugaauauuuaugauaauauaauuguuagauaaagaaaaauagaauguauucauggagggauuaaagaaggcuucuuagagaccgguugcuacuuuguaagauagcguguaaguaugcauaccauauagaaagguaggggugugugugugugugugugugugugugugugugugugugugugugugugcgcgcgcgcgcgcaaaguucugugcuuuuggauugcucuucugagucagacaugguucacaggcuuccauuccggcacuugggaggcagagccagguggguuugaaaguuugaggcuggcauugccuauguagugaauuccaggacagccagagcuacauagacaaugcaucagaaaagcaaaacccuuugauuagucuucaguugaaauaugagcuggggguaggcaaaggcaugugggucucuguaaauucaaggccagucuggucuauauaacuagauacucugucucaaaaguuaaaaaaaaaaaaaaaaaaggaaagggaagaggggaaaauguuaugagccugaccuagugccagcuauggguagcugagacaagauugaguuaaaggccguccuuggcuacaugcagagaccuuauuaauuuuuguuauaaauaugaguguuugggaaaaggacaaugaaauuugugugugugugugugugcaugugugauuuuguguuuauguuuuuaguaaagaguguagcuaauaauauuaguauuaaagacuauagggcgcauggacacaucuucuauagugggauagguaauauuucacacuuuauaucuguuuuuuaaguagaucuuaguucuguuuggaaguugauaauaacagguucccucugguuucuguuuuuguuuuuguuauuuguccaaaugagaacauuaggaaaagugcccuggguacugugccacccagcucuaaucccagcccaccaacagcagauacagccagccuggucugcagagcuggagaagcagaccgugccccgccccccgcccccccccccccaccucaccccaccgcaccugucccauaacaguaggaaaagagcucaugauuuuuacuuaguaaaauaaagggauuaaaaauauaacuuugaaaauaaaagcaguacuguuuaugagacuauugaaauauaauaaugugucuuacaaguaguguaauguuuaguuauagcuauaauugaaacauaguuuuaguugguuuuaacguaaaagucuacaacucaguuaaaauuucagcuugcuuuuagaucaguaugcuauugauccuuuucuuugaggaagagguauauaguguucauucuuguuuuccuuuaaagcaaaacuuugaaaucugugaagauauauaaacucuuaaaauaagauaaaacucaaauuuuaagaguuuauauuuucacagauuucccacaucaaaaauuaacaauagcuguucauugcacuucauccuuuuaaagaugcaacagauagagaugguucuuauuagagacuggguuuuauuuuucgacauggucucacucuagcucuggcuugcugagaacucacuauuuagaccaggcuuaucagaauucacaaacauucuuguugggguaaccagacauaggucaccaugcccuacuacuuaaauuauuuuuucuauuuauucauuuuguguacaugaaccacaacacacaugugaaggucagaggacaacuuacaggagucaguucuuucaccuuauggaucccaaggaucaaacuccugugacuagucaggcuuaaaaggcaagcaaagggugugccaccaccgcucagccuauuuuuuuaaucuuuacacuugugugugaguaugauauaauaagugugcaacuaggcccagaaucuccugcacgcuaagcaggccuguacuacuaugcaauaugccuggccucuucccucuucaguuuucauuuuaacuguuuucauacaguugggggggggagagaagaauuuaguugaaauguuuaaguauugaacuuuuuaaaaaaaauuaucuauguaucuaauguauaugaauguuguaucugcaugcaagccagaagaggccaucggcucccauuacagaugguugugagcuaccacaugguugcugggaaucacaaucagggaccucugaaagaguggccagugcucuuagccacugagucaucucuccagcccaaauaguaaauguuuacucaaugacuuugguaaaugguuauuuuuaguaauucucuuuuuuguuuuuuguuuuuuuguuuuuguuuguuuguuuguuugaggcaagguuguuucuguaguguuggcugucuuagaacuugcucuauacaucaggcuggccuccaacucagagacucaccugccuuugaaucccagugcaugugccaaccauguccuggugauguacagcauuuuuaaguggcuguuuucuucucuguggucaagagcuugccauuguuacugucagggcgcugacuuuuauaccuaccgcuaggauuuguccgcucuccuuuaaagaguugucuuaaaacuucauuuggagggugggagacgccugggcugucgcggggucggugaaaagacaagcuguaagggugcucggcucuucccucaucagcccaggcuccuuuacccuacagcccauuucacagggccgaccucuuuuuccuucuucaguuuagagcaccugcccucucuuccgcccuucauuugcguuuccuuuugcuuuuggagaguuguggugaguguccugaaagguccagguccacagcaagggccuucaugauugugcuuguccauccucuguguucuccgcaaaguaguuuacaugcuacgacauuaucagcuucuaguugcuuugcuugauaaguacuuguuggugcauuacaugacagaagaccccucuccgucgucucagggcugcugaggaagccagaucacuggguuacaguggugcucgucacuguggacuggcuucccuguggaccugguucucucuccguggagucuguagccguguuuuuacauccuaucuugacaccaccuuacauaaccaggcuggagagguugcccagugguuaagaacacuuaauugcagguuggcgagauggcucagucguuaagagcacuggcugcucuuccagaggacccagguucaauucccagcagccacauggcagcucacaacugucuguaacuccagaucuacacggauauacaugcaaguaaaaugccaaugcacauacaauaaaaguaaauuaaacaaacaaaaaaggaacacuuacugcuguccuaaagggccugaguucaguucccagcacccgugucagguuguguucuaaugccgguuacuccagcuccaggagcucugacaccaccuuuggccuccaaaggcacuguacacaagagguaugcauucccauaaacaaagaaaccagagaguaaagaauaacuuaaagguuuguuuguccagacguccaauagcauaauguuuaucaagccuuacuguuacuguuuaguucuucuuugccaacuugaaggcccuguccuuucuggcuuauacaauuuauaguguguugugguuauaaagguauuuauuucuagacuugggguuacugaguacaaguagauacauccuaaaauacuuugucuccuaaaacaguugauaaggauuuuucauguauaguaggcacugaguaauuuuuguuuuguuuuuaauagaaaauuaguuaaaucuccgaagccuuuuuuucuaauuaagaacagaaaguacagacugaauuacuacuucuuuucuuuuaagguaaaugagaaaacaggacaacuuauucaauaugacaaguuuuacauccaugaaguccaagagcugauagacauaaggaaugacuauaucaacuggguccagcagcaagccuauggagugguacgucugucuccucaccuugugacugagccugugugccguuuguacaaugcaaaaggaacaguuuagaaacaaguauuuucauagcuuuuauuccaaguacauuauuuuagaauagugcauuccauacagagcucuguuucuauguagauauucucccagcaccaaaccagugcuacugccgccauuguacuuuucuagagcaaaugcagguguggcuugaacuuugaacucuuauuuccuuugagguuacuaccucuucucuaauguugagaguagcagauaccagaucucuuagaaaugucagauguuugcuuuaaacccaggugagaaucccagaaccauuuauuccuuguuuuaauuuuauuuaggauuguuaauacacauucacauguggauguacuucuuugccugugacuaaaggucuuuaguaacaaguuaacagauauuuaauagcuuuaauuguuuuaaaguaaguuuagucacuuaaguaacagauaauuaauaguguaugagaacuaaacauaguggccacuccuggagucucagcacucuaguugccgaggcaguuuguucuggggcagccugaugaaaacaguaaaacccucuguaggcagccugucuucuaaccaagguagaauaaaugcugucugacuaggauuucuuuguagcaagcacccauuguucuguuugaauauuugcggaaauuucguagucuucucaccuaaauucauccuagcacaaaguuccaaugauaucaaacuauaucucauuaaggagcuauuuugguguuagcuguuuucuaauaagaagaggaaauagagggcuauaguuuugguuuccuuuuuccucauuucucccuaucuuuaguuacugucucuccauuuauaaauguacaugacacugaguacacacuauugcacgaaacuggcuucuuuuccuuaacuuuccuuuuuuuuuaaagacagcccagguuugucuggaaccuaccauguagaccaggcuagcuuugaacucaaagagaccaccucccucugccuccagaguucugggauuaaaggccuguacuacuguaacaucuaguucuuuguuuuaaauuaaguucaucacacuuuuguauuuacauagaacuuuugauauucuuauuccugaaguuuuaagagaucagauucauauguucauugggugucauuuuuauaguuaguaaaguuuuagugacuauccuaaagauacucauacuauuuuuuauguacaucuauuuuauguauauacacacaaacaugaauacuaguuuggcuaacggggucgugaguuguuucucugaagauaaauucuugcucugucuaggcuggauucaaccuuggaaaacuugugauucaguuucccggugcugggauuauaggccggugauaccacugcaacuuguacacaguugcugagcuagauagaguuuggauaaggggcugaagagauuuauuuuauguguucaggguguucugccuguauguauaucugugcugcauuuauggaccugaugccugcugaggucagaagauggccuuggauucucagggacuagagcuagaggagguuguaggggacugcauggauucugggaauugaaccuggguucucuggaagagucaucuagcuguacccucacccgcuaggcugucucucuccucccucccuuucucucuucccuuucuuuuucccucuuuuccucccucccuuccuuaugcaccaaugagcuaccucagcacgcaaaggcacuugccaccaaaccugguggccugauaucaaucccugggguccaggugguagaagaaacugacucuuacaaguuaucuucugaucuccacauuugcuguggugugaaugcaccccccccccccacgcacacacauacacaaauaacuacaauaaaguuuuaaaacuaaaacuuaggaaccugcauauaugguuggauauauuuauaauaccagcauucaagaaguggaggcaaaaugaucagaaguacacucugcugguucuauuucagaagaaaagaaagguccaugcuggguuuauuauguuugcguuacauugaaauuugacuuaagugguuuuguugaguuaaaugagguuuuuuuucaucuuugauguuaaauauuuguaggucauaaaucuuauuuacucaguauuggacuguguguauacauuuguucuagggaguuuaauuuuaugugcucauuggguagugauuuaaauagcaaucugacauguucaguauauggcuagauguaguuugacauaugagcagguauaauaucagguuagaacagcauuagaggacauacuguaggacaucaaugccagguaggacauucuuugcaguugucaaaagcaugauagaauuuagcaaaaaauuaggaaaacuacaugaggcuacgcuuauuucugcuaccauuugccaaguuggaagggauaugccccacucuguccuaaggcucuaucauuuguuguaaaguucacagaacucaaagaacuacaacauagccaagugcaguuuguuauaggauaaggauacagauguuagucagguuaagacaauaaugaagacucuaggagagguaucaguagcagagcauauguuuuuuucuccaugggaaagucaaaugcguaccuggcauugauguuugauacugcucaggauugcuaagcagugaggcugaaauacccaguguuguuauugggugucauuucccacaagguggcuagcuuucuuaauuaugcacgugugagcguugugccugugugugugcacgugcacaggggucaaaucacagcaucagguucccaggaucuaaguuacagguggcugugaggguccaugugggugcuaggaacuggacccugcuccucaggaagagcaguaagugcucuuuacugcugggccuucucugcagcuccaggucugaacuuccugaaggcagaacugauguuugauggcugaaaucugcaucauaaauuacauuguuuauauugucagcagcuaaagauccuagucauuccaaagacccagaauagcccagggcaaaugcuguauguuuuauaaaaauuaauuguucgcuacaguagccaccagguguaaauucaguagcauauuucugaagauuguaguacuuugaguacuaugagcauaaacacugagcauauguggaaauuuucaacugauggagugcuugucuaaugugugaaggcuuggguuuuauacucagcacuacacaaaacugggcaugcugacagaggucuacaaccccaggaaguaggaggaggaucagaguuacaggccauucuaaacuguguacugaguucauggccagccugagacaugugagaccugccuuaaaauaguuuguacauaugugggcugggaguguagaucacucaucauucaagccuuugcuuaguaugugcaaggcccugaauuuaauccacgauucaggguucagcgugguaaggguggggguacaauuguuuccuguucucuuaaguuuucauaccuucauaaaucuguuuuuacaaguuagcaacuuuauguucugucuugugcuuuuuauuuuaaguuaauauugcauauugcuuuaaaaaaaaacacuaguagggcuggcaagauggcugagaguuagagaaaaguacuugcuauguaaacaggaagagagccaacuuguauagacugucugcugacccccacagacacaccugugcucucugucacacaguaauaauaauaaauacaaggaacagacuuaaguauggugguagaugguaccucuaauacagcuuugaggagaguucaaaacuaaugguagaguacccaaaaaucuuuacuucauagauagagauguggaagauguuauggaacggugaaucuuuuuguuaauuuauuuucuaccucauuaaaucaauauucagcuguagcaaaauaugugaccgcaggccggucucuugaguucgaaacuacucuguccucccagggauauacaaugagacccuguuuaaaaaaaaaaccaaacaaacaaaaaauaaggaaggaagaaggaaagaacgaaagaaaacagaaacgcuuaaggggaaaauacaaccauuacaaggugccuuccaucuuucuggugauccgucacauaacuuauggcagcuuuucucucauuuugcuucuauguaauauacuaaagauuuuuuacuucauuaaggucaagucugagaaguaauuaauuccauuuucuagguaaagaaaaagaaacagccaucacgauguuucaggcuaagaauuaguuugcuagucuacauaaauucugcaaggggggaaacucaguugcuuaaaccagaucucauauguucaaaccugagaguucaaaacugaugauagaguacccaaaaaucuuuacuucauagauagagauguagaagguguuauggaacggugaaucuuuuuguuaauuuauuuucuaccucauuaaaucaguauucagcuguagcaaaauauguggccucuguguugacuagaaauagaucacuaacacuccucuuuccccauugcugcguucugcgcugcugucuuaggaugucagccauggaguaacugagguaagucuggggacauacaguuucagagucaugaaggguguucuuuccuguaucaagagucaaauuugucuuuagugugaguuuuuguuuguuuuuuaaugcgcacaaacacacacauaucugguuuuaaauagguacauuauauugguuuuaaaaguugacuccauagaaauuauccuguauaauaucaggaagaccuguacaauucagaggaguuuucuaaauuaaagccuguugcugggugugauggcaugugucuuuaaucccagcacuugaaaugcagaggcaagcagaugagggcagccuggucuacauagugugaguucagaacagccagagugcacaguaagacucugucauaggacaaagacagcagcaacaagaaaacaaugauauuacuuaccaugacaugauaccuucuaacaagaguuacuuugaaauaccuguucuugucucccaauguaaaauacaguauguucugagaaauaaauuuaauuuuaaauuuuuauaaaugcuuaccaguagagcagaauauuacagaagugaaaugaucuauuuuuuaaacuaauaauugauacucagauuguuguuguuuccccuuaguacauaaagcuauggcacucugaccugacagugggcggccgugcuuuccuugucagaccugggggauugcuacuuccucuguguuacgcugcuugguggucuuuugcuuuguuuuggcuuauugaguaugauuuucccaguacuugaacuaaugaacauugguuaggucacauuacauaauuauugcuuguuugcuuccucaguaaguaucauauaaaacuaugaacggauggggcuaguaucagacacagcucagugcuagaguucuugcugucaugcacaaggcucuguacacaacccccagcgguguaagacuuuguguuugggggagaggaaaugaaaacacuguuugaaaacauggucagggcuuagacugacuugaaauguuguuugcaccuucccuguaggaacuaaaccagcauuucucaacgugugggucaaaacugacccugacacagggguugccuaaaauuauuggaaauaucagagaauuuccauugcaguuccuaacaguaacaaaacugugguuaugaagcaguaaaaauaacuauguuugggggucaccauaacaugagcagcuauauuaaagggucacagcauuaggaggguugaaaccacugagcuaaacauauccauaguaaugacggauagaaacgaagagugaggggcuggugagauggcucagcgguuaagagcacugacuggcucuuccgaaggucccgaguucaaaucccagccaccacaugguggcucacaaccauccauaaugagauccgaugcccucuucuggggugucugaagacagcuaaaguguacuuacauauaauaauaaauaaauaaaucuugaaaaaaaaagaaaaaaagaaaugaagagugaggaauguggaggugguucagugggugaagguaucugccacuggacccacauguuggaaggagagaagagcuacuacacuguccucugaccuccaugcacgcguauggcauguaugcacucacagaagcacagaaagauuuaaauggcucagcagacaaaggcaccugcugccaaaccuaacaaccuagguucagucccuaggacccaccugauagaaggaaagaauuccccucugaccuccacauaggugccauguaugauaccaggaugccugcauaauuacauacucauacaacauagauuuuucugcugagcauggugagacgcuuuuaauuccagcacucaggagucagaggcaggugguucucuuaaauucugggccagccuugauuacauaguuccaggacaaccagagcuguguagguagaccccgucucaauccaaaagaaacagaaaucaccuggggaguacuauuucaguaccgucuuuacguuaaauucaguugugguacacacuguuguuccagugaagguacaaauucaagaguuuguagccauccugggcucaaaauacaaagggcugggauauaauucagcaauugagcacuuaccuaacauucucuuuuuuuguuuguuuguuuuuuuuuucaagacaagguuucucuguauagcccugucuguccuggaacucacuguagaccaggcuggccucaaacucagaaauccgccugccucugccucccaagugcuuggauuaaaggcgugugccaccacgcucggcucaguggucacaucuuaucuaaugccaugacccuucgauaccuaacuugccuaacauucucaaagccuugaguucacuagcaagcugaaugaaaauccuguagucaaaaaugaauguucuugaaaauuucuaaccauaccugugaaugaacaagagugugauaaucaucuuuaccaaaagugacagcacccacacaccaguucauuucuuuauuuccaguuggcagauaucccggugacaauuuguacauauccauuuguauuugaugcccaggcaaaaacuacucugcuccagacagaugcagucuugcagaugcagguaagugcugugcaaugguccuuugauuuagggauguuguaaaaaacugucucugugcugcuggguuuugguuuuuuguuuuuguuuuuuaaguauuugaaacacuggugauaauacuaauguggggacgccauuguagacugucauuugcauaauaaugccucguggagcugugagaauugcuacaugaaacauacaaacaugaaagcugcuuaguuaacaaggagcugucauaaaaauagaguagcagccuuuauucauguuaaaccuucaaaaaugaugaacccccuuuguuauauauaauaaguccaucuuuccaaacaauuuaaucagguucacuauuacagguuagauuguuucagaagccuggcuccacucugcccuuuaauuacauaugugagaaaagauggcaggaacuagaggugagauaaaaaguucaaugugggagcagaggcaauucaucacuuaaaugaaaagaguuugaaauugcucugagccuggcauggugacacacaugauuaaucucagcucugugaguucagaggccagccuggucuauauagcaaggucuaaaacagcccggacuacagaggcccuagcucagaaaaggaaggaaggaaggaaggaaggaaggaaggaaggaaggcaggcaggcaggcaggcaggcaggcaggcagggacaggaaauuaccuugagguuggucauaggucauauauauuggugguggggcugggauguuuuauggggagggauacauacauauauauauauauauauauguauguauauacauauacgcacacuuauuuuauauaugugugauaucacagugaaacucaugacuuuauguuaguuauaaauaaauuaacuagguauggugaugcuugcaugugaucccagcccucgucuagcaaucggaaacuuccaagggaaagcguuuaauuggggacuugguuacaguuguagagggugagucaccacggcagaaagacagcaguggcacgggagcaauugcuccagaguuuuguauccuaaucugcaggcagaaguggcugggccugaugugggcuuuugagaccucaaagcucauguuccaugacaugcguccuccaacaagaccacaccucauaauccuuccugaguagcccaccaccgggaacucaguacucaauacaugagcuuauggggcuuauucacauucagaccuccacacucagcuucacagcacaguuagguuaaauaagacugccuaaaaguaaaauaaaagucugauuuguguuuguuuguuuucuagauggccauugaccaggcccacaggcagaaugucuccucucuuuuucucccagugaucgagucugugaauccuugcuuaauucuaguuguucgcagagagaauauuguaggagaugcgauggaaguccucaggaaaaccaagaauauagauuauaaaaagccacucaagguaagcaagcacuccacauaaauugggacuucucuguaaaagcuguucuaggguguguguguguacguguguauuugaaacacuuugugguuuguuuguuuuuuuuaauuacagauuuacuucauucucuguuuugcuuauguguauguacaguauguacaagccagagagaggguuagauccuguguaauuguaagugggcgcugggaaccaaaccugggucaucugcaagagcaacaagugcuucuggccacugagucauauaaauuauaucuuuaacuuuugaaauuauagguugcugagauucauuagcagugaauagcucguucacaggucucugagauguaaucuuuugguucuucauggucuauucaguguucacaucacccuguuuuagguuauauuuguuggagaagaugcuguugaugcaggagguguucgcaaagaauuuuucuugcuuaucaugagggaauuguuggauccuaaauacggcauguuucgauauuaugaagauuccaggcucauuugguuuucagauaagguaauaugcccgucuaccacaauuaucucuuuagaucuuuguuucuaacauauucuagucagacagaggucuguuuuauuacagcuugaaauuaggaacuuuuagacauugucaaaacacagucuuguguuuuacacauuucaaauuaaaauaaauugaagaacagucagcuuuaaaauaauuuuccuucugaguguguggaaaauuucauggugauuacugucuuagccucucuucuggagagaacuuagcauuagagaucacugaccgcuuguaauucagauucagggccaguagacgguagcagugagccagaucuuccuucccagcacauauuuggauccaggaagccaccuguuggauacuacugcuuugacacgugugcaugggagacagcugauaguuacuaggaccccguguucaguuaagacuaagauguuaccagcugguccuuuacagaaaauguuuggauucuauuuuguaaaaaaauuucugagucgccuauguuauaaauauauaagauuucuuuauauguacauuuagucuuuuugaaggcugucuuguaucgggauagcagcuauugauguucaguacuuaggguaauuccuaagggcaacaaacuacugcacuggaauuauacugucuugggugcuuggauagagagagaaauagcucagccuuauuguuaggcauccagcucaugggccugucccaguguucgcuggcgcccuccaguggccgcagccuaggucuuggucuuguguuuucuaucuguugcaguucucuuuacuaaugcccauccacauuguccugucuauugagggcgucagguguucuugccugggcucuugucaagcauccucagcacuaugcaguucuccaaaauggucaagacuuuaaaauacagccaaacaauagcaccaauauuaugauguacaugaaaguaaauacacuuuaaguuauugcguaauuuauuucaucuuuaaguuauagugaguagagauaaaacuaaugauguuugcugucauuugaaauaguugaacucuauuaauuugauuauuauaguuaguuuaucaauguguacauguuuaaguuaagggauuuuuggauuuguuauuuuaguauaauuuaauuuuauaaguauaaaauguuugcauaauuguaaaucagacuuacagaaaaagacacauuggaagacgccccgcuugcugucauucucuccuuccuuauuuacaacugcuuuuguguuuucuuguuuuauuuuucuuuauuuuugaaauggggucucucuauguagcccuggcuauucuggaacucuauguagaccagaauggacuuaaacucacagagauccccugcuucugccagugugugccaccaccccugccgaguuccugauucucuuaguuuagccucccuaguugccaggaucaugggugagccaccauaacuugaauguauguugucggguuuuguuuuccuuuguuaggcuugagacuuggucucacuauguaccucuaaguaaccuggagcucccuguguaaaccagacuggacuccagcucacagguccccugcuucuuccugagcgcuggaauuaaaggcauggucuagcucucucagccucgguugaaaaaaaauuacuguuuuaaggguuguguuuauagcucauuuggaauaaagcaaaugucuuagaagcauaaagacuugaauuugauccccaacauccauccacuugaaaagcuuggcauaagggcuauggaaagauggcucaaggguuaaguaauacuggcugcuauuccugagguccugaguucaauucccacauggccacucacaacugucguagucccaugggauccagugcccucuucuggugaguagaucuauaugcagacauaacacccauauucauaaaauaaaucuuuauuccccccucccaccaaaaaaaucguggcauagucaggcuacugugacucacaccuguaauccuagcacuugagaguugagucucaggacagcuuaggcuacaucuaaaauucaguuuuaggccaggccuugccucaggaaaaaaacacaacagaaagcuaggcaaggagguauguauguguaacccccugcugggaaggcagaguccaagcagaucuccgggcacuggccagacagucuagacucauugcugagcuccaggccagugaaaggccgaauuucaaaggagguggcuagcuuucuugaugauacccaggguugucuugcacauguauaugcacacauauacacacaccaagaacaaauuuucuuuucuuuuuuuuauuuagauuuuucuuauuggauauuuucuuuauuuacauuucaaauguuauccccuuuccuagucccccccaccccccaaacccaucagauuuucuuuaaagguuauuuugcuuuuguugucugucagccaucaucucauucccacccauccugggugucagacucagggccauguccauaauacacagccuaacagcccacauuuaguauuuaacgacacggaggugcuuuuguuucuggggggaaaagucaguuaugaaacuauauaugugucuguaaucuugauaguucuggaacuggcuauauauaccauacuggccuugaacuaacagagauccuccugccucugccucccaaaagccacaauccuuaaaacaguaaauuuuugguguuguuuuuuguuuuuaaauucaaggcugagagugauggagcaugccuuuaauuuccagcgcuaaggauuuaaguuaaguaaucccacucgccgcuaauagacaaguuucuaaaaagaaagugcauugccugggacugugccaaaugauguucaugcuguggagauggcaauaggagugagcuucuuucucauugguugauuuuucuguguagucgauuuuuuuuucuacuguagaaaauaaguuuuuguacuaaaaaaaucaagguuuagcuugcaagacaagucuuucacuuuuuucuucucuguguuuuagacauuugaagacagugauuuguuccacuugaucgguguuaucuguggauuagcaauuuauaauuuuaccauuguggaccuccauuucccuuuggcuuuauauaagaaacugcugaaaaggaagccgucccuggaugaucugaaagagcugaugccagccgucgggaggucagugguuggaaagugccgaggagggcuugaggcugagaggagaggacugcacacgaggcuugccugcuggagacagccguggcuuccuugucugugcuaacggguucaggacagcccagugugugcugacucaugagcagagcugucaguaagaacauacguuuuacuguaaagacgcacucgguuugguuuuguucuguucuguuugcagaagcaugcagcaauugcuggacuauccagaagaugacauagaggaaacauuuugucuaaacuuuacgguaagaugagcaggagcuuggccucgguuaggauuucucguuccauagagcaaaugcuuuuuguuguuuaccaagacaggguuucuuuguagcccugacuggccuguaaauugcucuguagaccagguugcccucuaacucaaggagaucugccugccucugccaccaaugcaguuuuuuaaauguauauuaaaauguauacauuuaagccaggcgugguggcgcacgccuuuaaucccagcacucgggaggcagaggcagguggauuucugaguucgaggccagccuggucuacaaagugaguuccaggacagccagggcuauacagagaaacccugucucgaaaaaucaaaaauaaauaaauaaauaaauaaauaaaauguauacauuuaagauggauauuauauggugucuuagucaggguuucuauuccugcacaaacaucaugaccaagaagcaaguuggggaggaaaggguuuuuuauucagcuuacacuuccauacagcuguucaucaccaaaggaagucaggacuggaacucaagcaggucagaaagcaggagcugaugcagaggccauggagggguguucuuuacuggcuugccuccccuggcuugcucagccugcucucuuauagaaccaagacuaccagcccagagauggucccacccacaaggggccuuucccccuugaucacuaauugagaaaaugccuuacaguuggaucucauggaggcauuuccucaacugaagguccuuucucugugauaacuccagcugugucaaguugacacaaaacuagccaguacauauggguauuagucugcaugauuaugugggcacaacacaucuugggacuggaguuacauagagaugguuguuagcuguuauguggggacugagacuugaaauccagguucacuggaagagcagccagccacgauacauuuauugagcuuuuacuaugucccagcauuauuucauuuuauccacaccgauccugugaguuuuuauccuuaauuuacagauaaggaaaacugaaauaguugcaugucagccauuguucaccugcucuaugccuucaguaauuagguacuuugcuaauuaagaagagaacuuaggagagucagggauucguucugagccuguggcuauaggacgaucagagauggaaagaugauuuagacacagcguagcguuacuaaugcacuuagacugccucguagauggauuuguccaguuugucucuccuccucacugacggccaugcuugcuuaacuugucacuucuguccuuccaccauggaucugggaauugaacucacggugucaggcuugcacaagcaagcaccuuuaucuacugagccaucuugccagaccucuuagauuguuguaagauuggaacguccagcguguuugcaaggaaauucagugcaugcuuuaaguugaaguaaaauuagugcauuauuuuauuuuauuuaucacaagaaaaaucuuacugggagcugcaagagaagaacacuuauuucucuuacauggcaccaugccucuggccuccacaggcaccugcacuuugauacacauucgcauauucagaccuacacaccucaguugaaggcuuccggugaaggcagcaccaguuuucuuuacauguaugguuccugguguguuuccaaagugggugaccccauccagccacagcagcacuuuauguuugggucuugugugacaaaacuuuuccuggagagagauggauaccaccaaagcccagcuugguaaaccagugagauugggguugcuuacaggaauauggauagggaauuacuuacaggagcagaaaugacaguugcaucaccaagacucaccccaacgcaggugacaggucacaaaaguugggaaccuagagcucacugcacugcacagccuguaggcagcucagcaggguggagaguguccuugccaagugacuuccuccaggcagcuggucugcucucagaaucaccuuugcagcauagcuuccugcccucugagagagacucuugaguuuauauugcuuacucuggcaggcaggggcccaguauaacagguaggaaugaguuuaggagggaguuaauuuuuuaaaaauuaacuaacuaggcuggguaguuuagcaguuaagagcacugacugcucuuccagagguccugaguucaauuuccaguaaccacaugguggcucacaaccaucuguaauggcauccaaugcccucuucuggugugucugaagacagcuacaguguacuuauaauaaaugaaugaaugaaugaaugaaucuuaaaaaaaagaaaaagccaggcagugguggcacacaccuuuaaucccagcacuucggaggcagaggcaggcagauuucugaguucgaggccaguguggucuacaaagugaguuccaggacaauuagggcuauacagagaaacccugucucaaaaaaaacucaaacucccccccucagucccccaaaaauugugaguaggcucuugguggcauaauuuugacuauauuuaaugagagaugcuacuuuuuuuuuuuaauuucuagaucacaguugagaacuucggugcaacagaaguaaaagagcugguucugaacggggcagacacugcuguuaauagacagaaucgguaaguggauugcacuggacucagcgaagugaccaggguuaguaggcauuuucuaaauuacugaaaacaucacaacuuaaagaaaacacuauuguauguuguguaugguagcgcacuucaggaggcaaaggcaggcagcugucucugauccagcuaggacuauguaaugaugcccugucucauaguccaaacacaaacaaacaaacaaacaccauaacauuugaacguuuaaugugccuuugcucgugaaaucgccuauaaguaaaggaacaaaacaaacaugagaaaugagaagaaacaacagcaaacaugguuugaaaggaaaugauggccacugauuagcaaaucagagaaagcagugauggacuggaauacccagaagacaccaguuuauuuugcagaacagcaguucagaugcugaacuaaacucagucuuagaaagugccaggcaauggugcacgccuuuaaucccaaaacucaggaagcaaaagcgcuuggauuugaguuugaggacagccuaguagucucugagagacccugugggcuuguuuuguuuuguuuuuaaagccugucuauaaggcacuugagauuauuucuaggcuauuucuuaagaaaaauacuuucagaauaagguaacuggcuaucauauaauuucaaaguauuccuaaaucaucaaaaaauacucaguucaacagcuggucuggccuaacuacugggcaagagggagggaguuagagcccugggucagcuccguccuacugagaacaaguagauuuuucagucccuuuguuuuuaaggaaucuauacaauauauauuucuaagaaauagcuauuaagcauucuuucaagaucaucuuuaagauguuuuuguuugcuuguuugguuugguuuauuuuuaaugaaggaauuagcuaugguuuaguguagcuugggauugguuucuuuuuacccauugaacucuauacucauuuuucugaguuuaguugaaaguagcaagaaaugaaggagcaaaaauguaaugauaagcauuggguauucuccauaaauggugcgugugacuugugcaucuaugccuggcuuuuauuucuaggcaggaguuuguugaugccuauguggauuacauauucaauaaaucaguggcaucuuuauuugaugcuuuccaugcgggcuuucauaaggucuguggaggaaaaguucuucugcucuuccagccuaaugaauuacaagcuaugguuauugggaauacaaauuaugauuggaaagaacuggagaagguaaggaaaaaccaaucucuacuugucaguggaaaagcaaaacuaugcguuauuggaaaucuagcccuugugugcuuuugcccuuccuauagcuccuugcugugcuuauuguagacacuugccugccccuccugcccuacagugcacuguguggcggcacuggugaggugauugggaggcgugcuauaggaacccuagcccaagacugagugacuuucuacccaugcuuaauuaaggcuuuuguuuccuguuuuucuaccaaaucccaguguuaagcuugaccauggugggagaggacuacaaaaggaaaagccuugguagcauuugaaauguaaaugaagaaaauaucuaauaagaaaauuguuuaaaaaaaaggaaagggaaaagccuuggugcucuuaacacuuuuguuuuaaagcggggaaaggggcuggugagauggcucaguggguaagagcaccugacugcucuuccgaaggucugaaguucaaaucccagcaaccacauggugucucacaaccacccauaaugagaucugaugcccucuucuggugcaucugaagacagcuacaguguacuuacauguaauaaaaagggggaaaaaauuaguagaaacauucugauuugucuuccugaaaauaguacaagaaacauuuacccagucccauguuuguguuuaauaaaccucucacuauuuuaguaaacucuuacuuacaaaggugacgggucuguucuuccuuccuggggagucaguaucuucacauuguaaaaugccaggguuguaauauuccuacucuuaacaugauagguuucauggaauacuccuuaaugcuaaaaaagguuguauuacuuuuagaauacagaauacaaaggagaguauugggcagaccaucccacgauaaaaauuuuuugggaaguguuucaugaauuaccacuagagaagaagaaacaauuucuauguaaguauauucugagacaauaaucuaaaguauuagcucaguuuagucuuuguuauuaagauuuuuauuuacauguauguuguaucugugccgaguauaauguauacagguaucccggaaggccagaaggguaugccaugcgucagacccccuggagcuuuuauaguugugggcuuuaucuauagagcucaagugaugucugcaguugccugagauccugugucaaagaaacagcguuggagaacuagagagagcugggagcgcagcuuagcaagggaagccugacuuggaguucagucccugggacccacauggaaaaggagagaacuuagaaagcuuaacuaaccaguuuucuaaauggcucuuccaaaaaggauuucuaaaagcuuuugccauuguucaucaaguauugaguacuuccuuuaaaauaaugaaugcaaaacuagacuguguugucuaaauuguuuuccuuggcaguauuuuugacagguagugaucggauucccauucuugguaugaagagucugaaacuagucauccagucaacaggagguggugagagcuaucucccgguuucccauaccuguuuuaaucuucuagaucucccaaaauauacagagaaagaaacccuccgauguaaacugauccaagcuauugaucacaaugaaggcuucaguuuaauaugaccuuggacuuuucuguuuaguacaaaaaccacucguguuucucuugugaauucagcacagugagaguuacuucuguaauucuuacuuauaaauuguucacuacuguacugaugaaagcccaaaauuaaaaacugugcauuaauacuaaacuguacagaaccaugaauuguccauccucauacaaguauugugaauacauuaaaguuuuacucacaggaauuuuaagaguuugcauauuucggaaauuaccugaugugugggugcauggaaauguugcuuacuguuucuucaaucacuggggggaaagacuacgauggccugcccacagucauuugauuauuuuuccauuuuguaaauaaaaauuuuguaauaaaauagugacauucagauaccagu

SEQ ID NO: 5544 - RNA, 13037 nt, Mus musculus
cugaaacagggcuucagauuuuaaugaagagcugaaguuggaaaucacuacaugccacgucauauccagagaguccauccuucugucuuuacaguggcugcucaugaaucaaacaguucuucaccucccgcagcaagacucuacaccccagguuucgaggugcguggugaagggaggugugcugugcgcggccccucgguagcgcccugggucuccuuaugauuggcucugugacgaugugucuuccacaucuagcucucuuuggucugaaagggaauaagugagugaaugaaugaaugaaugaaugaaugaaugaggguagggcaggagccccuuugucuccuccuccuuuuguccugaggcuauacuggugaguaggaaaacugaaaauccaaauuuuguuaaaggugugcuggaucuguauuccuaucccaggcaaggcaaagccagcugagccuuccauuguuuugcugguuaaagcuguuuuaaguuuugacacacacacuucuccauuagucucccuuguucaggaucuuucugggacugacugguacuguagccguuaguauucuaaugcuaauuuggguccccuaaguuaguugacuugagaggguaacuccuagcuucugggaaacugccccaguuaauucugauugguaaauaaagaugccagcagccaauagcuggggagaagagaggaagaggcaggauuuaagguuccugggcuugggaccuggaggaagcaggagggaagaagagagacucgcucugccucaggagugugcagaacagagacaagagcagccaugggguagggaagcaaggcgagccuuggguuccgggccaagaaaacguggcccagagggcugacuaauuggaauuaggagcagcgaagauggagcauagagauuagaaguaguaacucagaguuaggcaguugcccggcuauuguguuauuuaaggcauauuaaaauauaaaggcggugugugugucuuucaucugggaacauaaauggucuaaggugggaaggaccucgcgccaggauuuauuaaaaauauuacuauugggcuggaaagauggcucagcgguuaagagcacugacugcucuuccaaagguccugacugaguucaaaaucccaguaaccgcugggggggggggggggggcgcacaccuuuaaucccagcucuugggaggcagaggcaggcggauuucugaguucgaggccagccuggucuacagagugaguucuaggacagccagggcuacacagaaaaauccugucuuaaaaaaaaaaaaaaucccagcaacgaggcuggagagauggcucaguauuuaacagcacgacugcucuucugaagguccugaguucagaucugacguccucuucuggugugccugacaacagcuacaguguacuucauagaauaaauaaaucuuuaaacaauauauuacuacuacaacauacaccagguguaagaaguacacaucaucagaauguuuguuguccaccuguugaagggccaggcucucugcuauggacuagggauaccagauaagucaagcccagaauguaugugguaucucuauaguccagguggucuugaacuugcuaggguaccuaggcuggucucuaacucucuguccuaggauuaccagcaagugccaccagguagacucuccagguauuuaauauccaagauaaguggaccucaaaacauuuaauuaaauauuauuguuaaaccaggcagugguggugcauaccuuuaaucccagcacuugggaggcagaggcaggcagauuucugcauucaaggccagccuggccuacagagugaguuccaggacagccagggcuauacagagaaauccugucucggaaaauaaauaaauaaauaaauaacccgacccccccgcccaaaaaaaucauugcuuuuuguuuuucucuugggcauuguggacacagugagaaccauacaaugaugagaucauguuuuguaagaauacuaguauauguucacugaauaucgauuuugaaauaauucaaaacuuuaagccugucuuaguuaggguuucauugcugggaagagacaccaugaccaaggcaacucuuauaaaggcaaauauuuaauuggggcuggcuuacagguucagagguucagcccauuauaaucauggugggagcauggcagcauccaggcagauaugaugcuggagaagcagcugagaguucuacaucuugaucugcaggcagccagaaggacacuaucuucugcacugggcagagccugagcacaggagaccuuacaguccaccucacagugacacacuucccccagcaaggccacaccuccuaacagugcugcucccuauggccaagcauucaaacacaugaaucuuugggaagcaaaccuagucaaaucacuacaaacacauuucuuaaagcugggcagugcuaguuccugccuuuaaucucagcacucaggcagaucucugagccagaggccagccugcucuauagagugagcucuaggacagccagaacuacacagagaaacacugucuugaaaaagagaaagaaaaaaagccagguaugguagcacacaacccuggacaccaacacaggggagaagaguuggggccagccuagcccaggucacucuaacucuguuacaccaggccuugugcuuuuuuuuguuuuguuguuguguguuuuuuauuuuguuuuguuuuguuuuuuugguuuuugguuuuuggagaaaggguuucucugugcagcccuggcuguccuggaacucacucuguagaucaggcuggcuucgaacucagaaauccaucugccucugccucccaagugcugggaucaaaggcgugugccacccugcccggcuccuucugcuucuuuacagcucuuuaaauaugucucuuuuucuaaaauaaaacugaaagacaagaaaaagaaaguaaaaggauuuuuaaaugaaaucaaauagcaccaggugcuaugagagcaccugccuuuagucuagcauuuaggagacagaggcaaggccagccuggccuauguaucaagcuccaggccaaacgagauaccacagggagacccugccucaaagaacaaacaaaauaaaaauuaauaauugugugguuugaaggaacgucuccauaggcucauauauuugagugcuugcucauuagggaguggcccuacuugagagggauuaggagguguggccgaauuggaggaagucuguuacuaggggugggguuugagguuuuagaaacccaagccaggcccagggccucucugcugccugcagaucccaauguagaacucucagccugcaugcuaccaugcccacccucguaaggaugauggauuaaaccucugaaacuguaagccagccccaaugaaauguuuucuuuuauaggaguugccuugguuaugguguugaagaaccugccugacuccauuuugaaggcaggauacauugugcuauguuguuagaaauaacuucaaaccaggcagugguggcgcacgccuuugaucccagcacuugggaggcagagucaggcggauuucugaauucgaggccagccugaucuacagagugaguuccaggacagccauagcuacacagagaaacccugccaugaaaaaccaccuccccuccaaaaaaagaaagaaagaaaaaaaaaaagaaauaacuucucuuuuacuguaagaauggagucccuguuuuuaagucuguuuccuggagccugaccugccccaacccaugaccuugacuuguuuuuuuagagcacccuaaaucucccuaauucacaugauggugacgacccccagguguuguuuuuguugucauuauuguuguuugagauuuuucuguacuucuguuagggucuaaaggggcccaaggguccagagggaaaacaaaaucugauuugaaacugacuuccagucagggacaagagcacagacucgggagcugacuguguucuugaacauucaucuuaguauuuaagcagaugacaaaaauguauugcaccugggccuacugguccaucagggucacaggagacacccaccggagcuggacuuuaacacuacccccaccucgccccccaccccagaauauuacaguuuuuaagcuugaaaacaacaaauaucugugccaagaugcaguuacaauuucccauccaucagaaucauuugcucuuucaugguuaggaacagucauuguuuugugaacaaaggaagaauaaggaggaauuggacuguccaccugggaagcgcgccuggagccucggaauuugaaguuaauuucaccuuacggucaaaacggaguuuugaaaacaaaauggcaguacugaggauaagucucauauguuugaucccugaacuuucuuauugcucccaugucugucuucuguaagccugcuuugaaacuacuuauggggcugcagagacgauggcucagcuguuaagagcacuggcugcucuuccagaggcccugaguucaauucccagcaaccacaugauggcucacaaccaucuauaauggggucuggugcccuccucuggugugucugaagagagcaauggugguaaacucauaugcauaaaauuaauaaguaaaucuuuuuaaaaauagggaaaaaaaaggacaggaucucuaaaaaaaaggaaagaaggaagaagcuacuuaugauuuuacucuuuaaaaggugcccacaaaauggacuuagagcugcucucuuaaacacaacuuaggagacagucacuggccaguuuuuggugcaccccaauaaaaaucaaguuuguuucaaauauggcucaaauuugucaugguggucuuauucuugcccagugggauuaacaguauagcuucauagcaauagaacacugacaauaaauaaugaugaugauaauaauaauccaauguucaaguuuuuaaucugugaaaccguuucuccacuugggaggccccgauggucaagagcauguuuguuuuuggagacaaggucccccacagcccugcuggccuccaacucacaagaagcugaggauguccuugaacuuugguccuucugucugcacuuuccaagagcugggauuauaggugugcucuagagccucccuuuaauucuagcucucgggagacagauauagaugcuucucugugaguuugaggccaaccugaucuacacagcaaguucuaggacagcuaagucuacacaaagaaacccugucucaaagaacaaacaaaaauauucauuaucucccaaguauuaguucuaagguauguuguuuuuguuuuuaaaguucccuuuauauagcccccagcuggccucugagugacagcucugaccuugcuguccagucuuaaagacuugcaucaaaaagacuauacuccccuuuuaacaccaaacauagcugauaauagacacugauagcuggauagacacaguauguaaucaauuuuuuguugguuuuuugagacagggucucuacacagcccugguuguccuggaccuauguagaccaagcugguguugaacucaggaagauccaccugccucugccuccagaguaguaggauugaaggccacuagggcacaacaggguuuuguguaucuaaggcuagcaucaaacuugcuguauaucaaagaauagccuugaacuuuuuaauuuugcuuuugagacaggguuucaucucacuauauagccuggcuggcuugggacuagauauguagacuggacgggccucaaauuccgaucaacuugcguuaccucccagcugggauuaaaggugugcaccuccaugccugacuaaaggaaggccuugaguuuaggaucuucagccucuaccuccaaagugcuggaauuucagguuuguaaucuuggcuagucucuccuaucaaauauuagaaaauggcaaauguuuuaacaccaccccuucccacucccccccccccccccgccccaguaaaccccuuguuuacccuaagagccuacugccuuuuccagagaucugaacagugaccccuuucuccuuggaacacugaucccucccccuuccucauuuccuguggccagugcuuuucagaucaccagacugaauaaagacuaugagguaggaccccaaaggggaagccaccacccgaauuagaauaaaaaucaaaggcacuuccuucucuguuuccucuccuaagcacuccuggauggugaacauuugauuuccaaccuagggacucagaugcauauuuuacauaucaaaacagcuugaccuccaaguccucccagcaucccucaguccuuaccugcaaucuccuacuccagcccugaacuuacuuucuuucuuucuuucuuucuuucuuucuuucuuucuucuucuucuucuucuucuucuucuucuucuucuucuucuucuucuucuucuucuucuucuucuuuuuuuuuucuucucugagacaggguuucucuguauagcccuggcuguccuggaacucacuuuguagaccaggcuggccucaaacucagaaauccaccugccucugccucccaagugcugggauuaaaggcaugcgccaccaccgcccagcuuuuuuuuuuuuuuuaauauuuauuuauuauuauacauaaguacacuguugcugucuucagacacaccagaagaggacaucagaucucauuaugggugguugugagccaccaugugguugcugggauuuugaacucaagaccuucagaagagcagucagcgcucuuaccagcugagccaucucaccagcagcccugaacuuucuagcccagggcuugggcugcccuuccucuagaggcucuuuauauaauacaggcagggaagucgccaugggaaaggaaacagaggggagggguaagagaaagagaaagauugcauacagagagagggagagaagagcaaggagagaacaagagaccaaaugauucuguuuagggugaaacacugcagauggaaauacugaugguaguggaacauucuggaaccauuguggacaguagugaugcuaccaucaccucuuuauccacagauaucugauuguguuuauaugcaaaggggagucuggagaaagucaagaaaagauuuaccaagaaauacugaauuuagugugaugacuuauacuuacaaccccaauacacaggugguugagacccaaacacugacacaggauuuagccagccucgguuacauggaaaaaagaccaaauuauccaggggaacauggaaaauccuaacuuaaauaaaccaaacaagcuaacaacaagaaguaaucaagagcuauuauuaugaguuuaagcuucaagaucuauuuaggcaaggucuggucaauaauguguuugcccucugagugugaggacaugaguucaggucuccagaacccacuuaucuguagggagugagugaaguccuguguaaauguaguugugacaugcacacagccaaugucucaaccucauggugguauuccuggaaccaacugcuaucuuagcuuggauuuuauuguugugacgagacaccaugaccaaaguagcuuuuauauaaaagaaaacauuuaguugggacugucuuacaguuucagaaguucaguccguuaucaucauggugggaagcauggcagcacccagacagaaauggugcuggaggagcccagagucaucuugauccuaaggcagucagaagacucauuuucauaaacagcgagguggaggcucucuuuuucacuggauggagccugaggauaggaggagaccucaaagcccacccccacaaugacauacuuccuucaacaaggccacaccucccaauagugccaauuccuugggucaagcauauucaaaccaccacacucuacuuccuggcccucauaggcuuguucaaacaaaggagucuauggggaccauaccuaaacauagcauaaugcaaaauacauucagucuaaugccccauauucuaucagucucaacaauguuuaaaagcucaaagucucuucugagauucauacaaucucuuaacuguaauccccuauaaaaucaaaaucaaaaagcagaccacauacuuccaacaucacaggauauacauuaccauuccaaaacuucauagugaggaaauacuggaucaaagcaagacagaaaaccaguggggaaaacuccaaacucugcaucuccaugucugauguccaacuccuuucagcuuuguugacuuuaacaaacuuucucuugggcugguuccacucccuguuagcagcuuuccuagguagguaucccacaacccuggcaucucucauuuggggucuccaaggcaacuacaacuucacagcuucuuguuccaaugucugggauucacccaugauuuucugagcuccucuaaaggaauuuggucacuucuccagcucuggucucuguaguacucuaggcucuggcugauuucacuacacuguugcugcucuccuuggugguuaucccacgguacugacaucuccaauaugcuggggucuuccgcuacaacuaggcuucaucaacagcugagaaggcuaggcugauuccaugacagacuucaaauuggcaauuaaggagacgaggccuaagaacgagucaaguccaggaaaacucaggcaagucaauuacuaauagaaaaaaccccaggcuccagccuucaugcuccauaaugguuccaggaugccuagagauagaguaagauaaagcucaccuaccagggauuccagugugcuuuaaaucgagccugcaagcucacuuggcugucucucuaccuugguaaugggagaccccagcacacuagacuuuuguguuuacauacuauuugagucugggguaucauucuuuggcgaaccauggacccuuacacagccucucaugggcuucuucauaauacucagccucaacuuuuuugcaugaccccaucagcccuguguuguuaacuacaacugaggcuguaccuucaccaauggccuucacuggccucuuacagugccaagccucagcugcuuuucaugacuccuucaugccuucuguuggaauuugccaaaagacccucacucacaaagaccaccgagaucaacauugcugcaaacugcaugcagaggauuucuauugaucaaugcauuggggacccuccucagcacgcaggcaagaggagagacuccaaagaaagaaagaacacacuuuuuuuuggggggggggggugguuucgagacaggguuucucuguguagcccuggcuguccuggaacucacuuuguagaccaggcuggccucgaacucagaaauccgccugccucugccucccgagugcugggauuaaaggcgugugccaccacaccuggcccaagaacacauuuuuuauaccuuguaagggucagauuuaggcaacagggcuagcuggcuuauucuaauugguguagcaaguaaccuuuucaggcauugguugguuugcauagggugacuaccuuuggccuacugacucacugugccugcccuuaugguggguuauucagcaaagcagcauuacauuuugaacuuaugggucagcuauuaacaucacagcuaucgacaaggucagggcgguucgcguuuuguuuuguuuuguuuuguuuuguuuuguuuuguuuucagaauucaguguggggcgagguaaggagaauuucucuaggaacugcuuaucuuguuaugguuauuuuuuugaggaagguucauuuuguuuuggcagcuguagacuuagucauuuugaccacuauguuucugaaagucccuucagaggggaagaggcuaagugaucuugaauuuauuuuggauucuacacuucaaacuaguaccaccugggugacuuuuacacauuacaauguacagcugcagcuuaguuauaucuggaacacagcuucuuugugcucucagaaaauauuucccagaagauuucaccucaaugaugcuggucucuuaaucaccacuaauuccuuaguuccagcgaacuaagcaucaauugucaucaauuguuccagcggucccuucuauucuuuuuuuuuuuuuuaagauuuauuuauuuuauauauaugaguacacuguagcuguacugaugguugugaaccuucaugugguuguugggaauugaauguaggaccucugcuugcuuuggucaacccugcucacucaguccccgcuugcacuggcccaaagauuuauuuauuauuauauauaaguacacuguagcugucuucagaugcaccagaagagggugucagaucucauuacaggugguugugagccaccaugugguugcugggauuuguacucaggaccucuggaagagcagccagugcucuuacccacugagccaucuugccagcccaguuccuucuauucuugacucuaaagccagagccauggccgaagcuggugacuucugcugcuuccuggggcuggaacaugaccccuuauucuauuacauccuucagugcuuaagcacaaauuuacucuguaaacugaccuugaacucagaucugcaagucucugacuccuguguucuggaauuaaagguguguaccaccaugccugggccuaagcuuuucauggccgccaugccucaagauccagaucaauagcuugugucuuccagccucaagauauguaucacaggugguacccuccauuucuguaugguaauucauuccagauuaaagcccaaaugaaaugacaccuaacaugauguaacuaucccuuguucaaauugcaaaagcauaaacaauaagcuuagcugggugggaucuugccccaaggucaccgcucuuaauuauauuuaauaucuaugaacacaggauuuaguuccacuccacuuccuggugucccuugaauacuucaacagcacauuuuguauuuuuuuccuuuuuaagcuuacuacugaaguggaaacuucugguuucuuuggaaagugaguugugucagauggcguuuugcuggagcaaacacgugaaggaguguuugccugaaguagacacaggugaaaagauguuuugcuaaagcaagcuugugaaagaacgugugaugaagguuucacuaacaacacccauuuauugguuugccuuacauuguguuguugaguucuguuuguggugacuccauagagagaaaugcacuaaaagaacuuuuggugguguucugguggcuucuugccauuuccguggaugugggcugauagacagagugaugucagcugauacagacucuuguacugaggcaagacaugugguggcacaagcugcauggaggacauaggaaguuuggaggaaguauaaacaggacucaauaaauagugaugggggcuugcuugcauagcuagcuuuuacgcuucuuggucuagaguccuugcugauauucccuuuguugagagaggcacaauagagaauuucuccuaacgucacugauggucuugguuguuccugcugacuugugccaauguggcugaggccuggcuguuucugcuaggacaugccaaagguacggauccaugucugcuauucuggcacugaauuggauagcuaguauauuaguaaaguauuugucaguagaucgagcuguugaauccuaugagcuaaauugcugauguccagacaaugcagaugggaucugcuccaaagaacaauuccuuuuuauuuauuuauuuauuuauuauuauauguaaguacacuguagcugucuucagacacaccagaagagggagucagaucucauuacagaugguugugagccaccaugugguugcugggauuugaacuuaggaccuuuggaagcgcagucggguggucuuaccagcugagccaucucaccagccccaaagaacaauuucuaaacaggucuacuucucccauucucaguaaccuuucuuucuacuaccucuggcagguagugggcuagaagagagauuaaaacauuuaaaaaacguuauuaaaaauauugagucaggcagggguggcacaugccuuuaaucccaggacuugggaggcagaguuaagcgguuucugaguucgaggccagccuggucuacacauugaguuccaggacagccagggcuauacagggaaacccugucucgaaacaaacaaacaaacaaacaaacauacaaauaaauaaaaaaaaauaggguuugaaaaacuccaaacuuacacuuaaucaaaacacucuucauagccgggcgugguggcgcacgccuuuaaucccagcacuugggagguagaggcaggcagauuucugaguucgaggccagccuggucuacagagugauuuccaggacagccagagcuacacagagaaacccugucucaaaaaaacaaaacaaaacaaaaaaaaaaaaaacaaaaaaaaaccaaaaaaccacucuucaugagaguaaaccagugcuagguuuuuuggagacuuccuuucucaaugcaagcagugugaauuucuucaccuuaaacucaggaagucuccccagaaaagggcaaaaagcagucacauucuucaccaaauuauuacaagaacagucucuaggccacauacuaaaauucucuucugaagccuuuugagccagguccacaccauucaaaucacuacagcaccaacguuuuccguauuccuacuaguaugguccauuaagccccacuuaaagcauaccacuacuuuacaaacugaagguucccaaguccacauuccuccaaacaaaaacauggucaggucucucacagcaauaccccaaucccuaauaccaacuacugucuuaguuaggguuagugaggagaugcuaugaccgaggcaacuguuaugaaggacaacauauaauuggggcuggcuuacagauucagaggguccguccauugucaucauggcaggaagcaugcuguguucagacagacauggugcuggagaaggaacugaggguucuacaucuuggucugaaggcagcuaggagacucucucuucugcaggcaaccaggaggagggucucuuccaca

SEQ ID NO: 5545 - RNA, 798 nt, Mus musculus
caugggugguguguucagguuuuccggucugcuucggugcaccgcugcagcuccagccucgggucugacgagccacggcauggcuucugcuuuggaggaguugcagaaagaccuagaagaggucaaaguacugcuggaaacguccacuaggaaaagacuaugugauacucuuacaagugaaaaaauccaagaucgagacggaacucaagaacaagaugcaacagaagucgcagaagaaaacagaacuugauaaagaaaagccagcugcuggggaugcuccucuacaacaggauacaccgugaaaaucaguaauuaugggcgggaucagucagauaaguuugugaaaaucuacauuacuguaccuggaguccaucagguucccacugagaaugugcagguacacuucacagagagcucauuugaucuuuuguaaacaaccucaauggaaagaauuacuccaggauugugaacaaucuuuugaaaccuaucucuguggaaagcaguucaaaaaaaaaaaaaaaagucaagacugauacaguuauuagucuauguagaaagaaagagaaaaacacaagaugggacugcuuaacacagguggaaaaagaaugggaggggaaagaaaaaccuuccuccgacagaaaagccuuccccccgacagugaugcagacccuagugagggauuaaugaacguucuaaagaaaauuuauaaagagggagacaaugacaugaagugaaccauuaauaaagcguggguggaacccagagagaagcaagccagagacgacacagaacuuugag

SEQ ID NO: 5546 - RNA, 838 nt, Mus musculus
cuuuuuuuuuuuuuuuaagauucaaggucauuauuuauuuguugcucuuaaagacucauuucugacuggacucagacuuggaaguagaagcucucagcaaggacagcccaugucucuuggcaauguguuccuggcgcuuuucuuuggcuuccuucauucucuuggccaaaaguuuaacuuaauucugcagccuccuccuuguucuucuuagugcguugcuucuucagaccaauacgucggcauuuguguugcaggaugcguggaguaacaagacccuggaucuugggugcuuugguccugggcuucuuaccuucuuuguuuaagggcuuccugacaacauacuggcagacaucaucaucuuuggagagauuuaaaagcuuucggauucuacuagcccuuuuaggucccaaccgacgaggcacaguaguaucugucaguccaggaauauccuucucuccuuucuuuacaaugaccaaguugagaacacugagauuagcguccacgaugcauccucgaacagacuugagcuuccucucuucaguucuccuuggucuguaacagggaugcccccuauucaacagcaggcgcacucugccaugggucagaacaccgugcuucaugggaaaaccuugcuugucauucucaccucugauccgggccacauaacccuuccacucuucaccaagagcaucagcggcuacuuccguggccaugcacuucucauagaaggugcggagcuugcgcucaucauccaccucgaugagcuucugacagucggcggcggggaaggagauguucagcuucaucuugacacagacgagcgccucauggcaggugu

SEQ ID NO: 5547 - RNA, 8071 nt, Mus musculus
ccuuuuccguuuucucugaucucgguggcagggauuuucagcaaaugcccuaacccucucuguagggggcucacguucaccauuuccagggugaguucaucucuguguaacucguccuuaccuggagugacugggugugugaucuauucucaccauuccuggggugaucucaucgaugugugaugcaucuucaccauuccuggaguaaccucauccaugugagauacauccuuaucauuucugggguaaccucaucuauaugugaucuacccuccauuccuggggugaccucaucuguguggcacacaaugugauuauaaaaagacaaagagguauaagaacauguucuauggggguguggugaggggggggugccucagugggcccaugccaaugcauccuuucucccugaaggaccagccacauucuauacuauuauauuguauagaauagaauuuauucagggcauggggagaggaguuaaguggauaguagaggcagagaaaggcagagagagagagagagagagagcagagaaguagaggccggccaugaccacagggagagagggagaagggaagggggaagggaagagcccaagagggcacgagagaagcaagccgggaaggaguaagagagggaggagggggcaagcagccccuuuuguagugggccaggccuaccuggcuguugccagguaauuguaagauggaauuuagacagagugcuaaccguacacaucuucaccauucuggggaugauuuauggauggaaaaaaagagaaagaaaugggaggagcucaggauguucuuagguaugguggaggagaagguuugugacagacauaagagagaauacagaauauggacaaaaagaggcaucugggagagugcagagugaacauugccagacugagcuggacuauguggagagagagaggcagggaaagcaagaaaggagacacuaacaaagagggguagccugggcuaagagauaauguaaccgaaauggcugaauuguauaggagccagagaggcugggggaagggaaaacccaguccagccucguggcuggagaaguuuaggguaugggguggaguaugccagccaggaggacccuggaauggguagagacucagggauggugggaaaacuugguggccagggucagcuuugauaugguaauaguaaccucuguuagcuguuugucuuggguuugagaccuaacaguuugauuuauaugugauccauccucaccauuccaggcaugacuuccucaccucaucuaugugugauccauccuugacauuccuggggugacugggugugugaaggucuaacuccaccuccaccccacccccacuccagaccucuuggaccagccagccauauuaucaggggacguaauuaaugacauuugaccuugcaucccaguuggaaagcauucaugccuuaccuucauccuucaucaaacagcucaagccaguugcuacuagaguugagggucccuaggguggaguagacaucguucucuuuuuaugcuuuuaaauauugguaagugcccugaacuagucuuaggucaacuugacacaagcuagagucaucugaaaggagggaauuucuauugaggaaaugccuccaugagauccagcuauaggggauuuccuuaguuagugaucagugggggagggcccagcccacuguguucuaacccugggcugaugguccugaguucuauaagaaagcaaggugagcaagccaugaugagcaagccagcaagcagcaccccuccauggccucugcaucagcuccugccucuggguuccugcccuguuugaguuccuguccugacuuucuucgaugaugaacagugauguggaagguaagacaaauaaauccuuucuuccuaacuuguuuuuuggucuugguguuucauugcaaaaauagaaacccuaacuauagggcuggagagauggcucagcaguuaagaacacaggccacuuucccaaagguccugaggucaauucucagcaaucacagucaucuguaaugggaccugacgcccucuucagucaggcagguauacaugcagaaagagcacucauauacauaaaacuaaacaaaucuaaaaaacaaaaaccuaaacaacccuaacuauaaugacaauaguaguaauaacaauaauaaaaacaaaccuuggggccuaaccaagcaguugaugggaucugaggacggaacucaacuugcaaguugguugcugggggcugggagaguguaugcaacccugggauucauccccaauacugcauuuaaccugagugcacagccuggguguggaggagcagaaguucaagguuguuugaaggagaaugacuccauaggcucagagauuugaaugcuuggucaccagggaauggugcuauuugacaggacuagaggguguagccauguuagaggaagcaugucacugggaguggccuuugaagaugaggaugucgcugcaagcuccuucucuagccccaugucugccugccagcugccugccugcucccaccacgaugaugauggacugaaccccugaaacuguaagccagccccaauuaagugaguuuaauuaagugaguuuaauuaagugaguuuaggccccaguuauaagaguugcagccuucagugucuugucacagcaacggaacagcgacuaaaauguggagauacaggaggccucgccucaaaacgugacaacauaaaaauucacguuguaagcugggcgggaagacagcuccuuuagagguuguccagucauuguuuucaauauuaaacuguuacacucggaggucaguuucaggagaauaacuugaccgguguuuagcuuccaaaucaagucauguccuagaaguuaguggcucugcucuuuuaucagucaacuuauaauuucuaguuccaugauaaacacuuuuuaaaucuuuuuacuucuuaccuucaccucuagcagcucuaaaggaaggcauguuuacacaucaggucucuuuuuuauauuauuuagcaaggguguacuuuaugcgaugauuaacaguaaauguaaagauuguuuuuuauauauuauuggauaauaaacuaaguaggcuaggggcuagagagauggcucagggguuaagagcacuggaugcucuuccaaauggcccagauuugauuggauucccagcauccacauggcagcucacaacugucugugacuccaguuugguguuuugccugcauguaugucuguaugagggugugugugugugugugugugugugugugugugugugugagucugugccacccaccuuguuuuuuugagaaugaccucuuccugggaccagguuuccuggcccgccagcguaguucgggaguguagcgaguaaggcaaggguagcgagcuuuuuuuuuuuuuuugcgggagcugggacucuggcugagcuccuccggcuuggcaagcccagugccaacagagcuaccucccuagccucuaucuuuuuuuuuaacuuccuguagagagcaagugucuuggauuuuaccuauugcuauauuggcucugaugauggaguuuaagaugugcucuccauaggcagcaucgugucauuugaaaaccuggaagaaggggcuggugagauggcucagugguuaagauugcucuucccgaggucaugaguucaaaucccagcaaccacaugguggcucacaaccauccauaaggagaaacaaauaauauagaaacuaugggccagagcaagagggagaaagggaaggggagauaagaaaaaaaagaaaggaaggaaggaagauagaaaggaaaaagaaaaccuagaagaagagggaagcuccuccccauccuccaggcuucuccccguccuccaggcuucuccccguccuccaggcuucuccccguccuccaggcuucuccccguccuccaggcuucuccccguccuccaggcgagccuugagagaauucucagaccuuccccugaagcaggucaugaaauccagacugugagaggugcucacccuguaauuagagaagaggaacguucuuguuaccaaaagcugaggacagagagaaggagccagacuagccgaacucuccgaagguuaucaugggcucaugacaaaccuguuugucuaaucaucucuguccccaacaccacucacuuccuccgacuuggacguucacaaguggccucaccucuuuagaucuaggaaaccgaaacacagcuugcgugguuuucuucggugaaucugaaucugacuuuuguuguagauucuucagccaggaaaaaauagcagcgaaggagagagagagaaauccuucccuggugagcuggauuccuugaaguugcagacuaugaaaagcgggaugcaguuguaaguaacccagcacucuccuacagugagagggguuguccaggcagaggagccauccggcagccaucaggccagcaagccuggaguaccuacuuaggaauaguggaagcaagagagacccugccucagcaagggggaagaaucaacucuuacagguuauccucugaacuccacacaugagcuguagcacauaaaacaaauaaauaaaaaauuuccucucaacaccaaccucuaacuuuaaaaaaaugucauuuuaugggcuggagugaaagcuuagcuauuaauugcgcuuucagaaagcccaaauuuaguuuccagcacccauggcuaguggcucacggaaccauuuuaggggagcuuuaggggagcuccugugagcgcccaggcacagauguggaggcaaacucacauacacacauuaaagaaaaaaaaaaaaggaaaucuuuaaaaaugcauguuaugcuggguggcuguagcauacgccuuuaaucccagcacuagguggccgaggcagaucucuguguucgaggccagccuggucuacagaucaaguuccagguuuguaauuuugacuuaauuuuuuugagggggaagggaagcuggccuagaacucacagguauccuccugccucugccucucaaguguugggguuaaaggcuugugccacaaccacugccagaguugaagguuuuuuuguuuuuuuuuuuuuuaguuuuauuuauucugugugcauguggagggguuuucacauguaugucacaguacacaugaggaggucagaggucagagguaggcuuagguuauaccuccuuccaccauguggguacaagggcucaaacucagguccuccaggcuuggugacaagugccuuuaccuacugagcccucucucuggcuucucuauaauuuacacuuccgucacugugguuaaagggcauaggaugugcaguuuuccuauaaacaagacaagaugugagaaacuuucccuaugagauggugccagcaaugccaggguuagggcaaacaccagguaggaacagaaguuccagacuuacugguuucucuuuaacuacagguuccugcgcugccaucaggagaauaauuacaguaugcaaacacuaacguguuuugcugcuguguuauauaauuaaccauuagcugccccacucuuggguuucaaaccucgucgauguauuucuucuucauauacagucagcagggaugcucaucugcucugagaccccagacucuucugucuguaacagcuccacacuaaugcgugacuuccagggucucagugggaggcauuggagacuagccagaagcccuuuucaaugaccuugacuuucacgugaccuuucgcucacccuugcuugacagaauagacaacuggcuggcuucacugugucaauuacugggaguccgcagucugcuggagaccuuggcgguugacucacagccugguucagccucugcgccucacucucucuccccuucauccacuucuaguucagaugucuaagagggcugggugguuucgaugagaaaccucucaggauauguuuuguaaaacaugguauugugcugucggggugaggagaggggcuuagcaggcccauucugaggcaucccuaucacccugagguaccagcaguacgaugggucucguauaaaaugaaguuuauuuggggcaugggagggggguguugagaagggaauaaaggcagagaaagagagggacagaaagagagggaggaaggagggacggaaaaagggaggggaagagagacagagagagagagacagagagagacagagagagacagggagagacagggagagacgggagagggagggggagggggcugggggcuggaggagggggagggggagagggagggaucagggagagcacagaagccaaacaguccuuuuuauagcaugccaggccagccuggcuguugcuagguaacugaugggcggagccuagaaggaaugcuaacaaguuaacaucucacaaggguucuggcaucugaacacuuagaucccaguugguggcgcuauuugaggaggucuagcuaguguaguguugcuagaggaaguacguuauugggcgcgagcuuugcgguuccaaagacuuugcacuguucccaguuugcccuucucuccgcauuguacuucugguucaagaugugaacucccagcauccugguccauaugccugccugcuugcugucucuuccgugccuuuaugggugcuaacccucugggaccacaagacaacauaacaacaagaccgucuuccuuaagaugccuuggucauggugugucuuaucgcagcggcagaaaaguacugaauacaagggacaacccgacuguguguuugcgccaagcgaucucguagacacgggccagucuauggacuaacugcccuugugcaucuauaccuaucacugucagagcacagaagaacgagccgcggugaacagugaaugucuuggggaacugugggaaaggcuccaggagaaaaggcagagggccuuuuaucucaggggugucuuguuuccuggauuguucuuggacgugauuuugugcuuccuguguuaaacauugacguucaagccguaaggcauguuuauucuuguuggaugucuggacauagcuauagaacccaaucuggucaguguacccugaauguggauguggccuucugccuugcuuuugugcuuucccagguagagucuacaguacuuuccagguaauuguguuuaaacuggucugaccugagaaaguucugggaaagagcugcccuguuaauaguaugagcuuacuggugcuaauuugcauauuuuucugaucacuuuuuuuuuuuucaaaacucaaacagccuuccuuggaucauuccuuucuuuguuacauuguguauaaaaggacacagaaacugaaguaagguugucuacagcaucacacucuaguccgcccguucuuucaggucuucagcgucagguccagcagacaagaucugcacagguugaugcaaacugacacaggauuaccucucuucuguuuauuuugguuuuauuguuugagauccagucucccgugguccaggcuggccuugaacuagauauacagcuaagaugauccuccugccuccaccucccaagagcugggauugcaggugugcgccucuauuccugguuuaugcagcacuggggcgucaauccaggacaacaugcuugcuaggcaacaugcaugcuaggcaagaacuauaccgacugagcuacaccccagcccucuguauccauuuuuuuuaaaaaaccaucuggagaaacaaguugggggaauaaauuacauaggaauuuggaaauaaaaagaauaaauauaugugccagagccauuuuaauacugaagauuuuuaaauguagcugacaauguuauuaaaauguuacuguaccgcgaugguuggggaaaucaaaaucuguuaagguuuuuagaagagacuacagcuuucuuauuuucuuuaaguauauguaaaucaaggguagcuguuggccaugucaggccacguacucaaguauacaaaaaugcugcccagcacgugccgaauagggccaauauggagggucuggguugagguauuaaauaaacucguaccagcccuugc

SEQ ID NO: 5548 - RNA, 3300 nt, Mus musculus
cauggaagaggaagccaaggucccagaaggcugcguaucucucacagagugcauuuacagaaaaacccaacccaagacugcaggcgccuuccacugaaguaacagaaaugggaaggggaaaaaaaaaaaaaaaaaaaaaacacugagugagucaggcgagcgggggacacggucucccuucccccuaccucggggugguggcaggcagccaacuggagcuugcugcauauuuaauuuaaaccuuugucugcccuggcaaggacaaaguacaaucuguuuuauguaaaaagucuucccugaggaaagccucagccuccagcugcgaaacugauugauguucuuaacuccucccccccccccccccagccucuguggggauccgagguugcaguuuccaaaaaaagaguuggggggggggggaggaaagcacuccaaacaaacaagcaaaacaaaauuucuugcuuuuauuguguuacucucaaucuaggagaauuagccugaaacuagagggagaagccuacaaauaaagccuauauuuuacaagccgauuucagagccccagaugggaggggcugggacagcaagcugccgcgggaggcuggagucucgucuaggagcuuugucuacaagcuccuucugccuugccuuagauggccuaaucuaaucaauacagauaccaaaacguccuaaagaugccuuaaagugaagccuucgugucaaggaacaucaccguuggaaauggucaccgaacgugagauggagauuaggagucaccuuguuuugagagcucuguggauuuccggguagccuguuucagagacccugauuugggagaucauaugucuugcaaaaccaaggcgugcauuguugcaacucaguuuggggucaccuccaaguguuccuggaccuucuagacuucugccuuagacugaagcacuuagugaccucagucucagcuggcgcucaguguucaaagguuagcgucgaggugcgcugaggagacccaaagggggcggaaccacccugcauagcauuagacuuuuaacucugcucccgcccucgguccccuguaucagauugguuggaaggagagcguggguuaagggggcauggaccugccuuccccuuucugguucaggagccaaacuucaucuuggagucagaacaaagccauggccggaucacacuaaggagcuccagccuguuuugggacagagccaggacccagaaaccauugccaugagccaccagcuggcugcggucccggaaaacuugugcagcugccgcacaggccagacugggccugcacacugucacagugccaggcccuccauuaaggcccccgucuccgcucacacccaacuugccccgcguacuuuggcauccuccugccuugaggugugcccugggauuacaggggagacuucagaaccaccgagugaccugccuccucuuaucuuucugggaauuacacaguuguucuggaaccccuuggagaggucaagguagauggcuccagucgcuggucugaugaaaauggaggauugaaucauuucccuuaacucuguguggucuaauuuaagugccugucauuaguacuucuaaggagaacacaggcgcccuagcccugaaaacugaaaucccucuccgaaggcccuaaugauggggacaaaaaaaaaaucaaugaauggccacauucacagcuguuuccagaaguguuuccugcuuucuuggacauuaagcuccaguaauaaaguuaacaacaguacaaucaucccgagaaaaggucaaagaagaggaaaaucuguuuugaaaaaagauccugccaucucuuccacacacccgagauuaucucgccaugcagugagugauuucuccggguaaacguucccauugacccucagugagaugaucugaaagaucuggcuuuugccccaguuguaugagucccucuccugcuugaguauaagccuccagaaaucugacagacuguaacaaguccgucuuuaaaggauuugugugugugugugucucaugagcacacacagguuagaguacauacacgaaggugccagcagagaccagaagagugccaggcaguugugagccuccagacaugggugcuaggaaaugaacuuuggucuuuggcaagaguucuucuuaaccacggagccaucucuccagcuccccaaagcugccuuucgaaucccuuaucaucaggcaaaggucuacaggcguucaauaagccugggucuuaagcaucuuuccugauauaggaaacagggcaggaugccacaguggggucagugaccuagagucccuguggagggugacccaguagugcugaagcuguaaggacaagaaagacuuccaggaagcuggcagcgaaggggaaacgguggcuauguugcuuagugaagugauaagcacacguuagcaagugugcugaauucagagggcuguguggauuaacuaucugggaauguuucugggaggggguggggggugggggcaguaacuguugagcucaaacuuaaaagaugggcaggcuuuggugauggcagaaauggagcgggcagacucguagcaagaugcaucccggaagacguaugacuccuccggauacugagaugggacagugcagggcguguuuggagcacagaggguccucuggaacagcuggggugcacaggauaacauagggagugacaggagcuagauugaggggucacaucagacgagauggugauuguucuggaaaacgaacccccuggauuccauccuagaggcaaagccgagacacguggagaaucuuaagcaaccgacaaggucaagggauuuaaguuaguguguacggcaaacgaaaggucugcagaagucuggaguucacuccggauggaugaacaagccuauuguccuauuguccaguugaaccuccuacaggacuggcagguuuucuccaccccaaccagauaaaccccaauucuccucaagcccccaaauucaaaucuugagagcuggaaaucuuccuuucccagacaacuccuccaaaacaauuaacacuuggcucagacugucugguacccuaaugucugucuagagucagcagcgauaaacuguuucucacacucuccccagaaggagugugaagaaaggccaaacccuaccccuggaacacaguucgccauauuccaguagagaccuugccucagauuauggaacaagcuagauuauagaagacuucuugucuagugacauuuguuuccuaaacuucuacaauaaagccuguuuucaaaccua

SEQ ID NO: 5549 - RNA, 36314 nt, Mus musculus
auauauaaauaaauaaaucuuuaauaauaauauacagugaguaccacagggaaaauguguacaauagacuguugauauaguuuggugaugguuuaguuuaccuacaaaaagaauaccuucuuuucuuccucuuggaaaagaagagagacaacagagcuggagaacugacccagcaaauaagagcacuuguugcucuuggacaggauucaguuccugccacccauauggcgagucacaaccgccugcaccuccgguuccagggggacugucgaggugucugcaaagcugaggaguaucagggcuuagacauccuaggcaaguccucuaccacucacuaaagccccagccucgaguuacguguuguugacguugucugugagauagugagacaaacaucuaugucagaacugaguaguuaauaagggcauaucagaucagggccccaugcccauggcacauaugaaaaugccacaaacccacacagguuaggugugugcuaacuuuaaguaagaauauuuuuacuuagcugcuucucaaggcauuuggcauggaccagacugaaggaaacaauggguuugacugggcuccuccgguucucccucuguauaagguacagcucucuaguccaucccagagucagccagcuuggacccacucccuggcaaagagaaagcccuuuuaccucucugcuacuuacccagggcagaagcaauugcauuccguaauauaggugucaaaggcauuauugcuauuuuaucuguauagcagucccaaguccagcggcugcugugggguuguguguuugcucauauuguugaacagggaaccaaguaaccaaccaaacaaacaaauaaaaaaaccugaaccuacuugaaaauguaucugcuaguauugaaaaauagguauucaucuaagugauugaguuuaagaauaacuaaugugacaucugccuaugaaaguguguagugccaagccacagcugagggcgagggacuagcuagggugcccucagucagcaggcaggaaaucaaaucuuccaaacugcugcuguaucuuggauucucacacugcaugacugauuuuauggauuucccaguaauggaaguaaccaucuuugaucuuugauccgugaaaaauuucugucuguagaaaaauaaagaauauaaauauuuauuuauuuauuuacuuacuuacuuacuuacuuacuuauuugaggcaaggucucacuguggcgcucgcuauguaaaccagguuguccucaaacccagauccaccugccuccaccucccagguacgaggauuaaagauguacaucaucacaccuaaaauaaugcaaauauuuaaagaccaaugagcauuacaugucaucgugucuuggaccauuuuauauauguacgcauuaaauaguucucuggcuucuuaguuacguuguaucaggccucagagauuugcucuugacucuguauauuuggugucaucaggccacaaacucaugcauaaaacccguuaaaaacugaaccaccguccucuguacuaggccccaauauaaauccagagauguguguauuuauauaaaacgauucagagcaaauaauuucuuucauccaggcuacuauccaauucacuguguagcacaggcuagccuuacacucagagggaauccuccugccugagcaucccaaaugcuggcguucgggugggagggccugcagucauccuggccaauucuuucaugggugccuuucugacuuccagguucgcuggaugauguauuggaucgucuuugcccucuacacugucauugaaacgguggccgaucagacacuugcaugguaaguucagcuccaagggacacgggugcuuucaggugucccaaguucuuaucccauccuugucccacccccaagccccugugaaaaauagaucaagcaacuuaauuucccagcaucuuuucuuccucgguuuuccccgugacaacagcgcuuucuguggaguucauccucucgaaggcagcucacugugcuaaucccugcccaccucccacucccaccagagucuuaaaauagagaaccuggcugucgucauccgcuuuccacacucaugaguucagacuguuuuucucgagggcuuccgaaaugacucuucuuccaauccgcagcaucuggucguagcccucccucccggcccagcccuagagcucugaggcacgaacauugagacgucaugucagcagccacggggacucccacccacucggcagcagcgcccuggcggcucuacccaagcaacaggaggcauaauuacaacauguuccuucccucauugaguucacaguuuauacaggacccagacuuaaggacucgagucuccucacgugcuguuuccgaguaccuuuguguucagccaugccaguggagaagucucuguagcuggcuuugacuacuuuguggguucuucuuucuuccacccuucuccacccuuucagcccccuacccuaacacuagauaggagagaaaggggguagaggggaaagggggccauguuagacuacucccugaugaugagaaguguugacuuccuuggggcaaguuugaucuuugucaucccaauaucuaauuucuucuuucuucuucuuucacacgacuacuuaacaaacugagaccaacagcaaccaaccgacaacccccacucacuccucucugggcccuagcauuuauauacccucugaaaaguccccagaauuccaaacgucgcacaaucccagaaacuaucugcagcuggcaaaaccugccccugcuagaguucugggcaagucauaguccgcugcuguagacagucugaaguaaccccagaucucacaccugggauuaaaauaaacauauuuucuuauaaguucucacuacaagucuucuuauuaaaaacaaaacuuugccuguguuuccacuuaccaugcaucguagacuggaacugaaauuaaccaagcuaucuuuucuuuaccugggcuacuaaugcaaauggaugcagagagagaaagagagagagagauacagagauagauacagagauugauacauggcuugauagaugauacauagauagaugauagauagacugauugauagagauagaugauacauagaugauagauggauggauggauagauagauagauagauagauaaucagacugcaguaccuaugagugaccacuugaacucuguggucccuuucuauuccuuccuguaucugcuucacaucauuucuggucucauucucuuagaacauuccaucauguugucacauagaggaaaaauauacaccaucagacuucaauagucuuuuuuuuuuuuuuuuuuuuccugagacaaagucuccuggaauugcugggggcagccucgaaaucacagagcucugccugcaucugacuccugagugcugagauuaaaugcagggcuugucacaccuggccagacuuaaacguucuuaaccuguccucauuuaugaguuagugcuuggcaaucucuucgucucuccuuccguaaccccccucccgcuucccccucucucucucucucccugccucccucccagcuuuccucgucugucucccucucuuccuugacccuaucuucuuccucucccugccuccuccucucucuccucacccaggacucccuacaugcuuaguauauacucagagccagacuucacccuccuccauuuuucuuuucucauuugaaauguucuccuuaacgcugaagaaaugguuccauucacugugauuugaauucuaggggaccgaccuacaggcaggcacgagugucacaugugugcgugugugcacacacacacacaacauacacguuucccucccuccaucccuauuccuuucuuuguugauuuuggaguagauggagggggauuuucucuugguuuugaaggacagacgaaagauucucaaccauuucagggauuaaagcccacccucccucccucccucccuuccuuccuuccuuccccucuuuauuuauucaucuauuuugagacaugauuucauauggccaagucugaccuugaacuccugaucuugcugccccuaccuucuaagugcuaagauuacagacaugugccacuaugcguguuaguuuguuagcacauugcuagguaucagauuuucaaaugucaguaggcaaacccuuuaccaacugagcuguauccccacccagcccagacaguccuuuuuuuuuuuaagacuucuuuuuuuuuuuuucuaauuucaaauauagcuuauguucauuauuggaaaauauagaaaguguuggauguuaaaagcuggucugggcagacaguuuauucuggccagaugccuuccaagcaugucuuacaaccagaguuccaucuggauggagagggccgacuccugaaaguuguccucugaucuccgcacaugugccaugggggcucacacccugccauaugucguacacaccugcaugcucacacgcagugguuggggcuuauucuguguuuuucaauagugagaguccaugcccuccauuaaggugcacugaggcagagaaucuuugcugacugugcgcuuauugcuccucacugauccuggccgucugccuuaccacaagaacucagacuuggggcucuuuguauccuggugccccgugguucucucacccugugugacuuagcucucaguguggcagcaggcagcccugugaagcacaguagguuagaacagcagacgccgaugucuuccuaagcguccccaaggcagguauuugauugcagcaguguuggccucggcuccauuaagcuucagaaccaaggcagaagaaaggauuuccaugguagaagcuuaaagcaagagguuggggggaucggaagaaucagagagcaguuaagacuuacguugucucugccacauucacuaguguuagccagucaguuugcaugauucaggguuggggaaguaacuccacacacagacaggaaaggcacuuaauuggcugccagucucccuuagugguacuucccacacuguccuucugcagcugaaacuuggagagaaaauuaucagggaguucugagaaagcugagggacagauggaguuguccccuggggucggugggucugucacguacuucuguggcuguccagagcugcagugucuagauagcaguuuguccuuucugagccaccggagucaguauaggugcugucccacuggaaacagacacuuugccauuuccuuguuacuuguuauuuugucucuuagcaagccuugcuucuugguuugguuucuucuugcuagguuuccccuguacuaugagcugaagauugccuucgucauuuggcugcugucgcccuacacuagaggggcgaguuuaaucuauagaaaguuccuucauccccugcugucaucaaaggaaaggguaagugagauguacggguuacuuccccacugucuuuaaguagugugugucagcaugcguaacauccagaggcuucuuaacguuauucuaaauaaaacuaacagggggaaguggugcacaccuccggaggcagaggcagguagaucucugaguuggaggauagccuggucuacauauccaauaccaagcuagccaggacuacauaguaagacccugucucauaaaaccugaauaaacuaacaucuauugguguguuguuguuauucuuagccaguuuuuguuuuuaagacaagaucuugccggggccuagcaaacacagaaguggaugcucacagucagcuauuggauggaucacagggcccccaauggaggagcuagagaaaguacccaaggagcuaaagggaucugcaacccuauagguggaacaacaauaugaacuaaccaguaccccggagcucuugacucuagcugcauauguaucaaaagauggccuagucggccaucacuggaaagagaggcccaauggacuugcaaacuuuauaugccccaguacaggggaaugccagggccaaaaagugggaguggguggguaggggaguggagggaggguaugggggacuuuugggauagcauuggaaauguaaaugaggaaaauaccuaauaaaauuaaaaaaaaaaaaaaaagacaagaucuugcagggcauugauggcauaagccuuuaaucccaacacuugggaggcagaggcaggcagauuucugaguucgaggucagccuggucuacagagugaguuccaggacagcccagggcuacacggagaaacccugucuuaaaaaaaaaaaaaaaaaaaaaaaaaaaaaaaagacaagaucucacuguauaguccuggcuagucuagaacauccuauguagaucaggcuggccuccaauuuacacaaagaucacaaagaucugaccauccacagugcugggcuuauggcuugcacuaccacacccagcuuaauuuauuuauuuuuccccccucagggccuccuguagcccaagcuggcuuugaacuuacuaaguagcuaaagauaaccuugaacuucugcucuaacugaccauaccucccuauagggaucucaggggugugcuaccacaccuaguuuuacuguuaauuuuucugcccccaggaaauugaugauuauauuguccaagccaaagaaagaggcuaugagacaauggugaauuuuggacggcaagguuugaauuuagcagcugcagccgccgucacugcagcagugaagguaaguuugccuuugucuguuuagccagggucuccuugucagcagaugcagagaggcagcuaguuuuauuuuagaucauuauaaagcuaugacagaauuucguuucauauuuauucuaacaaugaaauaaacaaguaggugauuuuaaugauauuuuaacacuucauuuucuguccuacuugggaauccaaaccucuuagugauuaugacauuagaaguagcuaauaaaacauaccugcaggcuggguguguuggcgcaugccuuuaaucccagcacuugggaggcagaggcaggcggauuucugaguucgaggccagccuggucuacaaagugaguuccaggacagccagagcuauacuuuuaaccuugcauaguuuugaugagucaccuuaaguaucucuguaucuuugauguuucucucucucucucucccucucuuccucccucucucucucucccucucucucuugcacugccuugcuaggauuucuugcuugcuuuuacaccucuacuuccaccaauuugagguaacuguugauucagaagaaagcaugugaaaaguguguucucagaacuggguguuuacucagcaagccucuaacgccauagcucuucuuucgagccgaguaaccgauggagugccuucucuggaaacucacauucuggcuuucagauuccuuugcauggaguaauugguguggcucauuuucaguagcacagcauaacugauuuuagugugugguguguggggaaaaagaaaaaagagcggacuucacagugcuggcugugaccuuugauguuaccaugagcaauuugcuaauuuaugugugccuggggagcuuugugucuaaaaggagggugugagggugaugugucugugagguaccugauggcgcagcacuugcucauagugggaacccgggaaucuuaacaucaugcaaaugguuuacuaauaugaaauaagauggggguacuaguguucugcuuuccgucaagcccuuucauuguuucuuguuguuuuaagauuuauuuuuaccgugugugugugugugugugugugugugugugucugugugugugugucugugugugugucuggugugucugugugucuguguuuguguguguaugcaugugaguacagguuccccuuggagacuagaagcuugucucuguuuguguguaucuguguuuguguggguaugcauugugagcacaggugcccaagaagacuagaaucuugugugugucugucugugcgugugucucugugacugugagucugcgugucucuguguguuugcauggguaugcacgugagcguggguaugccaauggagaccagaaguguaggauucccuggagcuagaguuacagacagcugugagccuccuaauguggaugcugggaacugaaacugggucgucuacaagagcagcagcaagugcucuuaacugcugagccaucucuacagagcaggucagacuguuuuuaacucaccuaugcaauggaaagauauaguucagcuaagcagcgaugaaauugcagcagcaaaagagugauguuaccugagggcgcuuuccgugcacagagagaccuuuggcucaccugucagaguuaauaucaucaaaaagcgagaaauccacaugcuguucuuagcagcaucgcagugagggcuaaguggagauucaauauguagauaacuauauugauaaugguuauugauuauagucuuauguugcaaugcuuacuauuguauaguuuuccucuuacuggguuuguggggguuucuuucuuuaaaauagauggauaaacacuaacacagcaacauuuugagcuuauugaagcuuuuuggguuuuguuucuugcuuaaugaaaauacauugcugaucacacguccaccaaaaagaccacccaggaaauaaaucaucuuucacagucagacccugugaaaggagaggaccuacgugaucaucaaagaaaaauaaguccuacaguauguucagggcagugagccuccaggucaaggggcccguaucucacccagcaccauggggaaagaaugaccaucucugagcagcgccacccccaucccaaccacugccuccaaacaccaacaaggaagcuagaauucuuccacgucagacacuaaaagcacaaucauguucaaaugacuuagcaucagaacagcaguaaguuucuaauuagugacaguggaaucacgaagccggugugccgucacccaugaugacaucacccaagaugccaucgugugggucgggcucaaguucuaugauaggcaagccugucaaucaggugugaacuuaaaauaaucaaagaguaaaaaaaauuuuuuuugguuguuuuugcuuuuguuuuucgagacaggguuucucuguguagcccuggcugaccuggaacucacuuagaccagguuggccucgaacucagaaauccgcuugccucugcuucccaagugcugggauuaaaggcaugcgccaccucugcccggcucaaauuuuuuuuuauauauuauacaagaaaacucauaacauguagugacugcacauacuuugucgggguggauauguucugucaacguuuaaaagaggggaaaagagaaaagaaggaaaacuguaaaccgguggcaucuggaaaauagguuacccagcacagaggggaggugaugaacccccaggacacugcagcaaguccaaguguagacagucggaaauggguucuguggguccaaagugccgaaagagaugcuucuggaagaagcacagaauggaaagaguaagccugaugcugugcauggacgauacuuauccuagccguguguggcgugacccacaaagaacucacggaguacagacggugcaugccugugcagccgugcgucccccuagcaccaugagcauguauuggugacuaugcacauaguagggcaacuaagcaaauggaaaccaaaaaggcaauuauuaacacuguggggacaaagcagcauaaauuauauuagaagcaaaguccagugauggaaccuaggaagcaguaggaagaacacaggugaaggauuuaacuaacaacugugaucuugcugugcugagaaacagggagguagaagggagcccuugaacgcuuguaacaucagucagcagguuuagaguagugaguuccucuacaggggugugaugacaaauggcuugccgcuuccccuuuaagcuuagcauggcucgaccuugcaggcccucgugauuauauuuauuuacaccucaaggacaucucugaacgagucuuauuugaaagcuucaacacgauccugugugggaaacugcaaacucaauuucaacuucaaaugugcuuugagaacacauacgaggcccuuguuuuagaaaauacagaaagaaaucccagcgguucucagccugacacuuagaaaucccuucuaguguguuugccuccuuguaaguaggugcaccgucuaugugccugguacccacagaggacagaggcaguuguuggggccccuggaacuagaguuaaagauuguugugaacugcuaucugggugcugggaaccgaaaccaugucuucaauaggaacagcaaggguucuuaaccacugagccaucccuccagguccugagacauaauaaauaguguaacuguuuaguagggcauucacccaaucuugaguguauuuacuaauccugucauugcuucgagggacgucagcaaccucgugguguuauuuuaaucuuauccccuccuuucaucucauagcuugcuuucaccgguuuuuaccaucccccggcccauauguugcacacuuaacaucucucuguuuaaugcccagucuaagaaggagcugaugcagcagcagggcagacggcuugacccuguggccucaccggccccuuacuuccugacuguagccagugucuggauugccaacugaauauguaaccugucucuugucuguuaagacccucuauuauuaaguaauaauaucucacaaagagacuuuucuauaaaaaugucccaaaagauaguccugcaucugcuugcuccuuuguuuuuucuuuuucuuuuuguuuguuuguuuacuuguuuuaagauuuacuuacuuauuuauuuauuauguguacacuguagcugucuucagacacaccagaagagggcaucagaucccauuacagaugguugcgagccaccaugugguugcugggaauugaacucaggaccaucugggaaaaugcagucagugcuccuaaccgcugagccaucucuccagccccuacuuccuccauugugauucauggauuucacuucuguaguuaaugacucaaaaucaucucuccaccucccaggcaggaaacagagacuccaaaaccaucaaaguuagugcuaugaaacaagcccaccacugcacuucacgucccuauugcuggugaugaucugggucuuuaagaaaaaacaaaguaccugugggugaggugaugucaugaucucaugaugacuccaggaguuccggacacucgauuaauuguugguucuguugugucuauuaaaaauaguaacaguguugaguacuacgucauguuggcucuguuggccucagguuauacugugcuuauuuuaaagugacugaaauuaguuucaucuguggagacuuuauauauauaacaaaagucuuauuaccaaagaacuuacugaggcagacauuucaaauucaaguaaauuggaaccaaacuaagaaauaggucaggauugaggagaaaccgggagaagaacgauggcaaaauuugugcauuaauauuuuaauaacacauaguuuauuagaaauaucuuuuagggguaaaaacucuugugcucuucgcaugacauuuagagaacaguaauuuccucccuaggguccccagguugaaucaccugagcaugccaagaaugaaaccaggaaucuaaucagaacacuuauuacaccguaaagcaguuuucuggaaacauugcucagucccguggccucauuaccaggcaucuguucacaaggucggugcacaaguuuauuuuggcugagcgaagcacaaauacaugaaggaccuucaaggauucugcugagcaugcucaacaucccugccuacacgugggagacgcagggggcauugauguagcugaccgccguccacccgugcaaucaagggcaggugaagagcagaaguguuggccccuuuggccagcucaggauucgcucuucucgguacaccucucuaagagaccaaccccgguuuuuauguauguaaauuagagcucugcaguaaaauugcugaagucuaauuggcuuuuuaaaccacugccaguggcgucaaaucccugaccucuugcuaucuguuuuaaugacuuucuguuugugaaaggauuuugagauuuuucagccaucaagccucacccucuuuucugcaggggguugggggguguggcaggauucagccucuuuuccuaccguccacagaacaguuugguguaacagauaccgcauucuagaacacucaguuuuguucuugauuuuuuuuuuucuuuuaaguuuggauucugccacuuaacagccaugaguguaugcaauuguauacaaaucaucuauacugauaaggauuaaauauucuucuuaucuauaaaaggguugacaucuuuuauuuauuuuauuuuauuuauuuauuuauuuuuggcuuuuugguuuuucaagacaggguuuuucuguguagcccuggcucuccuagaacucacucuguagaccaggcuggccucgaacucagaaauccgccugccucugccucccaagugcugggauuaaaggugugugccaccacugcccggccuggguugacaucuuaucucuaaaacagcuacauguccagaaugguagcucucaacuggacauaguuuguggccccaccaacuccaccacgggacauucuccuccaucacaaaugacaaggauguauuccugguaccuccauggcagaggccagggaugcagcuugcuguccuaugaggcagaaacacugcagagacuuuccagcucaaacgggcugacagacccugcuucagaggggugaugaugauuccagaaaaagaauuaauuaaaaagcauacacauguauauaagaauuuugucgcccggcaugguggcgcacuccuuuaaucccagcacucaggaggcaaaggcagguggauuucugagcucgaggccagccuggucuacaaagugagguccaggacagccagggcuauacagagaaacccugucucgaaaaaccaaaaaaaaaaaaaaaaagaauuuugucuuuauagagugacuauuugucaauaaauauauaucacccucuucuucagaacacuaagauauaucauucaccaaaugugaauacacuugggcucaucccuggauuucaucaguuuaauuauugauugacuagaggggagauuuccccaauacugagaacuaaacucugcagcuauugaauguaacacauaucacagauaaugagaaauugagcugaauaccugucauaacgaauggggaggcauagacaguagaauagaaucuaacgcacuguguggcuaaccuagaacucaggacccuccugccucggcuuccugagugcugggauuacaggcgugagcuagauggguaucuauaccuauaguuuugacaugaauaagaacuaaaguauuuuagcucuuauugcuagugugugcaguuacuguguggacagugacaccuucaccccgauugacuggcaagcuguguccaugcuuacccgccccacuucagaguaaccucgacuuccuuauccuuuuguuuaacaguucacaagccacauagaagaaaaggguacaguauuuaaguaaagcagacauaucagauaaaugauuaugaugucuuaauuugcccucaaaacagagacacugagccagagagauggcucagcaguuaagaguguagacugcuagccggggugguggugcaugccuuuaaucccaacacucaggaggcagaggcaggcagauuucugaguucgaggccagccuggucuacaaagugaguuccaggacagccagggcuacacagagaaacccugucucgaaaaaaaaaaaaaacaacaacaacaaaaaaaaaaccaaaacaaaaccaaaccgagugcagacugcucacuccugcaaaggaccaagaguucaguuacuagcaccacacugggcagcucacaaccuucagucucuaccuuccagaagcgccaacacacacaugcacaauaccaacccaaccccaccccauccccaggccaaccccaccccacccccaggcaccugcacacuuuaaaagguaauuguaaaucuuuuuaagagauaucuuucuuucuuucuuucuuucuuucuuucuuucuuucucuuuucuucuucuuuuaucuuuauguuauuuuaugagacaacgucggacuggccuacuuguaucaccccagugcugggcuuaagagccccaccccaccccccacucguggugccuagcuuucuuuuuaugauaggagugagccauuagauacacaaaccauagugacaaauggaucagaaauuguuauuguguaacccguuauuauaaucaaaacuucauuaagccagggugagaaggacauguaccgacaaagguguauggaaaugcuguguaacaaaaccccauuacuuggugugcuaauuuuaaaacuaauuuuuuaaaauguuuuuuaaaccuuuauuaaauaagccuacuaauucauaauauuaaagaaauaguuuaaaggaaagaaauucagucacgugucccaucugcauaaacauuaugcugucuucauuuuugcauauuuccccacguacugcaggcuugcguugcgacuacuuuaugggugugauugggauucuggggcagggaagguauagccacuacauaucggguggcaagcaugacuccugcacugguggaccuuugugcugucgcuaugacacuggagggaacaggcuggccuuuggcugugauuauuauguagugacgccucuccucugaaacagcaacauugaauaauuacgaugcauugaaugcuucucaacuucacagugcuacuuuuuucuuuucccucuguucucauuuaccugugguucagucuauacagugggaacuccaacuuccccauguaauaaaaacuguuggaccuucugauggccuaaaaccaaccaacgauuuauaccuccuuuuuuuucuuuucuuuuuccccaccauccucuuuuuccccaaagacuagucccaggcuggccucggaauuacuucguagcugaggacggcuguaaaacuccugccucgcauccuaauugcugggacugcagacacacaccaccaggcccuguuuauucaguguugggaacggagcccagggcuuucugccugcucaugcugagccagcacucugaccaauugagcuacgcccuuagccccacuuucugccuuuucuguacaguaauuuaacuuccuggaaaccuagauguuguugauaaagucuagguacugauaauaggaggguguguaacucaaaagcuagauuacaguccaggccuuaagugaguccccagaucccagaguugggccugcucugaguuuaagccugaggcuauaaccuccuaguaggugaauggugcuccauugagaugccugggagacuccaguguuuacacugaaacccugcugucuaugaagaacucuuuagcaaucacaacugauaaguuucugugccugagcaguagcagcuugggggaggggaggauuauuucacaaccuauugcuaaaggaaguccggccaggaauugaggaaggaacugaagcagaggccaucgagggggcguaugacuugcuucccauuguuggcucagccugcugucucguacaacuccggaccuccugcuagacccaccacugugggccgguccuucccaugucaaucuuuaaucaagaaaaugcacuacaagccgggcaugguggcauacgccuuuaaucccagcacucgggaggcagaggcagguggauuucugaguucgaggccagccuggucuacaaagugaguuccaggacagccagggcuauacagagaaacccugucucgaaaaaccaaaaaaaaaaaaaaaagaaaagaaaagaaaaaagaaaauguucuacagagcugucuacggguaauacggagguauuuccucaacugagguuccucugcccagauaacucuggguugugucugagguuaugggagaaaaaaagauaggacuaaauugaauaaauacuuaguuugcauguuaaugaccuguucgauauaagaccuuucuagaugcaguagugcagaaaccuaagacucagcccaucuucugguuucuuaacaucuugcuccgguagcaaacacauccuccaacaguacucuaguucauuugugagguagguguuagcuacugagcgcaccagucagaagcaccacagcuggcaacggaacaauccagucaauacucgggggccacuuuagcucauuaaagucagcccuagaaauuguacucaggggacuggagagguggcugagguauuaagagcgccagcugcuguauuguaaaggaccccagguugcuucccagcaccuacaugguggcucacaacccucuauaauucccauugcaggggcucugauacaccuucuggccuccacaggcauggccuccacacaguacacagacacagacacagacacagauucaggcaaagcacccacacacggaagagaaacaaguaaaucuuagggauuguacuccaggccuuuguuaccuucugguaacaaagugugcucauuggcuuccugagcaggguuuguauugacucacaagcuagaagagguuuuaguccaucgcugguggacacuguugcuuggaccgucgucaaaucagcauaugguaauagagcaguaugcuggccuccugacagugggaagguuggaucccuaagaucgccuucaagggcacaucaaaucaucuuucacuggucaccaacucuugagggccugccaauagcuagcuguacaggcuggagacauaggccuuugaaggaacauugaagacucaagcgauaacucuggggacuacccaugguuaaguaugggauggguaaaagccaugaauuauugaaagaggauucacaggaagagaaaggcacggagaaugacagcacugaggagggaaggcaucuuugagaugggcacaggcacuuccuugcccuaugucuccgaagugucucgcccccacccuucugagaagugaaugcucucuggucaagagaaaacaaauaugagaagcugaauuugucaagaauuguuucaaagguauuaacugcaugugcaugauagaggggggcacgugugucagaggacgacuuuggggaguggauugucuccuucccuucuuacauggguucuggggauuaaacucaaguuccuagguuugccuggauaggaccuuuauccacugaacaaucucaucagcccaaaaaggauuuuuaugcauuuguuuuuuugagauagggucacguuauguagcccuggcuggacuggaacucucuauguagaccaggcugaccuugaacucagagauccaccugccucugccucccacaugcugggauuaagggcaugggccacaccauaccugacuccaaaauaacaauuuuuaaauguguaaaauccacuuauuuucuugaagaaguggacuuuaaagauucucucucuuuuuuuuuuaagauaauuuuauuuauuuuguguaagaguguuuugccuuuauguagguaugugcaccacaugaauguuaguugcugcccaaggaggucagaagaggguaucagauccccuggaauuggaguuacagaugaucuacuaugugggugcucggaacugaaccuggguccucuacaaaagcaaugaguacucuuagccacugagcuuucucuccagcuccaacuuuccacauucuucuugcuacucagagcacaugguaggaauacagagcuuaccuggggagcagggacggcaugugguuugacaucguggguuaucgguaaccagccauacugagucacgacgucgugggaauugaagagcuguuucuucaggguuaaauacaaguggaaagaaacacccaaauguuuguaacaccuuucacuuggaaguuuagagaugaacccugguggacgaguuuccaugguaauguuauaaguagaggcaaucacacauucacaugccugagaagaaauaaucaguguuagagccuugagacgaguauuuuuagucuagcuauaaauaaaacaaugaaucauccguaugcuaugcagauuuaaaguggguaaauuaaggaauuuuuuuuuauagaguuucauacuucagggagguauuucuuaaagguucagagaaauguccccaugaaagcacuacagugaugggaacugucuaaugcugugugugugacagggaugcucucugccauggccaugcugggaugcucacugugauggccacacuguuaacacugcagucacagacagcugcuaacaucucugcuguggccagugcaaggugcaagggaagaacuugaguugucaauugguuucuuuucguuuuaagauuuuauuuauuuuauguauaugagcagacuguagcuguccucagacacaccgaaagaggacauuggaucccauuacagaugguugugagucaccaugugguugcugggaauugaacucaggaccucuggaagagcagucagugcuccuaaccacugagccagcucuccagccccuucauucgauuucauuuuaauuaauuuacauuuaaauguuugccuguaaaagagcauuaacugcucuuccagaggaccagguucacuucccgacauccacuuggugcggcgugggugacuguaccuccaggucuaggcaaucagauagccucuucuggacucuaaggaaacuauaccauauagugugcauacauacgcagaggcacacaaaguaaaaauaaauaagccuuuuguaaagacaaaaugaaauacaccaugaggagugaugagugugccuugcuagguuauucauugucuaaagauggcggcauaugcaaacaucuuuggcuccuaacuuucucuaccugguucuaguuagaacuacuacuguuccugacacagccuuguccaaaucagugucuuuccuuuuacucuuacuaacccaugcugaacuacagcucagaacuacagaugcuauuuucuccaaaguuaaucucauuauacuuaaaaaaaaaaaucuuaaagcuuagcauaaugcuaaaaugcuuagaauaaaauguauaaauguaauggcauacuuugaaaugugugaaaaagcaaaaugaauuagcguuuauauagauaauagcuaugucauaaagaaaauauaaacaauuugugguauugaaaaaaauauaaacaaugcaugguauuugcgauagaagacugcaggaauguuauuuauuuagcaaaauguuacugugucucacagcagagaacuuguagaauaaauguaagcauacuaaauauuugaaagcaucuuuuucucagaccuuaucacaucucuauugaguagagccaaggagcaauaacggagcgucugcgaaguuucagcaugcaugaucugacagcuauccaaggggaugagcccgugggacacagacccuaccagacuuugccagaagcaaagaggaaaggcaaacaagccaccgagucaccagguaggccugucugucguggugcaagggagccuuucauaacugggcgaagggucaggaugaacgccaaagaguacagggugcuggacacagaacuggcuuugcuuuguuauccaccguuguugacgcagaggaucaagucaccugcgcuggucucaggcuugcuguauaagugaagcugucuucaacuucuuuaguuuuugguuuuucaaggcaggguuucucugcgucguagcccuggcuguccuggaacucacucuguagaccaggcuggccucgaacucaaaaagauccaccuuccucugccuccccaagggcugggauuaaagaugugcaccaccacugucucccgcccacuaccagugauaaugaguucugaggaagagggaaggugagucuucuggccuccacaaacaccaucaaccauucacucucauccacguacgcgcacgcacacacacacacacacacacacacacacacacacacacacacacacgcaugaaagcaacaaagcguccauaauggaaacgugagcauauaacccugaacuccacugccuagcuugucuucaauuucuuaauccuccugccucuaucucccuagugcuaggacuuuggguguuagcuaccacaccuagcaagcuaccacaccuagcaaaauugaccuauuuuaagcauauguuuuggaguuuauuauuugauguguugucugucuguucuccagacagggugucauagcccaugcuggccaagggugacugagaacuuccuguacucuugcuccgaccucccaagucuuaagcuccagugugcagcaccacacuuagcacaaugcaaggcuagggauggaauccagaguucuguggcugcuagacaagcacucuaccagcagaacuacaagcguaugccuuugagcuucaguuuuaccuguagccccuccucuccaauuaucucuuaagucagacagcuacuugccuguggcugcccacaaaaacugugcagcuaagagcagagccucuuacgcaucuuugagguuuuaggggcugugcauaugguccccagcucaucccagcuuuaguucugacggucaucagcacucucucuguucagguuauggacugacauccgcaggucagagagaagucuuaagcaguugacuugcuaauucaagggcuagcguguaagccucuucugcagaaaugaugagcguggcguaguuacugugcugcgugcucuuaaucaaaugcugugaccuuggaagcaucgcacauaaacaagcagagucccucauccuguaucgugucugcggcagucuucauuugugucugcacugaaaacuaagaugcugaagacuucuuuuuuuuuauuacaguguuaaucauccuuucaaaaacuuaaguucuccuuagagggagacugaaaaaucaucauuuauagcucaagcuaauuuuaaaaauaaagcaguagcccuuaguagaaaguugugucuuucuuucuuuuuaaaagaccaagauuuguaauguagcccaggcuggccuugagcucuuggcagucguccugcuucagauuccagauguuagcuuccacaccuaguaaaagcuccucuucaacaagugaagguuggggcuggagagacggcucauuaacagugcacacugcucuugaaaagaacccaacauuauucccagcagccuuagcuccaacuccacggggauccaacaccucuggccucaaugagcaucugaacuacuugcacauaccaauacacagauacacauacauacaugcauacauacauacauacauguaaucaaaaauauaaaauuaaaccuuucacuuuuucccaagaaugaauaaugcuuaaaguaguggccacugucugaaagguuauauucaaaccaaccauugauaaaaauaaugcuuuuaagaaugaaaaccugaggcugggcuguggcuccguugguagagugcucaucuagcauacagaaagucccaaguuccauccuuuuaucugggcagaggcagguagagcuuuguguuuaaggccagccuggucuauauagagaguuccaggacagccagggcuacauacugagauccuuugaaaaaaagagagagagagagagaaggggaaggaaagaaggaaauagguagguugguuauggauagauaaauagauagguagauagguauauacauacauacauacguagauauauagauacacagauacauagauauauauaggcaggcaaaaaacaaacaagaaagagccccuuguaaauugcacaaaagggguucaaauuuuuaacaaagucuaucuaggcaagaaauacacagaaaaggauuuugacuccaaagauauuccaaaucaaaauaguaaauuaauaauaaauuuuauccucccagaacauucuuaaucaauaguccuaauauguuacaguguaacaaaaugccccccagcaguugccuagaacaaucagagucuccuuuuggcucagaauguaggguaacugggcucugcaaaguaguucuguuuagggucucaugcagcugugcucagacagcagcuggggcuggggccacacccccacagaagagcucacacgugucagggcuuggaaaagcggagcagcaggugucuaaagcaaggaggccucucagacaagccuguguguccguucuguauggcccucagacucugaggcgagcuggagucaccuggcagcugcgguucccacagccaguguccaacaagacgcuggcagaggucccacuguaugccuucaccauauuauugguggugauuuguggaggcagcuacaaaagccugggaaguugaggggagggaggaagucaugaaccaaccucuuggggcuuuguauggguuuaaaaugaaagagccauuucggaugacagucagccagacaagaguucagagcuguguaugacaggacuguuccucuccuucguaauaacaacagccaagugcccacaagaacuaauaagcaaaauggcaacuuauuagcugagaaauauaaaaauguuagauccuaaggggggaaaaaucagacacuauaaaucagugccuguuuugagcuuguguuguagaagugcaguagacagugguaaggauuaaguugcuuuguuuguguguguguguguguguguauuguuugguuggggugguauuauuguuuguuuaguuuugauuugcuauucaaucggaaauaacacaauacucuuauuuugaaaaacuaaauaaggggggaggguaugggggacuuuugggauagcauuugaaauguaaaauaagaaaauaccuaauuuaaaaaaaaauaauacaaugggaaacuagaaauggcaaccucuaaauuuuuuucugauaguuuuucucauuauacaagaauaauuuuuaaauaaauacuuggcaguuaaaaaaaaaagaaaaauuuaaacuacauaaaagccugcuuucugugacauagaguugucuggggacugucaacaaggagcagaggaccuuggcaccaagcaugaagucuuaguuacgugguagaaaggaagaacuaccucuugcagugugccuugaagaucacauguagcccgacaugaccaugcaugcauacccuuagagaaauguaacuuuuuuuaaacguggggacagauagaacuggaaggaugaguucaugguuaagagcaaauacugcucuccccgagggcuccaguuucuuucccaacacacagguugcucaacucauagccuucuauaacuccuacucccuccucuggcuucugugggcaccugcacuuacaugcagaugcccacacagacacagacacacacacacacacacacacacacacaaaguaaauuuaaauuaaucuuuaaaagccugguaguaguggacaacucacaccuuuagucacgucacagugcuugggaggcaggggcaggcagaugucuacagagugaguuccaggacagccagggcuacccagagaaacccugucuugaaaaaccaauaaaugaauaaaguaguaauaauaguaaucuuuuuaaaauaaaauaaacccauucacauacaugcugacacuucucauagagaauauggcuucaucuaaccaucucccuggcgucccugaacuuccucccaucugccucugcugccuuccacauucaggcuugcuucuccguaggaugcacugucucuaacugcuggaggaaaacaagggauuccagccaaaauaaugccugguccugcuuccaaauccuuccugacuucuagccuagaugcuuggcaggucuaaaauuguacuugccugauauacaauuaaagucauuuauguuauuaugagaguaaaaagcauauuagcaacuguucaugguuuguauuguaagucucagauuauuugugucccaggagagcugacuagugacauuuaccccacgucauuuucuugacagaaaaaaaauccaucucugcuuccuccuggacccuuaucuucuguuccuuaucuuuauuagaaagggauuuaaccacccccacccccuuuccaggccuuguagcugcacuggucuccauggccucagacuggccccugucuggcuucccccuccccccucagccucugguuuugguuucagcauuaauugucccacagggcuuguuagagaugcacaucuaggccccaccccagggccagugaaucacaagcuucaggguggagcccagcaagggugaggguacugacuaguuauccaucccgacaggacuagcuggugucugaggcucucaccuucagccgugggguccucuugcuccugacucccagccuggaguacaucuagaccucuuacaguagccagcccuccuggauguuugcauagcggucagacauaaguaauuaaggguccacauaacagcccgucagcuggcccuguggucccuggcugaccuuggugcugggugucuccucuaagaucugucuuauggcuugugguuucuuccagcugaaaccucccaggccucaucagcacuguaagugccccagugaacucacuuucccaacucuaaagucuuugggucuuucucagguuccccugucauuccaaguugaccaacaaugggaugagugggggaggauauuuggucuuaauuaaagucaaaggcacaaauggcagccuaaaacacacuuuggggguugcuaacaacucuaauagcuaaucuaauccucuucucugguguguguguguuuguguguguuuucuuguuauuguuuucaauuuuuagcaaguuguggguauuagccacguugggaauuuuuaggagauucaauguuauuguuguuugguuuaguuuuugauguaugugugugugucuguguguguucucugugugugucuguguguuguuuggcuuuguucuugauuguuguuuccguuuagcauauuguuuuguuuuuguuuuuccaagacaaggcuuuacuguauaguccugacuguccuggaacucacuauguagacuaggcuagccucgaacucagagauccccugccucuaccuccccaagcugggaccagaauguguguaccaccaucacacguggcuugguuuggcuuuuuuuuuuuuuuuuuuuuuuuuuuuuaagauuuauuuauuuauuauauguaaguacacuguagcugucuucagacacaccagaagagggagucagaucucauuagggaugguugugagccaccaugugguugcugggacuugaacucaggaccuucggaagagcaguugggugcucuuaccugcugagccaucucaccagcccccgguuuggcuuuuuaaaucuuauauauuauuauuuuauguguuuguacacuuagggaucaaagaacaacuuuggagucauccucuccuucuaccuuuucccgugccaucucaaacucaggucgagucaccuuggcaggccugguuuuguuguuuugacacagaguuugaccuuguagcucaggcuagccuuaaacacacaucagucauucccugcuuccugaguccuugaugccacgggugugcaucacaccagacuaugggcuguguguuccucuaaggcuuucuacuguuuuccuuugaggcagugucucucccucaacccgggguucauguauuucuacaaggcugacaaccuggaagcccccagacaucuucuugucucuuugcaugccucccacacauacaucaguggaguugcaggcuccaggggccaugcccagacuuuuacuugaaugcuaggaucugaacccagcuccuuuugcuuguacaagagcucuuacccacucuuauccccagcccucuggcuuauuuuuuaaauaauaaaaaaauaauuccuagaaaugggaacggacugcuggacaugguauuacagcuaugaauucaagcccagccugggcuacagagcaagaccccgcuccaaaaugcauuaaguaaugaguaaaaccaaucagggagauguuccuggagcaaaugagccuugcaaucuuuaucuagaauagugcacaaagcaaaagcucaccgggaauggccaggaagacuuuccagaugagcaggaggagagauccccccaccccaacccccagauagaccccagcagaagagguagguucucuggugucguccaacuaaaaugcugguccuguccauuugauuagccuauggaauuccacugaaagauggaagugagcagacagacgaagaagcggaggggccauucuccgaugacgagauggugacucacaaggcgcugaggcgaucccagagcaugaaaucugucaagaccaucaaaggccgcaaagaggucagugugcacuggguaaugcuuuucccgacaaugugugugaggagggauuucuuccuuccuacuuugucaucacagcugugaagugaucagcggacgaaggauucaaaugagaguguagcguuauaguucaaauucuuuauuaaaagcagguguauuagggaucucuagggacaauuuuuuuuuuccuggaaauuuugaaauaggaaacuuuuuuuuaucuugugcucuacauagaaaaagugucauucccacacagcaaaccccauggcuuuuguaaaucucuauugcuuucucugugcccgagcagagaaagcugcugacaaaauuaacugcauaguuuugcuuucaagaagcccuaugugaugauuaaauaguagcaauuuaccuguaaucacacggugucguugggcuaagaaaaugaaggaggagccaggcucauugacugacuuaguacucagcaaacauaaguacuaagucagugucuuuaucuaugauugauaaugucacgugcuacacacacccaucacaucacaagcuacaugucugugggaguucuuaauaaggagguugcuugccagggaguugcuuugauggcugguugacugguugguugguugguugauugguugguugcuuugauggcugguugacugguugguugguugguugguugguugguugauuuuugauugauuaauugguugguugaauaauugacuugggugcuguauuaggaauugaacaaggaccccaugcaggcuaugcaagaacgacacuuccgagcuacauuagcagcacauuuuauuuugagguaagaacucaguaaguugucauucuguggcccaggcccagguagauccugaacuuacagucaucaggcuugggucucccaagcagcugacaaagaagcugauucuuuaugccagaugaguaaaaccguuacuauggcgacaaaauauuaaaacuuuccuaauuuuaaaaaguagucagucccuuuaguuuuguuuguuuuaguuugguuuagccaguauacagaguaacaaauccuuaacggcuuuuccauagucauuuuggcuuuccuauuguuaacccuaacacuuuucuuucuucaggugcgguauggcucacuaaaauauaaagugaagaagagaccgcaaguguauuuuuagugucuacaccuugcccuucccaagaugaauaaaccgcuaacagaucaacuucauuuucuaaccugauguauucagggcuuaacacuuuaaaucuucagaguguggcagggaugggauuuacgcaaugacuuuaaauggucuguguuucuuuaacaauuacuuuuagauguuuaacugcuaaacuuaguuauguaagguuuguaaauguacguguagauaacaaaagugaccgagaaucgcgucccugaugucagcagcaacacugagugccuagggccuaaggauaaagccuagcuagacccagggcagacuucaaaagucucugcuccaggacacaccugccugccguucugguguugcauucuguuuacaucaucuugccugcaucuaucacaggagaguggugacagccccugaggagccagugucauugccauaggagggggcuguguccuuccuuaagccuuagacgcugaaaguuuuuuaaacaaaugauuugaaaaccagguguccacauagcacuuuccuggcuaguuuugcacacuugaaaauuguuuacuuauuuuacaacuguacauuuacauuuuccugaugcugucuguuuuguugucugucauauuccgacaugucaagaucaugccuugaaaccgcgucaucuccuuuuccuauggguuuguuucguuugguaaauccauucagcccauuauagacacauaacuguuaaguuuguagucuuuuguuuuguuuuauugagguagggucucuucccugauccucguccugcuuccacuucgccauugcugggauaacagacguuaucacacuuggcucauuuuaaaugcccuucaguuauauuccggacaucugagaaguuaucuuaaacauuaaccaguuuccaucauugaauuugaugugguuuuucucaacagcaaauuauucuagguuauucuagguuaaaaaaaaaaaagcuuuugggggcuggagagguggcucagagguaaagagcacuggcugcucuuccagagguccugaguucaaaucccaucacccacguggcagcucacaacugucugcaauccagcuccaagugauuugacacccucacacagauaugcguacaggcaaaacaccaaugcacauuagauagagauagauagauagauagauagauagauagauagauagauagauagauagauauuagauagauagauagauagauagauagauagauagauagauagauagauagauugauuuuguggaagcgucacagaccaauguagcacuuaguguuuucuaacucauggacuucccaaugcccacacucagcuccugagcucggcagaggccuaugcugccuuacagacccagcaaugacuaacaucuuuuagaucuuuuucugccugagauuauucucugaaaaugagugucaggguaaaacacaaacaccauugaugcuacguaacaggcuuccagaaaaaugccaucuuuuauuuuauuuuauuuuauuuuauuuuuggguuuuuuuuuuucgagacaggguuucucuguauagcccuggcucuccuggaacucacucuggagaccaggcuaaaggccuucuuuuuaaucuaacagauuuagagggauugaacucagcuccuuuuagguugcccuacuaacuggacauuguggacacuaaaucauauuggggugaugaauaaucaaauuuucaauaucaaacaaugcuuacaugggggugccugaauggcccacacacacaaugaccucuugauacuacgaauauuuucuacacagaaucacauuguuaauauuuuuaacacgaaauaaaaauucaaucuuuuuccuccccaauuuaaucuuguaucuccaucuacuuugcuuugacuaauagccucuuccuuucgaaaaggauucuuuaauuucuauucaaacaucuauaaagucccacaauaaauuauuggacaggauguauucauuucucaugaaccagaccugcucugaaccaaugcugugcggcaugggugguuuucccugcagaggccguguuaccugauaaggugaugugauaaguacaguaaguuacuuugucuccauggggacaaauuggcaagauuguaucauauucaaguccaguaucaguauuaaacuuacccuuaggagcuaaggauagacaccaugcuugagguacacaaggccuugaguucaaucccaaaaccaaaaaaaaaaaaaaaaaagauaguuaaaacaaacuuauuauuauuuaaugaguuuguauacuauuuguuucuucuuuugacuuuuguuuguuuggguggaggguguuuuguuuugugagacagagucucucuguguagcccuggcuguccuggaauucacucuguaggucaggcuggccucaaacucacaaagcuccaccugccgcugccucccagaugcugccauuagaggugugucccaccaugcccaaguuguuuugagacuaagccucacucuagccagccugaaaugcacuguguagcccaggcuuacuuccaguauauggucacucuggaugccuccgccgccuuuuuuuuuuaaauauuuuuuauuauuauguauuuuccucaauuacauuuggaaugcuaucccaaaggucccccauacccucccccccccccacuucccuacccacccauucccauuuuuuggcucuggcauuccccuguauuggggcauauaaaguuugcguguccaaugggccucucuuuccagugauggccgacuaggccaucuuuugauacauaugcagcuagagucaacaacauuaugccuccgccuucuaagugcugagauuacagguguguggcuccauacccuacuucacaggcguuuuaaauugggagaaauaucacguucuagaaucaaaauucucaagcaaagauaccgccugacucggagcuaaaguuggcugaccugcucacugccguucacccucccgguccuggucccugcucgggcuugucccugcuguagacaugcucauaugcgcuugaugacuguccuaccccgcuuuguuucuguccccaaggucucaugucauagcaugcccuuuucuuugaacucuguaugcugagcuaaagcgcuguuuuguucuguuucucuuaaagaggaccgggucaccuuguuuguuucugcuuuugagcaugcugauuuuuucaagagauguaaauuuauucauagaccacagugccuugacuuaacccacacugccaacuggagcaccagcacgcgaaugcacaaaccgguuuaaggcacuguuucucucugccuuuugacauguauccaaaaauuauagccuacuagcauuucaucuuaguauccagucguucagcaugaucacuaacauuccccguacuuagcuguuguuuaaguauaaaaauugauaugucuauacugugucuuucuuuuuccuuucugguauuaagaagagccauagcuggagagauggcucuguuuuaagaaugcauacugcucuuacagaggaccuggauucaguucuuagugccuaagccagguguuuaguucacugcagccugcagugccagcuccuggggguacaauaccuuccucugauuuccaagggcaccuacgugcaugugaacauucuuucucacggauacacauacacacaucauuugaaauuaaaaaaaaaaaauccugugaaaaacaaaaaggaaccagaaauaagcugauuacuacauaaacaauugucuacggccaccucaguuccucauagguccccuccacacacacuguguguguuuucuagggcuaaaaaaaugagaucuugcuaucguuucuagcaauaaacacuuuagcacauagaggucugggacagaacuaacuccucauguguuuucagggaucuuauuccaugugucaccaccaaagacuuccacaguauuauaaaacauguaacuacucuaaaaugacgucagcccuuggcuacaucgucuucuuucucuuuuguacauuuggagaaaugccugaaccuuaaugguauuacuauaauacugucuuauauuaacuguaggguuuuuucauuggaauauugucugccauuggaggggcgggggagacaacgaaugaagaucuaaauacagaaaucugaacacaaguuccaaagcguguccucugaccucucccuuuuagguugacuuauuugugaaacagguaaaauuugagagggucauuguuuugugguuuguacuauuucuuaagaaacauacccuaagauuaaauuuuuucugaaaagaaaguaucuuuuuuuccuaaguacuucucaaguuagucuuuuagugggaauucugccgauuaaccuugacuuaacauuuuuuuccuucuaauauauauuuuuuaacucuguguacuuuaauacuuuaaguggaaauaauuuuauaaaaucucuguuaaaucucaagccccaaauguggguggcucugcauguguguuuugggaaacuuuuacaauaaaguaaacucauuuuauuaguggcagcugaguauuuuuuuuucuuuaugugucugaauauguauguugaagucugugaauugauguccuuuauuguucguuauuaguaacagagaacauguccauguccuucagcuugcagcaagucaggacuguuguuacuuucuguaaagcuucacuugggcugaggaaggaguccuggguugugaagucuggaugcuaagacagagaagcagggcagacaccacaggaacuuugucacagugacugacagacugucuucagcaucgaguguuaacagaaaauucagguuuguggaugcugaaaguguucuggaguucugucugucugaaaggcagaggagguuugucugcaucggguuuuaacuuuagagauaaauccugaucuaaaagcuugggaggcagaagcaggcagaucucugaguucaaggccagccuggucuacagagugaguuccaggacagccagggcuauucgggagaagccuugucuugaaaagaaaaaaggaaaggaaaggaaaggaaaggaaaggaaaggaaaggaaaggaaaggaaaggaaaggaaaggaaaggaaaggaaaggaaaggaaaggaaaggaaaaaucccuuauauugcuuuauuaugcuaugcaguauauguucauuuucagauagcauugaaaauagcguuauaaauuacaguucuuagucuuuuuaucaggcuuauccuugucauggccaaacagggcuauaaauuuaaacagaaauucaaaaguacacagugaacuugugaaguacuucauugauguuuguuuuuucccuugggguuuuauuuucccuugaaguaguuaguuaacuguccuuacagagauguguggaaaaaaucacauuagggacacguuguucccggaaaguauuguguucauuuaucuguucaucaaucuaucugagucucgaggccagccuggucuauggagcgaguuccaggacagccagggcuacacagagaaacccugucuaaagaaauaaauugcucuuuagaagaauguucuuugaauuggaauuauaauuaccugcucuguagguuacuaaagaaguguucucaacaacaggaacuucaggcaccaggcauguauguaguauguguauguaaccaggcauguauguaguauguguauguaaccaggcauguauguaguauguguauguaaaugcaggcaagacacucauaugcucuuuuuaaaaaauggcuuuuagagaaagaagaacagggaaaaggugccauauuaaaaaagggaaggggcuggugagauggcucaucagguaagagcacccgacugcucuucugaagguccugaguucaaaucccagcaaccacaugguggcucacaaccaucuguaacgagaucugacucccucuucuggugugucuucagagacagcuacaguguacuuacauauaauaaaaaauaaauaaaucuuuaaaaaaaaauucccaucuugaagguuucccuagucuggaauuucauagccuguucucuuuaaauaaauaaauaaauaaauaaauaaauaaauaaaauaaaaaagggaagaaggcaagcaugauugggaacaacuuuaaucccagcaccggagaagcaagcugaucgcugugaauggaaggccggccaggacugcacauuuuguuauuuuaugcuaugaugguauucuguuguuuuaugcuaaucaaguuaucgucacuuuccaugcauccaguagcaugcauugguuguccaguuuguacaauaguauggcuaugucagagccugcauccaugaagacagaauaacaguuuaaaggaauucuugcugggaaaggaugaauucacuguuaucaaaucaaugucuacacuauucuaggauuuuuuguagauccuugaauaauucauuugauucucuuggaacagauuuuuaaagcaauacucgggucccuucuugucuuuaccuuuuuugggggugggggugggggaggggaacuaagacaagguuucucugguaucuuugccuguccuagaacucucucuguagaccagacuggccuugaacuccaagggaugaaucuguuugccucugccuucugagugcugagauuaaaggcaugugcuaccaaguuauaaggcuuuacuuuucccucuuaaccucuagcacagcggugugccuuuuggcuccagagcauauuccaaaucugagcaucucacucagcucuccacaacuuccuaauucaggccagccuccccucucacugagaaggaucugugugugucuguguaucucuguguguguuugcgcgcgcgcgcgugcgcgugugugugugugugugugucucugugccugugugugucuguagcuuauaagaaucuguccucucuaccauuugguugcugacacuaggacucugguccuuaggcucagagacaauaacauuuacuuacugagccaucuccggauuucccuccaguccuggaacagaagaaauaucacuacauuuuuaguaacuuugcagauuuucaccaugaccuucaauggucaaguccucugguauagugaauuucauguuuucaacugacuccuuuggagaauacuaacagagaaggcuggggagagaggaggcgaagaucagggauaggcuuggggugcggguggggaagagaguguauuuccuuccaacugccagggucuagagaagaggaguggauguggauggaugaucuucuacugugaugcaccuucucaaacuacaucaggccaggccuaacuuacaugacgucaaaccugagggaugaagagggucaugguucuaccagcaaucauuaguagguacucuggauuaacuagaguucaccagaaaaacacuagcauuagaggaaggaaggaaggaaggaaggaagggagggagggagggagggaggaagggagggagggaguacaugauagauagauagauagauagauagauagauagauagauagauaucauuuauacacauagauuauaaguaauuggcuaaccugauucuagaggaugacaagaucaaacuucacaaggcagcuuagugggcuggagggcaauggaagaguuaauucuuuggagaucagguacauggugcugaccacagucccuuuucuucugauucggaugaggcccacccacauuauggaguauaaucugagcgucuauucauucaugaugucaucuugaaaaugaggauuaaagccaggaguagcugugcaugguuuuuuuuuuuaaagauugaucgauuuauuuauuuuauaugaguacacugucaccccccucacauacaccagaugggggcaucaaaucccauuaccgaugguugugagccaccaugugguugcugggaauugaacucaggaccucuggaagagcagucagcacuccuaaccacugagucaucucuccagccccugugcaugcuuuuaaucccagcacucaauaugcacaaacagguggaucuuucugaguuccaggcaaaccuggucuauguggugaguccaaggcuagcuuacugagaccccgccucuuaaaaaaacaaaaaaaggaggaggggaagaagaggaagagaagagauggacagaaagagaagggauacuguaucaguuaaaucaguagaauggccuagccaaguugacauauguacaguagcugucucaauauucuuaaaaauuaaauuuucaaaggaacuccaccucaaaauaaagccauuuucacugucuuuuuauguagaaacuucacgucuuagcucuuguuaucuuacaacgaagaugcuguagcuuaugugggaaaagaacaacuacaccccggcuucagaugccccuuuguguuucuugcugaccauguaccauccuuacuuaacaaaccaaccaaccagccaacccagagaauaauucccacgucguauuguugggaacucgggacuuugguucauuucauuauacuucgggaauggcaauacugaaaaaagaaaaggcuaaccuagaaaugcuuuuauaaauacccccgaaguuuccgauguucaucggaggauuaccuggaaucagcuguuguguucauugaucuggcuuuuagcuucagagaagagagagaagaugcuuuuaaacugaauaggaaaaauaaaucgcccauccauuauuggcugaga

SEQ ID NO: 5550 - RNA, 87802 nt, Mus musculus
agggccggcggggccgcgggcgggggcggacgggcgggggaccgggcuccgggcggcuccgggcaccgcgcgcacacaccgggccggcucccgagggcgccagcgcggccccggggagcgcgagcggggagcgcgcggccugcggucagcggcccaucggccgaaaagaugguguccuggaugaucucccgagccgugguguaaguacgggcggggaagacgcuuggggcccgguugccggagccaagcucacgggccgcggccugcucacccgugucccagucgcugcggggcuccggggcggcggcggcguugggagcagcagggcgcgggcgaacggacuggcaggcggugggcucugcuccguggagccgcuccccggcgcgcggcgggcucugcucggcuucuccucggccuccccuccgcuccucggcuacgcggcaggcgcugcuccgcuccucggcuccuccgcugcccggcgcugcgcgcggcgggcucugcucggcuccgcggcgcgcucccggcugcggcucccgcucccgcggcccgcgcugcgcggcaccgcccugcgcaggcuccgccgacgcugagcgcgggaggccggcgggacuccggaugcgcccgagccuuugucaccaggucuaccgcguugcggugucuguccgcggcgcacgccgcuuggucacguguaggaggaggagagaucggugucagagcccgggcugcagagucuugcucaggggucccgaggugaccugggaaagagccugcgcuagaaaggucgggcaaacgcugaccguggagggccgugggugggaagaaauguuugcaauggagaaggcgcaggugccaguccccuuuguucgggucaucuccucaguucacugauugugauacaaacgagagcugcggauggggagaggaggggggaaaaguugagauguguuguuuaaucugcaaagguauuugaauacaaguuaaaccgguucucuucccaucuuucaccuuacccugugcgcucuaaagcaaagucaccaaauaaagggccauaaauuagguaaagccugggggcgggaauucauuauucauguagcaguagugucaucugaguaccuuaaugaaauguuuauaugagguuaacaggccucgcugauuagcuuauaauuugaagggagaaaaugacauuacuugggcauuauuauuuucacuacggagaaggagcuaauuuuuuuuuaacuugcuuuuauuucguuuggaagugagcuagguaaccuaguuugcaaugcauucaaaauuugcucuuucauaaaauguccuuuaaagccucugaacuucuuguauucaucuuaaagccacaaauaaauaaaguuaugccacgggugccuucaaauuauguuuugccucuuccaaggcagucuucggguuuccacauaauccaggcauacuuucuuaaccuaccagaagucccuccacuauuuuggccuagccccucaaauuaaaugccccauuaaaaaaacuggguuugucuuuugaucucuuagaccauuuucaaugauggaaaauuauggaacaccuugaguuugcauucaucaaauaagauuuuuauuuuuuuaauuggugaaaggaaguauguuuagugcuacgcuaccuccaauacaaaggucaguaccacguaggagaucuuaaugggacacacauuucacauccacagauaucuacuguacaggucagaaugucaggucuuaugaggguuauaccugguguaauacccaguguuagacaaggaagaaauuaucugugguuggagcgucaucaaagaaggcaaaagagauuacguucauaauagaccuugaggaaugaacccgaucuagaccgccaaagaggaagaaggaaaagauuucugauagguggacugguguaaaccagagcugggguagauuacagagugagagccagaaaagcaggaagagaaagagaggccauuguuuuaugaagacuuuuauaaucccagaaacacugaguccaguacugaaggaaggaugcgcuccugcucggucagccuguggaguugaaggucuggggugaaggggaagcaugcaaaugugacuuuuuuuuuuaaaggucauuaaaacauguauuaaucaggagucaagaaauguguuucgugaacuucggguccagcacauuugucgaggaacaucuguguguguguuuccaucugcgcuuggguuaucucuaaauguaaaagcuguccuaauagcuacacaaaccuagauacuugcuccgcacugugaaauagaauuuguuuguguaucuccuucuucaccuacugaaaugcccagcugggccuaaacaaggucagacaguuuccucagcccgagccuuuggagguaccaucaaggacaagggacccuaucuaaaccugaacucccaagauuaaggagcaauucuuugcagaccuugaagcauaacucugaggacaagaaugauacauuagacucagacucagacuccacuuaguagcuguguagccccucugacuguacugagcccaccugagcuuaaguugccuuuuuuuuuuuuaauuuaucguuuuggguggccuugggguaaugugacagaggacaaccugugggagucaguuuguuccuuccaccacgggauugggugagcauagggacuuaggcuugacaagcaagcagcgucuccucaucuucaauugauugucacaacaucaacuuacuuaaagcucacaagaccaauaaaugagugguuuuuaauggauuccgugugugagcguggggggggggggggugucugccuguaccugggugugccugaguauauguauguguaccacgcuucugcagaaacccuaagaggucagaauguaaugucagaucccaugaaacaggagauacaagcaguugugagcugccauuugaauccuggaaccaaaaccuggguccuuggcagaaguaagugcuauuaaccucugaacuaguucuccaggugagcaaauuuuaaggaaugguaacgugagcauaccucauaauacuaaauucauauacacugcccguaccucauauucugaaggcacugcucacagauugaggaaagcccacacacaaacacaucuuucccuaacuuuucguagcuucuguguuauagcauuguacacaaaucaaaacucgaaccagcuggucugaauuuaaauaucaguucuaccacugugacucgccccauaagauaaggcacauucucauauauaauguccacaugcagcaucuaguggguaguaauuauuccauaagugccaguagcugcuuucagaacaaagaagcacggacuagccaaauaccuacauauuaaauuuuagacuauauuucauuuucuuuugucccccccucugagccuguguuuagauaucaaaguuauauauacaaaaguuguauaccauaauauuuuauaaggaaugcuauaauuaauacaggugcaauucugcagugggcaucuguggugcuuugaauuaagcuugacccagggaguagcacuauuaguaguuguggccuuguuggaggaaguaugucacugugggggugggcucugagguucuccuccuaguuuccgguagucauucaucuuccuguggccuucagaacaagauguagaacucucagcuaaccauauaccaugccugccugcauacugucacgcauccagccuugaugauaauggauuggaccucugaccuagagguucauccugugguauuuugcugaaaaaauguggcugcuuuuugccuuugucugaagagucugccugagacuaagucuaagguaaagagaaucaacaacaaaggaaaucucagaaaaucccaccucacagagacacacuucuuccaacaaggucacacauccuaaaaguaugacucucugggccaagcauauucaaaccaccacagcauccuucacagacuugccuugaggaauuccuuaggaaaaguacaugaggaauauuucugagugaaacuuuauguuuucaugauccuuggccuaaaacugcaaaauuauuuaccaaaaaguuauucaugucuucuguuacaucaacaaagcacaagaacuuuaucaagaugcagccuggccgccugacaguagcagcacaugccuuuaaucccagcacucaagagguagaggccuccuugugaguucaaagcuagccuggucagagugaguuccaggacacccacagcuacacagagaaacccugucuuggaaaacauaaacaaacaaacaaacaaauaaaugagcaaccugacagucuuauacugguguuuuguuuccuaguaauguaugacaggucuuuuuucuuuuguauuucauaucuuauuaucgagguugaauaauugcccuaauauuuacuuauuaauuaucucacuauuuaaacaaucugugugugcuuugaucacuucuguguguuucuuguuugucuucucugagccccuuacuggauaaggaaucucggacuauuuaacauuggauagaaguaauuuuuaaucuuauuuuacaucucucauggaugucggguuuuuuuuguuauaugguucauaguucuagugaugugugugauggauagguaugugugcacauagaggcacacauggagccacaggucaaugucaugugucuuccucuguuacuuuccacuuuaugauuugagaccugggaucucucagagccuggaacucaucaguuggcuagauggcuggccagcaaaccucugggauccaugcuccugucucuccucccacgcacuagagugacaggggcaucugccaugcccagguuucuuacaggacugcuggggaucugaacucagguccucaggcuugcaucgcaagcacuuuacccacugagccaucucccccacccuguaauaacauuuccauuuguuuuccuuuguucuuggugauguggguguuacuagaguucaaacuuaggaccuugcacacacuagccaaguguucugccaaugaacugcauccccagcucuuacacauauugacguucuuucuuucuuucuuucuuucuuucuuucuuucuuucuuucuuucuuaacuucuuguaaauccagauguuugguaacuauguucuucucauacacaauugaauuauggagaguucucuauuuccuucuauauaacuaacauguuuucaucucuguuuugccauaaugauaucaucuggcagucguagugguaaaaacuuucuccugcuuucuucaacuguuuguucuaguuucauuucuauggcugugacgggcacccugagaaaaagcaacugaggaaggaagaguguauuuugacucacaguuccaggugacaguccauuauugcagggaaguuaaagcuucacauccacacuggguggugggggugaucuuuccuugcuuucuucuggcuuucuccucucuuagaaggugcuagaccuagggaauggugacacccacaauggacugggucuucuuacaucagguaacaauuaugaauauugccccccaccagacaugcccacaggccaaccuagacauauuuuuggagaugaaaacuaugcucuagcaaugucuccucuuuccagcauauucuuuuuucuuucuuuccuuccuuccuuucuuucuuucuucuucuucuucuucuucuccuucuucuuuuccuucuccuccucuuccucccccuccuccuccucuuccucccccucccccucccccucccucucccuccuccucccuccucccuccuccucccuccucccuccuccuccaucuccuccucccuccuccuccuccuccuccuccaucuccuccuccuccuccuccuccaucuccuccuccuccuccuccuccuccuguuuucgagacaggguuuuucucugugcagucaugacuguccuugaacuuacucuguagaccaggcuggccucaaacucagaaaucugccugccucugccucccaagugcugggauuaaaggugugagccaccacugccuggccacacaauucauguucuguuuuacccaucugccaggugcuccuuguaagcauaccuaugugcuguuuuuucgcacuccuuuaucuugcuaaauacuuugcucaacucuucaguuaguucucucccucucucucaccuaagcauaccucagaggaggggaugucgacaucucugaggcuaggagcacuuguugcuguuacugaggaccagcacccacaggucuguaacuccagccucaggggaucugacgccucuuaugaucucagguaccaagcaugcacuugguuugcaaacaugcauaaagucaaaguaccauacacguaaaauaauaagauuauuuuuaaaauaauuguuuuaagaauauugcaagagggccggacgugguggcgcacuccuuuaaucccagcacuccagaggcagaggcaggcgaauuucugaguucgaggccagccugguuuacaaagugaguuccaggacagccagggcuacacagagaaacccugucugggggggggggggggggagggggggagaauacugcaagagaauaaauaaacugugugcgcugugucuacucugacuccugugggaugcucccaaacgccaucgcuuaggcuucccuuccccucccacuaaugcugcuguuuuccccuccaguggugauguccuuuugcuugaucuucaucuccuauaucagcagcccuugcuacaguuguccaccgucuccucagacuuucuccagcaaccucugcucuugcagagguccugaguucaauucccagcacccacaugguggcucgcagccaucuguaaugggaucugauguccuuuucugggugugcaugaggagagcguucauaugcauauauaaauaaauaaaucuuuaaaugauaauaacauauauauuuagugauucaaauacuuuagaaugagcauauaagcaggugaggagagcuuagugcagauaacaagccauuuuuuuuucuuuugauccuagauuacacauuuguauuagacuacucuucuauauuuuuuuucggguaaauagauaaauaaucaaaauuguucgacaaaaccauuauaaaaaucuucuugucuaccauauuaacugacugugaaguucuuugccuacuuaucuauaacuagugaaauauauuuaacacucacucgugcuguuauauuugcucagaccaccaugacugaaagucggggaagacagcaugcucacccaagucgcacagacagggaaaauguggcaguugggauggcauuguugguuagcgaucaagauaacuaaggaguagaccacaaagugucacucuacuauacuauguagccauugacuauguaccccaacacucacagcaauccuccugccucagccuccugaacugagaucauaagaaugagcuaccacaccuagcuuaaaguuuaaaaguuccuuuuuguauguuuucuuuaacauacgacuucaauuguguguguguaugugcuugagugugugugcacgugcacacacaugccugcauauauguuugugugcugugugaguaaccuggcaccuacagaggccagaaguugugccggguggaugcuagaaacccaaccugaguccuauguaagagcagcuagugcucucaugggcugagcugacuauauguguccagcccuaugccagguuuucuuacacucgauacuauugauguuuuagauuaaguacuuccuuguucugagggcgcugugcauugugggguuuuuagcagaacucuuggucucugcucaugagaaccaagacaucauaccccauuucacugguucuaagagccccagaugucuccagaugcugcccugccuguuucaccucauauacagaauugcuacuagcugagauucccccaggcuccaugcaaagggaaggaaggaacccagaagcuaugauggccaguguggucaguuacucagucuagauagccaaacagaauuuugccaggcagugguggcacacacauuuaaucccugcacucaguagguagaggcaggugaaucucugugagcuuaaggccagccugguuuacagaguaaguuccaggaaagccagggcuacacagagaaacccugucucagggagagagagagaaagagagagagagagagagagagagagagagagagagagagagagagagagagagaaugagaauacauucccuuguuacagaaagucuuauagaaauaaucucuuagcaaauacagucaccugccuagcacauccgucuaaaacuggcuggcuuguuuucuguuugcuguucugugugcccuuaugggagacauuggaauucuuguaaugauguuaggaaauucacuaggauagacuuuucucugaaugcucuguggaaaacaugaucgcuaaccaagcugucuuucuuuuucuuuaugccauauagagauguuuucaggaguaauaaaacuacugaauuauuuaagaaaucgccuuacaauauucccaguauuguaccauauuuucugaguuucuacaaaacacagcagagcuaugaaguuaugugaggcuggagggcagcuuggaggaggggcucucugauuuguauuuuguauguuguuguuuggcuuuggggagugugcuuauuuaagacagggucucccucuauagcucagucaggccuugaacucaaaauuuucacgccucagccucuugaacacugggauuacaguugucagccaccagaacuggaaacagucaaucauauaccugacaggucugggcccuuggguccaauucccagcaccaugcagacaaaaagauauuaggacuuuguacuuaguuacuuuucuauugcugagacaagaugcuauggcccaggcaguuuauaaaggagaacauuuagucacguucaugguuccagaggguuagaguccaugagggcugagcagaggcacuguagcaggaacagcugagaguuccggucucuaaccuuaaggaggaggcagugcaccagggaugacaggaugcuuguaagguacccaagacacaccuccuccaaccaggcaacaccuccuaguccuucccaaacaguuccaccagcaaggggccaaguauucaagcuuauggggcuaagcagacacauucugauuuggacuuccauggaguagaaauaugaagccaaagguuaccauuaugucaccagcgccacaguuaccagagucagcagugugaccaaggcagaacuagcaaggagaugagugaaaguccuagaggggauguugacauaguuuguacuggccaguaugucaugucacgagguguucagauguccucaugcagaauguguggugauguuuucaaauaaugaugugccagucuuaggaaauaacuguguguacacauaaggaaaaucaaucauucugccauggacagcuuuaugaaccacuuagcacgucacuuuucugggaacuauggccugcuggcacugauagaccacaaacgaggucacuuccgaagucugagaucaagguaacaagaagucaggguccucaggacugagcaggaaucuuuggagccuuucugcuuucuggugguuugcuagccgccucugguguuaucaucuucaggucccucccuucaucuucacauagaugggcaauggcugcgggauuacagccugcucuguugacuuccuuuuaacuugaauaucccugucaacaccgugucuccagauauggucacuuucuaaaguagugcuuuggucuccagcauaccuaacaauacacaacaaccuucaagcaugcagaggggauacagacagaggcccaagaacaaccucggggacuggauuauuaacaaaauagcuuucuuaauauacucugugggagaagggguaugugguucugccuaucgcaucuccacuggguguguuaacucugcuccgugcugacaaaaccgcauaacucuagacugcauguagccugugccaccauccaccaucgggugcugggcuugcagaaaacuccuacgcaucgcucagugggugggaggauguagccugggaugaggaccucagcccagaugagaaacaaggcaggcugaggccaaagagucagggguucccaagcuccggggaguccaaacucugcuggaaacuggggaguugggaacauagguggcccacagacugggaccaggagaucuccagcuuaccucagaggguggauguccaggaacuaggaggggccuucugcgggagaguagggcgacuccuaccgugcucagguggguaccuggguuucugaacccuuucuaccuuaccaaguuuccugguagggucugcugccccacagggguacugauuuucugcucugugaaucacaaaauuagaacugacaguauguggaggaaagcuguaaaggaccaaguguauguguucucaccacucaccuuguugacacaggguccucaacugucagugcucugcacucugaacugcaggcuagcugcuccuccgagaacuuccaggcaguccuguucccauccucgucuugauguaggagugcuugaguuucagaugaccaccaccacauccaauuugcauacuuuaauuucaguguauacgggugccuugccugcauguauguccguuuaccaugugcaugccuagagcccguucacaccaaaagacaguauccgauccccuguaacuggaguuacagcuagccaugagccacugugacacgccuagcuuuuuauguggguaccagggaucaaacgcaggucaucaggcuggcuugcuugcacagguagguacuuuuucccacugagucaacuugacagcccauaaaggacaauuuuaucaccucuaaaauuguucaccauuaacugccagccucaugaaaacagugugugguccuccgugagcucuggaggcaaggaagaaccccagggaagaucuugauuguacuggcuguaugcuuccucuggagagccauaggugagaugcuuagggaagacucguguguauguguguguguguguguguguguguguguguguguguguguguguguagagcacugguauguauagaaugguugagccgacuguaaaucugaauaugauccugaucguggcuguguguuugggggucgggguaugagguauucagagaacuacagugcuaugcgagaagcaagccagcuaugacucugcaucacaugacaacaucuuuaaaugccuccacauaguuaaacugcacauaugugaccugucaguuuuugaaaaaaguccaauacagcauaggaugcgaguuagcuccaaagguagaaagggguauagcgauugguguuagggcauccugcuccuaagcuugagagacugauagaauucacuuuaucaucuauuugacaugagaguguguguccuguauccuuuucucugugucagcccuuacauuggagauguguuaaacacuuggaguggguuaggcgcugcuaccuacaguaacuaaaggggcaagcugagacaagcaggaggcagauaccacaggaaagagaggcuggucccgucccagcccauauguucucgcuaguauaggggccggugcuauugcgacgccaggccacagauggaggcagggaaggggccgcaccugucaugacgagucgagucuuggaacagaaggccagaaccuuugagaaaaugacaggcaggcugucuuuuguccuuuuuccucaaagcugguguaaguccagcgaagaaaguccaagugcagacuuaugugaaggguuuuugagguucuagaaggggaugcacagcuagcuaguuacaugagcuccuuacuucccuucauugucagaugucuuuuucucuuuaaccuuuuuaaauauuggggaggaggcaugugcgugucauggcguuggugaggaggguagaggacaucugaggcuuuugguccucgcuguucucuggguacaccagccucacagaucucggggcuccuuguguuucagaaucuugucuccucucucacuguaccuguguugggaugacaagccugggcuacugcaccccacuuuaaucugggcucuggggauccacacuaaaguccucauucuuuccugcaagugcuuuagccacugugauguuucuccagcuccggacaaugcuuucuuaucuaucugauaagaaaagaaucuauauuagauaauauaucuaucugauauauuacauguacuauuaaaaaaaguagcucaguauuuaaaaccaugugaaucaauguggccaacccuaagagacaaagugacaucugaagugcagacuaguguucuucauucaauggcugugcuuuguggguuuuuuuuuuuaauauuuauuuauuuuauguaugcgaguacacugucacucucuucagacacaccagaagagggcaucagaucccauuacagaugguugugagccaccaugugguugcugggaauugaacucaggaccucuggaagagcagucagugcucuuaaccgcugagccaucucuccagcccugugcuuuguguuuuaaugcuaucgucuguuugagugguugacuaguccaaagccuuacauuacuugagacuacccagugcuuccauaaaaguacuuuaauuugaguuagagauaugucucaguguuaagaguucccuugcaugcaugaaguccuggguucagucccugucucugcaagacaaggaaaagacaaggggaggaagggggaggggagaaggaaagagcucaccucacacaucuguuuuagagcagugccucaggguuagaaguggaagcuuuagccuugggcccuggauggcucugaacuaucaggugaagagauccucugaaauggagaggaacccccuggugugugguauuccuuuuguaugcagaagggaaccgugguguggagagguguguacuguccccagggucauugcuguaggagcgaucuggccaggacaucugucacucuccgguggccaggauuuacuuggcuuguuagccuagucacuggcucuuguucauucucucugcugugcucacuuggucacuaaaugacacguacaccgagcagcgccagaggacccagaaccggauaugagacaucggcuuguaaaugugcagcucuguguguaaagauuuguaauuuuaggacacuggauuggaauuuugaaagucaccucuacacccccucccgcaggcccgccccacccccaucccaggaacagccucagucacuccaaaguaaaaacacauugccaauguagcuguuucagcuuggagaguauuaccuccauaugggcuguggauggccuagauucccucuagaacucaacagauucuuguuuugcuaugguuuuucagucuuuauguuuugcuaacauuuuaauccaggauaccaggucuaaaacuuuaugguaaagaaacaagaguuuccaaccuugaauugggaccuggucacacguccaguacuucugauauuuuggagucggaggcaggagaaucaguuucaggccuuccugaagugcaugagacccuaucucaaaagauugccuagcuuuguucaacaucuaaaaaacgaauccuguaagaugcgaugguuuaacauugcagguuggggccagaaaagcaauucuuuuuuuuuuuuuuuuuuuuuuuaagauuuauuuauuuuauuaauguaaguacacuguagcugucuucagacacuccagaagagggagucagaucuuguuacagaugguugugagccaccaugugguugcugggauuugaacuccugaccuucggaagagcagucgggugcucuuacccacugagccaucucaccagcccccagaaaagcaauucuaacauuacuuaauuugagaaauucuguuggucaaaugguggcuuugaccuccuaaaacgucucuaaguuauuucugggguugcaguguuccuaagggagggcauccaauuuugauuuuguugcuguuguuguuguuucuguuguuuguuuuugagacaggaucucucugaggcuagccucagacucccagagaucugacugccucugucucucugccucugauucugccucugccucuuagagcuggcagaauccguuuucacagggauguugaaucccucauuaucaucacagguuccuacagacagagugccugccucauuaaaauagaacugggcggggacaccugccccccuggacgccaaggucagaggcucaccugagcccucauguuucaaaccagccugggcaaccuaaagagacccugucacaaagaaggugguacauccuuggagcucaggaguacuauagcuuauuggaagcuuguuuaaaaaaaaaaaaagagagagagagagagagagaggccgggcgugguggcucacgccuuuaaucccagcacuugggaggcagaggcaggcagauuucugaguucgaggccagccuggucuacagaguuccaggacagccagggcuaggcagagaaacccugucucgaaaauaaaaaaagaaaaaaguuuucccagacuccauucccaaagagucugcuugaguggaccuaggaugagcugggugucccuguuuccaggggcuccucugugacuggaacacacaaucauacuuucaaacucuucugcuggauuuuguuagaaacugucaugggagugaacugccaaagaccaccauuuuaaaacagagaaguaaaaaugguacaaggguguugguuuggcuauguagugauauuaaagcaugccaucagagaccuuaaaaaagaucucugaagcuuacuaagaggcagucaguggucuguaaagaagucagcccccgcgcccccccccccccccccccgcuccccaggccuucgaggugacucggcagguggccguguuuaccaccaagccugagggucugaggucaacccccauuucuaaaauccacaccguagaaggagaaaacagacaccuuuaaccugcacacauauaaagcguauaugugcacaugcacggacacaugauggacacacacauacacauaucauuuuaaaauguuuaaaaggaagugauccccucucagacgaagccuggguuguuuuuuuuaguauuaacuguaaaaguauuuagaagcgacgaauaugggaaguggaauaucuggaguuuauuacagcaugaauuugaaccugaaaauggauaucacgucuucaaccagccugagaacacagcucagcaagcaguaaaaccucauguuugugcgguggcugccuggcugccugcugcagucuauacugucucaaaagggccauuuguaaagcuucugggaauggcgcccgagacuuguuuaucuguauaguaaguguaucaaaauucuuucugcuaguuaaaguguccucaauauaaaacuagcuuacagcucuggggagaugacagagugguuaagggcacuugcugcucuugcagaagacccaggguugguccccuguauccacgugguggcucauagcugaccauagcuccaagcaacccaacaccacuuuccggguuucacagguaccugcacacacacuggcacccaucggcgcgcgcgcgcacacacacacacacacacacacacacagagcuuuacacauaauuaaaaauagaucucuaaagaagucaacucuuaaagggcuccauuacuugggauguccucacaagcugugaguuuucugagugacagcacagguagucuguccugaccguacuuucaacaaaucacacugggagugggugcuuauccccaguccuauuucuguguagcuggagagagagagagagagagagagagaguguguguguguguguguguguguguccaaguucucuugcuuguccuuccccuagaaucuaagaaaagcuauauggccgggcagugguggcacaugccuuuaaucccagcacuuaagaggcagaggcagguggauuucuaaguucaaggccagccuggucuacagagugaguuccaggacagccagggcuaugcagagaaacccugucuugaaaaaccaaaaaaaaaaaaaaaaggaaggaaggaaggaaggaaggaaagaaagaaagaaagaaagaaagaaagaaagaaagaaagaaagaaagaaagaaagaaagaaagaaaaagaaagaagaaagaacagaaaagcuauaugguauuuaaaaugggguucaauguguuguuauggaaacuaauccaggaaaaacaggaaaagguguaucuuuggcuagaaacgcaggggggaaggaagcguuuuguggaaagaauuaacugucgugaagcaaagacacuuugcagaaguuacauguagauucucugcacaaacuaacaaugaaucggaaagauggccaucaauccaaaaccuguaauagugagaaacuuuuagguguguugacgcagagauuccagauacagcaguuaagucuugacugcuuucugaguggcagauagcacagguagucuauccugacgcuacuuucagcaaaucacacugggagugcuuauccccaguccuauuucuguguaacuggcgugugugugugugugugugugugugugugugugugugugugaacaagauguuauggugguguagggaaaggguuucucaccuagaagggguaagaguaagaaaagcuuccuaaagcacagaguuuuugaacucuguccuuaauagucaucuuccuuaagcugucaggaauggaggggcuuuuaaccccagcacuuaggaagcagaggcagguggaucuccaaguucccagccccuggucuacagggcaacuccagaacagccagggcuacacagagaaacccugucguggggacuggggcgcauauauucuacagugcggacgguguauuauauaguacauuuuaagaguggcauuugcuaaaacugcuacugaaaacauaccccaacaccuugagacccuuccuccacuuguguaaguuucaguuagagaugaauucauugaaguaacaaacucugaacuuacauaguucuucuccacacauuaaaaagaaaacagcagaucucuggucagcaaagggcucucaucuuuuuuuuuuuuuuuuuuuuuuuuuuuuuaaagauuuuauuuauuuauuuauuauauguaaguacacuguagcugucuucagacacuccagaagagggcgucagaucucgucacggaugguugugagccaccaugugguugcugggauuugaacuuccgaccuucggaagagcagucgggugcucuuacccacugagccaucucaccagcccggcucucaucuuucauuguguuguauuuagcgugccuuagauuaauuucucuagcugucuuauuuuugcaaacagaaggacacgaaucagcuauuggaaagaagugaauguucgcuauugaauaguuacuguggguacuucuucccggauguguuucugucaaaagauaaaacacugucuggauuguguuuuucuuuggucuagccauggaaugacuuuauuuccaaucggguagcaaaggaagugagaggcugacuuugaacaaagacuugcaggcggugggggccuuggcugcucaagagcuccacuuagccugaagagagucccaguaaagcugccuaccaagggcaagccccaaggcuuccugggacagcugugggguugcagguggcuuuaacagagcaauggugucacacugagcagguggggagccagguuuugagaagagaggggcaaggggcccugucggaucuuguguuuuaaaagaucucugggcuguggagggcagacuggggacaaaggaggagcuucaauagccucauuuagugaacuagucaagcgaaugguagguaacaaggccccagguggcggcaguggucagagucaggauuuauguuuuaaaguagaagcuaggagggcagcuugacaguuuggcugugaguauucagaguaggaaccggaugaguucauaacauagggaauucaucgaugucaagaagaggguguuaggucuuaucucugcaugagaaacacgcaaggcuccccagauaguguggcagcaaaaaagcaagccguuaugguaggaugaugguacauucgagcauuaggggaaaugacuguccggccugagaauuacuguacugugcugcagcauuagggcaggaacaggcaaggagauggguaacggcauagagcacggaacauuagaaaagcacaagaaagacaucuuguguuacacacccuugucucucuggucacagccuccaccucaaaccacacucagucaguucuggugaggucacagaaauaaaacaauaaagauucuagacuauugaaagauaacuuuuaugacauuaagauugggaaaagcaaucauaagugggaccagcagcuugcguucgaugggaaaggcugaugaugauagguugaaguagacugaaauuauauacuucucugucaagugauaaagacagcguggagagugggaaagaaaccggaaugggacaaaauauuaggagcauacaaagguaagaaauagggucgacaagccaggcggugguggcgcacacccuuaaucccagcacuugggagacagaggcaggcggauuucugaguucaaggccagccuggucuacaaagugagucacaaaacagccagggauacacagagaaacccugucuagaaaaagagagagagagagagagagagagagagagagagaaaggaaggaaggaaggaaaagagagaaagagagaaauagggucgacaaaacggcucagaagugguacuuuccagcaaggcuagccaccugagaucgguccucaguuacacacacaguggaaggaggaaaccaacuucugcaguuauccacuguggcgcauaugcacaugugugcacacaaaauaaaauguaauacaggcuauugucuuuuugaaaagcaagacaugucauaugcagaacauaagaagauacauggacaggcauuuuacaaaaaaaaauaaaaaguagugugcaugaaaauagccaaggaaagccagcgauggugccguacacccuuaauucuagcacuccagaaggcagggacugguggaucucuaagaguuugaagccagccuaccuggucuacagauuuuucaggacagccaggacugcacggagaaacccuauauugaaagggggaaaaaaaaaaggaaggaaaaaagagagagaaugaauagccaaggagcacagaaagcacaugccuuuuuuguuuuguuuuguuuuucaagacaggguuucucuguguagcccuggcuauccaggaacucacucuguagaccaggcuggccucgaacucagaaacccgccugccuuugccucccaagugcuaggauuaaaggcgugcaccaccacgccuggccaacaugugccuuucuaacauaguagcaguauuaagcugaguuccuauucucugucuuuaacaagggagccagagcacccucugucuuuugggacuaaguggaaacuguguuucaaaucuaccugcgacuugaaaggcuggauggaugacugcagaaaguaaaagucuagucuugaacaccagaugaauauuuuaagaaauaucaucuaagguugagcguggugcuauauacacuccucuaaaucccagcucuggggagcaucaacagguggggacuaccuagugggacuuugucuccaaaagagaggaaggaagaaagggaaaaaagaaagcuaacacuuaggcaccuucauuacucuguaagagucaugcuuugaucuguuguaugggagauacaaucagaaagguaacgcugagaaaacuaagccuuccuaucaaaaaaacaaaaaacaaaacaaaaacaaaaacaaaaccaauggccagcuggugggggaguggguguuacugcccaagccuggccaccagggaagccacggaaaggugacaggaaagcacagccauaauaaauaugaauuuaaaacuauaucccuggggggaaacaugcuguauaagagagguguaucuccuucagaugguucacgguuuauuugguguuauuguaacugagagguagaggcaccauggccaucaguuacugauugccauuagaggccggucuucccgaggcaguccaggacgcagggcacccagccuguguucagcagggcugggcacgguaagcccaggaaagcaucugugucgagaaugcuccagugagcaaucggcgcucuccugagaugacccccugcuguugcuaggcgcuccguucuguuucaggaggagguggcgacauuauguaaugccaaaccauauuucagcccucuuuuauguauuuggagaaagagauaaagcuuaaauuaaacuguuaaaucuuuacaaucaaauggaacucaaguugguucagaguuggucugggaaaauaaccgguugugcauuuaaagaaaagaaauucaugaacgugaacgugcugggguuuggguuuuucuuuucuuuugcuuuguuuugauuguuuugccauagauggaagugacauuaagcgcucucuugauggguaagcacuggucuuugggaugcaugugcaucagaugugggacguucugaaaguacacucugccaucuccagcccgacagugccuagugagagacugccuuagacacugucuugauucucucuuuuagaacaaagcuucugagaaauguaagcacggagauccgcuugaaggccccgucucuagcuacccagaaaaccaaagcagagcuauguccauggugggacccucaccaguaacaagcaagagaaaauacagggucugacuggguuuuuuugagucagggucuccuguagcccaggcuagcucuagacuuacugacucaacuguguagcccaggaugacuugacagucaggaucucccuccccgugcuaugagggcugggauuccaggcauccacuggcauacucuguuucuguagagcuggggauagaacccgggucucaugcuugauagacaaggucucugcccacuaagcugcagcccagcccugguuuuuuguuugucuguuugguugguuuuugguuuuucgagacaggauuucucuguauagcccuggcuguccuggaacucacuuuguagaccaggcuagccucgaacugaacucagaaauccgccugcuucugccucccgagugcugggauuaaaggugugcgccaccacaccuggcacuuguuuuuuuaauaaauaaaaaaaucuuuaauaacauacuuaaguguacuagugauaacaccauucaaacccugaggaaucuaugauuacaacagaaaccaaauacucacuggcaccaaggucaaccgaaggccuuaggaccaguguuaagaagagagauuacucguuuaaaauugugaugguaauuuccuacaaagucaaaauacauaccuuccagugcagugguagagcucagcugacaaagugcuugccucgcaccggacuaagcccuggauucaauucccaacacuacuuagaacugaaugaggugacaugugccugcgaucccagcacucaagagauggugcaggaauucaggaguucaaggccagccuagguucauaaauauauuuuguuuuguuuuguuuuguuuuguuuuuaaguauuugcuuaugggugugagcaagcuugugugaguauguggaccccagagcaggacuucuagaacuuuccuuuauaugucucugcuuuauugccuugagguaggggggucucucugaacuggaaguuugccauuuugacaagacugacaggguggggugucuggguaucugccugcuugucuuggagggcuacugcuaggaugauaggcaccaacgcugugcccggcuuuuugggguuuuucguuuuuguuuuuuuaacaugggagcuagacguuuagacuugguccucacaccugcauuugcuguucuuccagagggcacagcaauaguucauaguagccuauaagucccaugacacccacuucuggcuucuagggguggcagauagagggacgcaaauguacacacuaauaaaaacugaucguuuuguuuugugagacaggguuucucuuuauagcccuguucuggaacucgauaugaccagacuggccuugaacucauaggucaacguacaucuaccucccaggugcugggauuaaaagcauguaccagcaucccuagcaaaaaaaaaaaaaaaaaaaaaauugaaguuaaguaaaaucaaugucuaaaucuuauacuugggagacugacguagagagcgccuccuaaggaagaacuuugacauggcuuuacuauuuauugucuauauuuccauggggcuucuuucaggaaugggggaugcccaaccaagucaagauugggaaagauugcaccuuugcucagaggggcaauaguguggugucguccaaaaucucccuuccaaacucaugaacaaugcuuccgaagaggagaggacuuggugccaaccagccagcaggcuggcuucuccagugacugaacucagggucaaauuagguagugcaagaguucuugugaccuguuuauuucuucgucugcucaguuguccaagauagaaaagaaugcucccaccucccuggugugcuuggacuagaggagaugcauagaugucccucugccggguaguuggcucaagaaaaugucaagagcgguuuuaaaugccuuuauggugucugaucacuauguucuugauauguuuugauaccauaauguaugcuauugucugucccacagaaagaggcuaacaagccuuucaaccccauuaauguaaguuugagaggaguguggcugucaucaugaagagagauuguucuagccauagggaguggcguggggaaauuuacugccucggugauauuguagacacucugaggaucugagugaaagaaacuaaggaagugguuuaagaaacacaaaaauaauaacgcuuaggcuuccagauccuguaaauggaugcuugccugccacccuaagcauuugggagguucagucuggccaagcgugaucuugaggcuagccugaacuauguagcaagacuccaucuucaaaauaguaaaaaaaaaaaaaaaaaaaaaaaaaguagagaaaccagagacccuguaagaauaaugagcagagaacccgucucugaaagcccccggcaguuuccccagcaccacaagucaaaaaauuaagaauuaugcacagaugcggucauaggcgagggaggguauaguagagucuggcaugcaccuugccaucggugaucgguuuugucuaaaggagaauuuaaaaauguuuugaccgaucggugguagcgcacgccuuuaaucccagcacuugggaggcagaggcagguagaugucugaaugaguuccaggauggccagagcuacacagagacccugucuugaaaagcagaggaggaggaggaagaggaggaggaggaggaggaagaggaggaggaggguacagguugguggugguggugaugaugauaagaacaacagaugcuucgaaaacaaacugcuaaguucacuucgguuugucagacuccugcagagauuucuggggugacaggaggggacugaagcuuaggaggugcggugggaaugagugucuuauggguggcguuggcagaagacuuagaccugacuucauuuugggaaguuggaaguaaugaacagcagaccacgaaucccugcauauggcuugccuuaccacgaaucccugcauauggcuugccuuaccaggcucugcuucauuggcguaaucggguauauuuuaggaaaggaaauuuucucaaaauuucaaaacugguuuguauggucuuuuuuuuuuucuuuuuuuuuuuuuccuucuaccagaucugguuugguguuuuuuguuuuuaaaccuuagauuacaacucaacucuuaaaugcucuuucagucagggaggcuaaugguaagugugguuuuacagauccugugcuuaagaagcuaaauaaagccugagguucccgagcaaacacucacucaagagucaggaguuggucagaggaggaggaaucugugaccucuucaagucuuugccaccuaaccaauuuggugggaaucugggaauggagcgaauaauacucaaagcuaaggaugggccccggcagauugagugcaccgcuggguucaggucucuuuaggacaauuuucuuuuaccagguuacaacugugauggcuuagauccauauguugccuucaucugcuaacaugggaagugugagcuaugcagugugugaaaucauacagacuuuucucuggguuuuguuucggguauaggagagcaaaggucauaaaaguaagaagcccuguguucugugucggggucaaccaauccucccuggaucaaucagucaaucaaucaaucaaucaauccuaaacucuucaaccucucugaggauuguuugugugguuuguagaacuaucacaguaaccuuuacaucaccuacauuuuugccccauugagaugaggucuuauggagguagcccaggcuggccuagaacuuauuaaauagcuaagcaugaccuugaacgucugacaguccaucuccugguccucggucugugggcauguaccacuaacccucuaccccuguggaugcugugcuggagauuaaacucaaggcuucgugcaugcuaaacaagcucucuacccacuaagcuacaucccugagcaccucggcauucuugcaagcauuuuccaugagcuagagguuaccaugcaguagggucuugcgguaggagagagggcguggccagaggagggagacuggaaagaggaaggaggagucugaugugcuguguggucuuuucuuuuucccuuuagcuuucuguuuccuuuuagaguagaaaucugaggcccugugguguaaaauuaaguuuagcucugacaacaugaaaauuccaagcuucuuagcucuugauaauguguacaaaguuuccccaaggaaugguacugucucuuucuguccuuaacaguuuuaaauguggaccuuccguucuagaacuacguaguauucagggggagucucuucugcaugaacccaacuucuccccguugcuguuuuucuuuuaggcuauagccccuuaauuguaguuaagcagcaacaaaucucuguaaagacagaagucgcacauugcuuugacuggggugugugugugugugugugugugugugugugugugaugcauucacuagccacauaaacaaugguacagugacucaccaggguuccaucgcuggacuguaacaaguguauuguguuccacuugaccuugauuuggcugcuaaucauuguuuauaggaaagcaucuuuguuuucaaagauguauaaguugugagcugagaccauagcucaguugguagaggguuugccucguaugcacaaagccaugauccagccucagcaccauauaaauuugcacaugguagcagauaccuguaauucuuacacuugggagauggagguucggcaagcuggaggaccauaaguuugggguuguccuggagugaauuucaggggugccuaaagguuuucaagcugauguuucaguuuacggguguagcucacuuugucacaaucacuuaagcuuguguaagucaagaagcaagagucaaaacaacuugcuacuuuaaaagucugaucagaauaugacagcuuacaacccucccaggggauccuucuucuaaccuaugagaacacugcauauacaugauguauaacauacaccugggcauacacauuuuuuuuaaaauaaaaaaaaaaucucaaaaggaaauguuuacaucucguuagagccagggguaauaucacacauuugugacuccagcacuaggaaagcugauuaggacggucacaaguuaaagacagcguugguuaaaugacacccucucagaagaaguuaauaauaaguccaguuaggacugaacccaucuugccaugcugacagccuauuguuucuucagaaucaguuuuaauccaaaaugagagugagcaggacaucagcuggaaggacaguagcccagagugagcgcuacauugucgcgcaucaucagcugagaggacaguagcccagagugagcgcuacauugucgcacaucaucagcugagaggacaguagcccagagugagcgcuacauugucgcgcaucgcuguuggcaaugcagaauguagaugcucuaccucugcuucuaagggucucucuuucccagaucagugcgucuucagaagcugcuggaggugaguccagauggaggaggcucuacaaaaagauuuucucugggagagaaaaauagucugcaaaaaaucagaaugcuacuguuguauaguauagugauaaugaauagaauucuuuuuuuuuuuuuuuuuuuuuuuuuuuuuuuuuugauuuuucaagauaggguuucucuguauagcccuggcuguccuggaacucacuuuguagaccaggcuggccucaaacucagaaauccgccugccucugccucccgagugcugggauuaaaggcgugcaccaccacgcccggcgcgaauagaauucuuaaauguauguugaauuuuggggcagacagggagcacacaaguguuauggagugaguucuagaacagccagggcuacacagaggaaauccugucucaacaaaacaacaacaaaaagccagccucuccucacuggcuuggaauuugcuaaguagccugggaaaguguccauuaaauccuaggaacccaccugcccccaccuccccagagcuaagauuacaaacucaccagcacacccaucuuuuuaaggaguccugggacucaaaggaacggcuccaugcaugagaggaagugccuuucagguguucugucuccuauuagaagcaccugauugcuuaaccacacccacugucacguuacaauuguauucucuggugugcuauuuugguugcuugaagacaucgguuuaccaagugguuauaaugaggaaaaaaaacaggaggaccgagaagucgcaaaccaaagaaaauuuugcaaauaaaaauauaaauacgcaauacaaugaaccagcauaauugauguagcugagcaacagauuggauucuugguuuccuggcaauccgugaaaaagaaaggcaucauguagccuuaucaaguaggaauaagaacuuuuuaaagugcugagcacugcacuguauuacugaauucuaaaggaaaccucacccaugaaauuucacaagcaaggguacaagcaucguacacacugccugcccucgacacugccccucuuguguuugugggcuuccugaagcaguuucuauacuugaaggaaaauguaaaauauaauacaacuuuuuccucucaagggagcuuaaaaaaaaauaacccauggucaaacuuaaucuaaugcuaggaugagccuucauggaggaauaaagguuuagaacaaggcaguacugguuggucacaggcggcucuauagaacuucagacuguuguugguaugaggcugaugagccaaguugacaccacagaauucgaauguggugaauaacuaguggucugugcuuaccacaggaauggggccgaagggacgaccacuaugaguuaguccauccgguuugucaacccugcuccagucuaucugagugccggcaaaacagcccuugugggauacgcagaguccgcuuugguaacaauguugcauuuccuguuguucugagggugggacgcuaauugcggaaacucauccagacaaaccugcugcugcugcugcugcugcugcugcugcugcugcugcugucuuccacccuucugacuuuugauucuguaguucauuguguuuauuugguauuacuucuaugguuuuaguuacucucuagucugguugggguuuuuguuuguuuguuuguuugucuuguuuuguccuuuaauauauuaaaauaccauguguuugauucugaaaggagugaaauaagaauuugccaagcaacguuaugcuuugacauauggagacucaucaaaugaacuccacaacauuuguuuuaacaguuagugauuugaaaucucuuacaguauuagaagcauaacuugugaugcaaagguuuuagggagguguaaugcugaaguuaacuauuguauuuauuggucuucuuuucuaggcaugacuacuuuaauccauauguuuacucuacuuuuuaaauuauuuuagauuuauguguauaaguauuuuaccuaccuaaaugccauaugugugccuggaaccaugugggggcggagaacuaaaccuggguccucuuacaagagcaggcaaugcuccuaaccaccgaaacaucucuccagucccuguuuauucuauuuuuaaaacgacuacuucgugggccuagaaaguuggcuuaacaguuaagagcaccgggcgugguggcgcacgccuuuagucccagcacucaggaggcagaggcaggcggauuucugaguuccguggucuacaaagugaguuccaggacagccagggcuauacagggaaacccugucucgaaaaaaacaaaacaaaacaacgacaacaacaaaaaacaguuaagagcuccuguugcucuugcagaggacucagguucaauucucagcacccacacagcagcuuacaaccaacccuaacugcaccccagggaaucuaauguccucuucugaccucuaaggguaccagacaacacacauagaacacaaacauacucgaaagcaaaacacucaugcauaaaaucaaucuaaaauuuaauuuaaugcuuguuuggcugguuugguuauuguguuuuuugagacugauagcccaggcuggccuuaaacuuucaguaauccuccugccucagccucucaagugcuaggauuauaagugugcaccauuauggauaacuaaaaguaauauccuuucaauucaauguuuauuuuuauauauuauuguauugguaaauuaaauauaaugguguucccuucuaaacagugucugugucugugugugugugugugugugugugugugugguauuuaaccauguccauuuuuuaguucacacaauugaaggggccacuuugccuuacuggaggugugggcuaucuugaacauuuuggccaaguuuucauuccuuugguggcaauaagacagagaggaaaugaguaacuauuucuuuuugccuauauaacuuuuuuuaaaaaaaucaaauuucugugaauuuuauauggaguaaauauucccuuuguaaagcuuaaguugcucuuguagguggucuccuaaaauguaguuucauuuuauaacuccccgugccuuggcuccaugcccgaccucccagguuacagacguuaacaguagaccccacucauuaaggaacuaacacuucccuucaaaacaaccccuagaaaacaucacuaauguaccuaauaagucacucugccguauucacauuggacaauaacucgugagguuaacagaggcucaguccuuaaaacccaccccacuauuuauaaagacaucgacucuuugcccaaguugcaaacgagaagcaauauugguuuuuguuacuucaaagaagagguguucaggauaaucuacuuguuuguuugauuauucugucuaauguagagguuaaggaauaagagcaaguugggcaccuuuaaucccaggcacuccagaggcagaggcaaacggguaucugaguucaaggccagccugguccacauaaugagacccugucacaaacaaacaaaauuaaauaggggcagaacaccuguagacagaguaucaauaccaaauuuuuacuauauuugugaaaaguaucugcuuuggaagccaaguguaugcuaaauaauacauuacacugucuaauuauugaacuaaauacaggaugacuaaagucuggccaagauuuuccauaaaauucagaaugcccagaauucagauguucuauauaaaaagguagacgcuucggaggaaguguguggcuuaauuaagaaagaauaaagcagaaagaaaaggaagaguuugggaagaaagagcuagggcucuaugaauuacaggcaggaagcuaucuaugcucaggaccagaguggaaaugcuggaggcauagugagagucugggauggagcagaugguuuguaugaggaaguggucuucaauuauauuuugaggaguucccacagaggcuggucugcaagggacaucccugagcacaguggugugacguguccauuagaaaguccccugcuggcaugccaaggaacauguugggacggccaaaaugucagcuggauggcaugagcccaguguauuauuggccaugagauuuuuuuuuuguugguauauuugugugugugugugugugugugugugugugugugugugugugugacagugagagugugagaucagaacacaacucguugaagccauuucucuccuucuaccagguuagauucuggaaauuauauucagaacaucagacauggugacaaguuaagcugccuuucugccccuuucaaucucauaagauuaaaaaauaaagcaggcaaaucggcacaucuacugucaccaaggacaaaccaucaggccugggggacagacuggauggucuaggguaggaugugacaggcccgugcagagaaggauagccucagugaguuccacccuggugauccuggauucuguggcagugugaaagacaaugccuugguggugugcagaauccagaaugaaaggcaccgugggugcagugugcacaugugacuauuuaaaauacagcggugguggguaauucacaggauuguuccucgugugcacagugaggacuggcaaauggcuguccugggaauugaguucugcuuuacccuuaguuguagucaauguuccagggggguugauuguauucuaaaaucccugggcucugugguacggcuaaaauccccagaaccagagacugggagucaguuuuucugguagguggcaaucaccggggucuguugcuagguaaggcagagauugucagugugucauuuauaguugcugaagauaaaauccccagcaggagagaacuugccauuucucuucugaccuggggacaugaagccacaaaccaaggccgaaggaaaccaccaggaaagcaccgucucaaaacaaacacauauaaaauaaaagcugugggcaaacuaaaaauagagauguaaauauuuacucagagaaagacagacucgucaaccgggacucaucucagugcuggagaacuugcaaaaggccucagguucuauccacuguaccacaagagaaaagaaaggcaggcuaaagaggugguucagcagucacaagccaucucugcucuugcaaaggacccaaauuugguccccagcgcccacgucaggugacucacaaccuccuauaacucuagcuccagaggucacagugccuuuuucccacuugagugggacaucuuuacuuauguccaccuacacacauaugcacacacuuuaaaaaaauauauuuuaaaagagaaaaauagacuugucuuagccagaaaugauagcacacaucuaucuaacauggccacuugggaguuagaggcagaggccuaagauuacaagcucaacaccagccugggcugcauagcaagaccuccaucuuaagaaacaaaacaaaauuuuacaguggcaaaaucugacauaaccgaaaacggaucaagguuaacacagacacugauuucuguugguaauaugugcccuagauagagcaugauaacaauguuaccuggccuuugugguuucuuccacaaaacccauaccucuggcuaauagugagaagagcaucaaaucuggauagagaagccuccuaccguacaccugaccaguacacuugaccaguacucaaaacugucauaaugaccuuagcaucaaggaaaguacaaaauguccaggcuagagagagcugugaagucguaugagcacagugugcugugcuugcugggaaccucgagccuaggaugucugcugcuauguaaaaaugaaggaagccugggcucccaauguaagauaauaaugggggcagagggggcgcuguauggaauauauagaaauuauuuguaugcuuccuaacuuuucuguaaaacuuaacuauaagauaaagcagcuauuuaagauaauccaaauaacacuggguauuggugguaguguguguggaccuuuaaguuugagacagccugggccauggaaugaguuacaggaaagccagggcuacaccgugaaacccugucuggggggagggggguaaaauuauagcaagcacuugaaaaaaaucaguacuaacucagauauuguuagauuauucauuuccauuaauaauuauuaauaauuauugucauaguaauuuuuaucuucuuuuuaucuggcauaauuuuucaucagauaagauuugauuaugugagaacagagaaugaagucaucucucuggagguaucuugaaguaggugaagguuacuucaggaaguguaauuucagagaaccguuugccgagguguuguacgcaaugccaaacacucagagaguaaccaacauugauaaauguuguggaaaucugcgaccuugggaauaauaguacggagugaccuucaaggacaagcaucccauugggaacacagauauuaacuggaaagacuuuucuuuugugacaugucugucugucugucugucugucugucuuucccuauguacuuacuaaccuuaauaaaugcauccgaguccuggugguaacucaauuuuauaggugcuuagaguuauauuugauagguauuugagaauuucacacauuuguacaguguauuuugauccuguuucacacacacacacacaccacccuguuuuucccucuugaguucucucagauccagccccaccucaugccuaguuauuuuaauguauaucguuacuaauacugaguacugccucacagucugucaucuguaaaagccagugcugcuccagcugguaguuuaaagugugaagauuuuuuuuuuuuuuuuuacccacaacauuguaugugugugcguuaaguuugcuaucuacagaugaaagauugugaacuuucuauaauaauaaaagugggauucucuccagcugccggggaugggacgauuuuuaccuuugauuuuuuuuuauuuucuuuuuuuaacguucuucaggaaaaaaaaaauauauauauaugauauauauaauuuggugaggugaugagaaaaagauacauuuuuuuuccuuguuuugguuuuucgacacaggguuucucugugcaguucuagcuguccuggaacuuacuguguagaaaccaggcuggccucgaacucagaaauccaccugccucugccucccaaguacugggauuacaggcgugcgccaccacugcccagccugugaaaaaaaauacuuuaaaagccuuguuuugcugggcagugguggcgcacaccuuuagucccagcacuugggaggcagaggcaggcggaucucugaguuugaggccagccuggucuacagagugaauuccaggacagccagggcgacacagagaaacccugucucgaaaaaccaaaaaaaaaagccuuuuuucccccaaaagcaaaguuuuuauuaccaugaagcugcuaucuaauucauuaaaauggccuuuuugcaucugaauguuaccauccuaauacauuuccugagucaaaucuugaacuguuagaagcaccgcuguaccaaauuaaugggauuuuucuuuucaggcugguguuuggaaugcucuauccagcguacuauuccuacaaagccgugaagacgaaaaacgucaaggaauacguaaguaaaguuuccaugauuuucauguggugugaacacaaaccuugaaagcgcugcuguuuuagaguuagauugauggguuugguugaaaggugauaguaguguuguuguggaaauaaccuuuuuuuuuaaauggcauuuuuaacugacagugaagcuucaaauggccuccauugaccacuggcaccuggagcucagaguucccaagagcagugacagagggcuccuaauggccugagucacaguggacugagguuugugugccugcuuaaggugcguuggaggaaagguuguaguuuuucagcuuugcgauuuuacggaugcgcugagaguguaucccguugccuccucuuucauggcacuuuugauugaacaugucccuaccccauucaugaugacuauugcaggcuugaagcuaacuuuucucucugucuuuuuaaagauuuauuaauuauuauauauaaguacacuguagcugucuucagacacaucaaaagagggcgucagaucucauuagggaugguugugagccaccaugugguugcugggauuugaacucaggaccucuggaagagcagccugugcucuuaaccgcuaagccaucucuccagcccccuaacuuuucucauaaugaauuuuuuuuuuaauuuuguuuuugcugugugugugugucuguguauguguguguguguacaccuuggugcacaugcauauggaggcugaacguagaugucuucucucugggaaccuguagggaacugcuacaguuaggcuaaggagccaaagagccuaggaguuucuugccaguauccccaguucagggguuacaagcaugugccacugcgcccauuuuauguuguuugggggcucugaacucaggcccuuacaccagccagcuagugcuuccuccacccuccaccgaguauaacagaguauuagcauacacuuccuugcuggcgaguccuggcguagguuucuguuuuggcagaguacauuuccagacaauaacaaauguguaccuugggcaguuaaucaaaagaaauaagcacccaguacugagauaacucacaucaauaacuguggcacuuuuaaaaaaaaaaaaucuguuugagggagccagaauauccauuucaaaaacaagcagucugauugcacuuagaacuugcacaguugcccugcagacaacagacaccauucucuuuccagcucuccuccaucuaaaaugaaacggaggcccauuaggcgucugccccucccccacccacuucucccuggagaguucccuuaaaaggaaucuuagagugaguaugaccuguugggauuggcuucuccuggcugccgagcuguguucuagguccauccguguuuuugcauguuucaguguucccuguguucaguggguccugaugguuggaacagugcuccauuguauuggugaaaccaaacaauggcuuguuuaucugcucauccgcugacagacaucugaauuguucugcuucugucuuuuggcucuuacgaauaacgcuggcacggacaugcccgugagcaucugucuaagugccuguuuugggcucucggagguguauaacuguggcucuuuguaaggacuuuggauggcagccuugccauccagcccggcgugugaucacaaagaucagaaauccaggcuugauucuugagucucucugcagguauuugagguugcauagagccaguggcugaaacuuucauaaugaaccuauucaacauuuacagccacauuucucuuucauauaaggccaguuuuuguaaugacgugcgaguacacauagacccacacaccgcaguuauaauggugggauacguuuaugagaggugaagaaguuaguugggugagcucuggaguuuuuaaauccuuuuaugauacagaucucuuggauccagggcugggaaaauagucuuaagacauggaagcauauuaagucauacuaauuuaaauucauuuuauaaguagcuugaaggggcauauuucaauaggugccguaauaaauauuucaagugccguguuauacuacuggcuuauauuaguuuuuaaaacaacacuugcuuuccguuuccaggauuucucaagcugccuguggugaaggaccuguaugguuauguuugcuuuguguuucgugguccuggggaugaaccaguuugguuuugguuccccuggaagucauuuaccauuacuguuguaaaaauacaauggaaaugagccccuaguaaaacaaagaugcaaaaccccagagacauaugaguguaacacugauuauuauucauuucuauggacaugaaauaccgcucgcucuacuguguaauucuuuacuuggaauccucuuuccaauagcaaaaauguaugaauaaccccucaucuauaaagugccaugagacuaugagccaugggguauacuacuggccagaccuuaauaaauggaagcuccuuuauaguguguacucagcgggaucuuucucugauucuagcuaacuguacgguugaagaacuggguggucuaucuuucagcuaugggcucgucucaccuaaagcauuccagggcccguuguagaagcccaggccugcaguccuagcacucuggaagaugaggcaggagaaucacugaagacuugagguuagccuggacuacagaaugaagagacucuaugugucucaaauagaaaauagauagguagacagacagauagauagaugcccugucccagguagauugacaaggagacgagcaagcagauagguagguggguagauagacacagacucaguaucgcagauggauggauggauaaguaaguagguagauagggagauagauaguauguagauagauacauagauacauauauacauagauggguagauacauacaugcauacauacauacauacuagacaggcagauagauacauagauacauacauacagauauauacaaacauaauagauacauacauacagauacauacacacauacauaauagauacauauauaauagauagauagauagauagauagauagauagauagauagauagauagauaaagacaaauagguaagcagauaggaggguagguagauagguagaccaaagagcaagcuaaauggacagcaauaagaauauaaaaguauuagggaagcauaaauaaauuaccuauacguauaaaugaauacuaaaaaaauguauauuuagagguugaucuaauuauaaaacaaugauuacuccacuuucacuaugcaucagguuuuuuguguuauccuuuucucuucuuuuccuuuccuuucuuuuagaaacaugguuucaaguagccuauacuggccucuaacucacuaaguagcgagcugaggcuggccuuaaacaccugauccuccugucucucuauuccaaguucuaagaucaaaggcauguguccccacacucagcuccacuugaaaauguaacuucaucugcuuuauucccuuaauaacacacucagauauuuauuauuggguuauuugaacauguaagacaauuagagauaacaugcuucugaaauuuuaauucucccucaugugcuaaaaauaacuuagccugcauaagagaauccauuaaauucaaaacuccuguuuugaaaauacagugagugauaaaagugaacagguacugaacugggaggccaaaccuacuccaucuugggaccggccucuaucauaaaggaaaaaaaaaaaaaaaaaacugagauuuuugaccugcaauagaacccaagcuacacccacauaccacagcucagcuaguccacugucugaguuccucccuagcuacuuccaacaacaguuaaucaaagauuaaucugauuguuucagaugcacuuucagacuguuugugauugucuuaccucagagcaccccccugucgacuuacaguagacauucaguuagguacuugccaggauagacaccccccucccuuacuuccauuuccuauaaaaccuuguccugcugaggguugaggcugcuccacuuucccuucccauccugcugugucgggguuggguuggaagagagcccaagcuuguaauaaagagacccuaauguucuuacauggaaaacggcugcuuaguggucuuuugggguucacgaaugcuuccuggcacaacaaaaccaggaaggaauagaauacaucauugaagaccuccgucacucacucgucuaacagcaagacucugagaaaccaagcuugaggugcagugugugcauccccuggaaugagggaugagugcuuaauuacuccccacaaauuucagagcacuucugcauaucaccaugucgagcugcugcucgucccagccaccacacuacucuagauggaaagccacaaaauauuuaaucccagacaucccuagaguucagaaauguagaauggguccacuuggcuguguucccucccaaggcucugguucccguggaagaucugucguucagagcuggaagcugcccacauuccuuggcuugaggcucagucccugugucuuugcagccaagagcucggggcugagaucuuuggaugccgccagcacugggcuuuuagccuucugccuccuccuuccucuuguaugguccuucaugaacgacugggcccaccccacaccccccaagguugucugauccuuggccuuaauuccaucugccgccuuauuuucucuuucucauauagccuaauauacuuaaauuuuguaggaauuaaaacagggaucuauucccaggaaaggaggcagcauucuaccaaccccaauaauauccagccagacucguguuugcuguccauucacccuggaggaccuuguaggacagcaugaguccacaccagaacuccuggguuucuaaucacucugcucuaccgugcugccguuguuguuguuguuguuguuguuguuguuguuguuguugagacagggagcucuguguagcucuggcugcccuagaacuuucugugugcaccugacuggccuugaacucauagagcuccgccugccucugugucccagguacugggaugaaagggagugcacaccaugcccagccccaacagugcuccuguuuuuaaaagcaaaggugauggaacaggagagaagucacaugagauggcacacgaccuagauucugucaguagcucacaucccugauuccauuccaggcgauucaguaacuacugcugaacuccaagagcaccaggcaggcauacaguacacaucagacaaaacauucguacacauaaaauaauggaaauaaauaucuaaauuuuuuuuaacauaggugacauucuaacuccacauaaaaauuggggcagcuuucauuaccggccagugaccauucuugggauuaauuuacacuuugggggccacagugauuuggcuauuuuuuagcaaggcauugaggcaggaccucuaagcucucagaucaacugugaacugagagguuaaaaauuuuugauaggggcuggagagauggcucacccauuaaaggcuaggcucacaaccaaaaauuuccauagggcuggcccuggcuuaaucccaaugcucaggaggcagaggcaggcagaucucugaguuggaggccagccaggucuacagagacaguucuaggacagccagggcuacacagagcaacccugagucaaaaaaaaaaaaaaaaaaaauuagaaaguauuugaaaguccuguaaaaaauuggaagagaaaaaaaaaucuuaauagcccuuauuuucucugagagcaggacauuaauacaguguucuuguguucaccuaaauuucaccaaauagagccauccuguuuaaacugguccugccauguuuggcagaucuguagacucacuuuauuuuuuuuccuguggaaguuucuuagcaguaguaaaccucuuugcaugucuguguucugaucucaauaucucuuuaugcugcccgguacuguaucccuuaaugucugucuccuaccauaggaaggguuuggcuacuuuaauuguacuauucgauaccuagaacauaguugguauaaaguaauuagucagaacuuugaauaaaugaacuuguaagacagaaaagcuggcuucucggugcuugcagaaugcuacauucugugcauugcaagagccuguauguguuccuggaggaccgaucuguuuccucagcuugaauucugccggguuagggcacguacaagcccauucucaacgcuuauccccaaacccagcgucuuugugauaguuaguccugaccuaaauucugcugauaucuacuucaaaagcacguucugaaagcaaacauuuuggacucauuuacuucuucccacccuaacuacuaccacucccccaaagccugcaaacggcagguugcaccugauaaaacagaugccgugugcaaaucaaaacaaacgggagagcucuguguguuuuggcagcguuccuuucuuccuuugccuauuuuuaaagcugagcuuuccugggauauaauuuccuguaugguguggcugauauggccuacuuagaugcucacagccuugcaguaauugaaaugcaagcuuacuggagauuuaauaggguuuuugcaaaguuuuccaggcucauacaucuuaaagauuccaaaauaugagaguguuuacuuccaagucguguguaauugcuguagcuuuucuaggaaaccgguuuucuuauucuaagaauacuggagagugcagcaaggaaagacgggcuaaacaguacuugaaaguuaaaaucagacauuugggccugagauuuacugugaacaaggaacaaaggagggacaggccuuugggagaugacuuauuaaaaggcccagcaaugacucuaguccucuguugaguuuccaacgugaccucauuuuucacugacugugggggugauaggaaugagcauagggaccagggccucgcucuagagugccugucauucagugacagcagaagcugucuguaguuugagggugggggcuaaagggagaaucauacuaaagagcuguguuacuccuucccagcacccucugccugguaaaggaagcacggauuuccacugaccuacacaaguguucuggguaccucaugacgggaauccaaacguucgucccagggaaaggauguagcgagcauauuguuagaaugucuuccugguguggacaaagcucuggauuugaacauaacacucaauauaacaacaacuauagugauacgucauuugguucaaagauuucaguauggaaaguuuauugauggggcuggagagauggcuccgugguuaagagcaguggugguucuucuaggaguccugaguucaauucccagcaacaacaugguggcucacaaccaucuguaaugggaucugaagucuucuucuggugugucugaagacagagacaguguacucauauacauaaaauaaauuaauuaaucuuuuuuuuaaaguuuacugauuaaggugagcuuuuuuuuuuaagaaaauuaguuuuuaucagccacaugcuuaucuguuuguuuacauucugauuggacacuuuuggcaaggaggggaagcgugauccccuaaaauguuguccaggcuagccucaaacucugauccuccugccuuaaucucccaaguagcagaaacaauaggcauguaccaccaggcacagccugaucuauguuuaguucuuacguuuagacaauagguuguuacaagagguucaccuugaaaagacacucaaccacugugcccuggguucucucucuuucugggacccacuuuauggaaggagaacgccagcuccccccagcucucucuaccuuccacaaggacacuagcauguacaugcacacacacacaaacacacacagaguaaauaauuucauuguuuuaauaagauuuuucagaggcaucccugugaaacauguauauucuaacaucuauacccagauuuucaaauuggcuuggugauaguguuguuggugaauuauucuauuacucugccuccaaauacuaugacauugguucccaaccucugggucaagacccuuucacaagggucacauaucagguauccugccugucagauauuuacagugugguucauaacaguagcaagauuacaguuaugaaguagcaaugaaaauaauuguaugguuguggagucaccacaacaugagggacuguauuaaagugucucagcauuaggaaggcugagaaccacucuucuguaguaucaaauaagucacauaauuagcauucacguauuaagucugauuugauagaaaaugggucuaaagcaacacaugcuacuuuuucagcucuuaaaaauuauuuuuaaauugaguauuagcugcuagaaugaauaucuuuaguuuuaagucuugguuuuggguuguuuuguuuugcuuuugauaugagucucgcuguauaggacuaaacaugggcauaaccacaagcauacgaagcuagguuuuuguuugcuugccuauuuguauuacuuuugcauggcugaggcucaaacccauggacucaaacaugcuagacaagaacucugccacugagcccacaccgcaguccauuuuuuuguuuguuuauuuggcugguugguuugguuugguugguuuauucuguuuuuccaggcaggguuucuccauguagcccuggcuguccuagaacccacucuguagaucaggcuggccucaagcucacagagaucuuccugccucuaccucccuagugcugggacuaaagggguacacuaccauugcccuacuuuaucaauuauuaagucagugucaauaaaugugggacagccuuuuauccuucagugaauuaaaucuauuugaauuaugugaaaguuauuuacaaaccugauuucgauaugucagauguacuuacgcauaggccaugucaauauauagauagguagauauguuuacauaaauauauauauacauacauauauauauauauauauauauauauauauauguauauauauguuguugacaucauugguauugucauaaucaaacgucuuaugcacaagcuuucuaaaaacaauuucacgaccgcuguggggucauugccacagcuacaaccuaagcaacuaagcgugaagcagauucuguaacuagagccggagaguuggcuuggagguuaagaacaguaacugcucucagcagaggacccaagauaguuucuccuacagauuuagaaugccaauuagugaaacucuuggccuuugugaaguaaauugagcuuucccacgcuccuggagcugcagccuugucuggcucccagugaaagugcuugggaaacagcgauggagaaguccuugcagucacaguacaccuagaggcugggccagacuuccacuccuacgggggaaggggggcaggacacuucauuaccaacuguagugucggugucaauggacuuaaaagcagagacagaaacggucggucguuuccauuaaaggaaauguuacuaagaaguuggagagaguccuagccaccuccacccuaaucccuagugauggaauaguuuaaaaucacaaaagcuccaacuaccaaaaaaaaaaaaagaaaagaaaagaaaaaaaaaccacccagcugccuccacccuuacuucagggagaaauauauucuaaggcagccaguguucagccuuccuggcccccaccagcucuguucagaacccauacccuccccaccagaagaaaacagaucagacucugagaaagaauacaagugugcagucaacugauuacaaaucugaaaugguaauaaacagcacaguuucuaauuuuugguugauagcuuugaagcacuuaaaaaaaaaagaaaaaugaaauauugacuaccaaaguuuuuauauauaaugugugugugugugugugugugugugugugugccugugccuuugaagcuaugccucguggugcacaucuguaauucccacacuccggaggccagagcaggagggucaggaauuugaagaaagccugugauaucuagugagcuugcucugcaagggaaguagaauaaauuaaacaauaaagcaaaagaauaaaauccagggaauuaguauuccuaagagcuauucacuugcacaagcguaauaaaacaacagcacuccccagauguauggugugugccuauaucucaucgauggcaggcggaggcugaagaauccugaguucgacuagacguagccccuaccucagaaugacaacaacacuugcaagaggaaauguggagagaagauuagcccaggauugacaaacaggaagagagaagaagcucgggccagaugugcuaaaugucagcgugcaggaaagcacucaacugcuuagaaauuuuauuacagaaaaguuguuucguuuugaaaucuaagaucuauggggacuggcuggagagaugacucaaguuaagagcacuugcugcucuuacagaagacccaggcuuggucuucagcacccaggugguggcucacaaccaccuguaacucccugcgugcaugcgggacacagaggacacauacacacuggaaaaauaaauauaguuguaaaaugaaaauacaucuuuuaauuuuuuuuaaugagacaguuccuaauuauaucaucugcaacugacuuuuuuucuuuucagcugaaggucacauuaauuaggcagucauuuuuuuuuucuucuacacagauaccagcaccuauuuuugaaugcuaagauacugacguucuucugugguuuuagacuccaaguccauagcuuguggcuggaggauucagauugucaggaagacugacaugacacugcagaagguucuuaaagaacgggaaagccggagcuguuccugaaaauucccgcuaagaccagucaagucuuucccaccaacauggucuagcuugggggauacaccgaaagcaucaugggaauguugggaaaggagaggaauacuguauaggaaucccaaauauacuggaguauguuuuagcuucaguuggguccuccuuuuagcaaauggaaugguuuaaguaaaacaaaaggaaucacuuuuaaagacacaaacaaacaaacaaacaaacaaaaaccacuuauccugacucugcaagugaaguacggaaggcuacccagagcccacagauagaggcgggggugagaaaucuguguuucgcagaaucauaauggcuuccagacauuccagcagguuucuuuccaaugaagaucugacuucagcagauuuuauguaucuggggaccaggggaacuccaacagccugcacuggugugaaagucagccaagggugaccuugaacuuugccuguaacuccuaaaugcagaggucguggguauuaacugaguucuguacacagccccagacuuucuccuugggaagagaccuucaucgacuguccacauccacauagcucuggucuuuuaguuggagaaacaauagaauauuuguagugagcuucaggaagagaguccugacaggguucccuucccgccauugugaaaagcugauugcuaccaagaacaccccccugaggacuggccuaaaagcuaaaggcucuuucuacugccuugaaccuuaugacaauaguagugguuguuuuuauuccuuuuugagaugagagcugacucugugaccaagcuaucuuggaacuuacgauguagugcaggcuggccucaaauucauauacuucugccacagguggcuccucccccccccccagguggcucuuaauuuuauuuuaauggugauauacauagaguguucugaaaauaagaagacauuuuacaugcuuccaauggauucucucuucuccagaccuagcucucuucuuucagugucacaguguugcccuuuguucugguugguucugugagaggaacugccugcacugaagcgcuucccggguaaugcugggcgacagaaucugaguacaucccccugggaucuuauuaaaaugcagacgcuaguguaguaguucuggccuggucuugaaauucugcccuugcagcucccaaaugaagaaagccagggcucugugcgugagcugaacccugacccuacauccaaagauuguacuuucuaguuguuucuaguuguuuuuuuuuuuuuuuuuuuuuuucgagacaggguuucucuguguagcccugacuguccugaaacucacucuauagaccaggcuggccucgaacucagggaucugccugccucugucucccgagugcaucaccacugccuggcuuaagauugguacuuuuuaaaggugugacuaucuuuucucucuuucucucucucucucucucucucuaucuaucuaucucuaucucucucucucucucucucucucucucucucucucuauuucucucuguguguuuugaauccucuggaggugugugugucagagacagagaaauugcaggcaugugggccuucgaucucucuggguugguucuuucuaccuuguuccugagguagggucuauauugguugugucacugggcuaugaacucugggcuggcuugacugugaggcucuggcucauucugccaucucugacucccagaucacaguaggagugcuggaauuacagaugcaccccacugcauccgacuuuauaccuggauucugggacugaacucuggucuucagacuugcacccucggaaccaucuuaccggccccuccagagagauucgcauccacagcuaaggggaggauauugacgauuuuuaaaauguuauauguaaauauacuuuucucucucuccccuaugcagaaucuagauguaacucugcgguguguaaguuugugaugagaaauaaauaaauagccuuuuuaagggaggaaggaaacugggagaggaagcaagaaaagguccuggaguaaacgaacaaaguaugaaagcaacaccgugagucccauuagcucaauaaaaaggagguugcuggccagacgugauggcacacaucuuuaaccccaggacucaggaggcugaggcagguggauguccgugaguucaaggccagccuagccuaccaagcaaguuccaggauagucaggacuacauagagaccacauggggagguggggggggggguggaguggggggagugagggugaaauaaagagaagaaaguguuccuugggcagacuuccaccaccuacaguguaccaaaucgugcuucuuaaaguuacaauuaauucagccgggcgugguggcgcaggccuuuaaucccaacaauggagaggcagaggcaggcggauuucugaguucaaggccagccuggucuacagaguaaguuccaggacaggccagggcuacacagagaaaccuugucucgaaaaaaaacaaaacaaacaaaacaacaacaacaaaaguuacaauaaguucuuauauacaguuggguacugacaaguuauuuguuuuaggaacauaugaaucgauuaacaacguggacuacaaggaacagguuuuaacacaguuaaccacacaauacaaguugagucagacuuccucuugguuuccauguuuugaggcuggccuggugucugugggugaggcuuccccuuugguagccacccuucgugcugugggcuuuccucuagagccgugguucucaaccuguggguugcgaccccuuuggcaaaccucuuucuccaaaaauauuuacguuacgauucauaacuguggcaaagugacaggaaggugcaacaaaaauaauauuaugaugggggggggggguuugucaccacaacaugaguaacuguguuaaagcguuguagcauuaggaagguugagaaccacuguccuuagaaucuuggcccagacuccagguagacucaguguggcccuucguucccucucucugacugagaugccuguggaaugguaccgccccuuggggugacucagaugagaaaaguagugaucugagauguugaaaugcaaaggaagagagaaacgcggguacagccuacagauguaccagguucaucuccaagauggccaaaugacccacucuagugucagggauuggcugcucccccacccccacccccacccccacccccacccccuuuaaagccugagaaguucuguacgguguuaaacaaggcagugucucuuauaacucuguauuaucccaaauaaaucaagaggacuuuaaacaaagggggugggggugaagcaugaauucucagccgacggggauggaaaagucuuggggcagagaagucguucguucuucccuucccuugugcuccugggagugguuuccuggaugcuggcccuaaguuuugcaucuuguuuucaacacuuuuuaaauuaauugucguuuugaaagguuucugcacuuuuccuucucccagguuucucggacaccgaggagaucagggaugagacacacagggcuacgucuguuuccauaccagacacacaugccuuaagcacagcucuguccuucagagccacugggucuucuguagggccuggggcggcuagaacuggaaacugcagguuacucaugcugcuguggguucacugugggacuguggaacucccacccaggagucaugguaaaugcgacagcaauuaaaacacccacgugagacacagugggcagagauccaccuccaaacagaggaagcccagcgcuagaccauuguaaaccaacauuccgucuacguucaucaaugauggccagggcuggaaagauggcucugcagguaaauaaaugcccuugcaggugaccuaaguucaaucccaggagcccgugucaagggacgaggacagagcagacagacuccacguguucacacgcaggcucugcccauguuaaaucugucuugaaagcuagcuuauuuucuaccgugccucuaacuuggcacagcucugagaaacaucccauggcacagccaucuggguugaauaaaagagggaggguuuuuuuguuguugguuuuuugguuuuuuuuuccaauuugauuucucacauuuuguuccucuuuguuuuaaagggggagaaaauuguugugaaauaaccaaauuauugcauaauuguucacgaaacagaagagaucuuuuucagcucucugccauuucuaaggaacccucaucugagaauuucuccauauccccucccccccgccacccccucacccccccccaguacucaguguccacaagcgcucugggagaacugacucaaccaagaagcuaauaauggccagaaaauaaaguucucuuuggguggucugaaaucuagcaguguuuauuucuuuucagauucagcaaaguuuggggguuuuauuuguuguuuuguuuuguuuuuagcccuucuuuuuuccccauuggagcauauuuuagcauuuaugaucugaguuuuacuucaucuaauugaaaucauuaggcacaaaugagggagguugguuggggggggguugguuuuuuuuuguuuuuuuuuuaagaccagcauuaguagcuuuauaagucagugaaucuguaguuccaaaaaaggugcagaauuucuugguuuuguuuuguuuuuuucgagacaggguuucucuguguguagcccuugcuguccuggaacucacucuguagaccaggcuggccucgaacucagaaauccgccugccucucagaauuucuuuaugucuugauaauguggaauauaauugacaaaauaauucuuuuuuuccguaugcuauagacugccacuugcaacucauaguuaauuauuuaaguauuaucaguuaagaccugacuuucuuuuucauuuugguuauuauuguugugugugcacgcuugauguguauauguguggacacauacugccuuagucagcgugugguagucauaggacaacuucauagaguccgucuccucucuguccaccaucauguggcuuccaaggauggaccucgggucauugggcuuucccuacaaggcaggggcuuuacugacuagacacuucccuucucaccggauggauaccagaccuuacauuuuaagauagaacccaggcuggcaacucccauaaucccagugcucagaaaggcugccacuacuccuaggcuacaaccguaguugagguccaugccagccuggccuauagaucuucccccagaaagcagaaauuguugaguaggaucguucuguguccgcuucacuaggcauggguccugggaacaugguggacaggacaggcuucaucucuuccuccuguuucagugaaauggcugaggcagguguuauauaagccaacuacagugcacagauuuauguaugaccuuuucgggggugggggacgggagggaggagccaauaacuaggagagccuuucccuugucauucagacaaaacagugaauaacacauagucuaugaggauuuuaguaguuauauguggauuaaacucucuauucuaauuauaugucuucuucuauucauacccuaccaugagagcucccuuggagccggagaaccuugugauaacagcuugugauucucucaugucaaacucugugcacaauagaccugggguaauauuugucaaaucaacuuaucagcuccauuuuuucuaaucacacacuguaaguuuguacaguuguaucacugaacacauuaucaucguugcuauuaugauaccacucuaguaccgacauaacaagaacaaguuauauaaaggaacaauauaagaaaaaaaaaacauuucuuaguuaacacauucccauuauccauggcucuuaaaacacauagcauaugaggugaucucucccugacccucaccacaccccaccuacaccccuacccugcccccacccucaccucaggcucacccucaaccgccaccuacacuucuacccucuacuccaccucuaccuccauguuuuccggcuguguccugauauuccugcuuccaguuucugcaaugggacuggggagggaggcuucacaguacgggggcuuccagugcucuguuuguuuauccugggaucuucauaaaaaugcuuuuuugguuuguuuugcuuuuuccugaggauguagagcauaaaacuucuuuuguugaaaaaauguuaaaagacccaugaaauggacccacuucucuuucagggucaggaucauguaaaugaguucucauuaaauggagcauggucuccugauaguacguuuugccucugggcguguucauuuuacuguauugcucgggcuuuaaauguccucuaauuccuccgggagagggaagcuaagcacuccaucacaugacugucuggauuuuugaaaugcugaggcuuaucaaaaccuuauggauuuguagcaauaauaaagggagugcuggcucgccgucagggaacgucugcccguguaccgugucaccggaaugucacuuuaggugcugugguuucauaucacagaugacucucuaaucuuucaaagaacuugccuaauuagggggcuuauugccuuggcaagugaauuucuuuugacaucugaaugaugcugagguuguguucaggcugaggauguagcucagagguacauccagaggaggacagagcaaaagagagcgagagaccaaaaugucuagauuaaauggaggagaaagagccucugggggaagggcagccaagccccugggcuggaaaauuuaggggcgggauaugccagguagggacugagggaugcugggagaaccuggaggccugguuugauuugguuauguaaaauauacaccucagucccuugucccaggguccaaaaccaaucacuuuuuaaaaagauuuuugagauagggucucucucucucucucucucucucucuccuucucucucucucugugucugugugucugugccugugucugugucugugucugucucauucuuucugaacccauagcuaaccaauucagccaggcuggcuggcuaguccaaagaacugauuguuucugcuccccccccacacucucuagaauugcagacccacaucugcacaccuagcuuuucuguuuguuuguuuguuuguuuguuuuuaugcguaucaguauuuugccugaacguauguuugugcaucacauucgugcaggccagaagauaguguuggaccugcuaggacuagacucauaaacaguugcaagcuaccaugugagugcugggaauugaaccccaguccucuuaacugcuggaucaucucuccagcccccaaccuggccucuuaugugggugcuggugauccaaacccaaguccucauucuuauguguugagagcacuuuaccaacagagccaucucccacagccucuugaucaaaccuuuaagcaucugauuuugucacaggaguguaggugcccucccccaggaaagcaaagcaagcagaguggggcauagaucagcaccuugacuguguuaacuugaccuuuaaccuuugggcgucucgccagccuuucagaauagauuuacuugcagcuuuuugcaaggcuugacgauuuaucugauuuuuuucccucuuagugaagaugaugagggaggggagagagauugcuuaaccucacauacacuggcaacgcaugaggagaguuaacacguucagucagaagccacuccuccuggggggucacaaucauaauguggaaugguuuuccucuuguucugucucagugugcugugugaaaaugucaugguuccuacccucccguugcuucccagauacuuagagucccugaggagaucucagccggaggcccugaagacaguucuccgugucuccaucacugccagucauuagcugugcaccagcuagcccauaauaggcccugguggguacauagcuaaaucuagaaccauugcuaugauggccccagucucaguucccgaagauuagaguggggccucacuuaugggcuaagauguuuugauugcgacuacagcaaagaacguggugacagggggacauggggauuuauucuguucagugccagagaggaaucuaacccccaaggcucuugagcugugcuccccuucaacacacaguuuccgagacuacugugcucccugcuagccagcagcaagaggaaaagccuagagguacacaccaaccauuccaggucauacugugugcgugagaaugaaacauucagccccacgugccugcaaggggagcugagaaguggggugcucaggcuuccugugccucuccuccguugcccuagaccccucaccgcacccguguucuaacaccaagcagccgaaggcgucauuggucagucagcaccuuuccuuaccuauaaaagcaacuuuuugagagcagcugguggcaaacaccuuuaaucccagcacucaggaggcggaggcagaggcagaggcagguggaucucugagcucaaggccagccagggcuucacagagaaacccugucucaaaaacaacagaagaaaaccuuuucuagaucuuucuuguucuucccaaagucacgcaugaccgaucuuaacacgugaccgcccuccugccccagagcagagacagaaguguccacccccuuucagcccucuuuccuguuuccucacaucaaggccgcuuccucacaugagcaaguuuuuuccuuccucuucccuuuguccuggaagaggaugugugcuugcuucuuccuuggaggcuuucuuccucucaccuagauuccuuagaauguucuuauccaucaucugauacgauauucucauaauuucaggagcaaugucaucucgugagaauauuaaaaaccugugggccagagcugccugcugugcuucucauguuuacugaagcuucauuuauuuguuuguguggauacgccugugcuuguuccugugugugccgcagagcacacacggaggucagaggacagcuugcaggaagaaguguugucucuccuaccccugugggugcuggagcuggaagucaagaggucgucaggcuuggugacaagcuccuuuaucuccagagccagaucuggccaguccauccuugugucuuuuucaaugcacugaauauaguuguaucaguucaugucauugcuaaugauggcagcucuguccuuaagaaguaacugaaucagccgggcgugguggcacacgccuuuagucccagcacucgggaggcagaggcagguggauuucugaguucgaggccagccuggucuacagagugaguuccaggacagccagggcuacacagagaagcccugucucagaaaaaccaaaaaaaaaaaaaaaaaaagauuuaacuguaucauguuuuauaugaaagaugagucaaagugugugugugugugugugugugugugugugugugguggucaacuuagugcuaaggugugcauauugccuuguuggagacguauuucuuaggaagaagcacuuaaugucuuuuguggccauuaagugagcuaccuugaaaugauuauggggcugggcgcagugacacaccccuauaaugccagcacuugcaggggcaucaacaguucaggaucccgcagagaacaggaaggagaaggaaggaguugcauccuuuuagacauuaugaguagucuggagaugacuucacgucaacaagaggaugcgucaugguuaucugcaaacacuaagccucuuuauaggugagacuucagcgacagugacagcacacuggaucugcagggguugagaaacauucccuacagacacagaagggccuguugacaugccgaggacagucaaagcgaugguuuucacagaacuuacuaauauaaacacuaaugcugugcuuuguuaucagugugaaaacuaucuuaggucuuuaucgucacguguccuuagguacaguuuuaggagcuguccuacccccaccccccuuuuuuuuuagccuugacuuuuggcauuuccucugggaaaaaccuuaaacagaggcuggguggccuugaggugcaguuuucauaaggcuuugcugaauaauuguuccauguaaaaucccagcuagaucagacaacacauugccaagguugacuuucucugugguuacucccccaaacaccacaggcucacugagugacauuuaaucauugcccacgcuuagugacaugcaagguccguauuucugauaagaauucaaucccuuuacauucuagggagcagacagucaaggaauuaauuuacaaaagacaaauucaagccaggcguggugaugcacgccuuuagucccagaacuugggaggcagaggcaggcggauuucugaguucgaggccagccuggucuacaaagugaguuccaggacagccagagcuauacagagaaacucugucucgaaaaaccaaaaaaaaaaaaaaaaaaagacaaauucauaccauagguuuuguuuauaucaaauuauacccagugccagacaugccuguaaucucagaaagcugaggcaggaggauugucacacgcaugaagccaacuuuggcuacaaagcaagaucugucuaggaaaaaaaauuauaaaauacgggcuagagagauggcucagugguuaagagcucuucugaagguucugaguucaaaucccaacaaccauccguaaugaagucugaugcccucuucuggggugucugaagacaacuacaguguacuuauauauauaaauaaauaaaucuuuaauaauaauauacagugaguaccacagggaaaauguguacaauagacuguugauauaguuuggugaugguuuaguuuaccuacaaaaagaauaccuucuuuucuuccucuuggaaaagaagagagacaacagagcuggagaacugacccagcaaauaagagcacuuguugcucuuggacaggauucaguuccugccacccauauggcgagucacaaccgccugcaccuccgguuccagggggacugucgaggugucugcaaagcugaggaguaucagggcuuagacauccuaggcaaguccucuaccacucacuaaagccccagccucgaguuacguguuguugacguugucugugagauagugagacaaacaucuaugucagaacugaguaguuaauaagggcauaucagaucagggccccaugcccauggcacauaugaaaaugccacaaacccacacagguuaggugugugcuaacuuuaaguaagaauauuuuuacuuagcugcuucucaaggcauuuggcauggaccagacugaaggaaacaauggguuugacugggcuccuccgguucucccucuguauaagguacagcucucuaguccaucccagagucagccagcuuggacccacucccuggcaaagagaaagcccuuuuaccucucugcuacuuacccagggcagaagcaauugcauuccguaauauaggugucaaaggcauuauugcuauuuuaucuguauagcagucccaaguccagcggcugcugugggguuguguguuugcucauauuguugaacagggaaccaaguaaccaaccaaacaaacaaauaaaaaaaccugaaccuacuugaaaauguaucugcuaguauugaaaaauagguauucaucuaagugauugaguuuaagaauaacuaaugugacaucugccuaugaaaguguguagugccaagccacagcugagggcgagggacuagcuagggugcccucagucagcaggcaggaaaucaaaucuuccaaacugcugcuguaucuuggauucucacacugcaugacugauuuuauggauuucccaguaauggaaguaaccaucuuugaucuuugauccgugaaaaauuucugucuguagaaaaauaaagaauauaaauauuuauuuauuuauuuacuuacuuacuuacuuacuuacuuauuugaggcaaggucucacuguggcgcucgcuauguaaaccagguuguccucaaacccagauccaccugccuccaccucccagguacgaggauuaaagauguacaucaucacaccuaaaauaaugcaaauauuuaaagaccaaugagcauuacaugucaucgugucuuggaccauuuuauauauguacgcauuaaauaguucucuggcuucuuaguuacguuguaucaggccucagagauuugcucuugacucuguauauuuggugucaucaggccacaaacucaugcauaaaacccguuaaaaacugaaccaccguccucuguacuaggccccaauauaaauccagagauguguguauuuauauaaaacgauucagagcaaauaauuucuuucauccaggcuacuauccaauucacuguguagcacaggcuagccuuacacucagagggaauccuccugccugagcaucccaaaugcuggcguucgggugggagggccugcagucauccuggccaauucuuucaugggugccuuucugacuuccagguucgcuggaugauguauuggaucgucuuugcccucuacacugucauugaaacgguggccgaucagacacuugcaugguaaguucagcuccaagggacacgggugcuuucaggugucccaaguucuuaucccauccuugucccacccccaagccccugugaaaaauagaucaagcaacuuaauuucccagcaucuuuucuuccucgguuuuccccgugacaacagcgcuuucuguggaguucauccucucgaaggcagcucacugugcuaaucccugcccaccucccacucccaccagagucuuaaaauagagaaccuggcugucgucauccgcuuuccacacucaugaguucagacuguuuuucucgagggcuuccgaaaugacucuucuuccaauccgcagcaucuggucguagcccucccucccggcccagcccuagagcucugaggcacgaacauugagacgucaugucagcagccacggggacucccacccacucggcagcagcgcccuggcggcucuacccaagcaacaggaggcauaauuacaacauguuccuucccucauugaguucacaguuuauacaggacccagacuuaaggacucgagucuccucacgugcuguuuccgaguaccuuuguguucagccaugccaguggagaagucucuguagcuggcuuugacuacuuuguggguucuucuuucuuccacccuucuccacccuuucagcccccuacccuaacacuagauaggagagaaaggggguagaggggaaagggggccauguuagacuacucccugaugaugagaaguguugacuuccuuggggcaaguuugaucuuugucaucccaauaucuaauuucuucuuucuucuucuuucacacgacuacuuaacaaacugagaccaacagcaaccaaccgacaacccccacucacuccucucugggcccuagcauuuauauacccucugaaaaguccccagaauuccaaacgucgcacaaucccagaaacuaucugcagcuggcaaaaccugccccugcuagaguucugggcaagucauaguccgcugcuguagacagucugaaguaaccccagaucucacaccugggauuaaaauaaacauauuuucuuauaaguucucacuacaagucuucuuauuaaaaacaaaacuuugccuguguuuccacuuaccaugcaucguagacuggaacugaaauuaaccaagcuaucuuuucuuuaccugggcuacuaaugcaaauggaugcagagagagaaagagagagagagauacagagauagauacagagauugauacauggcuugauagaugauacauagauagaugauagauagacugauugauagagauagaugauacauagaugauagauggauggauggauagauagauagauagauagauaaucagacugcaguaccuaugagugaccacuugaacucuguggucccuuucuauuccuuccuguaucugcuucacaucauuucuggucucauucucuuagaacauuccaucauguugucacauagaggaaaaauauacaccaucagacuucaauagucuuuuuuuuuuuuuuuuuuuuccugagacaaagucuccuggaauugcugggggcagccucgaaaucacagagcucugccugcaucugacuccugagugcugagauuaaaugcagggcuugucacaccuggccagacuuaaacguucuuaaccuguccucauuuaugaguuagugcuuggcaaucucuucgucucuccuuccguaaccccccucccgcuucccccucucucucucucucccugccucccucccagcuuuccucgucugucucccucucuuccuugacccuaucuucuuccucucccugccuccuccucucucuccucacccaggacucccuacaugcuuaguauauacucagagccagacuucacccuccuccauuuuucuuuucucauuugaaauguucuccuuaacgcugaagaaaugguuccauucacugugauuugaauucuaggggaccgaccuacaggcaggcacgagugucacaugugugcgugugugcacacacacacacaacauacacguuucccucccuccaucccuauuccuuucuuuguugauuuuggaguagauggagggggauuuucucuugguuuugaaggacagacgaaagauucucaaccauuucagggauuaaagcccacccucccucccucccucccuuccuuccuuccuuccccucuuuauuuauucaucuauuuugagacaugauuucauauggccaagucugaccuugaacuccugaucuugcugccccuaccuucuaagugcuaagauuacagacaugugccacuaugcguguuaguuuguuagcacauugcuagguaucagauuuucaaaugucaguaggcaaacccuuuaccaacugagcuguauccccacccagcccagacaguccuuuuuuuuuuuaagacuucuuuuuuuuuuuuucuaauuucaaauauagcuuauguucauuauuggaaaauauagaaaguguuggauguuaaaagcuggucugggcagacaguuuauucuggccagaugccuuccaagcaugucuuacaaccagaguuccaucuggauggagagggccgacuccugaaaguuguccucugaucuccgcacaugugccaugggggcucacacccugccauaugucguacacaccugcaugcucacacgcagugguuggggcuuauucuguguuuuucaauagugagaguccaugcccuccauuaaggugcacugaggcagagaaucuuugcugacugugcgcuuauugcuccucacugauccuggccgucugccuuaccacaagaacucagacuuggggcucuuuguauccuggugccccgugguucucucacccugugugacuuagcucucaguguggcagcaggcagcccugugaagcacaguagguuagaacagcagacgccgaugucuuccuaagcguccccaaggcagguauuugauugcagcaguguuggccucggcuccauuaagcuucagaaccaaggcagaagaaaggauuuccaugguagaagcuuaaagcaagagguuggggggaucggaagaaucagagagcaguuaagacuuacguugucucugccacauucacuaguguuagccagucaguuugcaugauucaggguuggggaaguaacuccacacacagacaggaaaggcacuuaauuggcugccagucucccuuagugguacuucccacacuguccuucugcagcugaaacuuggagagaaaauuaucagggaguucugagaaagcugagggacagauggaguuguccccuggggucggugggucugucacguacuucuguggcuguccagagcugcagugucuagauagcaguuuguccuuucugagccaccggagucaguauaggugcugucccacuggaaacagacacuuugccauuuccuuguuacuuguuauuuugucucuuagcaagccuugcuucuugguuugguuucuucuugcuagguuuccccuguacuaugagcugaagauugccuucgucauuuggcugcugucgcccuacacuagaggggcgaguuuaaucuauagaaaguuccuucauccccugcugucaucaaaggaaaggguaagugagauguacggguuacuuccccacugucuuuaaguagugugugucagcaugcguaacauccagaggcuucuuaacguuauucuaaauaaaacuaacagggggaaguggugcacaccuccggaggcagaggcagguagaucucugaguuggaggauagccuggucuacauauccaauaccaagcuagccaggacuacauaguaagacccugucucauaaaaccugaauaaacuaacaucuauugguguguuguuguuauucuuagccaguuuuuguuuuuaagacaagaucuugccggggccuagcaaacacagaaguggaugcucacagucagcuauuggauggaucacagggcccccaauggaggagcuagagaaaguacccaaggagcuaaagggaucugcaacccuauagguggaacaacaauaugaacuaaccaguaccccggagcucuugacucuagcugcauauguaucaaaagauggccuagucggccaucacuggaaagagaggcccaauggacuugcaaacuuuauaugccccaguacaggggaaugccagggccaaaaagugggaguggguggguaggggaguggagggaggguaugggggacuuuugggauagcauuggaaauguaaaugaggaaaauaccuaauaaaauuaaaaaaaaaaaaaaaagacaagaucuugcagggcauugauggcauaagccuuuaaucccaacacuugggaggcagaggcaggcagauuucugaguucgaggucagccuggucuacagagugaguuccaggacagcccagggcuacacggagaaacccugucuuaaaaaaaaaaaaaaaaaaaaaaaaaaaaaaaagacaagaucucacuguauaguccuggcuagucuagaacauccuauguagaucaggcuggccuccaauuuacacaaagaucacaaagaucugaccauccacagugcugggcuuauggcuugcacuaccacacccagcuuaauuuauuuauuuuuccccccucagggccuccuguagcccaagcuggcuuugaacuuacuaaguagcuaaagauaaccuugaacuucugcucuaacugaccauaccucccuauagggaucucaggggugugcuaccacaccuaguuuuacuguuaauuuuucugcccccaggaaauugaugauuauauuguccaagccaaagaaagaggcuaugagacaauggugaauuuuggacggcaagguuugaauuuagcagcugcagccgccgucacugcagcagugaagguaaguuugccuuugucuguuuagccagggucuccuugucagcagaugcagagaggcagcuaguuuuauuuuagaucauuauaaagcuaugacagaauuucguuucauauuuauucuaacaaugaaauaaacaaguaggugauuuuaaugauauuuuaacacuucauuuucuguccuacuugggaauccaaaccucuuagugauuaugacauuagaaguagcuaauaaaacauaccugcaggcuggguguguuggcgcaugccuuuaaucccagcacuugggaggcagaggcaggcggauuucugaguucgaggccagccuggucuacaaagugaguuccaggacagccagagcuauacuuuuaaccuugcauaguuuugaugagucaccuuaaguaucucuguaucuuugauguuucucucucucucucucccucucuuccucccucucucucucucccucucucucuugcacugccuugcuaggauuucuugcuugcuuuuacaccucuacuuccaccaauuugagguaacuguugauucagaagaaagcaugugaaaaguguguucucagaacuggguguuuacucagcaagccucuaacgccauagcucuucuuucgagccgaguaaccgauggagugccuucucuggaaacucacauucuggcuuucagauuccuuugcauggaguaauugguguggcucauuuucaguagcacagcauaacugauuuuagugugugguguguggggaaaaagaaaaaagagcggacuucacagugcuggcugugaccuuugauguuaccaugagcaauuugcuaauuuaugugugccuggggagcuuugugucuaaaaggagggugugagggugaugugucugugagguaccugauggcgcagcacuugcucauagugggaacccgggaaucuuaacaucaugcaaaugguuuacuaauaugaaauaagauggggguacuaguguucugcuuuccgucaagcccuuucauuguuucuuguuguuuuaagauuuauuuuuaccgugugugugugugugugugugugugugugugucugugugugugugucugugugugugucuggugugucugugugucuguguuuguguguguaugcaugugaguacagguuccccuuggagacuagaagcuugucucuguuuguguguaucuguguuuguguggguaugcauugugagcacaggugcccaagaagacuagaaucuugugugugucugucugugcgugugucucugugacugugagucugcgugucucuguguguuugcauggguaugcacgugagcguggguaugccaauggagaccagaaguguaggauucccuggagcuagaguuacagacagcugugagccuccuaauguggaugcugggaacugaaacugggucgucuacaagagcagcagcaagugcucuuaacugcugagccaucucuacagagcaggucagacuguuuuuaacucaccuaugcaauggaaagauauaguucagcuaagcagcgaugaaauugcagcagcaaaagagugauguuaccugagggcgcuuuccgugcacagagagaccuuuggcucaccugucagaguuaauaucaucaaaaagcgagaaauccacaugcuguucuuagcagcaucgcagugagggcuaaguggagauucaauauguagauaacuauauugauaaugguuauugauuauagucuuauguugcaaugcuuacuauuguauaguuuuccucuuacuggguuuguggggguuucuuucuuuaaaauagauggauaaacacuaacacagcaacauuuugagcuuauugaagcuuuuuggguuuuguuucuugcuuaaugaaaauacauugcugaucacacguccaccaaaaagaccacccaggaaauaaaucaucuuucacagucagacccugugaaaggagaggaccuacgugaucaucaaagaaaaauaaguccuacaguauguucagggcagugagccuccaggucaaggggcccguaucucacccagcaccauggggaaagaaugaccaucucugagcagcgccacccccaucccaaccacugccuccaaacaccaacaaggaagcuagaauucuuccacgucagacacuaaaagcacaaucauguucaaaugacuuagcaucagaacagcaguaaguuucuaauuagugacaguggaaucacgaagccggugugccgucacccaugaugacaucacccaagaugccaucgugugggucgggcucaaguucuaugauaggcaagccugucaaucaggugugaacuuaaaauaaucaaagaguaaaaaaaauuuuuuuugguuguuuuugcuuuuguuuuucgagacaggguuucucuguguagcccuggcugaccuggaacucacuuagaccagguuggccucgaacucagaaauccgcuugccucugcuucccaagugcugggauuaaaggcaugcgccaccucugcccggcucaaauuuuuuuuuauauauuauacaagaaaacucauaacauguagugacugcacauacuuugucgggguggauauguucugucaacguuuaaaagaggggaaaagagaaaagaaggaaaacuguaaaccgguggcaucuggaaaauagguuacccagcacagaggggaggugaugaacccccaggacacugcagcaaguccaaguguagacagucggaaauggguucuguggguccaaagugccgaaagagaugcuucuggaagaagcacagaauggaaagaguaagccugaugcugugcauggacgauacuuauccuagccguguguggcgugacccacaaagaacucacggaguacagacggugcaugccugugcagccgugcgucccccuagcaccaugagcauguauuggugacuaugcacauaguagggcaacuaagcaaauggaaaccaaaaaggcaauuauuaacacuguggggacaaagcagcauaaauuauauuagaagcaaaguccagugauggaaccuaggaagcaguaggaagaacacaggugaaggauuuaacuaacaacugugaucuugcugugcugagaaacagggagguagaagggagcccuugaacgcuuguaacaucagucagcagguuuagaguagugaguuccucuacaggggugugaugacaaauggcuugccgcuuccccuuuaagcuuagcauggcucgaccuugcaggcccucgugauuauauuuauuuacaccucaaggacaucucugaacgagucuuauuugaaagcuucaacacgauccugugugggaaacugcaaacucaauuucaacuucaaaugugcuuugagaacacauacgaggcccuuguuuuagaaaauacagaaagaaaucccagcgguucucagccugacacuuagaaaucccuucuaguguguuugccuccuuguaaguaggugcaccgucuaugugccugguacccacagaggacagaggcaguuguuggggccccuggaacuagaguuaaagauuguugugaacugcuaucugggugcugggaaccgaaaccaugucuucaauaggaacagcaaggguucuuaaccacugagccaucccuccagguccugagacauaauaaauaguguaacuguuuaguagggcauucacccaaucuugaguguauuuacuaauccugucauugcuucgagggacgucagcaaccucgugguguuauuuuaaucuuauccccuccuuucaucucauagcuugcuuucaccgguuuuuaccaucccccggcccauauguugcacacuuaacaucucucuguuuaaugcccagucuaagaaggagcugaugcagcagcagggcagacggcuugacccuguggccucaccggccccuuacuuccugacuguagccagugucuggauugccaacugaauauguaaccugucucuugucuguuaagacccucuauuauuaaguaauaauaucucacaaagagacuuuucuauaaaaaugucccaaaagauaguccugcaucugcuugcuccuuuguuuuuucuuuuucuuuuuguuuguuuguuuacuuguuuuaagauuuacuuacuuauuuauuuauuauguguacacuguagcugucuucagacacaccagaagagggcaucagaucccauuacagaugguugcgagccaccaugugguugcugggaauugaacucaggaccaucugggaaaaugcagucagugcuccuaaccgcugagccaucucuccagccccuacuuccuccauugugauucauggauuucacuucuguaguuaaugacucaaaaucaucucuccaccucccaggcaggaaacagagacuccaaaaccaucaaaguuagugcuaugaaacaagcccaccacugcacuucacgucccuauugcuggugaugaucugggucuuuaagaaaaaacaaaguaccugugggugaggugaugucaugaucucaugaugacuccaggaguuccggacacucgauuaauuguugguucuguugugucuauuaaaaauaguaacaguguugaguacuacgucauguuggcucuguuggccucagguuauacugugcuuauuuuaaagugacugaaauuaguuucaucuguggagacuuuauauauauaacaaaagucuuauuaccaaagaacuuacugaggcagacauuucaaauucaaguaaauuggaaccaaacuaagaaauaggucaggauugaggagaaaccgggagaagaacgauggcaaaauuugugcauuaauauuuuaauaacacauaguuuauuagaaauaucuuuuagggguaaaaacucuugugcucuucgcaugacauuuagagaacaguaauuuccucccuaggguccccagguugaaucaccugagcaugccaagaaugaaaccaggaaucuaaucagaacacuuauuacaccguaaagcaguuuucuggaaacauugcucagucccguggccucauuaccaggcaucuguucacaaggucggugcacaaguuuauuuuggcugagcgaagcacaaauacaugaaggaccuucaaggauucugcugagcaugcucaacaucccugccuacacgugggagacgcagggggcauugauguagcugaccgccguccacccgugcaaucaagggcaggugaagagcagaaguguuggccccuuuggccagcucaggauucgcucuucucgguacaccucucuaagagaccaaccccgguuuuuauguauguaaauuagagcucugcaguaaaauugcugaagucuaauuggcuuuuuaaaccacugccaguggcgucaaaucccugaccucuugcuaucuguuuuaaugacuuucuguuugugaaaggauuuugagauuuuucagccaucaagccucacccucuuuucugcaggggguugggggguguggcaggauucagccucuuuuccuaccguccacagaacaguuugguguaacagauaccgcauucuagaacacucaguuuuguucuugauuuuuuuuuuucuuuuaaguuuggauucugccacuuaacagccaugaguguaugcaauuguauacaaaucaucuauacugauaaggauuaaauauucuucuuaucuauaaaaggguugacaucuuuuauuuauuuuauuuuauuuauuuauuuauuuuuggcuuuuugguuuuucaagacaggguuuuucuguguagcccuggcucuccuagaacucacucuguagaccaggcuggccucgaacucagaaauccgccugccucugccucccaagugcugggauuaaaggugugugccaccacugcccggccuggguugacaucuuaucucuaaaacagcuacauguccagaaugguagcucucaacuggacauaguuuguggccccaccaacuccaccacgggacauucuccuccaucacaaaugacaaggauguauuccugguaccuccauggcagaggccagggaugcagcuugcuguccuaugaggcagaaacacugcagagacuuuccagcucaaacgggcugacagacccugcuucagaggggugaugaugauuccagaaaaagaauuaauuaaaaagcauacacauguauauaagaauuuugucgcccggcaugguggcgcacuccuuuaaucccagcacucaggaggcaaaggcagguggauuucugagcucgaggccagccuggucuacaaagugagguccaggacagccagggcuauacagagaaacccugucucgaaaaaccaaaaaaaaaaaaaaaaagaauuuugucuuuauagagugacuauuugucaauaaauauauaucacccucuucuucagaacacuaagauauaucauucaccaaaugugaauacacuugggcucaucccuggauuucaucaguuuaauuauugauugacuagaggggagauuuccccaauacugagaacuaaacucugcagcuauugaauguaacacauaucacagauaaugagaaauugagcugaauaccugucauaacgaauggggaggcauagacaguagaauagaaucuaacgcacuguguggcuaaccuagaacucaggacccuccugccucggcuuccugagugcugggauuacaggcgugagcuagauggguaucuauaccuauaguuuugacaugaauaagaacuaaaguauuuuagcucuuauugcuagugugugcaguuacuguguggacagugacaccuucaccccgauugacuggcaagcuguguccaugcuuacccgccccacuucagaguaaccucgacuuccuuauccuuuuguuuaacaguucacaagccacauagaagaaaaggguacaguauuuaaguaaagcagacauaucagauaaaugauuaugaugucuuaauuugcccucaaaacagagacacugagccagagagauggcucagcaguuaagaguguagacugcuagccggggugguggugcaugccuuuaaucccaacacucaggaggcagaggcaggcagauuucugaguucgaggccagccuggucuacaaagugaguuccaggacagccagggcuacacagagaaacccugucucgaaaaaaaaaaaaaacaacaacaacaaaaaaaaaaccaaaacaaaaccaaaccgagugcagacugcucacuccugcaaaggaccaagaguucaguuacuagcaccacacugggcagcucacaaccuucagucucuaccuuccagaagcgccaacacacacaugcacaauaccaacccaaccccaccccauccccaggccaaccccaccccacccccaggcaccugcacacuuuaaaagguaauuguaaaucuuuuuaagagauaucuuucuuucuuucuuucuuucuuucuuucuuucuuucucuuuucuucuucuuuuaucuuuauguuauuuuaugagacaacgucggacuggccuacuuguaucaccccagugcugggcuuaagagccccaccccaccccccacucguggugccuagcuuucuuuuuaugauaggagugagccauuagauacacaaaccauagugacaaauggaucagaaauuguuauuguguaacccguuauuauaaucaaaacuucauuaagccagggugagaaggacauguaccgacaaagguguauggaaaugcuguguaacaaaaccccauuacuuggugugcuaauuuuaaaacuaauuuuuuaaaauguuuuuuaaaccuuuauuaaauaagccuacuaauucauaauauuaaagaaauaguuuaaaggaaagaaauucagucacgugucccaucugcauaaacauuaugcugucuucauuuuugcauauuuccccacguacugcaggcuugcguugcgacuacuuuaugggugugauugggauucuggggcagggaagguauagccacuacauaucggguggcaagcaugacuccugcacugguggaccuuugugcugucgcuaugacacuggagggaacaggcuggccuuuggcugugauuauuauguagugacgccucuccucugaaacagcaacauugaauaauuacgaugcauugaaugcuucucaacuucacagugcuacuuuuuucuuuucccucuguucucauuuaccugugguucagucuauacagugggaacuccaacuuccccauguaauaaaaacuguuggaccuucugauggccuaaaaccaaccaacgauuuauaccuccuuuuuuuucuuuucuuuuuccccaccauccucuuuuuccccaaagacuagucccaggcuggccucggaauuacuucguagcugaggacggcuguaaaacuccugccucgcauccuaauugcugggacugcagacacacaccaccaggcccuguuuauucaguguugggaacggagcccagggcuuucugccugcucaugcugagccagcacucugaccaauugagcuacgcccuuagccccacuuucugccuuuucuguacaguaauuuaacuuccuggaaaccuagauguuguugauaaagucuagguacugauaauaggaggguguguaacucaaaagcuagauuacaguccaggccuuaagugaguccccagaucccagaguugggccugcucugaguuuaagccugaggcuauaaccuccuaguaggugaauggugcuccauugagaugccugggagacuccaguguuuacacugaaacccugcugucuaugaagaacucuuuagcaaucacaacugauaaguuucugugccugagcaguagcagcuugggggaggggaggauuauuucacaaccuauugcuaaaggaaguccggccaggaauugaggaaggaacugaagcagaggccaucgagggggcguaugacuugcuucccauuguuggcucagccugcugucucguacaacuccggaccuccugcuagacccaccacugugggccgguccuucccaugucaaucuuuaaucaagaaaaugcacuacaagccgggcaugguggcauacgccuuuaaucccagcacucgggaggcagaggcagguggauuucugaguucgaggccagccuggucuacaaagugaguuccaggacagccagggcuauacagagaaacccugucucgaaaaaccaaaaaaaaaaaaaaaagaaaagaaaagaaaaaagaaaauguucuacagagcugucuacggguaauacggagguauuuccucaacugagguuccucugcccagauaacucuggguugugucugagguuaugggagaaaaaaagauaggacuaaauugaauaaauacuuaguuugcauguuaaugaccuguucgauauaagaccuuucuagaugcaguagugcagaaaccuaagacucagcccaucuucugguuucuuaacaucuugcuccgguagcaaacacauccuccaacaguacucuaguucauuugugagguagguguuagcuacugagcgcaccagucagaagcaccacagcuggcaacggaacaauccagucaauacucgggggccacuuuagcucauuaaagucagcccuagaaauuguacucaggggacuggagagguggcugagguauuaagagcgccagcugcuguauuguaaaggaccccagguugcuucccagcaccuacaugguggcucacaacccucuauaauucccauugcaggggcucugauacaccuucuggccuccacaggcauggccuccacacaguacacagacacagacacagacacagauucaggcaaagcacccacacacggaagagaaacaaguaaaucuuagggauuguacuccaggccuuuguuaccuucugguaacaaagugugcucauuggcuuccugagcaggguuuguauugacucacaagcuagaagagguuuuaguccaucgcugguggacacuguugcuuggaccgucgucaaaucagcauaugguaauagagcaguaugcuggccuccugacagugggaagguuggaucccuaagaucgccuucaagggcacaucaaaucaucuuucacuggucaccaacucuugagggccugccaauagcuagcuguacaggcuggagacauaggccuuugaaggaacauugaagacucaagcgauaacucuggggacuacccaugguuaaguaugggauggguaaaagccaugaauuauugaaagaggauucacaggaagagaaaggcacggagaaugacagcacugaggagggaaggcaucuuugagaugggcacaggcacuuccuugcccuaugucuccgaagugucucgcccccacccuucugagaagugaaugcucucuggucaagagaaaacaaauaugagaagcugaauuugucaagaauuguuucaaagguauuaacugcaugugcaugauagaggggggcacgugugucagaggacgacuuuggggaguggauugucuccuucccuucuuacauggguucuggggauuaaacucaaguuccuagguuugccuggauaggaccuuuauccacugaacaaucucaucagcccaaaaaggauuuuuaugcauuuguuuuuuugagauagggucacguuauguagcccuggcuggacuggaacucucuauguagaccaggcugaccuugaacucagagauccaccugccucugccucccacaugcugggauuaagggcaugggccacaccauaccugacuccaaaauaacaauuuuuaaauguguaaaauccacuuauuuucuugaagaaguggacuuuaaagauucucucucuuuuuuuuuuaagauaauuuuauuuauuuuguguaagaguguuuugccuuuauguagguaugugcaccacaugaauguuaguugcugcccaaggaggucagaagaggguaucagauccccuggaauuggaguuacagaugaucuacuaugugggugcucggaacugaaccuggguccucuacaaaagcaaugaguacucuuagccacugagcuuucucuccagcuccaacuuuccacauucuucuugcuacucagagcacaugguaggaauacagagcuuaccuggggagcagggacggcaugugguuugacaucguggguuaucgguaaccagccauacugagucacgacgucgugggaauugaagagcuguuucuucaggguuaaauacaaguggaaagaaacacccaaauguuuguaacaccuuucacuuggaaguuuagagaugaacccugguggacgaguuuccaugguaauguuauaaguagaggcaaucacacauucacaugccugagaagaaauaaucaguguuagagccuugagacgaguauuuuuagucuagcuauaaauaaaacaaugaaucauccguaugcuaugcagauuuaaaguggguaaauuaaggaauuuuuuuuuauagaguuucauacuucagggagguauuucuuaaagguucagagaaauguccccaugaaagcacuacagugaugggaacugucuaaugcugugugugugacagggaugcucucugccauggccaugcugggaugcucacugugauggccacacuguuaacacugcagucacagacagcugcuaacaucucugcuguggccagugcaaggugcaagggaagaacuugaguugucaauugguuucuuuucguuuuaagauuuuauuuauuuuauguauaugagcagacuguagcuguccucagacacaccgaaagaggacauuggaucccauuacagaugguugugagucaccaugugguugcugggaauugaacucaggaccucuggaagagcagucagugcuccuaaccacugagccagcucuccagccccuucauucgauuucauuuuaauuaauuuacauuuaaauguuugccuguaaaagagcauuaacugcucuuccagaggaccagguucacuucccgacauccacuuggugcggcgugggugacuguaccuccaggucuaggcaaucagauagccucuucuggacucuaaggaaacuauaccauauagugugcauacauacgcagaggcacacaaaguaaaaauaaauaagccuuuuguaaagacaaaaugaaauacaccaugaggagugaugagugugccuugcuagguuauucauugucuaaagauggcggcauaugcaaacaucuuuggcuccuaacuuucucuaccugguucuaguuagaacuacuacuguuccugacacagccuuguccaaaucagugucuuuccuuuuacucuuacuaacccaugcugaacuacagcucagaacuacagaugcuauuuucuccaaaguuaaucucauuauacuuaaaaaaaaaaaucuuaaagcuuagcauaaugcuaaaaugcuuagaauaaaauguauaaauguaauggcauacuuugaaaugugugaaaaagcaaaaugaauuagcguuuauauagauaauagcuaugucauaaagaaaauauaaacaauuugugguauugaaaaaaauauaaacaaugcaugguauuugcgauagaagacugcaggaauguuauuuauuuagcaaaauguuacugugucucacagcagagaacuuguagaauaaauguaagcauacuaaauauuugaaagcaucuuuuucucagaccuuaucacaucucuauugaguagagccaaggagcaauaacggagcgucugcgaaguuucagcaugcaugaucugacagcuauccaaggggaugagcccgugggacacagacccuaccagacuuugccagaagcaaagaggaaaggcaaacaagccaccgagucaccagguaggccugucugucguggugcaagggagccuuucauaacugggcgaagggucaggaugaacgccaaagaguacagggugcuggacacagaacuggcuuugcuuuguuauccaccguuguugacgcagaggaucaagucaccugcgcuggucucaggcuugcuguauaagugaagcugucuucaacuucuuuaguuuuugguuuuucaaggcaggguuucucugcgucguagcccuggcuguccuggaacucacucuguagaccaggcuggccucgaacucaaaaagauccaccuuccucugccuccccaagggcugggauuaaagaugugcaccaccacugucucccgcccacuaccagugauaaugaguucugaggaagagggaaggugagucuucuggccuccacaaacaccaucaaccauucacucucauccacguacgcgcacgcacacacacacacacacacacacacacacacacacacacacacacacgcaugaaagcaacaaagcguccauaauggaaacgugagcauauaacccugaacuccacugccuagcuugucuucaauuucuuaauccuccugccucuaucucccuagugcuaggacuuuggguguuagcuaccacaccuagcaagcuaccacaccuagcaaaauugaccuauuuuaagcauauguuuuggaguuuauuauuugauguguugucugucuguucuccagacagggugucauagcccaugcuggccaagggugacugagaacuuccuguacucuugcuccgaccucccaagucuuaagcuccagugugcagcaccacacuuagcacaaugcaaggcuagggauggaauccagaguucuguggcugcuagacaagcacucuaccagcagaacuacaagcguaugccuuugagcuucaguuuuaccuguagccccuccucuccaauuaucucuuaagucagacagcuacuugccuguggcugcccacaaaaacugugcagcuaagagcagagccucuuacgcaucuuugagguuuuaggggcugugcauaugguccccagcucaucccagcuuuaguucugacggucaucagcacucucucuguucagguuauggacugacauccgcaggucagagagaagucuuaagcaguugacuugcuaauucaagggcuagcguguaagccucuucugcagaaaugaugagcguggcguaguuacugugcugcgugcucuuaaucaaaugcugugaccuuggaagcaucgcacauaaacaagcagagucccucauccuguaucgugucugcggcagucuucauuugugucugcacugaaaacuaagaugcugaagacuucuuuuuuuuuauuacaguguuaaucauccuuucaaaaacuuaaguucuccuuagagggagacugaaaaaucaucauuuauagcucaagcuaauuuuaaaaauaaagcaguagcccuuaguagaaaguugugucuuucuuucuuuuuaaaagaccaagauuuguaauguagcccaggcuggccuugagcucuuggcagucguccugcuucagauuccagauguuagcuuccacaccuaguaaaagcuccucuucaacaagugaagguuggggcuggagagacggcucauuaacagugcacacugcucuugaaaagaacccaacauuauucccagcagccuuagcuccaacuccacggggauccaacaccucuggccucaaugagcaucugaacuacuugcacauaccaauacacagauacacauacauacaugcauacauacauacauacauguaaucaaaaauauaaaauuaaaccuuucacuuuuucccaagaaugaauaaugcuuaaaguaguggccacugucugaaagguuauauucaaaccaaccauugauaaaaauaaugcuuuuaagaaugaaaaccugaggcugggcuguggcuccguugguagagugcucaucuagcauacagaaagucccaaguuccauccuuuuaucugggcagaggcagguagagcuuuguguuuaaggccagccuggucuauauagagaguuccaggacagccagggcuacauacugagauccuuugaaaaaaagagagagagagagagaaggggaaggaaagaaggaaauagguagguugguuauggauagauaaauagauagguagauagguauauacauacauacauacguagauauauagauacacagauacauagauauauauaggcaggcaaaaaacaaacaagaaagagccccuuguaaauugcacaaaagggguucaaauuuuuaacaaagucuaucuaggcaagaaauacacagaaaaggauuuugacuccaaagauauuccaaaucaaaauaguaaauuaauaauaaauuuuauccucccagaacauucuuaaucaauaguccuaauauguuacaguguaacaaaaugccccccagcaguugccuagaacaaucagagucuccuuuuggcucagaauguaggguaacugggcucugcaaaguaguucuguuuagggucucaugcagcugugcucagacagcagcuggggcuggggccacacccccacagaagagcucacacgugucagggcuuggaaaagcggagcagcaggugucuaaagcaaggaggccucucagacaagccuguguguccguucuguauggcccucagacucugaggcgagcuggagucaccuggcagcugcgguucccacagccaguguccaacaagacgcuggcagaggucccacuguaugccuucaccauauuauugguggugauuuguggaggcagcuacaaaagccugggaaguugaggggagggaggaagucaugaaccaaccucuuggggcuuuguauggguuuaaaaugaaagagccauuucggaugacagucagccagacaagaguucagagcuguguaugacaggacuguuccucuccuucguaauaacaacagccaagugcccacaagaacuaauaagcaaaauggcaacuuauuagcugagaaauauaaaaauguuagauccuaaggggggaaaaaucagacacuauaaaucagugccuguuuugagcuuguguuguagaagugcaguagacagugguaaggauuaaguugcuuuguuuguguguguguguguguguguauuguuugguuggggugguauuauuguuuguuuaguuuugauuugcuauucaaucggaaauaacacaauacucuuauuuugaaaaacuaaauaaggggggaggguaugggggacuuuugggauagcauuugaaauguaaaauaagaaaauaccuaauuuaaaaaaaaauaauacaaugggaaacuagaaauggcaaccucuaaauuuuuuucugauaguuuuucucauuauacaagaauaauuuuuaaauaaauacuuggcaguuaaaaaaaaaagaaaaauuuaaacuacauaaaagccugcuuucugugacauagaguugucuggggacugucaacaaggagcagaggaccuuggcaccaagcaugaagucuuaguuacgugguagaaaggaagaacuaccucuugcagugugccuugaagaucacauguagcccgacaugaccaugcaugcauacccuuagagaaauguaacuuuuuuuaaacguggggacagauagaacuggaaggaugaguucaugguuaagagcaaauacugcucuccccgagggcuccaguuucuuucccaacacacagguugcucaacucauagccuucuauaacuccuacucccuccucuggcuucugugggcaccugcacuuacaugcagaugcccacacagacacagacacacacacacacacacacacacacacaaaguaaauuuaaauuaaucuuuaaaagccugguaguaguggacaacucacaccuuuagucacgucacagugcuugggaggcaggggcaggcagaugucuacagagugaguuccaggacagccagggcuacccagagaaacccugucuugaaaaaccaauaaaugaauaaaguaguaauaauaguaaucuuuuuaaaauaaaauaaacccauucacauacaugcugacacuucucauagagaauauggcuucaucuaaccaucucccuggcgucccugaacuuccucccaucugccucugcugccuuccacauucaggcuugcuucuccguaggaugcacugucucuaacugcuggaggaaaacaagggauuccagccaaaauaaugccugguccugcuuccaaauccuuccugacuucuagccuagaugcuuggcaggucuaaaauuguacuugccugauauacaauuaaagucauuuauguuauuaugagaguaaaaagcauauuagcaacuguucaugguuuguauuguaagucucagauuauuugugucccaggagagcugacuagugacauuuaccccacgucauuuucuugacagaaaaaaaauccaucucugcuuccuccuggacccuuaucuucuguuccuuaucuuuauuagaaagggauuuaaccacccccacccccuuuccaggccuuguagcugcacuggucuccauggccucagacuggccccugucuggcuucccccuccccccucagccucugguuuugguuucagcauuaauugucccacagggcuuguuagagaugcacaucuaggccccaccccagggccagugaaucacaagcuucaggguggagcccagcaagggugaggguacugacuaguuauccaucccgacaggacuagcuggugucugaggcucucaccuucagccgugggguccucuugcuccugacucccagccuggaguacaucuagaccucuuacaguagccagcccuccuggauguuugcauagcggucagacauaaguaauuaaggguccacauaacagcccgucagcuggcccuguggucccuggcugaccuuggugcugggugucuccucuaagaucugucuuauggcuugugguuucuuccagcugaaaccucccaggccucaucagcacuguaagugccccagugaacucacuuucccaacucuaaagucuuugggucuuucucagguuccccugucauuccaaguugaccaacaaugggaugagugggggaggauauuuggucuuaauuaaagucaaaggcacaaauggcagccuaaaacacacuuuggggguugcuaacaacucuaauagcuaaucuaauccucuucucugguguguguguguuuguguguguuuucuuguuauuguuuucaauuuuuagcaaguuguggguauuagccacguugggaauuuuuaggagauucaauguuauuguuguuugguuuaguuuuugauguaugugugugugucuguguguguucucugugugugucuguguguuguuuggcuuuguucuugauuguuguuuccguuuagcauauuguuuuguuuuuguuuuuccaagacaaggcuuuacuguauaguccugacuguccuggaacucacuauguagacuaggcuagccucgaacucagagauccccugccucuaccuccccaagcugggaccagaauguguguaccaccaucacacguggcuugguuuggcuuuuuuuuuuuuuuuuuuuuuuuuuuuuaagauuuauuuauuuauuauauguaaguacacuguagcugucuucagacacaccagaagagggagucagaucucauuagggaugguugugagccaccaugugguugcugggacuugaacucaggaccuucggaagagcaguugggugcucuuaccugcugagccaucucaccagcccccgguuuggcuuuuuaaaucuuauauauuauuauuuuauguguuuguacacuuagggaucaaagaacaacuuuggagucauccucuccuucuaccuuuucccgugccaucucaaacucaggucgagucaccuuggcaggccugguuuuguuguuuugacacagaguuugaccuuguagcucaggcuagccuuaaacacacaucagucauucccugcuuccugaguccuugaugccacgggugugcaucacaccagacuaugggcuguguguuccucuaaggcuuucuacuguuuuccuuugaggcagugucucucccucaacccgggguucauguauuucuacaaggcugacaaccuggaagcccccagacaucuucuugucucuuugcaugccucccacacauacaucaguggaguugcaggcuccaggggccaugcccagacuuuuacuugaaugcuaggaucugaacccagcuccuuuugcuuguacaagagcucuuacccacucuuauccccagcccucuggcuuauuuuuuaaauaauaaaaaaauaauuccuagaaaugggaacggacugcuggacaugguauuacagcuaugaauucaagcccagccugggcuacagagcaagaccccgcuccaaaaugcauuaaguaaugaguaaaaccaaucagggagauguuccuggagcaaaugagccuugcaaucuuuaucuagaauagugcacaaagcaaaagcucaccgggaauggccaggaagacuuuccagaugagcaggaggagagauccccccaccccaacccccagauagaccccagcagaagagguagguucucuggugucguccaacuaaaaugcugguccuguccauuugauuagccuauggaauuccacugaaagauggaagugagcagacagacgaagaagcggaggggccauucuccgaugacgagauggugacucacaaggcgcugaggcgaucccagagcaugaaaucugucaagaccaucaaaggccgcaaagaggucagugugcacuggguaaugcuuuucccgacaaugugugugaggagggauuucuuccuuccuacuuugucaucacagcugugaagugaucagcggacgaaggauucaaaugagaguguagcguuauaguucaaauucuuuauuaaaagcagguguauuagggaucucuagggacaauuuuuuuuuuccuggaaauuuugaaauaggaaacuuuuuuuuaucuugugcucuacauagaaaaagugucauucccacacagcaaaccccauggcuuuuguaaaucucuauugcuuucucugugcccgagcagagaaagcugcugacaaaauuaacugcauaguuuugcuuucaagaagcccuaugugaugauuaaauaguagcaauuuaccuguaaucacacggugucguugggcuaagaaaaugaaggaggagccaggcucauugacugacuuaguacucagcaaacauaaguacuaagucagugucuuuaucuaugauugauaaugucacgugcuacacacacccaucacaucacaagcuacaugucugugggaguucuuaauaaggagguugcuugccagggaguugcuuugauggcugguugacugguugguugguugguugauugguugguugcuuugauggcugguugacugguugguugguugguugguugguugguugauuuuugauugauuaauugguugguugaauaauugacuugggugcuguauuaggaauugaacaaggaccccaugcaggcuaugcaagaacgacacuuccgagcuacauuagcagcacauuuuauuuugagguaagaacucaguaaguugucauucuguggcccaggcccagguagauccugaacuuacagucaucaggcuugggucucccaagcagcugacaaagaagcugauucuuuaugccagaugaguaaaaccguuacuauggcgacaaaauauuaaaacuuuccuaauuuuaaaaaguagucagucccuuuaguuuuguuuguuuuaguuugguuuagccaguauacagaguaacaaauccuuaacggcuuuuccauagucauuuuggcuuuccuauuguuaacccuaacacuuuucuuucuucaggugcgguauggcucacuaaaauauaaagugaagaagagaccgcaaguguauuuuuagugucuacaccuugcccuucccaagaugaauaaaccgcuaacagaucaacuucauuuucuaaccugauguauucagggcuuaacacuuuaaaucuucagaguguggcagggaugggauuuacgcaaugacuuuaaauggucuguguuucuuuaacaauuacuuuuagauguuuaacugcuaaacuuaguuauguaagguuuguaaauguacguguagauaacaaaagugaccgagaaucgcgucccugaugucagcagcaacacugagugccuagggccuaaggauaaagccuagcuagacccagggcagacuucaaaagucucugcuccaggacacaccugccugccguucugguguugcauucuguuuacaucaucuugccugcaucuaucacaggagaguggugacagccccugaggagccagugucauugccauaggagggggcuguguccuuccuuaagccuuagacgcugaaaguuuuuuaaacaaaugauuugaaaaccagguguccacauagcacuuuccuggcuaguuuugcacacuugaaaauuguuuacuuauuuuacaacuguacauuuacauuuuccugaugcugucuguuuuguugucugucauauuccgacaugucaagaucaugccuugaaaccgcgucaucuccuuuuccuauggguuuguuucguuugguaaauccauucagcccauuauagacacauaacuguuaaguuuguagucuuuuguuuuguuuuauugagguagggucucuucccugauccucguccugcuuccacuucgccauugcugggauaacagacguuaucacacuuggcucauuuuaaaugcccuucaguuauauuccggacaucugagaaguuaucuuaaacauuaaccaguuuccaucauugaauuugaugugguuuuucucaacagcaaauuauucuagguuauucuagguuaaaaaaaaaaaagcuuuugggggcuggagagguggcucagagguaaagagcacuggcugcucuuccagagguccugaguucaaaucccaucacccacguggcagcucacaacugucugcaauccagcuccaagugauuugacacccucacacagauaugcguacaggcaaaacaccaaugcacauuagauagagauagauagauagauagauagauagauagauagauagauagauagauagauauuagauagauagauagauagauagauagauagauagauagauagauagauagauugauuuuguggaagcgucacagaccaauguagcacuuaguguuuucuaacucauggacuucccaaugcccacacucagcuccugagcucggcagaggccuaugcugccuuacagacccagcaaugacuaacaucuuuuagaucuuuuucugccugagauuauucucugaaaaugagugucaggguaaaacacaaacaccauugaugcuacguaacaggcuuccagaaaaaugccaucuuuuauuuuauuuuauuuuauuuuauuuuuggguuuuuuuuuuucgagacaggguuucucuguauagcccuggcucuccuggaacucacucuggagaccaggcuaaaggccuucuuuuuaaucuaacagauuuagagggauugaacucagcuccuuuuagguugcccuacuaacuggacauuguggacacuaaaucauauuggggugaugaauaaucaaauuuucaauaucaaacaaugcuuacaugggggugccugaauggcccacacacacaaugaccucuugauacuacgaauauuuucuacacagaaucacauuguuaauauuuuuaacacgaaauaaaaauucaaucuuuuuccuccccaauuuaaucuuguaucuccaucuacuuugcuuugacuaauagccucuuccuuucgaaaaggauucuuuaauuucuauucaaacaucuauaaagucccacaauaaauuauuggacaggauguauucauuucucaugaaccagaccugcucugaaccaaugcugugcggcaugggugguuuucccugcagaggccguguuaccugauaaggugaugugauaaguacaguaaguuacuuugucuccauggggacaaauuggcaagauuguaucauauucaaguccaguaucaguauuaaacuuacccuuaggagcuaaggauagacaccaugcuugagguacacaaggccuugaguucaaucccaaaaccaaaaaaaaaaaaaaaaaagauaguuaaaacaaacuuauuauuauuuaaugaguuuguauacuauuuguuucuucuuuugacuuuuguuuguuuggguggaggguguuuuguuuugugagacagagucucucuguguagcccuggcuguccuggaauucacucuguaggucaggcuggccucaaacucacaaagcuccaccugccgcugccucccagaugcugccauuagaggugugucccaccaugcccaaguuguuuugagacuaagccucacucuagccagccugaaaugcacuguguagcccaggcuuacuuccaguauauggucacucuggaugccuccgccgccuuuuuuuuuuaaauauuuuuuauuauuauguauuuuccucaauuacauuuggaaugcuaucccaaaggucccccauacccucccccccccccacuucccuacccacccauucccauuuuuuggcucuggcauuccccuguauuggggcauauaaaguuugcguguccaaugggccucucuuuccagugauggccgacuaggccaucuuuugauacauaugcagcuagagucaacaacauuaugccuccgccuucuaagugcugagauuacagguguguggcuccauacccuacuucacaggcguuuuaaauugggagaaauaucacguucuagaaucaaaauucucaagcaaagauaccgccugacucggagcuaaaguuggcugaccugcucacugccguucacccucccgguccuggucccugcucgggcuugucccugcuguagacaugcucauaugcgcuugaugacuguccuaccccgcuuuguuucuguccccaaggucucaugucauagcaugcccuuuucuuugaacucuguaugcugagcuaaagcgcuguuuuguucuguuucucuuaaagaggaccgggucaccuuguuuguuucugcuuuugagcaugcugauuuuuucaagagauguaaauuuauucauagaccacagugccuugacuuaacccacacugccaacuggagcaccagcacgcgaaugcacaaaccgguuuaaggcacuguuucucucugccuuuugacauguauccaaaaauuauagccuacuagcauuucaucuuaguauccagucguucagcaugaucacuaacauuccccguacuuagcuguuguuuaaguauaaaaauugauaugucuauacugugucuuucuuuuuccuuucugguauuaagaagagccauagcuggagagauggcucuguuuuaagaaugcauacugcucuuacagaggaccuggauucaguucuuagugccuaagccagguguuuaguucacugcagccugcagugccagcuccuggggguacaauaccuuccucugauuuccaagggcaccuacgugcaugugaacauucuuucucacggauacacauacacacaucauuugaaauuaaaaaaaaaaaauccugugaaaaacaaaaaggaaccagaaauaagcugauuacuacauaaacaauugucuacggccaccucaguuccucauagguccccuccacacacacuguguguguuuucuagggcuaaaaaaaugagaucuugcuaucguuucuagcaauaaacacuuuagcacauagaggucugggacagaacuaacuccucauguguuuucagggaucuuauuccaugugucaccaccaaagacuuccacaguauuauaaaacauguaacuacucuaaaaugacgucagcccuuggcuacaucgucuucuuucucuuuuguacauuuggagaaaugccugaaccuuaaugguauuacuauaauacugucuuauauuaacuguaggguuuuuucauuggaauauugucugccauuggaggggcgggggagacaacgaaugaagaucuaaauacagaaaucugaacacaaguuccaaagcguguccucugaccucucccuuuuagguugacuuauuugugaaacagguaaaauuugagagggucauuguuuugugguuuguacuauuucuuaagaaacauacccuaagauuaaauuuuuucugaaaagaaaguaucuuuuuuuccuaaguacuucucaaguuagucuuuuagugggaauucugccgauuaaccuugacuuaacauuuuuuuccuucuaauauauauuuuuuaacucuguguacuuuaauacuuuaaguggaaauaauuuuauaaaaucucuguuaaaucucaagccccaaauguggguggcucugcauguguguuuugggaaacuuuuacaauaaaguaaacucauuuuauuaguggcag

SEQ ID NO: 5551 - RNA, 7342 nt, Mus musculus
  misc_feature (4600)..(4699): n is a, c, g, or u
  misc_feature (5530)..(5629): n is a, c, g, or u
cuggagagacaggccagagguaaagagcacucuuccaggagaccagacacguagccacuggcaaaacaaacaaaaaugaauaaauaaaacagguuuuguaaaauagugauuuagagcaacaauaaaagaaauacauacaaauaaaaauaaauaaaucuuuuaaaaaacaaucaaaaagagauuacuuuuuuaaaaauauguauuuauuuauuuuauguauaugaguacacuguggcuguauagaugguugugagccaucaugugguugcugggaauagaacucaggaccucugcuugcucagaccccacucccucuagccccacucgcuccagcacaaagauuuauuuaguauuauauguaaguacacuguagcugucuucagacacaccagaagagagcaucagaucucauuacaggugguugugagccaccauguggaccuuuggaagagcagucagugcucuuaaccacugagccaucucuccagccccaagagauuacuuuugacucagguaaucaguccaaaccaagcauaugcccucagugaugugauuuccccagcaaggcugaacuucugcauaaccgcuccaaacagcgccacuaacuggggaccacguguuaaugccugagccuacgguggacacuucucauucaaacuaccacauuccacucccuggccccuauaggcucauggcuccuauaggcucauagccauaugauaauguaaaacauacuccauuuuuaaaaauccucagaaucuuucauagucucacaacuuccugaagucuaagguccagaucuucuuucugagacucaaggcauccucuuaauuguaaccuccuguaaaaaaugaaaacucaaaccacacauuccuaacauauaguggcauagaauauauauuacuacccccagagggaggaaugguggcacucuaaggacauacugaacaagacagccccauuaggcagacuccaaauucuguagcgugauguccucugugugaaauuuuaaugucaaacguucuacucuuacagcuuuguugcuugcgaacauggcaaguacuuauccaauaauuccuggauaaaaagucaguaucucuuuuguuguugauguuauuuuugucuuguuuuguuuuuauauuuauuuugugugucaaugugugucauaaauaugcuguggugcuuguagagagaucaaagaacaaugucacaggucuuuuuacuauuugaaaguccuuuuggcuuucacuuuucucccaccauuucaguugaacacuagguaggagagagaaaaggauacaggagaaaggagaaagggggcaacuauauuguuagacuaauuccugcugauugaggguaucauguuccuugggacaaguuugaccuuugcuggaaggauagcuaacuucuucuagucuuuuugcacgugacuacuugacaaacagcaaucaaaagcacccaaccaacacuagccaccagccccuucuacuggagcccuggcauuuauacacccucugaaaaguccccagaauuccaaaccucacacacucacagaaacuaucugcuguugguaaaaucacgcccuugcuagagcacucggcaaaucacauucggcugccguggacugucugaagcagccucauaucucauagcucggauuaaaaugaaaacacagucuuuuaauauucccuuguuuuuaaagaaaccaaaauccucacuauggaacaaacugugggaaucauugcucuccugcuguguggguuccgauuauagaacuuaggugucaucaggcucgguggcaagugccuccacccacuaaaucaucaugccagccccugaacuaucuuuuaacguggucugugccaaucuugggagcagaaguuucaacgcuaacuacucuccaauugcaaaugauaugaguucuccuagaugaagggcugacuccaugggagaugucagcucugaguugccuccaaagaaaaagucccccaaguuuuucugggccugaguacucugcagcaugaagacuaucaaccccuucaacaugcucagaggggaaacagugaaagagaagugacaagauuugaggagcauacacaaaagacagaaaugagcccaaagagaucagucagguccccagaggacagagcugugcugcacaucauacuucauaaaugcuaacuagcucguccucugacacuaugaaucugaugauuugaagucugauagggcaaaaggaacaggcaauuuaugcuugcccugaagucuccuccauuuagcaaguggcuuauuaucaaaguuccucucuuucaaacuugauaucugagauggucaguugguuuucuucuguccuguggccucauccuggaucuucacccagagcucaggggcuaaagggcaaagaaugggugccucuagcaaucaaugguauacccauuccaguaagguggaucagagaagggauuccugaagaaaugaauuauaaagguaauugucuaugugagaaaaaaauagcaagcacaggauggucauuggugacaugugucuuccaaagauccuuggcauaagaaaugcuggaggagaguuccagccucaaccccuucugaggucagguugaaggguugggacauuggcaucuucaaagaagaauauucugucuaucuguuggcuguucucugcuuucagagcucuaagaaggugcucucugccaggggugguaucagccaugcguucucaggaccaggucagacucaaggggaugggacagacucaaggggaguggaaaagauccaaggauaaauauauucaacuaccuccauacugauuucucauuucaucgaauccagcacaagggagcuggagucuuagcaggcaaagcuuggaauuaaguguauagauuugaaucaagauuuuuuuccugugaccaaccucuuaggguagaguuuguuugugaugaaugcaggaaaacacgucccauauaaucaaggagauggaaugccccuauuugagagcccuuggcuucugggaacucccaaagugcuccuaaacuugaacuccuuccuucucacccacacugagacucgguccucgggaaaacagugaaguucaaaggugccugcuccaggcaguuaacaagucuacuagucuuucugugugacucagccuuacucacugagcacucucugagcauccacugugagcaucaacaaggcuacggggcuguuagcuugugucauucucggaugugccugcccucuucaacugcuacgacuuccagcgucuguaucauguucuguagauccugacaaugcagcugggcugggcacuaaggccagaaugagcucaaccguauugcauuauuguuggaagaguguucccauuaauaaaagcaagcauugugcaaucucauacacuuauuacuguaccccgagaugacgcaacgcaacacuggcccucgguucacccauaccaaacgggagaaaugaggccgaucagucgaacuccauggguucuuucacagagaaucauaaaaucucagagcaggaugggagauuaggaaaaaauacuucaccacauugucuuugucccaacaauggagaauccgaggcucgcguuauucuucguugaauccaccaguuggaauuuggccaaagugcuugucucugcucacagaugcaguguuugaacacagauuggguccugggcugucugcucccacucucgaaagacuagaaucuagaauaguuucaagccaucuagggcgauugaucuguauuauuaucacacuggguccagaaauucucucccuggggauacgggcauguagggcaaagguagguaaaagaaaaauaaucauuguguucuuaugauuucuucugauucaucauugcaucaagauaaacucucuaaucucagaucucagaccuccaggguguaggcccaacccaauuauuggguacugggcuaugaauguuguccagcuuuguaacaaucugaaaggcauguuuauguuggaccauuugaaaaugacaucuucuccacuggugcuugcaccuguguguuugccugccuuuugccacgucuccuuaaaaggggaagcaggucucaaucaaugaguucagaccucauagucgauacgacaucaagauuuuguucacgauguuuauaauuuccuuuaaaaauguuaggguuuauuugauuauuuguaauugugugugugugugugugugugugugugagagagagagagagagagaguguauguguguguauauuuuuauguaugugugugugagagagaaaguguguguguuuguguaagugugagagaguguguguuuguguauauguguauguaugugugugucuuugugcaugugugugugugagagagaaagagugugugugagagagagagugugugugaguguguguuuguauguaugugugugagaguguaaguguguguguuuguguauauguaugugugugugucuuuguguaugugugugagagaguauauguguguguuuguguauauguauguguguguguccuuguguaugugugugugaggaguaauauguguguguuuguguannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnuguguguguauguaggugcccuuggaggccagagacaucagcucuagcagagccagaguuacugaucacugugaguugucugagaggaguacuggggaccaaacgcagguccucuguaaaaacaguaugugcuccuaaccacugagccaucucucucgauccuauaauucacuucugucucaauuauuugaaucguugugagaugggauagguacaagaacuuuucucugaguuauuuuuguccauguucacuucuauaugagacagccuaagaugacaaugacacagagagagacaaggauaucuuucucuaaggauauugucaacuaaugaaaacugaaaacaucuugggcacccagagccaaauggaucuguugaccccaaguuggcccccuuaaauauacuggagucacacauuuucuugggaucaacauguuuaacaguacuguggagggugccggaagagacaugcuggaacuuaccagagguggcuccuguuuuggagaagggccuccuauguuuacauaacagaacauuuugaaaauagaaaagucuggucagaaaguuagaggcuaagggaagaaauagaaacgaaacacuuccucuggccucccccucaguccuguaaaaauaggcagacuucccuuuccacuuauagagggacagagcugccaggcagcugucguggaaucauaagguugaggugagcacagucagggcuggaaacucggagcuacaguguccugaauucgagccgguccucaagagaagcauugcucugggacaugcugggcuagccaagggccggcaggagaacaggaguacuugccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagggggagggagaggggaauaaccucauuucaucccuucacguuuuaaauaaacacacauuuaacuuuugcuucuccuaaccugugcaguuugcaaugccuguguggaauagaauauggaaugacuauguuuggccugucuaugaguuucauaacugucagagauacaagacagacugacaaauaaugauaauaaaguuggaauaucacuagcuucucagaaaagacaggaauggaaaaggacagguacuuagaucaggggaggaguugacagagcugggcagagcagacagggcuccacuguggagguggugaaggaaggcauucugggcagacggaauggcauuaaagcccagagcauggacgcaugcuuggaaaauugagggccuauugguuguaggcaauggagacacugagcugagugaaguaagcaggaaguaaggugagaggaagguuugaagugccaagcaaagauucguguccaagcaggaauggcgaccaccaauuucacccagggaaaaguaacaguacuaggagaguuuuucaugcagaguuagaaagacaaggaggacgagggugcuggugcacaacuuuaauccccggcauucaggaggcagagacaggcagaccuuugugaguucaaggccagccuggacuacagagugaguucuaggacagccaggguuacacagagaaacucugccuuuaaaaaacacaaagaaagaaagagagagagagagagagagagagagagagagagagagagaaagggagagagaggggagagauggagggagggagggaaggaggaaggaagggaggaaggaagggaggaaggaaggaaggaagggaggaaggaagagaaagagaaagaaagaaagaaagaaagaaagagaaagaaagaaagaaagaaagaaagaaggagagagagagagaaagaaagaaagagagaggggugagggagggaggaaggauaaaagagagagagaaaggaaagaaggaagaagucacuuaggagacuauuauaucggucccagcuacagcagaugagaaccuggaaggguggugagacuggaugagaaagggcccgugcacagaaugagcugcagauaugguagcagcuuccguaucugucacccucaaaaagcucuuucgcagauuuuuuuuucucagacugcuuuagggaugcuuaauuuucccagggucaacgccagagaccaaggcagaacaguuugugaucacagccauucugcugaggaaaaaggccuaaaagacuuguugucaggaagaaucucuccagggcagagaucugcugucagggaacguguguguguguguguauguguguguguguguguguguguguguguguguguguguguguguguguguauguauguaugugaauaugacugcguguguuugugugugcauguuugugugugcauguuuguguguguauuuuuguguguguuuguguuuguguguguguguguauguguguugucuuaguuacuuuuccugcugcugugauaaaauauccugacaaaaccacuuaagagaaaaggagcuuacccaggcucacagcucaaggccauugucuguuaugacagggaggugaugugcuugaggcagcugcucaccuggcgaguuuguacucaggugcugaagggugaaggcuccuguucagcccagcuuccucuuuuugaug

SEQ ID NO: 5552 - RNA, 6716 nt, Mus musculus
cgugcaccgacggcagcgaagcgccagcagucgccagggcccgcgccucccgcgcgggugggugcuucaccucuggggcuggugggggacccguaaccugagucccaccgccgggaccucuauuugcauaacccgaccccccauuucuucccuacccaggcuggagaugagagucgggcuccccaccgaggcgucgucuugccuguggucagcgcgggggccgcgggacuggccggagcgcaggcggagcgggcuggcgcacgugguaagagcaccacuauuucuuccuuuucuccccccucucccuucgaaacagggcuuugcaggguuuuuaagagggugggauacccacagagguuucgcugagcguucucuccuguccccuuugaauuugauccccaauuggaaaggagaucgcgcgcagagcacgaucgagaaacuuucccagauaaugcuuuugggcguuugaaguaauggcgaggaccauucccgggagaacaacuuucacgguuggcacgaggagaacagcgcugcucagagagcggcgacaagccggcuccugguggcacuggggcuccccugaccaccguacuccaauagggcaggagccggcgcgcugcggccgcgggcaucgcaggugaugggcgggagagcgccugcagcgccgcgcucccuccacggcguggcgccguggcuccugcccgcuggggauccucgcugcuccggguagcgugggucaagaaagagaacagccuagcccggucugaaucccuuuucugcgggacuuugaagcugagaagggcagggcaguuucccagcuugcgucugcuaucccaggcuacguagaucccggagccucgggcuuggguacccugcaguagccagagcgcaucggaagagggcugggcgcguggggaaggugggaaccgaguguccggagggccagcaguuuuagcucucuuaaaaguuuuuggucauuuagcaggaagcuuucuccuggaagggcuuguuuauuuauugacuuauuuauuugccggggaaaacacgugugggggccauggcuaccagaaacugugccauuuguugucacucagcgcagaggaagcucuaagcaagggcguggggggggggcuauuccugggguagaccuuaggcgcgggugguaggaugcaccccuccccguggggggggugcgggggguuggugaguugugaagaugaaggcagugucuuccuaggauauccugacugucgccaggcaggcaggcgcacacacgcgcgcugucaagagggaggagguguguaguguguagcguaagguguguugaguggguuuguaagagggcagcggaggagggagaguguguagcggaaguggagcgagcgugguguguguguguguguguguguguguguguguguguguguaugcgcaucgggcagggugaguguccaagccuccaucuggucgcccccacgcagcggaccgcccagacacgccgggaagggcgcccgcucugagcagcagcuggaggggagggggcggggagagcgcgggcagagggagggggcgccuccggccgaggaucuuucuccccgaagcucccgcagcccuucugcuccauucucuacccuaaccccuacccucaaguuaccuaaaaauacuuaaacaaacaaacagcccagaccuguuccguuuucacuccuguauaaauagcacagacuuuccaaaaaagcaagaccgcauuuacucuuaucaccagacacuacuuuccaccguguaauucagaaaaaggcagucagcuuccgugagugcggguaauuuuuuucucucucucuuuuuuucucugucucucucucucuuuuuuucuuuugcuugcgguuuugagcugccaagaaagugaaggagggguuugacuguagugucucggcagcgcucgguuuucuuuccgaaguuuaauuuuccggaauggcucccaaacaagggccggggaggcggagccgccacuaccggaucuucuccuuuuuuggaaagucucggagaaccggaauuccuccccgccccaagagacagagcuaccagcgcggccgccgugggugaacucacggcggccgcgcuagggucggugcucgcgccuucuucccgcugaacucugcaguccggaguccccgcugcaggcaggggccgagagccccagacccgggugguuguccaccggcugcaaaucguuccuggcgagcucagcggagcccgcgcagccaagcccguaugcaaauuggccaugugacggcaaaagcugccaggcccagcccuguuccucaguccauauaugggcagcgacgucacggguauugaagaccugcccauaaauacuccgagccuaacacuuuccgucugagagagcagcgauugauuaauagcugggcgaggggacacacugacuguuauaauaacacuacaccagcaacuccuggcuccccaacagccggaucacaggcaggagagagucagugacggauagacuuuuuuuuuucuuuaagaagccaacaacuugguugcuaguuuuauuucuguuaauuuuuuucuuuuuuuugguguguguggauguguugugguggucuuuucuaaguguggagggcaaaaggagauaccauccuaggcucaguucaaccccucuccaaaaaaaacggcuucucuggcgcuccagguagcgagggaguugggucuccagguugugcgaggagcaaaugaugaccgccaaggccguagacaaaaucccaguaacucucagugguuuuaugcaccagcugccugacagccucuacccgguggaagaccucgccgccucgucggugaccaucuuccccaauggugaacugggaggccccuuugaccagaugaacggaguggcgggagguaagccgcgugucuucuucggagcuuguggguggggagcggugggugugggggggcuuggaggggagaauggggacuugagguggacggcgcugaccacacuggcucugaagacuggaaguaggcgcagggggagcggaaaaagauagacuagggcugccuggccgugcgcgccagcagaugcaccuggucaccaaaagccacccgcaugccuguagcuccgggcgcgcccagcuuuggcuaggcgcaggguugaagcaucaucuccugguccuugaagcagguccaucagccggacucugcgcuacugggcuagggucaaagagaugggaaaguucaucagucggguuagagcugcgcgucuggagagcucagugucaggggagcgcuuagggagcgcgcgggcagcgcucucugggcagagcccacucccggaggaucucccgagcgcguuguccuucugggguggcugggaggcaccacccaacuugcgcaucgccccaaagugaacaggguuaacaagccgaggcggcggagcagggcaaguaacagcgagaagcggcaaggagaaugccuagggaggcccgcgcuggcaccggugugcgccgguuccuuggcgaugcuguguaaagucgucuuccucagcccccgcgccuuccuagaagcgcagccucuuagucuuaggcuaagacagggaugcgcggguguccggcuuggccgaggauguugggagggaagggaacccuagacuccuuccuccgcugcccggguucacacuggcagucuucagcugaagcgcagcgggagagggagggggagguggcaccaggaauuagcuucaagaacaucacccacccacuuauccauucugggguuccccucucucgcggcuggcaccuucucuguaccgccugggauugauuggucggcucuuuuuauuggugucuguaugguugccucggcgguaagaccacaaggcaaaggagugggagagaagucagaggcagaugggaaauuguuugauauuguugcugcuauuggguguuuuuauugggaacuagagucacagauggccgggagauggaagcaggaaggggcaugcccugcuucuuggagauacaguuuuugaguuccagacucugccuaacuucuuacugucucuccaggccucaguuuccccaccuguugcucuguaguguuggaaucaugaaauggggauugccguguguguguguguguguguguguguguguguguguguguguguguguccgcgcgucagcaugcguguaugugaauuaguucuugccuguauucucauugucccaccucuucccugacuuuucccuccccagauggcaugaucaacauugacaugacuggagagaagagaccccuggaucucccguauccgaguagcuucgcucccaucucugcaccuagaaaccagaccuucacuuacaugggcaaauucuccauugacccacaguacccuggugccagcugcuauccagaagguaucaucaauauugugagugcgggcaucuugcaaggggucaccccuccagcuucaaccacagccuccuccagcgucaccuccgccucccccaacccacuggccacgggaccccuggguguguguaccaugucccagacucagccugaacuggaccaccucuacucuccgccaccaccuccuccuccuuauucgggcuguacaggagaucucuaccaggauccuucagcauucuuaucgccgccauccaccacuuccaccuccucucuggccuaccagccaccuccuuccuacccaucccccaagccagcuauggacccaggucucauuccuaugaucccagacuauccuggauuuuuuccaucuccgugccagagagauccacacggugcugcuggcccagaucgaaagccguuucccuguccucuggacucccugcgagugcccccuccacucacgccacucucuaccauccguaauuuuacucuggggggucccggugcuggagucacgggaccaggagcaaguggagguggugagggaccucggcugccuggcagugggucugcagcagugacugccaccccuuauaauccgcaccaccugccauugcggcccauccugcgaccucgaaaguacccuaacaggcccagcaaaacgccagugcacgaaaggcccuaucccugcccagcagaagguugugauaggagguucucacgcucugaugagcugaccaggcacauccgaauccacacgggccacaagcccuuccagugucggaucugcaugcgaaacuucagccgaagugaccaccuuacuacucacauccgaacccacaccggggagaagcccuuugccugugacuauuguggccgcaaguuugccaggagugacgaaaggaagcgccacaccaagauccaccuucggcagaaggaacggaagagcagugcucccucugcaccuccaucugcccagucuucagccucugguccugggggcucgcaggccgggggcagccugugcgguaacagcgccauuggaggaccacuggccuccugcaccucucgaaccaggacaccgugagaugaagcucuggcugacacaccaguuucuccaggccccagaggcccucuguccgagcugccaacacuaccacccuucccuguuccuccccaugaucccgugaucugggcaaaggaccuugauggagcccagcucugucccaccuucucacggacggccuuccgaaaacuuaggccauuugaagggaguugacugucacuccaagaaaugggggagcaaaaagagggcugggugagggccccuggccuacagggcugcgcucugacccugacugagagaugucugacuauggucugcuagcccuuuccguugacccuggaugccaguuguucugagacuuuuucuacaauagguugggaguugcugauuccuuugaucgaggacagcggaaaagacuaaauuaaagcaaaacugauguggcacuuuaauggcuugggacugacuuggggguggggguggggaguuguacagugagcagagccucauccuggcugcugcacucuggcccuagagcagugaauggagguuucucuggccaucucaacccuuaagcaauauguccuagaaacucaagagaauggaagugcaaugucgggcaggacaaagcaauauuggcuccuuuuuuuguuguaguugaggaacaaagauuauuuuuucaguguauauccauuuagauuuuguguauuuuugaugugcacugcucuccgaguucugaaccuucgggaaaaaaauguaaagcauuuaugaucucuugaaaugagucaaagguuaacuaacuuauuuaaagggggacguacauaggaugcaugcagugagugguguugcaaguguccucugugccuugugugaugugggcaguguuaacagggucugcauguguacaggaugccuuacuaugggaacagaaaaaucacuccuuggguuuaaguauggcuguauauuucugccuauuaauauuuggaauuuuuuuagaaaguauauuuuuguaugcucuguuuugugacuuaaaaguguuaccuuuguagccaaauuucaggugagaaugugcuucaaugucacugccgcugauuuguuugguuauuagcucuuaauaguuguggagagagaaacaaucuauucuaacauaaaaaaaccacuaacuggaguucagauaauggauggcuuauugacuaugguguaaauaaauacuuuucaacaauau

SEQ ID NO: 5553 - RNA, 4828 nt, Mus musculus
uguagucguuggugugggccgcgugaauggagcuccgcgcgugaggcagcgccuggcacggcccgcgccagcgccugucugggccccggagcgugagugcggguagcggccgugcgcgugcgcacucgccuucgcgcgcgggcaagcgcccgaccauuggcgcgcuaagcgggcgaccgugcaaggcggccccgcgcgccccgcuggccgguuguugcggggaggucucccgccuggcgcggggguccgcgcggguagccguggcggccgccggagaccgcaaggggcggcgcagaggcggaacgggccggccgcgagccgcgcaggaagcgccaagcaugccccgcgacaacauggccucccugauccagcgcaucgcucgccaggcgugucucaccuuccgcggcagcucgacgggcuccgaagggccggcgccgggcuucccggagaaccugagccugcucaagagccugcugacccaggugcgcgccgaggaccucaacaucgcgccgcgcaaggcgcugccgcagccgcugccccgcaaccucccgccggucaccuacaugcacaucuacgagacggagggcuucagccugggcguguuccugcucaagagcggcacgugcaucccgcugcacgaccacccgggcaugcacgguaugcucaaggugcuguacggcacgguccgcaucagcugcauggacaagcuggacacgggggccgggcaucggcggccgccgccagagcagcaguucgagcccccgcugcagcccuuggagcgggaggccgugcgaccgggcgugcugcguucccgggccgaguacaccgaggccagugggcccugcgugcucacuccacaccgggacaaccugcaccagauugaugccguggacgggccagcugccuuccuggacauccuggccccacccuacgacccggaggacggccgggacugccacuauuaccguguaguggagcccaucagacccaaggaggcuuccggcucugccugcgaccuuccccgagaaguguggcuccuggagacaccacaggccgacgacuucuggugcgagggagagcccuauccaggccccaagguccuaccuugaagcuccugccgcccggggaacugugggccaaagauguacccugcccugcucaagaaaggccuggcugcccucuaucuuccauaagggcucuucucuccgcccccucgccuggacgauggauuuacuggagugaccagcgccacaucuugaggaaccuuggggaacacggcccacuggaguacagccaccaccgggcacgguuaugggggcgggugggcggaaggcuagguugauuccugguauccucagugccaccaaggcuuugauuuaagggaaccgggcagggacccuaaagcgcuuccauccuaaagccauaaugaaaccauuuuuguuucucauucucuacaaaauacacuaaguaguuuugaaucccucuucccuucggugacucagauuuguuuucucuccugcccacgauugcuccuuaauaguuuaauuuauuacugauugugcaugaccuugaauuguucuuguuuucuuuuuuuuuuuuuuuuuuuuuuuuuuaguuauucguuugguuaaaacacacacacaaacuacucagcaucuaaagugaggaguucugaaaagacaucuuucuagcacugggguucacccucauaacugugcguguugaggacgaugucuuuccuccccuggcuugguagccacuucugguguacucagguaaccuuuaguaagaaggucacauacgcgaauucucuugucaggcccuuaaagcucgucuuucccuugggucucaagaucugucguuuaaacaaauuuuuuuguugcuauuggggauuugccuuuaaagcaaagacgauuauuauccucagcugacuuuuuccuugacgugcuucaaagaugauacaauaauuauguguuuucuaaccagacgauuccgaggagcggaaucugcuaugcuuccaaauaacugaauguaaaggcccuggccaccuguugaauuccauacucguauuuacuuccagcuucuuccuaggaaagaagagaaagauacucuugacuguuuguuguuguuguuguuguuguuguuguugguuuuguucuguuuugguuuuuuguuuuuguuuuuuugcguucucuguggagggagccugcagaggagcugugugguuccagcugugcugccgggagauagccucccagcacucccuuaaacaagagccagugcugccuacuacugccuucucuugcaggaagagguagagagcauguaguacccugggaggggcucuggaaguaggcugcuggcuaagcaggcaagaagcccugggcucaauccucaguaccacauaaaccaaguguagcacacagcauuuaggaaauauaggcaggaggaucagaagucaaggucagacuuggcuacauagugaauuugagcggaaccguggaugcauaagacaccaucauauaaauguguguguauacauaacauaugaauauguauauauacacauauacauauguauguacacacacacauaugaaauggauacauggaauagaugcuugagaauuuagccauuuagggcaccaagauuggagacuaaacccuaugccaacacugcagcaaacccuagcgcugcugcaguauuauggcuggcggaggcucagccccuuuaccauguuuacagacgugucuaucgauucugaccauggaccaccaguuuccccuguuuacuauguguaggguuccuuuuuaucacaggccuuuucauaaagacaaacuguagaaaucagaugugcccagcugucuucuaagcucucuugauggcucauguggcaauagaauauacuaauaucggcaauaaauggagacuuacugucaugagugacaaauguuuguugaccuggcagggaaacaaacugcuuuuggcuccauguauccaggauacacauccaggcugaagggguguccuucccggugcagucauuaaagugguacgagacagcaaauuauugcuggcuuggcuuguggcuuuuuguuuguuuguuuguuuguuucauuuuaauaaaaaugagaacaacaggccaguggaaaccugcuuuaaaccugacaaaccaugagcaacacccaaacacuuccaccauggcugcuagaguucaaguucuuucugaucauggucuuuaaaaugccuuuggagccucucgaagcagcucuuugagccacucguaugaacaucuagauaggaagugaugguuuuaaauuugacuauuuucauagaauauuaauaaugaauaugguuuuucagccacauacagauuuugaauugcagcaaagguugauuccuuuacaaggauuguugagagucauguguacuuuacagcauacucuggagguccuuucauggagccuguagaagucuagccuggaauugggcuaguaauaacaauuauuaugaaggccuucauugcaaaagaaggaggagaaauauuaaagguuuguuauaagcaguuuggaaggaaaaaaacccuaaggugcuuuucaaaagaguaacgaaauuguucugagcuaaaacagcaauacuguguuccucauuaguucaauaggaacagugaaacugucauuucacuaauaaacugaguaaacuuacggugaaaacaguguaauauguuuuaaugagccacuugagaaagaauaugcucguuacuaagauaaaaugugcagaaaaauccuugcacgucuaugcauaaacuauuagcuauaacuucugccguuguguuucccuguaggucuacaauauagauuguggucuagaaauuaggauaaaaguuaccuucuccuuuucuuagaaaagaccaaugagcacaaugguguuaagucacuuaacuguucugaugaauaauaaaugcaauaacuagauccugagugagacgcugucugucugucugucuaaauacacugaaccuuuucaaccuuguaguucuaucagugaccaguuauaucgauguaagauuuucauaccuuccuacuccuuugagaauugauggguuuacuaccacaugcugcugauuacauuaaaaaacaacaacaacaaaaaaaaaacccugccuuuuagguaauguguuuucuauguuaauaggagugaguucucuugaguuuuuaacaugacugucaaaauguacaccuuuccuuccccacucgauccuugcauugucuuguagguuccuugaacuugacaucuggggagaaccuaccugcucugauggcaaaugagucaacugcuuuagcucuccuguccugcccagcagagagacaguuacccccacuucgucacucugccacucuccugacagcguuugcuccucuaccgcaggccugaauucagaguguaggguuauacagaacccagauugguccauugugcugagguuucugcugucaaaggagaucauuucuuaacaauacccagucuuacagugcagggguguuuacguuucugaguaagauguguguacuuaugggaaauaaaagcauguuuaaaauuacguagaaauaauguugcuuauugcaaaguggagaagggaaacauaacuauuacuauuuuaauuauuguugaaaacucacaguuuauuccauaagguuguauuguaucaaaagccagugaccuacagaucccccaaagaccaagaagugguauaaacuuaguuuguuuucuugugaguggucuuugaagcaagccgacugaaaauacaucugagaguauuuacugucu

SEQ ID NO: 5554 - RNA, 2224 nt, Mus musculus
ugacugaagcuggcucucccauuucuugcaucucagugcauugaugguacaauggcagcgacccgcugaacaguagcuuguacggguaccacagcuuuucuucaccucccuccucaguaaugcuuuagcuauggagacugaguggcuagaccauagcuucugggccucaggaccaagucggaugaccccauccuuacucacucuuaggccuuuagaauccaccugauuuucuuuauuguuuaaucuaaguauuuauuauuacuuuauuguugcuauugugugugugucuguguguguguguguguguguguguguguguguaugcaugaguauaugucaugccauaucuguggaggucaggggguugggagucaguucccuucugucacagggggaccugaggcuccaacucaagucaucaggcuugguggcaagcacccuucccugcugagccaguucaucagaggaccuuccacuugauuuucuaacuucuugcauuuucuauucuagcuagaugcaaaagcuucaggucagaggcuggagcccuuccucuuccugcaucuaugcuuauauacugugcagaaagaugauucucaauggcugggacaaaaugagucuuuccgaggcaucuuuccuuucuccacagcagcacacagagaggcaaguguaugguucaucuucuagagacacacauucaccaccuucuugguuuuuuaacuugagaacaggagaccugaguguccuacgggcgaucuguucacgugaauuacuaacucuuggggugggagcuuauccagaucuuguuugccccacugguauuuccaucuccacacugcuuagaugcaugggacccgugaugguuggcuugagacucccucucacggaugucagucaguucuagguuaguuugucaugauuuagugaaguuggaacuuuugguguaccugucuuguguuggggaggugggaaugggauggagcuuggagcauugcccaccaccaccauaugccccaccuguagccuuauugccuguguagcaucuugcuggauuaaugucaccacaggcaccucuccgggguuggacuaccucccuucccaaagucugccccucuccgagcauaagagccuuuugugggccccaagaugucauuccaacacagagcuuugugcuagcaacuguggguucuccuuaagguaacuguggguggcccuccauuuauuucccugcuuccuuuuuguuucugugaauucuguauacccccuccccuaggcacaugccguccgugucaucugaaugaccacuuagaggaaggaucaggaguuuguuguuucguuuccagcauaaaucaaaacuuuguguucacgcuguggugcgagcagauccaggaauagcuuugggauugcuaagugucuggagagcaccgacuacagacauguuuugaagcuggucauaacaguugcuacagcuguuaacaguucucgaaagaauagcagcauuauccagcaggccuuaaaaugugccggacuugcauugcacagaagucacacugggauagauguggauucccccuccccuuucugaaaccuagccauaaagucuucaauaacuuagagaaauuccuuucaguucugaauccaacaugaaggacauuguguugugacaaacccaucucgcagcccaugaacguugucuuugugugaguggauguacggguuguacuguuauguuuuuauuuauucugcauucuuuauucuaauguccuuuccuuuuuccugaccagaaagauuguuauugagcccuucacaaagcugaaauccugcaguguguuaaaaaaauguuaacaauucaaagaaguuauaaaaauuuauaaguuggcagaaugcuugggaaauagcugcauauuuuaauauaaauagguaaugcaaauauuuguucauugcauugagagaugagucucuguuuuccaaaaggcccugcuauuuaaauuugauuuauuugauuacauugaaauaguguccaucaugaaugagcccaaagacgaaaugccaccauuguuggcaaaugaaagaaaauaaguuugauaugugguugcauuguguggcuaaacaguuucugcccaacagugggggcugcuuugugaugagaguucucaugaaggugacugccuuuaacuuuuuuuuuuuauuugcaauuugagauuaaaguuugauguuuuagaagacu

SEQ ID NO: 5555 - RNA, 1389 nt, Mus musculus
uuccugugcuacauauuuagagacuaugugaccagagcgcuagguccacaaccucuugacaccaucuguacuguguucaugggaguacuuaugacucuggagacuuagcagcuuggugucugaucacccuagguuaacgacucuuggauuacggauaccagucucucugcauccucaucuguccacguagacagucagccagggaguggaagaauccauucuuaaguggcucgugggucucuggucggucucaacgaaugucgaaagcagagcaucaguugaaaagaagaacagguaucccaccccuaucuccaccucaggcaggggcagccauucccaccacugaccccuauccaguuaguauucuccacugaaccacaacaggacacauggcauauugucagcucaaguaacuguccaguccuuaguccucaguuguuugaucaauuauagaagauccuguguuuuuauugaaaccuuuuugggauacugcuguccccccauuucccuggcuuagcauucugggaaaacucuuuauggcucaccuucccucacauacaguaaugucagguagcucucacuaguguucuagacauggaaaagccugugucagcagaguggcuaauacagggggucgggggaggacauuugcugacuaugcggaauagcugauaaagacuugagugcaaggauuugggaggggacaauaaagggagauggugaggcagggcagugcaucuugaaaugucgguuaucucugguaggaaacaauggucaauucgguuuacaguguguaaaaguuacugucugacucaccccacacucaucuaccugagugggcgaggcuauuguuuacccacccacuauuacucuccguuggcugugguggcuuuugauggccccagagacacccucuggcaaaggccaagaguggggcagacacaucaagcagggaacugcuggugucccauaaaggaguucuccaaggcgaauucaggugaaugaaauccacaauuccaugacagugggcuuguguaccaugcagauuuuucaucuccauauuuugguuagcuuccggaaagugaagcuucaugggaggugcuuggcacagcacuccacacccagaagggauccggcuagcuuaaaaaucaaugauauuauauuugcugauaaaaauagagaaaugagagcaaaauuagguucaucuauugggauuucuuauuuaagguccaaggucaggcucuuugugccuguagccaugaagcaagcagccaugaaagcaacuacucuuuagccacaaugguaagcuuuuuuccuggcaucuuuuucagcuagaaggucauugaacaagagaaacagcacaguccggggaaaccagcucuugggcuu

SEQ ID NO: 5556 - RNA, 80178 nt, Mus musculus
cgcuuaagcccugcgguagcagagggucuguucagagucucgggucuccgugcuguuuuaaagacagagaggcuccuaguacgcuugcgcggcgucgugggccggguuccccugcagaccagacuugguacggccgagcgguuggugcaaucugcagcugcagcccuggggcgcgcuuuucaaaucggccgugccuugcaccgagauggaggggcagcugcugaggggucucgccgcgcagcaggugagcgaggcaggggacuggagagcugcagccugggccgagaccgagagccgggcgagcuccgcggcuugcacgccugaagggugcaccgaaggaggagagcgaggccgggggcaacaggaggacgccggggcccaucccaccugccggucuuccaaggcuugcaggggaggugaugcuccgggagucggugcucgaguugcuccccggcccgcgcagcugggcguguaaugcaaggugcugcuuguagccgugugagccagcaucaaacuguggggcgccgcggggugaacgcucaaauggcauguucuuagcuuuccaggaagguguaaguuuaaacauggauacaugcacaaauacuaggaaaaaaggaggacgaauccaguguuuguuuguuuuuuagcuaucuaaaauauguucaaaaucuuuuacacuuaguguagucgagaauauuucuugggaaccccagucaaguguuaaaaguauucuuccuguucauuauuuuaguauuuuaaugaaaagaaaccccuuauauccuuguagcgacaucuucauuuuaauuuuaauuuucaccucuuaccggcuccugaaguauaguaguucgaaccauauacucuugccagauuugugggucgaggcgaauacugcaggaucauagaauuucuuuaguagaugcaguauuguuaggaaguccucuguaauucucuggaauguugagccaggcuuuguuugaguuauugugcaaaccauauuaguagucacaagacguguuugcuacaaacauacacaaaacuuucaacuuucuugugaaauauuucuuauuuuuguuauguauucuagguauccuauuugccuuugucaaaggguagccuugaacuccuaaaacuccucuugccuccacuuuccuacuauggacuuuauagggcugccacaccgagccugacuuaagauggaguggagcuggguucuaacccagugccuugugcauucuagacaagcccucaaucagcagagccacaccccacgccuauguugaugguuaacacagccucuauuucuacugaacuaaauggagaucuguuaaguuucuuuuuuuguuguuguuguuuuguuguuuuguuuguuuucgagacaggguuucucuguguagcccugguuguccuggaacucacucuguagaccaggcuggccucgaacucagaaauccgccugccucugccucccgagugcugggaccaaaagugugcgccaccaucacccaguaucuguugaguuucuuauggggauugugugagugcugguguggccauccaagugugcuauuagugcgacagugacauucaagaaugcuacagaagagaaaagaggauaacagagcugaguguauggaagggaaauauguguguguguguauguguguguacauauauauguauauaugugugaguguguaugaaugaugcauauaauuucaauauauauagcaaauauauuaaggcuuauuuauguaaauaugacaagauaguaauuucuaauccuaauaucaaaacauagaauuggcuuuuguuugggucuugaagauaagcaacaaaauguuaauggguuucaacuucacaggaauacugagucaggaggaggauuuuauacuugacuaacaaacacuguguucuuaguuuaugugucccccgcccccaauugaaaucugugaucuaacagggugaggucagagguuuaguuguuagcccucggcuucaaccucaguggugucucgacuccucacgcgcugcauauugguucuggagugagguuggggucaaaucccauucugcuauguaauucucagugaccgacgggugguucugagucuaguuuccauggcugcagaacaguugaugugccugucuuggauaguugucaggagcacaggcaugagagaugacugguuuuuuuuuuuuuuuuuuuuuuuuuuuuuuuuuuuuuuuugguuuuuccagacuggcuguccuggaacucacuuuguagaccaggcuggccucgaacucagaaauccgccugccucugccucccgagagcugggauuaaaggcgugcgccaccaugcccggcgacuguuuuuauuacaucccuuugccuacuccucugagcaccuaacccuaauuggucuuccugguaaagucuaggcuccuaugaaaaaaagugcaaguggaagugcaguuugagaagaaacaauucguccuuguaaagugcucucaggacacgaauuacguuucucugcacuucaguuuccuagaaugguuaguguuaauuuuuuuuuucuucaguucaugggauauuguuuaagagauggagauuggggcuggugagauagcuccugagguaaacacgcuugcuucacaugguggggaccugagcuggagagaggggacaccacgccucaaaguugcugucugacuacuacauaaauaccaugguauggcaacuaucugugugcauacauacaugcacucacacacacagccuguacuuguguacacacaccuuacacauacacacaggcacacacgauaauaacaacaacaauaaucauuuaauuaaauauucuagaagcaaacauacuguauauaaacagccuuucauuuucuucgccuaccccuggucuuuuuaccaacaugucauaguuacaguugcuaggugaguaguaguuuuggucagaauuacuuacaguauggcuucugucuuguuucaccaagcccccaucccugcuugcaacuguaaaagucaccucucaggaugggcagugaggcccauucucugccuuuuugugcaguucuggaucuuaaaacuguccaaaugucucucuuccauauccuagauugccagcuuuguaaguuuuaccuuuuuguggcauucgagauaaaauccagcccccuucccccccccccgccuuuuagagaagccuugcacugcugaacuauacccagcucuaaagccucuucuguaugcagaugcaggcgugugcagaguuauucucaucugggcacguacguagggagggcagagggcagcuucguuuauuccuuuauuguuuuccacuuuguuuguuuguuuguuuuuuggagacaaggucuugcuguguagccccuggcuggccuggaacucaggaacuagaggaggcugguauggagucacagagaucugccugccucugccaccccugugcugagauuaaaggugagagagagagagagugagagagacagacagacagacagacaguauuucuuuuugaaccugcagcuuuccauauuugcuagacugacugccaguaccccccagggucugucugccuucaccuccccagcccugagguuacagcccagacgccacggugccugcuuuucuguggacacucagguccuugugcuugcacagugagcaucuccccaacuccccauuucuacucuuacuuaucuuaaacauuuauuuuuauuuauguauuuauauggguguguacaugagugugggguaccaggagaaggcguuggguccccuggagcaggacucauaguuguuugugagcugcaugcugugggugcuggaaacugaacucauauucaauggaagaacagcaaguauucccacugagcugucuguccagccccuaucuccuacuuuuaaaggguccagcuauucuguuuuuagcuuuguuccguccauucugucuuuuuuuuuuuuuuuuuuuuuuuuuuuugguuuuucgagacaggguuucucuguauagcccugguuguccuggaacucacuuuguagaccagacuagccucgaacucagaaauccgcuugccucugccucccaagugcugggauuaaaggcaugcaccaucacugcccggcuccgucuuagcucuuaacuuuuacuauuaaccauaccaggacagugacacagguuucuguuugaccugauggaaccccgagaaaggagauugcuaacccacucacucuggggacucguucuucaauggugcagcaggaugcaugcggggcagcuuuucuuauuggccacagucauccuuaacucugccuggcugugcucuguggucugggcuguaacaguaaugauuuuagcucuucaguccucuuggaggccagucaacaugacugcaugcccagcgggcgcccccuccuuuccagauccuuauucacacuggauggcccgagacagcaacuucuccccagcaguaccaugcacaccuacuaaguaaagacuaauucucuugcucuuuaaacaguuccuugccuaaggcugcuuaguuuugcuggucagagguuuucuucucccgggcaggguggaugugugccgacagguuguguggucagcauaagcuuucggcagcaguggacacuguuaacugaauguauucaaagacaaugcagauguagcgcuuaguaggcaguucacccugcagccucagcccucucucacuugcucgacuagcuuugacaaaggagucaggauccuagucuauagcgcaucuaagcugaaguggguaagaggccacuaucuuuuaaguuucucaacucugccacuguggcuggaaagcagccagagccaguaugagcuaguugugauucaauccggcuuuuuuuacgagcuggugugauucaggacaacuuuauuuacaaaaucacacauggaccagaccacaguucacuaacucucgcaguaaaggguggaauucuagaaauagcuucugcauaugccuuauuuccuuaagggacguuaacuuagucucaugcguaagcuuuuguuuguuuugauuuaagacuuugagguucuuaucccuuccauuucccaauccucuguaaucaccgaagucuuuuucagcuggggaagaaaaugcacuucccagauagauggaggcccugaagcccaggcuaauguguaguguggccguggcccccugcugguuacuucagguuauugcaaccuuaaaucuuuggauuucacuguccacaguagcaguccaccugcuauuuugaacgcuagaguggugguucucaaccuuccuaacgcugcgacgcuuuaauacagugccucacauugagaugacaacccccccccaguguaaaauaauuuuguugcuacuucagaacugucauuuggcuaccguuaugaauugguauaaaaaaaaugaacaaaauaccugauaugugacccccaaaggggucuccaccccacauuagaagaccguuuaaaaaaaugcucuucccgucuccaaagaccuaauuggaugggucaggaacuuuaauaagguucuuuccgugugccucaguugguucucggauguagccagcuuuucagaaccucugcgccagcucaaucagcugucucguugcuucguuuaaaaggcaaagcugaacuccgaggcaccagauggcauuuauuuauauuggcucugugggguaaagcggcucaucccagcuuccagucgcucccggugugcacuuaccagcgcuaaccagccugccgccgucuaccgucuaucacuguagacaugugggucacguagaugguucuuagaacugauugcugaugaugugaaaggagaaacgacauuggggcuugcaagucauccauagaugacgucggaguugguggaaggcagucauggucaaagaaaggagugcagcaagggacagcguugguagaguaccccagcuugagucagcacauacuacaugacaagguuagccugugacgauuccauguugugguaacagaagguaauuaaacagaucuguucucucaugugaauagcucagccgauuaggcuuggagagucaagucaaaccaucuaacauuuugcuuucggggguaaccgccauagacucucaacucuccuaacccucuucucuuccuuuugaaaugauuguccuuuuaauccuugacacuuauuagauccuauccacauuuuuaaauugaauuucgguacaaagaaaaaguaauagguuuuuuuuuguuuuuuguauuuuguuuuuaaaccucugaagccaggauugucgcuuagaaauagacacgcguggguucugugcccguucauaaagaggccucuguggcuucuaauguuuacaaaguuucugggagugaacagaggacuuugcaucugguguguagacuuuuaaugguacgaaugagacuuguauauugagugaggccaucaugcagucacuaaauagaaaaagaccaagacccagaacuaagcuacaaagaaauuucuuggugacuccaaaauaaacauggccagagaugagucucugucccggcagcugaggccucuggcgauuuccaggcauaucagagccaccuguggcucucaugaucugugcauguguguagugugcugcuuacaguuguuaagguggugguggcagccgggguggggguggggguuauaugcacauguguagaaaaagaggguccuggguccccuggaacugauauuacaugcaauuuugaacugcuggauguacgcgcuggggcccgaacccugguccacuagaugagcaucaaguauucuguucuuaauugcugagucgucauucuuauucacccgcugcuuauucuguauuucuuaaggcugucuaacaaaugacccacaaauccccuccccacccccaguuccagagauugacaguaccccacccccaccucugcaggcccucaggaacaccccuuccaugaccccuuuaggcucuggcuacugggaucaaccuguuguguuccaucucugucuucacauggccuccucguguaucugucgucauagggcucugucucugucucucugucucugucucuaacucuguaucucucuguguguuugugugucuuguguguguguucauaugaccaguccuguuugugagucuucuuguagccccuuugggucuacaucuauauguggccucucuguauguguccguuaucuuuauguggccucuguguuucugugucuuuucguggccucucugugggucuguguauuuuuguagccuucucucucucugugggucugugucucuuccuggccuuauuaaaauuugagacccauucuacuccauugugaccccauuguaauuaauaacacgggaaauucuguauccaaauaagggcccacucaagggucaaauauggauuuugagagcucuguuaagcuaacggagguuaugguagcaagauguucuucucaucuuuguuucuuuuccuuuuagccaguaaauugaaaagaguuccuaauaaugcaagaaacuugagaaucuugcaaauagcuuuugcaaauggcuguauuuguuucacucugggaagcuugguuucauccucagaaugguauaaaaaaaaacaaacaaacaaugucuacuacguuucccacccucugccugucuuaaucguaguucuagacucuugcaaccucuuacggaggauucucuauuccaggacugcagcauccgagagaaaauagacuuagagauccgcaugcgagaaggaauauggaagcugcucucgcugaguacgaaaaaagaccaaguuuugcaugcaguuaagaaccucauggugugcagugcucggauccaggcguacacggcagagcugcagaagucaaaagaagagauugcaaaucaaaccggagcacgguuagugcugugagucgccuuugcuuuagcgaacuuuagcauucuuaggcauuugaacagaaaacaugacauaauuuaaguguaaaaaacaaacaaacaaacaaacaaacaaacaaaaugucaggacaccaaacuguuuaaaggccaacaugggagugccagcugaugucacaguuguguggacagcagggcucaaagggaacucucuuccauugagcugguuaaggugcgaagcucuuucacuagaaagugaaaguguguuaggagaaaaggauggggagggucuuuucaagaagaaaggacagaggccaagaguggaguccacggagaagugucucugagaaauuaauugcuggugcuggagaggugguucagugguuaagggcacuggcugcucuugcagaggaucuggguuuaguuuguagcacuucuauggcggcucauaaccaucaguaacuccaauacugggggaucuucugcccuccucugucuuccucugggcuccuggcacacacauggugccccugcauacacacaaagcauccauacauggaaaauuaagauaacucuuaaaaaaauuaauugcuuaaaaacggacaaaaucagucccuuauagaugugcuauuuguacuaagaauaacagcagcuuaaguaaaucgaguugagugggccacagaugacaaacauauaaauggaagggacuuaaaauagaccgcccagcccuuccuauggugagccaguuccagagaagggaguggugcucccagaaggguugccaacuauagucccaguuagggcuugcugcugaguuucagguccuguggucccugucacuccauaucagccuugugggauugauguagcauuugugugucacauuguaucccauuucacaggcagggccaagccccaccugggccuugggugaauggauccagaggcuugacuucagugugucuccguauagccucugucucucuggucuguuuguaguucugguacaagggggaaaguuucucucuguacuuuauuggucauuggguggggcacugugucccuccaugaaauucuguacaaguaagguacaggccugucagagaagguuucuguaaacggaaaacagaaauaggguugugaugcagcagaucuagaugcaaagcggccacuuugucagcggccuuaccuuacuguaaaugccgacccuuaugcuuaguccuuuuguugcaggugcauugugugugugggggggauggagggugauaagguaacucucuaugugggcauuaugcacacacacacacacauacauauauauauauauauacauauacauauauauacauauauauacacacacauauacacaugcauacacauauacauauauacauauauacauguauacauauauacauauacauauauacauaacacacauauacauauauauacacauauacacauacacauaaaaacacacauauacauacauacacaaacauacauacauaccuauauauacauauacacauguauacacauacaugcaugcacacauaauaccuacauauacacauauacauacauauacacauguauacauacaaauauacaugcauacacauauauacacaugcauauacacauacauauauacauaugucuaaugaaaugcuuuaguacucaacaaaucuauuuuuuuguguucuauguccugucauuaguaauaaaauuaucccaguaucccuguguaggaagacauuuggaggcugauguuccuaagccgggccauaggucaggcgaggaugugauaugagucaggagcuaugucaaaguuggauacugacagcuuguugcacagcagaauauuuguuugagacaaaguuugugcaucuagaaugguaaaguuuguuuuauaaggcccagcuuuuaugaggauagugaggaaucacguaaauggcaaaauuugaggucccuugauuuaagggaccaggcauucacuauuaugcuguuccucuaguagccuucugggaccacuguuuaccgcuucuucagcauuuguaaugaauugugaguuuaacguuuugugagcuuggcaccuuagcuuuucuggagugaugacuuacagugauaucaaggaagucucacccauauuagauuuagccaagauagggugggggggaucugagacucuaagcuggaaaugcacacaaauuucuguuuuauuuuuuccccucacaaaugaaaauaucuucugugcguauacauaaguauauccucauaaguauauaugaaagccuuacagcgguuuccuagggauuuaaaaugauuccugacucuuccgugugacccauuuguuuaugccucccuuuguaucugcagguagagccugaagcugcugagcaaauauaacaagaauuacaguacuugcuuucuuccuggguaaacaucauugugggcuagagagaguccucccauuagcgucuuuagcuccuuaagaaaagugacacaggcucuaccaucugacaccucagguucagcaagcaccuguuacuugcacaagcuucguaagcacucugcuuggaugucccuguuugaagaacacagggugacagugugccaucucaggccaaccuaagaaucuguagcaaauguguuguccuugaagaaccagaauuccguuccuuuguuuagucuuugagggagacaaaaaagcuuuaguauauauuuacacauacaugucgguuaaaauacacauguauguauauaguacugacgacuaaaaugcccuuuaaugaagacaucagucuaauucuuccaaacuuuuacaauaaaauaccaaaaaaauuauuauagacuguuuacuuuaggccagugguucucaaccuuccuaacacuguggcccuuuaauacaguuccucauguuguggagacccccaaccauaaaacgagucucguugcuacuucauaacugucauuuugcuacuguuauggauagugauguaaauacucuguuuccuagugguccuuggguuugggucgcgacccacagguugagaaccaccgacgauguaggcccgaaaagcgcagaaucagaucagugcgcagccgaggagccucugacggaaacuggcucucguggauugaaggaaucagucccaccaggugaggggagugaugaaacugcuccccccaaaaccaauugcaaagggaagcuuagagugaaggauugcgcugcagaggauagagaaaaagaugcacuugguugacgcccaugcagggguuuguuaguagaaggucuagaccaccagccaagguguggggcugaccgcgggagcauugugcugccugccuucauuaaacaucuggaaaccaggauuguuaagacuggucacauagugcucacagagcuaggccagagaccuaggggacuucaaaggcuuuguauacgcccaacccccauucccauacccuuuuccgccagaaaccaccuuuccuucuuucuaccccaccaggcugucaagugaugacuacguuuaauguguaucuuuuuaaaauacccccuuguaccauuuuauguucagccaaaagaagucacgguaagccaguguuuggggagacuguauagaagcaggggauuuuuaaagaccaaugguuaagaacagggaggcacagaagcagcagugaucuaguagguaaugaaagaguuccucuuguguuugauuuuaaagagaggagcucuggguguaaaccuggcuggccuacauccugcuguguagaccaggcuggcccugaacucauggcgucccauuugccucuugacucccuggugcugagauuacaggcgugugccaccaugcacgaaaucacuuucuaaaaagauguacuuugggcuggcgagauggcucaguggcucuucugaagguccugaguucaaaucccagcaaccacaugguggcucacaaccaucuguaacgaaaucugaugcccucuucuggaguaucugaggacagcuacaguguacuuacauauaauaaacaaauaaaucuuuuaaaaaaaagaugugcuuuauuuuuaauuauguauagguuuguguauggaugcccuuggcaaccacaaaagggguaccagaccuccuagagcugaaacuacaggcuguugugagcauccucacccccgguggcaggugcugggaacguggcuccaguucucugcaagaauagcacuuucucuccacugagccaucucccuagccccugaaaugauuagaaaggaggguguuacagccuauucaaucacacugaacccugagagcguguuuacuggaaaaaccuguuucuugugauguaguauagccuuggcacacuccuuuaaucccacucuggcugggauacagacacacccuuagcgcacaccuuuaaucccaaacaaugaagguaaaguuaguuuguagaaggagacacccauguuugaaagugaugucuaauugaguggcagacaaagugaugaaucagagaaagauuugacagaaugggauauacucaacucucaggagaacagagaggaaagggaagcuacuuaggagagccguguagacaagagagaagguuuuaccagggccguuguacagagacagguuggcgagagagaacauacuagacacaggugaagacaaaacaagccagagagugagaaggagccagaagaacagaacagguugaggccaagcagagcaauucaggagaagccgagagaagccagauugaaucagucagcuuggagaggcuuuucagccagaacagcuguccgagcagccagagcucagaaagcucgaaaggcggcgcuaaugcagcaguaagacucagaggcugaaaacauucuaggccuagauaaaauuguacggaugcuagacgcuuccaggacuaggcuucaaccgaaugcagacggaggcaguaagucuugaagaggacaauacuucaggagaauagaaguuacauuuacaggaggggaugagagccaguggaugaguuucucaggggcuugcuccuagcucuucacuucaaggguucugucucgugaacugccaucugaugaaaaccugguuaucucacuucguuagagccuuugaaagccagggcuccgggacaccuccgccugugcacaucaguuuaaugccugucugcuggacaaguugggcuuuuaugcccugcuccgaagaacugacggcagaaacuagucacuccacaguuacaggaggaggaagcuauuugcccagugaaaauuaagacucacuucaagagcgguuagccgcugcuucuccuuguuacucucucucguguucaagguuuuaacuaccuacuauugcucacagcgucccugcugccuuuuuuuaaaaauacacuuguuuaucauaaacucuuucauagauaaacauccgugugugcuuacuuagucggccgcuaaucucuuggcaugugagcuuauccacggccuucucucugugcauauaaacacacauuguuccauugagccaugugaacaugaguugcaaacaggacaggugcaucuuaguggcuuggcagucaucugucucuaagaauauucuucuguguagucaauauaugaguacaugcaaaauguuacuaauuuuguaauuuucuauauccacuccuuaucuaauugcucacaaaucucucauaguuuuggguuauuguuuuguuuguuuguuuguuuauuuguuuuuugagacaagguuucucuguguagcccuggcuaccuuucucucuguagaccagggcagcuuggaacucacagaaauccgcuugccuuugucucccuagugcuaggauuaaaggggugcuucaccccuacucagcuguaguuuuuuuuuaaccacuagaauuugauuaauagaguuucauguagugugucugguuaugucccuucggcuuauaaugaaccuuuucuaaaauuucguugucauuaaugcuuugaagagucuagacauuuaaagcccuugaaauauucuacggucuacgccgguuugguaguuuccuuaaguuguccuccagucuucuccauauucucuguuucucacuguagcuggaagucgaauuuagaguccuacggaauugaaccuguggccuugcccacgguagguacauucccuaccucugucagauugaacccuucacacuuggacuugggauuuuccuacauuaaccaccacuguccacugccaagaaaaacgaacuucucccaugagcuuugagagggcacugauuuggcacagagggaugagaauuccggggccacuugacacuaucuauccauuuagcagaauagaaguagucucgcugcuggcaaccacgagcuccugaguaguggguccaugagcagacuuacagugccaggcaugcuucuccucuuggggagcaggcauuaaauggagcaggagguaguugguuacccccauaaccuuuauccccauuaacacccaugcuacuuggacccugugaguuuauauuccuacacuagacauuguuauagcucacuggguucacagccggcuaagaccuguuucuuugacuuguagaaauguuucaguuuagaaaaagaacugaaaauuuuaucuaauuuuuuaaucuaauuguuauuauuauuauuuuuaucuaagagcucuugccacauacacagacccuggcuggucuucugugacuguccugucugaucucuugacccuccgcccggcauguuuguuugauacuuuaucuucucgccagcugcauucccaguuugccuuuuaauguugauuucagaaccgaguuaccccuccuagcuccgguuccucauccuuccuucugacugggcaucugccugugguucauccuuccaucuggagguuugcguuuuagauccgugcagucacgugcaagggccuguuucacagcacacgcgucgugcuggaguauugcauucgagucuuguuauuuucucguuuaugaagguguggcugccagaauguuuucucagcugauucucuacuccagaguggcuucguauggauaugagggucucuuuuuuuggaguuuaguauuguucaucgugauuuagugacauuuuccuggacuaagauguggcgguauaagugggucauugcuggaagaguguccuugguuuuuuauaggauaguguuuuuguuuuuaaagcaggggaccauaccuuuaauaaugaugcuuuuuugggacauugauugguugguuuucugguacuugguaugacucuauuucuugggguucuuaaggguaacuaacuucuuuuuauuuccaugugaaacuuccacugcagagugccucuguccucuacagcauuaacaauuauugaaccuaaguggucuucaacuccccccuccccccaccccgaucuagugcuauggucuuccccaagcuuugggcacacugucuucucucccaggcuagcguaacauuagcuaauggucgccccacucuauggggugaggucuccaggagcuggcuuccccaucuuccaaagauuaguggcacuuugggcggccucucuguuuucuggcuguggugcuggagcaggcuacaggaggccuugcuuuucuuguugauaugaaugaaggcuuuggugggauguguagagaaagucuuagaugagguaucacgggaaccgggaguuagacccugaucacauuagcaaguguaauuucuaucuaaaccuacgcucaucccuagagccaaaacaucaaugcucacaacauggugccuguguucgacauguuaaagaaguccacaggcgcguuagaauuguuacuuuauucggcagcugcgugagcuaacgagauaugccccuucuccuaggguggaugcagucggaaggacagcaacucacuaauaagggaaguuguaauugaugaaagaagcccaaagcuugagucuaggugugcuacuugcuccauuccacgcaugcgugcuucccgcccucucagacgcagucccagaagcccgguggccguggccaggaggcgagguaguggguggggcgcucccucacgcauagcauccuccuccacacucaggaacuugcauaucagcacugcccucugucagccccccaucccccaccccagcuggcccaucucuucuccgcucuuaggucugaaauauuuuauuuggcuuuguaauaauaauaauaauaauaauaauaauaauaauaauaauaauaguuagagucacuuauaggauuuaauuaugugugucauucaacauaauugugaguuuuuaacagagccgagauaacauuguaaguuggaugugacugcagucuucacacuccagccugcuacuuuaucgcuuuaucgcuuacggacucucaguuaaaauaagaaagagccuagcagggaaguaaaaauccuguacuuguaguaguucuauaacgaaacguguauuuaaagccguugcugaauuuauuuccuaaauuguagaugguuuggugucugugaggggggcugacuauaucacaugugggauguaaucuaggauaucaugaagcuauuacuaccauaguuuuagggugauuuuaaauucugcacuauggauuuuuugagauuuaguuuucaccuauuugcauaaaagguggagggguuuauaaucugccuucaaauuacagaauaccauucagaauccucuugcuguuucauuaagagcaaaguaaaauauuguugccauuaugcuauuuauuguuacagugcacuaauuuuggcacagaaauggcuguuuaaaaauccccauauggaacaauauaaaacaggccaaucuguguuuacucagaacauuuucauacagaccuuccaguaagagaguggcaggcuggcgcccucuguugaucauuuuguguaccuacagguaauuuccuuaauuuuguuauguuugucuuuuagggguugguuagagaguuuacucaguuacaguagaauaacaggcccuggauucaguccucagcucuggaaaaaaaaaaagucuagcaucuaugagucuuacacaguaccauaaacugggcugguuugcauaagauacacuguuucauagcuuugcucuauccucagguuacaagcaagaauaucucuaacuuaauaagaugacuguacucagcaguuuuugcacccaaaauaauauauuuuuaaaguauugggauugaaaauaacuaaaguuccagaaauucgagguuugauuuuuuuucccauuuuuuuaaaaagcagacuuacuucuucaaauuuuaugaucaauuagguuucgauuauaguuugagaauauuuuuacuuaauaccuuugcaggaaucuguucuuccuuuguauuaugugggcccuagagaucaaacacagguccccagguuagaccacaaguacccacugacccaucuugccuucccuggcuguguuugugagauaggaucucccuagguagcauaggcuagccuugugugaucuucuggcauaaaugguaucucacuuuguuuuaugcagugugaauucccaauuggaggguugguguuggcuuccaucuuagaauuuucuugaaaauguuuuucuguccccccuccccacauucuauucccucaucuuaauguauuguauguucauucuuuggagcuuacaagaaaugagaugccaugcccaccugcacauaggaacaaagcauaaggugcuuuugaggguggguaucuuucagccauaggaagagcagcccacagguuggcuggguaacaccagacucgaaaagccagcguugcuaaugagcccgaaguacaaguuuugugauaaguugggcaucagaauguaaccagaacacguuauuaggaaguguacuaguuuauguacacucaaaagagggugucucuguaucucccugaaagcuagcuagcugccgacugaacauccuuggagacaaauccuucacauuggucguuaguauucauagcuaccucuuuauuuuaaagcucagcuguuuucgaaagacaugauguguuuuucucucggcagggauucgaguucugaaaauaaagaaggagaauccugcagaggaaagaucgcccugucagguaugcugcagugugucacugcgggucccugaauauguuuauagacugacuauuauugcaggccuugugcauucuguauuuccagcaauccaauguuuagucuaacuauuuaaucauuauggucuacaauugcauggaacuucauggauuggggaaacucugucacaugcuacacacauuguguggguuugucuucucuucaggcacucgagugaguggaagguguguucaagucacuugcuugcuguugagcguuggagagcugggcugcaaacccacaaggguucucucucugucauuuccguuuggaaaggcgguucaagcugcauguuccauggugguuuggcccauguuuggccacugucacugggcugggcuccucaugguugcucagugaauaucagguagaugacuggccacuugcagccgguaaaaugcaaacugccccagccccaccaaguuuuccauucugcccaauucuuuuccuggcucugucuuccauuacacaagccacgugauuuaggcagauuuuucccccacuuucucuugucaacagaggccuugauugagacaccugauuggguugugcaauuguuucauuuccuccauucccucccaucuuugccucugcuggaguggcauuuccugucagcagagcgagcaggcaccuugccacuagauggcgcuuagguugucggucucaguuucuccaaaaugguagccccccaccccuuccguaccaacccccugccacuagauggcgcuuaggcugucucauuucucuaaaacggcagccccccaccccauccacauccccggaagaaguggcauggagaugccacacgauuagcauggcuggcuugcagauaucucaucgcgacacccugcaaacagccuuguggccugagcugaacccccaguaauagcugguguaucccacuggccagagcaagguagagcgccugcuauuguguccccuggccugcugagggacuauucucucucuccaucgcucacagccaugguacugaguuuuauuugaccucacuggcaaaauuggagaaauugcccucagugugugugugugugugugugugugugugugugugugugucgggggggggggcagggggagcaccucagaaaauuauaugaacuucauaaaauccuuuugccuguuuugugguuauuugcguucacgaucagccuuccacuuguggcugacgugcccucagcguguccuguguccuggucuccgucuuguacuuguggcugacaugaggcccacugcuuugccugggccuuuuagcuguggaacagaggacguuugcagacuccucucuacugugccuaaauacauccuaacaugcauagguaaaugcuggagaacuucagagauuucccaccaccacuaaaauauugcccucuucccuugcuucuaauaagguuccacucuguaggcgaaugggguaggugaccuggucagugaguucggugacuuaacauugucuguuguccuguggagaccgcuuguuuacugccaccacguuuagaagagucuugaacaaaaauauuuaaggucaaggaugacuuuucgugaucucagauaccuuuggacagaagccaagguuagcuuuuuuuuuuucuccccaagacaauuugaagccuaauuaaggcgugaacccccgggagaugggacacccgugucauuagcaucauuagcaugauuucagcugacuggacauuuuugcagcccaguuucagaauguuucuaagaucgcgcuguaaacaggacagaccuggauuuugagguuuucacugaccagagcuuccuaacuauacaaauaacagguccaucccauccuucccgcaccaggugaugcgggguggcugguguguguuuucgccucccaguucagugacuagaccaaacugguuacccacaaacggucagcgguuucaguuuuuuguggguuuuuccaucuuucuuucuuuucauauguguacgugcguguuugcauguguguggauguguguaagugccugugcacaugcuaggcuuccggagguuguggcaucccaguccugauguccacacuacucauuuugaugcagggccugucagucacacccacaggucccuggugaugcuuaagucucuagagccaacuuucuuuggggacccccugaggugucggccacagccaccggacaugcacauggguuuugcgauccaaacuguggcugugcagcaagauggccuccaagccaucgccccaguccagucccuaguacacaucaggccagcuacaaugcuguugaggcugucuuaguuugccauaaaaugccagcagagacauuaaaaaaaaaaaaaaagacaaagguggaccacuguaagcugaaacccagcugaucaucugccagaauguagaagguauuucugucauucgauguuggauccuuugcugucugaagacugcacagccaacagggacacagaugagaaagauccccuuacauggagucgaggcgagguauggggaagagcaggauggaacccaagcuguggggaggccugggucaguguccucccaugagcgcgugaacaguuagagcuucgccaccacagccaggacagcugcgagugagacgcacuggccacuguggaaugaaaggagcuaggaggcggccacugugguccagcaagaagugaguuuggacaggccauuagccggguuauaauucaaacacaaugaagacauccguauuaaagucacggguaaaauaccggggucuuauuauggucaacauaaguuaggacugguuuggaauuguagcuaacauaauggcuggaaaacaaagcuauugaaaaaauggaacaggcagauuggauacuuuggaggcuaacgaauggcagauggagaugaccucaggggagggacugagacgcuggaauuaaagcauucaauagaucccgaccggauuuaggagaaauaaauaaaaggcgguaguuuuucuucaaaccagcaaugacuugcuagggaugacaguggaaaaagugucacuuacaguaaagcagcagcccccccccccaagcauuaaauauauaagaaauaaccuuaauuaaaauacacgagcaggagcaggaggcgaagcuccgugggaggguucuucccagccccugggccugacuucuagcccucaaacaaacagaaagccagggugagagcaaaugguaaggguaaaucuguaaugugaagaugaaauauuaaaaaguuauuaguucccugggccagugagggcgcucaacagauaaaggugcuugcuaccaacccucaugaccucaguccuccugaggcccaugacuuccacaagucgccucugaucucugcacacagggagacacaaagucucucucucucucucucucucucucucucucucucucucucucucucucucucucucucucuucacauaugugugugugugaguauauauguauguguguguguguguguguguauauauauauauauauauauauauauauauauauauauaauaaaacacauuccuaaguuguuuugcauaguaaaacauuugagagggaauuuugaccaaaauuaaaaacauucuuaaaaagaaccagugacagucacaugccuccaaaagacaacaacccagcgcagcaggcgucagaaggugucaguugauaacugauucaguuccacacaugaaguguuuggcccaggaacaagcauggauggccucagaagggcacagccaauaaggaagucagcgugacauauacguaaagcuaagauaauauuuagaagaauguauucucacuucagauacuugcaaauuucacacauauuuaauaacuucuaacacacacacaccgccagagcuggagagauggcucaguggcugagaguguguaccaauuuccacaggaccugaguuggguucccagcaucuacauauggcucggaacgaccuauaucacagagccauuggauacagcgcccucuucuggccuucaugggcaucgguccugcaaguggugcagagacaugcaugcaggagaaacacccaucugcauaaaaauaaauauuuuuaaaaaucaucucuaaacaauaauuaggaaauugcuguguauauuucuuuuuguuuuuggugggcccagucugucauggagcucagagguucacaucgugggugaaacaaaaauuaucaaaauaauuguuucuuuuucuuuucuuucuuucuuuuuuuuuuuuugccuucuuuauagauauccgaauaccauuaauguggaaagacuccgaucacuucaguaauaaagaauguacguauagcuuuaauuuguauuuggaaauguuuccucgagugcuuaggacacgcauuugugauuucugaggucagaacucuuugguucggagacacauuggugccauuuggcuauaagcauccugucagcaaacugucgauuucugacuugggggaccgcacaucaguucccugauucagacuaagauaugcauaccaaugaaggggagucaucagcgaugggaacuugugugggggcucagaguggagagauggguagaaagguagagcccccacaccccaaagaggcauggggugagucaguagacgugaaauuucuuuuuuucucuuauuauguaugacucaggaggucugagcuuugcuuugcuagaucguuuaagaggguguaaugaaagauuuuuagauugcugugauuuucuccuccucccccucccccuccuucucuguuucauuggcuacacacagucuucacaaguccauguaucucuuggaucacggacauuaaccucaaaugugcccuagcuguucaaggcagagccgggugacccagcagccccuucauuugccuuguuuaccuugauggcuuuguccauauuccaaaagccaaaugguaucgggcauaauuaguuuuacaugaagaauuuaaaucagguuaguguuuguuuuucaauuaagacguauaauucacuucaccaaggaaugcuugugggauuugagucaaucuucgagauuacugcagagaauaaacuuuccuaaagagcugcguuuucucaguaaugaggauuuagcccuuuaaucaccuggcauuuuuaagaacgucaccagauuggagggucuagcugcuguuguuuguauccaugccugccauuugggcguugggguuuucacauccuuuuuuucccuuacuuauuguuugguggcuguugauacaccuuacaagucaucuuuucuuggacaucaaaacuuggacaucaaauggagucauuuauauguguggcgcuaaauugaccgagaggcauaaaguuugcuaagugaucagauuuggcugcagggaucucuuugggacaccgccgaggggccccguguuuauuuucugauguuccuugguuugagguugggcuugaguggggugagggagugagugaccuccgagugucucacucacacagguaugauuguccugcuugugacggcuccugccgcugucugcugucucuccucuaggcacacagcgcuucgccaucuuuugcuuauucaggaugggagcucagguguuugacacggacauggugauuguggaccagacagucacagauauauguuucgaaaaugucaccaucuuguaaguagccuuaauccucagagggugaaaucugaacuucugccucuuuuuuuuuuuuucuuaucagugaagaaagccuaauuacugucuuuuaaauucugauggccuacauccuggugggccuuggcuucuuuucaaagcaccggcagcuuuaaaauguuuaaaaguuacccccuuuuuuggauccagaauaaaauagaaaucuuauaauuaauacuuagcaagcagacaguugacucaauggcucugcuaaacuucuuauaaauauuuauauuucugucccuacccaaacucugaguaugauagaauuucauuugaugcuugauguaauacagcaaauuugggcauaaagcugauuuucuuuuccuucacaggaaauucaguacaaaaacuaaugaggugguaaagcuuucuuaugaaccguucucuuaagugcuucugacgguggauuuuggggugcucuuucucuuauagcgggcuucucucauguacucaaacaguguagaacagcuugaccaucuuaagggcucuuuuaugggcaggcucauuuuauuauggcccauccuacagagagacaaaaacagcuuccuuggguagccauggacaucauuuuuaacgaacaugagguuuuuuuuuccccuggcccuuggccucucucucaaagucuuuguuggcauaucuccccaugggguuugucucuggggguagggggagcccuugagaugccauuucuagaucaaguggucguagcugccccaacugcccacaggcaaucaccagcauacccuuggccgcggcccguggcacuuuagauuucagaggggucacgucacacugacaggaccguggcagacagcguuccguggcuccugcagcucgcguccuggaguaacuguguaagauguaacaucgaguuacccugggcugucagcaguaacgcgagccuuuuuacaaguuguacucaagccaguggaauuuaguucucuccugccuugggauuagucucaaguucuuguacacuuuuaggcuaacguguaucuccuucauuaucucuuucucuuuacuucuauuuccaaugcugcuaaggacuuuuucuccccccugccaaaauuaucccacucacuaaucgccucuugucuucacaucaguccaccauuguucauguuuugccacagagacaaaaaaguuccuguggggugggggugagggccccccccccacacaggaagaacaauacaaaugauuuggaagacaacauaugauuuauuggcauuuuugggguauaaauauuuuaaauuggccuaaaaauagcugcugacaaauguucuaaauguuaaaaaaaaugugcucuuuguuacgacgcuuguuuuuaauaagucuucaauauuuaugaaucucugguuuuccucuaaauauugacauuuguugcucauuaccaggaauacuguauguuuagacguugccaaguaagaaacuauaaaaauagcugcaagucaguccuuggauguauccaaacuguagauuggcuauuugaauuuuaaagccccaggacugaggccuaccuucugucuucagguggcaucugcggaugaaugcgguucuaaguguguuuuucccuuaguuuuacugcuguuugguugugugguuuguugguguuuuuguguuuuuguuuuuguuuuuguuugagauggcauuucucugguucuguagaccaggcuggccucgaacuugccucuguuucucaagugccaggauuaaaggcgugugccaccacuugguguuguguuuugcacuuuaguaaaucuguccgccuucaccuccccagccgugggguuacaggucccugcuucugugccuggcuuuuuaaaaaaaugaauucuggggaauggacucaggugcacaugcuugcuugccagguauuuuacuaaaucaaucaaucaaucaaucagucaauaaauaaagucauuccccaaguccccaagacugguuuagaagcuaagaguucuaaaagucacagugacccucuuaggccauuuagaaaguaaauaaacgugggcaugguguccccuugcguacgguuuaaacgcugaauuuaaauauugggaagacacccaagggguuuuaguuuugcucucugcugaauuagacucccagccuugucgcugcucucgguuucagcaacgaggcaggaccggacuuccagauaaagauagaagucuacagcugcagcgcagaggaguccucccuaaccaacaccccgaggaagcuggcuaagaagcugaagacguccaucagcaaagccacgggaaggaaaaucagcgcagcgcuccaggaagagagcccagaggcgugcuugcucgcugguucuguggcguaagcucucuaauauagcgugggugguauuucagagcauugucuuucgaugcuuguuuguaauuuaacuggaaaaacauccugcaacagaggggaacucggagguguggccuuuacccagcugagaugcgcuuggccccuucuuugaaggauggaagucaggugaacugcuuuugcguugcuugggauuccacaccuguauuagucgggguucucuagagucacagaacuuacggguagucucuauauaguaagggaauuguugaugauguacaguuaccccaacaguggucagcagcagcugugaauggaaguccaaggaucuagcaguugcucagucccacaaggcaagcaggugaaggagagggagcgaaucuuucuucuuccaauguccuaauguaggucuucagcagaagguguggcccagauuaaagguguguggcaccauggcuggaucugggacuugcuuugucccagaugaccuugaacucagagaucucccugucuuaaucuucugggauucauagccacugugccucaagaucuccaugcugagauccaggucagaaacucaugucucccagacuccagaugaggcccacaggagagccuuccaauucuggaucguaguccauuccagauauagucaaguugacaaccaggaauagcauuacaaugucuaaccagaaagaugaaauguuuuucucaaaagcggccugaauauaucaagugucugcaaccugacucccuaaguggauuucuauaugugugucaugcuuuuuguuuuaauguuuuuaaacaaaccaauauaguaucauuauugcauuuaacaaauuaaaaaaaaaaguccuaugugaccugguagccugcauguuucagacuguacaguccugagguauaacuguucaaaucaggucgguaauaugacaugugagugagccuuuggggcuuguucuagccuguucuauccgcuguuuuccuuggccuuauuuauugaggaaaccagguuuugcagugcgccuguauguguaaucuagcugauuguaucucugugcugcuuugaaagcauuuccccuuguaauggagcugaggguuggauucaggucucaauccgguguguuuucacgcugugucguucgggguucccgucucacuucugagcucccguguuucuagccugacgcgucauccaucauaaagcuugcuaccuguccuuuauucgaugcguuuagcagccauugcucauaaucccguguuucauuggagacgugaaucugaugcucccuagauuugcccugcgugucuuuguaauuacuucucggagaguuuggugcaagguguuuggauucuaauuaauccucuuccccagcugucuccaggugcaccccccaccucuuacccacccaaccucacaccccaacccccacucccccacaaauccuuccagaccaauugagccugccuaaaauauucuugaugugugguuccugguugauuaaccagagucugcagucuuaagaaugcugcugucuguuucuuuagcuggcagcuaaaguagccaguggcuccacagcaaggggugagacuguguccaacuucccucacaccacgcugggaugugguccagcuugggcguccacagguccugugcaugcugucguagcugcuucgaguucaugugaguggcugccuugcccuguccauaacacacgguauccaugcagugauccacugucucugacuacuggacccuuuuugcugucuccuacacugaucccugagccuugggaagaggaggugccggaaaggugcuccguucaguugcccugcauuucuggauaagccagcacgagguagaugaggcuagacccauagaugaugacguagaugaggcuagacccuuuggccugcauuuuucaucaaagcccagugguuuucuugguagccucucguugaguguuccauuauugcucucaggaacaagcauuccagucuugauucuuucaauuuauaauuggccucugcuauuugcccaugaguucgaaugcuagguuauuuuguuuuguuuuauagguguguuucaggaaccuuucauuauuuuauaccaugaaagucugucaaaagacgugauaauacaguggauuuuacccaguccuguccuucaggucugaauguagagugugcuggcucacgcacagcccacagccccucuaaacggucacuugguaggggcuugugcacagcauugguauucagagagcauaagaagauaauuuuugcuuuuuaagauacagaucaaguucaauguugagacuuccacuucaggucuuauuuagccuuuaaccaaaaugagugccuauaaaauaguauguaacuaggagacgguaucuggccaaauauagcuauuuuucuuuucuuaacaagaaugcauuuuucuucucacucccaucuaaguaaucuuuauuuuccauaccccuugauuccucccccccaccccaccccaauauuauagcagucagccuacuugauaggaaaaauguagcugauugaacuuuugggaaguugguaaaggaacgaguguaauguuuuagagacaagcuguugaccagaaugcuucucaagugagaucauuguugguuuggaagaugcccaugcaauuagucacgggcuaaaaaugaagcgacuucaaauaccaucauaaaaugguauuguugggcuucaagaagacagugaacauuuuuggcgaauuuuuaggacguucccuggcgugacucauuuccuccccuuaucuguggaauguaggcuuacugaaaucucuucagcuacaucuugccaguuucccccuaaccagugaauuaacugcuuuuguauugugacuagggcaguguucuucauuguuaaaacauacuuuaaaaaccuguaguaucauuugugauauuuuaguugacuagaagacaaacuaaauuuaaaagcaaaacaaacaagcuacucugugaagagcuagcugaguuaguuaugagcacuggucuucugucugugaccacaguaccagggcaccugagguccccuucuggccucugaggguccugcaggcaaaacagguauccauaaaauaaaaaugaacggcccgagaauaccccgugcuacaucuuaaguuaggaugaagguauaaaacaaucuaacacaucuccaguaagugaagcgugugugguuugaaacguaccgugaagagguuuaaggguggggaagcuaaugucguuucuaaauuuaauuaaggggucacucagcuucccgguacaacuagccuuggaaaggaccccgccgcagggaaguccugggguuccugagauuucagaggucgcuagucagucaggauucuugcaaaaagugcuuauacgccauuguuuguuuuccuugaaaagagccccuuaauuuuaagcuagucgauaaugagacgggcgcgcucucucuagccaccagcaagucaaguugaauucucugaacuuccuuugcaaagguggccggaagucccugcccugcugcucaccuagaccagagaaaugcugccucuuaagaguaccugaaaggaaagcaaguggucacgguucucugccagccaccacugcuuaaccacaccaaucaggucacuaggaaagcggcaugaauuucaggacuagaaucuagagccgcgaagcugggaugcgggagcgcuggguaaggggguuguuguguuggucccauccaguuucaguuguuggggacggggcaugcugcuuugcuucugagcagaauguguuuccuccccuguuucagcuccucccugugauguguguauguuucuacuuaggccgcacccccagaucuccucugaaguuucuugguauuuaaccaguuaucuuccuuggccauaucaucagcuggcuguauucuagcauacccguuuuuuagaagggauuauuagugccuuucgcuuucauacuguuauuuuuagaugugccauuccuaagacucggagguuaaugaccuguauguuuaccuuuuaguaguugggggagaugcuuucuugcgcaugaucauguuuuaaagccugugcuggauauggagauagauauagauauagauauagauauagauauagauauagauauagauauagauauagauauagauauagauauagauauagauauagauauagauauagauucaucuugacacaaacuagggucaacugaagaaauaaccuucaucagauuggccuguaggcaagucuguggagguguuuucuucauuaauauuaaugugggagggccgagcccagcccacuguagguggagccauccccuugggaaguagugcugggcuauauaagaaaggcugagcaaaccauguggauuaagccaguaaguagccuucuuccaaagccccucccucaguuccugcuuccguguuccuaucuugacuuccuuucacggacgauaaaccauaggaugacguaaauccuuuccucuccaaguugcauuuugucauggcguucauuacagcgauggagaagcaaccuaacacaaagccgaagaaaaaccuuaaaaccuguaauucggucuucgcaucauuuuuaccuaacuggacacauaaauaacauaccuuuuccccagugcuccaagugagcacagaugcacgggguccccauagcuuuuuucugugcacagcaagaccacuauuuaucuuuagcuguguuggaaugacugaucucaagugcuaugguugucgguaagaauaaauuauaguguaucuccuacaaauauauaagaaauacauauuaucauaauauuauauauuaagaaaaauauauaagaaauauggaagacacuacaauuucuuucuuucuuuuuuuuuuuuuuuuuuuuuuuuuuugguuuuucgaagcagguuuucucuguauagcccuggcuguccuggaacucacuuuguagaccaggcuggccucgaacucagaaaucugccugccucugccucccgaaugcugggauuaaaggcaugcgccaccaccgccuggcacuacaauuucuuauauauaaaguauugugugucugcuagaaauaaacccguggcauauguguuuauuuuugguuucuguuuuguuugcuuucuuucuuccugccucucuuggauguuuucucuucuguaguucauguacacagagacaacuugucugcucuguugagcuccucggacuuuggccuggucuauagcaucagagucuucccacgcucuucgaccuucuaccacugaccacauccaucgaugaucuuuagaucucucuccucccuucagagucccacuccugccgugaugggaugguuuguauaagcuuggcccagggaguggcacuauuaggagguguggccuuauuauaguggguguggccuuguuagagugggugugucauugugggaggggccuuaagacccucaucuuagcggcauggaagucagucuuccaccagcagccuucagaugaagauguagaacucucagcuccuucuccagcaccaugccugccuggguacucccauguucccagaaccuucaugauaguggacugaacuucugaaccuguaagccagccccaauuaaauguuguuuuuauaagaguuaccuuggucauggugucuguuaacagcaguaaaacccuaagacaggugaguaccaggcuugguuuaaugcuuugugguuguucuuuuugauuuguuuuuguuuuguuaucacuucgacgccugcacuccugaaggcuuaagaaaaaaaguaaccaguccuuucuuugagauggauaaugaccacuguggcagcuccugucacaaccaggcaucucuuuaguuucuguggccuuugauuuugccucuuaaaggauuaggcgugauuuucuuuuuuuuuuuccccaacccccaaggucucuccauucccccucucacugucgauccuugugcuucggguacgguggacauucuugauugucagggacugcacaugcuggccuucugucgagucccccaguccacuggacuccucucugugugucuagggcucaugggcuucaggacuagaucccacuggaccugucuucucggugauugagauagaguccuaaucacuuccuacuucccagggccaucggcuucucuucuacucucccaucucccaaguacaucagcucgcugaagggccuccauaguucuccaucucaggaaaugguuuccauaggcuugucucaccuuucuccacucucuuggauugcuuuaguuguccuuccuccugccucccgaaucgcagcccacagaaguccuguuugaccagccaggcagccacauucugccacaccugguguuuggcucauugguguccuccuucuggauaaacccagcuggucacucuccaugcaguagcucuuugacuugucuucuuggacagcacuuucuuggcuuuuuuuucccccuuucccuuaguuacuguuccucccuugccuccucugcuugcugcuuuccaacuuacuccaaauugucguaauugcucaccagccuuuacaagcucuuaggcuuucauugcugugaacagacaccgugaccaaggcaagucuuauaaagggaaacauucacuuggggcuggcuuacagguucagagguucaggguguuaucauccucgccggaagcaugguagcaugcaggcagacauaguacuggaggagcccagaguucuacaucuugaucugcaggcagcagaaggggacugucuucugcaggcagccaugaggggagucucauuccacuggccagacuugaguguguguguguguguguguguguguguguguguaugaccucaaagccccaccuccacagcgaugcacuuccucuaauaaggccacaccuuuugcaauaaggccacaccuccaaacagccauuucccaugggccaagccuauucaacaccacacuuggcuuucuaauucucauuaaauuucaccucugcaccugaagcucucaaauuuagauauucauugucuucuggcucaacaccuaccuuccugcccaauaauggcaauuaaauggaauugauccaaacuagagcccguaucuaauccuccuucgccacccauccccccguggaauuaguuagugauuccauuuuucuaguugcuugcacagaaagccuggguguucuuccaaugcugcguucacacugagucagcuuugagaagguguuaauaugucaccuccuuccgcacugccccgggccugcaucugcccuaguugauauuucuguuugcauuuuagacacucccccccccccccaaacaacagccacagggaccgguucauucugguaggacucagaccuuagcagcugccucuacccgaaacccaccaacccaccgugcucacuucaaguaucacucagagaaagauccaguaguaucuuugucccacgaguuagugcuguguguagcuucugcucccugcuggcccaguuggacauccaguauuacugagagucuaucccacugcuggccaguuggacaucaagcaucaccaugaguccgcccccugcuggccaguuggauauccagcaucacugugagucugcccccugcuggccaguugggcauccagcaucaccacccuucucacuacauuccaaccaaucacugcaugggcagcugagccacugggccugagcucccaugguuuuugugacugaguuaucccuucucugcucaugucuccacacaaauaugacuuguguacaaggggcuuccucuucucugcucauccaaaauagccuuuuuccaccuuaauccuccuucugggccuuaccuagcaucucguaccuauuauaauuggauauuuuuuugauuuuuuuuuccuugaaagagagcacuccuccacccuccauugcuuacuguagccucggugacacaggcagacaacucuagcucacugucagucaucuuucuccaaaagauaacagauucugcauccaguggcggauaggaagucuguuucauuuucuuucauaagggaagaacgauauugcuuuuauccacuuaaaacacuugauaguucuccaaaauguaguuccaggaaccaagugaacaucuggggagggugcuccuauauuauaccuuguuaucacacagcuggcgacguguugacaggcaguucugggugccguuccggcguuccuugugccguggagcgccucaguuauuuugguucauucuccagucuucuccagcacuuccucaguuuugcaggggaaugggggugcacauagauguuaggagaaaauaaaagguugauugugaaaggcucuguggaaacgugcauggugugugucagggauagccgagguuagcccacauggaacaggcagugcuagcagaggguagcccacauggaacaggcagugcuagcagaggguagcccacauggaacaggcaaugcuagccgagguuagcccacauggaacaggcaaugcuaguugaggaaagcccacauggaacaggcagugcuaguugaggaaagcccacauagaacaggcagugcuagcagaggguagcccacauggaacaggcagugcuagcagaggguagcccacaugcaacaggcagugcuagccgaggguagcccacauggaacaggcagggcuagcagaggauaacuuauacagaacaugagacauucauaaucauuaacuggaaacacuguguugaaaguuauuccggucaguaaggauuacacaauuaaagaccaagagaaugggcuggagcaagggcucagugguucugagcaccggcuacccuuucagaggaccuggguuccacgccuagcacccacauggcugcccacaaccauuuguaacucuagcuccuggagaucugaugcccucugagggcaccaaacacacaugugguacaugggcauaccugcaggcagaacacucauacacgagaaacuuuaccagagaacauuuucuggagugucuguccuuuaaucuuagagaacauguaugugucccugaauguuugccgugugcacauuuuuuuuuuaaaucauagagauuccaugaaggaaggucugugugcuugcuaacugcguacauguuuucauucuagagagcucauuaaagauuuagugggaggucaguuugugaaauaccaccuggcacagugaaaaaccguccuguaagaccugucucuuccccagaguuggucugugucugugagcacacacguguaccuuuagcauguuccggggugguuuaagauucuacuguucaggaaaauaauaaaaccaugaaaacucauaaauuaagguuacaggugccaggcagugguggcacaugccuuuaauuccagcacuugggagucagaggcaggcagauuucugaguuugaggccagccuggucuacagaguugaguuccagaacaccagagcuacacagagaaacccugucuugaaacacaaaacaaacaacaaacaaacaaacaaacaaaaaaguaagguuacuggcauggaaaauauaguuguuauuuaugaacagaaauucauuuuuuuguccuguucugggaauugaauuuaaggccucacacauacuaggcaaacccuuuaccacugagcccagccccaaaugcaauuuuucuaaccauucacuaccaagguacauauuucaucuccaugaugccuuaagaauuccacaagagugcuuuguuaauauaaacacaaaacaggaccacagugagaaggcucgauggccucccucaccuauaauguggguagaaacuccagaccuuugaguccguaaccggaaggagaugacauuugucagacaguuaggaguuaaugugggaaagacagaugcuaacaguguacucccgcagagagagcugaggcuggcaaggaugaugcugagggguuuuaaagggagacuaggaagaaggaaaaaaacaaaaaaacaaaaacggggggggggggcgaggaagagcgagagcucagagugccggaaguagaaacgucaaagcgucgaaggaagccugaacaggucugggugcagcuugccuggucguaccaauagggacagcaaugaguuaggccggcuaaacagacuaggacacagggagagguggggcuggaaccgauguggaguucuucacgcagcccugaguuugaguuuucucagcccaucgaagucaaaggucaacugugcguaucucgcuuggucauuuugccucucccccuggagcucauccauccaguuagcgugacuggcccguggauccacgcaucucugccaccauugcugagaguacagaugugcaccgcuugagaguuuacgcggcugauggggaucugggcuuggguccccaugauggcaagucaagucauuuaccugcugagccaucucgccagcccugagaucucuuuguaacugcuuaagugccaguccucagggacacccucucugacuuucucaucaugacacuucucauccacguuguuucuuucauugaaaagguuggaugaccacuagaaaucgccgguguuuuauaaauuuguaucucuguuucgccucuugccugcaccaggauaucauguugaaucuuguuuacagcuaaagccuauagccuagccuaagacuuagcacgguguagggaccguguaaauguagggacagagacccuucauugaaauaauuugugauacaaaaaccuuagagauuuuauugccaaaauaugaagugauaaagcugcuaaaucgguuaauagcuuguccugacuauaaaucugccaucugugauauauagacuuggaaaccaggaaacucugagauagggucucacuucggaguccaggaccacagucuuuaggcucugccuccgauuugccgagaccacuggggugugccaccaugugugucuuguauagcuaaacuuuuuaaaauuuuuauuauggcagaauguaugugacuuaaauuggccauuuugacagguuuugagaacucaggucagugguauaaaggggaauaaguuucguuggcuguccuggauggccauucccaccaaccaucuccagaaauuucucaccuuccugaacugaaauucuguaccuauuuggcucuaaccgcucuucuccccuccccacucagccucccaaggcaccgcccuccuuccuaaggguuggaccaccacagaugcauguuccccgugagggcaucugagauguguuucuuuuguggcagaaaucuuucauuuagcauaacgucuuucaggucauccacauaguauguagaguaugucagaaugcucuuccuuuugaagugagauaauucuuuacagugucuggauguguagacggagagauaguaagugauugguaaauugaaagguugauagguaaauagguaaauggcguuuauccauucaugccugauacacacuugaguuuuucagcucucugggucuuguaaauaacaccucuguaaacacagcacaauggugcgcgugcacacacacacacacacacacacacacacacacacacacacacuuauucccaugcuuguuuuauguucuugggggguguguauucaagcagaacuucuggauuacccugugauuuuucucuuuuguuuuuuaguuuuugggggaaccauggugcuggucuccgcagccgcugccucauggcucuggcugggaguuuacgcaagguucccgauucuccacaccccagcuagcauuccuuauguuguguacgccaaacccagcuuugguuuugguaguggccaguuuucuuaguaguagauguuaaguagagggugcucuguggucgauuuacacuggaaauguuccccucacuugguuacauuucuuuuuuugugccuuuugaguguuucuagagaaauguuguuugggucauugacgguguuuguuuguuuguuuuuuuaagaucagguuguuuguuguuuguuguuuuuauuuaguugaucauuugaauaguugaccacguagauaacuacacguaaggauauuuaaagaugcauucucucuuguccucagaggugcaaaguaccauuugcuggcucauaccacccugaccuuggaaaaugcuggagacugcuuuaagacccauaaccugucuguucacggagauggugagugugcuguguguuauuucuuguguauuuauuagguauguacacguggugacgguaauuccuaauuuuagcauguucccccgaaaggagauaauggcuugaaaaauauacucauggaugagucugguuuuuuccccaguguguuucucucuucccuacaggagaaaaauuaaggucuccccccuccccacuuucuaaaucugacuuacaguaggaagaacugaagucuucuguguccuuauaugaggcucagagaugauguuucucgucucugcuagcuggguggucagaugugucugguuuuaaaguuaaugauuaaggcagccacccccuucuguugguagaaagcacaggguugguagaaagcagaggguaugaagaaaguaggguuauguucauuuuaaucacuuucuuucugaauaauaaugguaguuuuucucucuuguucccccuaaaaggaaucuaugggaauguguaagaagcuuaggugacaaggaaggcuugugaggggaaguggggggggguaugggggacuuuugggauagcauuggaaauguaauugaggaaaauacguaauaaauuuuuuuaauuaaaaauaaauaaauaaauaaauaaauaaauaaauaaauaaauaaauaaauaaaggaaggcuugugagcacuuugccagcuguaccugggaugggaaguacagagcaguguugggcuaggagcucagcuguaggaacugaguugcacacgugcugguuuuccaggggaacgucuauggaacgcgugcaggcugauggccacugcuucaugcuuaaugcucagaggccucagugcuaugggauggaugauuucauggugacuuuuuuguuauaagcguggucuuuaauuucucaaacccuauuuuuaaugaugguucuuaaacauuuaaccuuccuucuagcccaccacccaccagagguagugggaaagaaacauuauuaggauauaaguggagaagcggaucuguuuagaaugggucuuuggagcaguucaguucacagcucagcagcgguagcucgauccauucgcaaacauuuuauggcuuuaccacuaguccaguucaguagugucgggauaguggcagugcuggcaggacuuaguaggaacagccaggccucagccgaauccagcaugcuugcggcagugggagggacuagaaccagcagggacucagggagaggaguucuuugcugugccucucucaacaaagcaaagaucgagggagaagaaucgucauaaagcuagcucuauaagcaagccccucucacgguccuuugagucccauuuauacuccugccaaacaucacguguccucccuugaucuugccuuguugaugugucuugccuugguacacgagucugucuuagcaaaacucuaugugagucugucucagcuggcaucacucugccaaugggccuaaguccaaggaagcggcaagaagccgcagcacaccaccagcagcuuuucggugugguuucucucuguagagacaacaaauggagcucaacuagacaauguaaggcggacuaaugcacgcgugucguuagugaagaauccuucaucacgugucuuuucacgugcuugcuucagcagagcauccuuucaccugugucugcuucaggaaaacauuuccuucauguguuugccccagcaaaacaccauccgacauaacugacucuccaaagaacucuuaaguuuccacuucauauaagaaauuuuacuaagaacagggggaggguggugggcuguaaaaccugugaccauuuaaagagcaucucuagcuacuacucaccaauaccaggcccccucagaacucuggauguagaugucccagcuuccgugacauucgcuucccuguuggucucucauggcuaugccauccguacagcuuuccccgcaugccaugguuugaacugugauggggaugagcuguguauuaaacugucuuuaguggcgagcauuugugauuccugcuguacuacuacuacacaguguugguuuucucucccccccaccccccucucuuucucugcuuuccuauggcuugagucaguaccaaaaaguaucuucauaggucuauguggaccuaguccaaaugugagcuuuauaaaugugaaaucacacacacacacacacacacacacacacacacacacacacacacacacacacugccuuauauggccccuguggcauugucugcccccaaucuguuucucuucaggacuucuuuuccucuugguuuuaaugcucaucccugaaacaggcccagcagccuuacccacuagcauguuaauuauuuguuagaaauaaugguggauucgcauagucucugcggcaagcagugugaacagaucuaguuuuguguuccaguuuuugugguucuucuguuuuacuuuguaugacuucagccucuguuauuuagugcacauaauuuuuaaauagugguuuuuuauuguuaguuuagcauauauuuuuuacauuuauauauuacauauuacauguuacauuuacauauauauuauacacacacacauauaauauauaccauaggccugucucuuccaacaagggguuauuacuuuuaucauuugaauuucccucuguuuguaaaauuaugcacuauguuuuaauaucuuagaaauuacucauaaauuguuuuuuuaaguuuuauuauuauacauaaguacacuguagcugucuucagacacaccagaugagggcaucagaucucauuacagauggaugugagccaccaugugguugcugggauuugaacucaggaccuucagaagagcagucagugcucuuacccacugagccaucucuccaaccccuacucuuaaauuguaaucaccuaaauaaacaauaagagaucauuuuuacuuuuucuaagacagcaugaaagcuuuagaaggauagcauguguuucccuaaucugugcauucuugcuauagaacauaauucuguuuguuucugagugucacgggguacauugagcuugaccuagcuuaaccccaugcucugacuguucauaggggacaacuugacuucuauaucuugaacuugggauuucccccacacacacuuucuuuuucucaaaacaaucuuuagaguuucuuuuagaaaaacuuugggcaggggguguccugggacuuuugacuucacucuugaaaggcauuuuuacgggauaugcuugguacuuucauuucuguccaucuuguccccuugguucagaaggaaugauuaaguacuuugagauguguuggguacaggguugagaguggccaugaaacauggacagagugacuggggcagugagacugcccuggggaugugagcagagagggagcuggcaggugccaggugcauggacgauaccauacauggaccgugggcauaggaacccugccuaaggcaggugguguuuuauaaguguagagauugauacucagguuaauugagucuccuagacguccucuuucuugagggaagcacagagaagcugugguuguuuuauuccucaguagucugagacuguaagaaagcccagguaagagguggcagguggaggcagaguauaugacaacugcuuuguggaacuagggacccaguguuuuucaaggaugcuaggaugggaugcugcuacaucugcccucaagacuaugauaggaagggauucuauaucugcauccucuucgcaagggugaugcaggaagggaucuaacaucuccauucagggaugcugcaggagggaacucugcauccaacaucuccauucaaggaugcugcaggaaggaggauuuuuuuuuccuuuccuuacaugaaaucugagcucaguuuaugagacgcacauuauuagaugugguguguuagguucagauacauuauugauugcacaaacuuuauggacuugccuacaaaucuaaucauuuaugauucugcgucauggggaauuacauucuaaguaaaaaaaaaaaagcaacucacagauauuuacaacauaagccauucauaaauuugagauuccuauauaaaaggaauuuauguguugcucagacgcuaggcuguggagagauuuuguuuuguuuagugcuuguuguagaaaaagguaacucccacuuacugcuuugugucugugccuggacaucacugaguguuucguguagauguguggauccuaccaggucaccuuuacugagcccugaauaaaaaccacauuccauuagucccagaggaaugcuauugugguaggccauaauaggcugaugcauggggaaguuguuaaagcucuguaguuuuaccuuugucucuuuauuuugaccaguucauugcuucucggccuuuuggcuaagaucaaguguauuuugaccaguucccuccuugacugauaacuaagcuuugguuauuuauauacuacuguauauuuuaguuuaugcucaguauccugguuagugucugauaucuugacacaccuaggaagaaccccuuugaagaauuuccuccauucagcuggccugugagcaugucuguggagcauuuucuugcuggcuaauugauagaggaaggccuggcccacuaugggugguaccaucccuaggcaggugggucugggcuguauagugagcuuagugagcagaagccagagagcaagcugguaauuagcauuccuccagguuccugccuugaguucccuccccugccuucccucauugauggacuauuaucuggaaguguaagcugaacgccucuucucccugaaucgcuuuuggucaccgcauucaucacagcaacagaaagcaaacuagaucgcaaaggaacuguauuuuuacccagaaccaguauuuuuuuuucaaagucucuaagguuuuaaguaaauaauaauuccagccaacagcuagauaucaggaugcagugaacauucaaagaaaucuuuuuuuacgugggacaaccugagaugagggcacauacuggauauuuguguacacccuguacacagguuacauuuucuggcgcuuuucuucuacauggauaggagggauuuauuccuacugcugugcugccuuagagagaugccaacauguugggugguuuguuuguuuguuugucguccccccccccaccucuugcuccagcccugcuuugguugagagaacuuuucuuuucuuuucuuuucuuuucuuuucuuuucuuuucuuuucuuuuccuuuccuuucuuuucuuuucuuuucuuuucuuuuccuuuucuuuucuuuucuuuucuuuucuuuuuugguuuuucgagacagaguuucucuguauagcccuggcuguccuggaacucacuuuguagaccaggcuggccucgaacucagaaauccgccugccucugccucccgagugcugggauuaaaggcgugugcugccacgccuggcgagagaacuuuucaaaauaaucuccaacuuaaaacagaaaacuuacaaguuuauugccaaggucuucccucccccacacaugcuaccgagcugcuuacagcucacaaaccccaagaaccuuaaguacccucgaccaccaccgccugcuucagcaagcaagguucuuucuaaugcagaccccaugcuuccugcccugcuccauugaaaggacguagcaccccugcaucaauuuccaagucuccucuugacucucacaaacuuagcaucugucuuagucaggguuucuauuccugcacaaaacaucaugaccaagaagcaaguuggggaggaaaggguuaauucagcuuccacauugcuguucaucaccaaaggaagucaggacuggaacucaagcaggucaggaagcaggagcugaugcagaggccauggagggauguuacuuacguacuggcuuacuuccccuggcuugcucagccugcucucuuauagaacccaagacuaccagcccagagauggcaccacccacaaggggccuuucccccuugaucacuaauugagaaaaugccuuacagcugcaucucacggaggcauuuccucaagggaggcuccuuucucugugauaacuccagcuugcgucaaguugacacaaacccagccaguacagcaucuuuagagagacgagcugguugucugggaggaggcccucccuugugcuugccggaugcuggcuugcugugugacuugaguaugucuccagggccauccucccugccuauugguggccguugcugaguuucugacuguuaaggcugucuucugauucccuggcuaugcauaugcauucugugguuggagccagugggucuaagacguguaagcaagcguucccuauuggccuuaccauaggaggccucugucuuuccuguuggccagaggagcaccacagcgugccaaugucuuuguucacucugaaguuguguauguuguagaggugguagcagggagacauucaagaggcgugagcccuuccacggcuccucuuggagcacugccugaccuccuuggaauaccaagauauuucagcccauugugcuccaucccugauuggggguggggggaagggugaacccuggguucugcuccuuuugcuuagugcaccggggaaucaccacaucauggugucuucucauuguucaugagggggcuggggccacccaaccaacauggucacucuuuuguuuuuccugcuugguugggacuccucacacuaggcuauccuucacuccaggccuguacacccugcucagucuaaucuuucuagucuguacagcugcuguguaagcucugccuuggugugaacaccccuuggccagcucacugaagcucugaugccuuacacugauggcuuccucucccuccucuuuuccuuccucuuccccucuuucuccuccuguccugccucuuucuccucucccuccuccucuccuuccucucuuccccacucucccucuuccucuucuucuuccucuuccuccuccaucccuucuucuucuucccacucucccuccuccucucucaccucuccccacucucccuccucccuccccuccuccuguuccuugcuuggugucaucacccagcacagcccucacaguuccuccccuccccucucagggcucacccucaaggcugccccucguggcucaugaguacuuguucaacuggaggaggagaaggaguagggcgaagguguuuaaguaucucaacauggguaaaauaauguuccacuugaggcucaccuuacuaauuacucuaaugaaaacuagagcaagaggggaaaucugacaaccaccaaucagugcaguagacuacuuugugugaaacuaugaagagcccccuugaauaauugcuucugaagugaagagacuagagguugccgcucuuccaguugaccacaguguugguccgggccaguccugaccucuuucacaugcuuggguacgccauuaacauucaggcaggugaaccuauaugucagaugaauguuaaaauauguuaacaauaaagcaaacaaaauuaaagaaaaggaaaaacucuggacuguguaacaaccguaaauguacauuuauaacuugccccuuucuccccuugcuuccuuaaacagaggaguguuccuuuuggcuucccuuguauggcaacgugugcugccggcugguggcccagccagcuugcauggcugcagaugcauuugcaggauuccuuaaugaacagguagaacacgucacaugucccucggcuugggguaccagucggacucucuaugcaggcguuugcucgagagggccuuucuggaaguguuaguuuuuuuuuuaaauauugucagaugugagccgugaaaggauggaggcuggaugacuggggcagccucuccaguucucucuggcuccccaucccacaagcacaggcccaggaugguggcagugauucucuuguggaagcugacccuggcuaugcagcaccuuucacauaaagacucuucuggcagacagcauuuggcacaguuugagccucugggcuuccaaagcugccucugggccacccccuccugauuuauucauagccauaguuauuucuauucaguaaauaauuaauugugggcuucaaugaaucaauagcuuuuuuuuuuuuuuuuuuugcuaaaagauuccauuagaaggaaagaaaaaucugcauucuuaccagguagucaacaucuucuaguguucuggaaaaaaaaaaaaaagaagggaaauuauuuucaguguggagagaguuauuuuuauaauuucccugagucuuuugaugaauugccgcagaauucuaagcacuagauucuaauagacuagcuuucccaaaucuguguugauuuaugauuuucuguguguaaaauuguaugguaauaauuaccuucauuuugcuuaaugcuucugagaacuccaggcgucuccuccgcucuuggguuugaggugcucagccuuaacuguacagccgaugcauagcuaauuccgggccguuuuuaaaguucuaaaaccuucacugauuauguaaauaccgagcugggguuaaaguuaaggggguugugauggaaauugauaauugauaguuguuugacuuuuuuuuuuccuuccagcaaacaggaaaaggucugguuggcuggagaaggcuguacugugcucugagaggggguaaacuccgcugcuuuuaugguccggaagaaauugaagcuaaaguggagccggcucuggugguuccuauugacaaggugagcggcuugcaguuccagggcgagcacugagccguagccccagcccugugagaugcuguguucacgaggagaucauggcuccugaaguuuauggucgcguuuguucuugacauucuugacgucacaaagaaaaggagccaagggcuguggagacggguuauuaacggaauguuaucuuucuuugcacagagaggcuacugauggggccagucacucucuaguccuuaggaacacaucaugauggaaguggaugcuaacagacaggccuuaaagcccagaauauguaugacccccaccuugaugagauaucugugggagcuggagacuuggcucauugcuuaagaugguuuccugcccuugcaggggaccugaauucaguccccaguacccacaucaugccacuaaagugauuuaacuccaacucaaggggauccgauacccucuucuggcuucugagagcacauguguacacauaacuaauacacacucacagagacaaaugaauaaaaagaaaccaaaaacuuuaaaaggcuuuuuuaaaaguuagaaaguugguuuuuuguuuuuuguuuuuguuuuuuuuuuuaacuuauauaauuucaugaguuuaagggaugcuauaaauauaaaucgucagcccaggcuauggugauguucuuccuuguuaauacucaaacgaguucauuaaaagaccuucucauuucuugugggaugaaggggcaguuggccauaccucugccagcaaaggaaagccugucacugcacuuagaacaugugaggaugcagacuacacuuagaccaucccacucgagugucugccaaggcucuucauccauggguuugacacaagaaagcaacaucgcugucuaguuacaagcuuuucacauaaaauucuguagggaaguaagugucagcacaggaccgaguuucuuucacgacaaucuugauuucaccucuuuuguuacagcccuccgcugacagaacccuucccuagaauacuuucaaugaugucucuggagccaaauccuaauuguuuuugguuuuguuuuuaacucuuuccaauaaagaggccuaucuggacugggugauuggauaggaaccguagcaucuuuagcugugugcugucuacccuucuaaucuaaagagugacguaaagucacgugugauuuuacguaaaagucguacuccaaaauacaugggaaccauguuuuuuuuuuucuaaucugucuggacuugaauuuaguucuuuaguucuuuuccagcaauauauuuuuaucuaguuuuuagaaaaaaaaaugguuuugcucuuuacccaaaggaaguuguguaguaagacuuuuuaaucucauaaaguccacuuaacuuaauguuuuuauuugcaaguucuucaugauaaaguuuuaauuaaaaaaaaguuuaaagaguuauucuuuaaacacauaaauaaauaaugccuccauauuaaaauauaaugaacuuaucuugguuuagaaaaauggguuuaugaaguauguaauuauauuagugaacaaucucaucguuugccaacuuugcauuuuguuuuguucacgcaaucucuuuagucuuuuacuacuuugaaaaauucaaauguaaaaaaagguugcaauugaagccagccacccaugcccuugaacagacaggacuuccccaagucugcccuuccagccuucuacuguuguuaacggccuucucucuccugguuauuucucuuucugggucauuugaaaaucaguugcaaacagcaccuuucuacuaacaggaaggauacuuuguauauaacuguaacauuaucaccuacaggaagucuguugcugaagcaguguuacuacacagagacggauugcggcccuagcacagcuaacauucguugauugauugcuuugcuccaagaccccuaagcacccaaguccuuugcucccauuaccuaaucguggcccagccugccuuuguuuuccuuuggugacccugacauguuuuuuuaaguucaggucucgucugagggggaaguguagaugacuggauguucgcagggaaauugccuaggucuggccuuagagcuggaggaaacacccaugaaugacauuugaccucuacacgcuugaaagugcuuuauuagccaaagugguaggaaggaagguugagucuuugagauccgcaaucuuguugcgauuuaaauacuagacauuggccacuugcguauguucacacugggacuugguucucuagaggugcucuccuuuggagcccuucccucucugcugagcccuccccucccucugcugagcccucuccucccucugcugagccccccuuccucugcugagcccuccucuuccuuuucugagcgcuccccucucucugcugagcccuccccucccucuucugagcccucccaucucugcugagcccuccccuccucucugcugagcccucucuucccucuucugaacccucccccucugcugagcccuccccccucugcugagcccuccccuccucucugcugagcccuccccuccucucugcugagcccuccccucccucucugcugagcccucuccucccucugcugagcccuccccuuccucucugcugagcccucuccuuccucugcugagcccuccccucucucucugcugaguccucccccuagcccucccaugggccucacaacuuuccgcucacaguaccaccaucaaucuagguauucaaaucugccacacugucccaggaguauugucacucccuaaaacacgaugguuaugucauugcuuauuccaguuuuucucaguuccaaaagugagucagaugugcagaaaagucagaagaaacacagcggucggccucguggccaaccccuuugauucaacaaaccugugguauuuuucugucaauucccuggucucauuucuuugcugauguguuugaacccaagguugaugcaccucccugaggaacacaacuugugaaacagcuauuucacgccuguguuguaacagcugagaaauguaacagugcgguccaacauacauauaguccaucuuuaaauuaucccuucgcuguccaaaauggcugcuuggcuugaguuuuuaaugcaggacucuccagauuagcuucccuaccccaagcaaggugcuggcuagugcccugcuggcccggggacugcacugugguucccauggacuggcuguuucccuaaccuuuucccauucccucuuacuguguaauaaacucguacauuuuuguaucucucuaauuuuggggcuuuaaaauacaugguagauuuucguuuguuguuuuuuguuuguuuguuuugguggggggggggcggggugagacaguguuucucuguguagcccaggcugucuuggaacucagaaaucuuccugccucugccucccaagugcuuggguagauuuucuugauggccuuuucuugugauguuccaauaguauuuguguuuaaggccaccauaaagaccaugugagcagcuaaguuugguaaccgcucagcugugacauguccgauacaguucuccgcuuggauugcaggggguggggcuucugcucucagacuguaauucuuguccugcuaaauggcauuuccuguaaggccaaguggguucauuaauuuucauagggagccaucuguggaaauggucacauuaagggaagaaaaacguaaaagcuauuccccggguacuuucaauccaaauuugaaagggugauuuacuucaaagcgauuacuucaacuucaaaaaacuucacccugaauguuguuugggcaaaacacucaaugguggguacuuaaggacagucucuguguacugcagaaagcgcuuuauuagccgaagcuauaucuguggcugguagggugggaaaaagcuagagucuucgagaucagcagucuguuuugauuuacauacuagacaucaguuauuucuauaauagaucugugcugaaucaaucaauaacucuacucggugugauagguuuuauugaauugucucaaacaugcuuuuaacuauuauauuuaucaagcgcauuuagaaagcccaauaaccacagaucgcauggcauguuuucucauuccugguagucauuuugauaucggaagccugucagcuacacaguuguccuugauuaaauauagccuccacaacuguuaguagugccuuucucgaggcguuuacaaucaguggacgcuaucgacagaaauugaagguaacuauuucaaacugauauuggccaugccugacgcuuggcuuaaucgaugacugcgcuauacacaguucagacauccccucuccguguccuguggaugugcgcaugcuccguccucagaccugggucagugauggugucgguuuuaagcaccgcuauuuucauuccagaucaacuugucuucauggcauauuguggggaaggaaggaaaugucgccuggaucacagacaacucagagggaagaaagugacuuuuuaacaacauauuuuauuuuuaaauucucaagauagucaauacaggacaguguaauugagccccgcuuaagcauucuauucuucucuacaagccuaaggauuuaacuuauguaucucccaguuguauaacgacaaaauauguuuuauguacauguagccauauguaguuaauauaauaauaauaauaguaauaguaauaaauaauguagacaguacuuccauuuccuaguagccaggauuuugucaccauuugggucuaauuccagauggaggaccuuacuagaaucaguuggaguuuuggauggucuuuguugcuguccccaccuuccuuccccaacacaccgccaacauaguuuauuuguuggagaaauagucguucagaugagagcuucccaucaucugaauuccucuguuugcauuucugagguuugggaaugcugguuggaguugguauggagcaggaauauauuuugaaaacacaugacuguguacagagguguaaaauacaucugagccgguggcuccucauggcacccaucuguggugcugcuuaaggucuuuuacugccaacugcaagcugucagucucguagcauccuguguuuacugcuagguuaucucuacgguaccucugggaggcagcaggaugagcugugugcaugugugcaugugugugcaugucucuguguguguuugaguacaugugaccaaaacaacuaacauccuucaaaagugcccauugaguuaguuuguuauguguuuagaauucaagggcuagaauucaaucuaacccucuccuuuguuuuuccugcugaugcuucuguugucccagagacuaacagagucccucaggugguacacuugacaggaaucugcaaucuucaauuucuggugggacaggagacuugagaaucaucuucucccauggugacccaaguguuuuccccagaguaguuuuuuaggaaaggugcuuaaggaaaaccacaaccugggugcagcagguuuggagaggguggaacacauuuuaauucaaagugauaaaagccaaaaggaaaagcccucgugaccucagagugugucuuugcugcagaguugagcucucguggucuucccagggaacccucccaucuuacucugcagcagggcacagggacauccugaugagcaaagucacagcaagccacccaucaccauaaucccagguccaucacaaaccggaagagccgaguggaaagcguccucagagaacggaaggaccgcgcaugaucagugcucucaaaccaaaccgacgcuuuggacaguagaaaaaguaaagcaggaaucgggucgcaucaucugcuucucucucggaaagucugugagcgaugcgcuucguuuagaugcugguccugaauuccgccuuggugaugcacuucaccugugguucuuccccggucucauucuuuccuucaaaaccgugcagccacauccugggugcuagauacuaaguuguccuugagaugggacaaaucccgugacuaggucauuuccagacuuugcguuuuuguauccugugaugagaaacauugagcaucuguccuugcugugaguuuaggauauaggucugaaauuuauccugcucuuuucucaugauuucaucuuuggaggaggauggaagugagccugguuugaugucaccagugcaacaaucagccuggguggacuucaacacccgacaagccacacuugugcaaaucucuuucuuugacagacaguuuuuaauuacaaauauuucccauuaguuagaguagcugggugauaaaauauaauuuaauguaaacucugcauuuaauuuucacuuguuuaaaaaaaagcaagcaagcaaacaaacaaaccagcaugcaaaaguauuugacauaugccauuucucgugaggcagaggcaggcagaucucugaguucacauccagccuguucuacauaaugaguucaggucagccagaucuacauagugagacccucucucaaaauaaacaaaaucccuaccuugggauuuuuuaaaucuguaacagugccuauggguacuguaguuaauagaggauguaauauuaaccuauauuguugaccugaauuuacuugagagauaaauggucugcuucaucauucucugcuucaagucgcuucauuagaaacaauaacucuuagauauauaaacacuucugugcaaagaaugccauugucuuuauuuaauaguugaaucuguuuaagccugucuacaagaguaaucagaaauucguguugaagugaaauuaagugaaaauagucaaaggcuaagaauauuucuuuaacccccccccccacuugaauucaaccuucaguuaggaugagagcagcauccugaagauuuuccuagagcuaaaucacccucugcuacugauaacaaaacuuuguuuuaaaggagaucgguugguguuugguugauugguuguugguugauugguuggcuagcugauuauuagguuggacaauugguugauuggaugauugguucuuguugguugguugguggugguugguugguuggguaguugauugguuggauggaugauugguuggugguugauugguuggaugguugguuguuguugguuguuagugguuguuugguuagguaguugauagguuguugguugguugguugguugguugguuggagguugauugguuggguaguuggucaauuguaugacugguuguugguugguugguugacugguuggugguuagugguuggcugauugguugauuucagcuuuaaaggaugccauuuagcaggcaguguuuuaacuuuuuuauguuguauauaugaauacuuaacugagauaauucacacaguguguugccuacagguaggaacguacaaagauguuguaacuauaagaucauuguguugacccuaugucccauugcagucuagagucucucugacuucccagugaacagcagucagacccaucccaagauggcugccaguucuuauguuuuguaauauucuggaaguucaaagacacacagcuacuuucugcagcagacguguucccaugggauucuggaagaauuacaaccuguagaaaauaauuccugguaugguacagauaguguucagcuuccagaauuuacccauuuuucagggaguaaaguuuuccuuccaaccccacaacuucccccaaaacucacaacauaguaagugugcgcugucacuuucucccacugguaaucggcaucuguaguuguaggcccgcgcauucugcacacacugcagaaagguuaacugcuucccucuacaccaguccguauucacaggagccuccugggaguugcugggugagacagauuagaguugaguugugcucuuuuuuuguuuguuugguuugguuuggguuuuuucgagacagaguuucucuguguagcccuggcuguccuagaacucacuuuguagaccaggcuggccucaaacucagaaaucugccugccucugccucccaagugcugggauuaaaggcaugagccaccgcucagccgcucagcauuuuuuguuguuguuuuguuuuuguuuuuuuguuuuuuggcugaguugugcucuuuuugaagaguucuuucccuacuuuuauaucaaauacaguaaaguacaccauuaaaauuuaacuuuuuaaaaguuuuuauuuuccaauuuaaaaucaaaguuuuacuuuuuaaaaauguuucuaaaaccgucuaaauggccucuuggcucccauuguguuuccacuggauagugcugcccugggauguuggaaaaugaaccuucuguccaagacgucauuccuccaacauucuucagccuaagccaccuauccuugcuguuacuacuuagcuguauuggacgugggcacuggccuccaccuuccagaaccaugaaugucaugucguuguccuaccugguaccacucauaaagggauugagauuuccaccaugacugaaaccauuguucuugugguaggguguuaugcccauccuugaaagaauugcuuagacauugggaugucuauaaaucacacagaucuugaccugugagcauuacaagggaauguaacauauggaaugaauguuauugauaaaaaccuguuuguuuguuuguuuguuuaauaagaaacuguaacguuuuuaccacuuuaaccacuaacaccgucauaugcgugacuguugggauaacgaagaaacaggcuugacugacucaauuuuaugacugcacuugaucuauaaccacacgaaagccauggcauacugugcuugcuauaccacaauuuuaggauguacuuaaaaaagcaggaagccaagauccuaauggcaguuaugucccaagaacauauaauuuugaacauauuaucuauauguguaaaauauacccaaaacucuuuuaauaaaagaagaaaauguuucuugaagacauucuagauuugaguuugaauacugaaaauucuucaagugacauauuuuacguuucaaagcaucaacggcaagauuauacaguuggcauagacgugguagcuaagcaauggaagauuugaucaucucagagauauuuuucuuagaaaccaccaauuuuauucuaauuuuuaggaaaccagaauucaggccguggaaaaggauucaaagaaaaugcacuguuucucuguccucagcacagccgcugggcgggcggugagucacaucuuugcggcugacagccuagcagacuuucaggaguggaugggcgccuuccggcaacauuucuuugaucucagugaguagaucuuuggguucucuagcaauguauucaugugccuugggaggcuggacaacagccauccaaauauuaaagaacuuguagcgggggcuuuuucucuuuuaaauucccugaaaaccacggccacguaccacaaaccuuuuccagauaacgaucaucucuagacuaaugcucagaggagucucauuuucaguaaccuuccgcucacugcgcaucugcugcgauaucaucuugugcuucaugcagagaugaguuucagccccaugaaugucuuguuuccaucucagugacacgauccagcuccgugcauaaaauaccuaaggaucucagguuuccguuuucuucauuccuaggagccuugcucacggguagauucuuggccucagcgauacacugagccaccuaugcauuaucugcgauuuuacuuugaaaauggagcuguugguuuaccaguugcuucugauccagcuaagccuccuguuagagucagccaguguuucacaucuacagaccgcaagagacucaugccguagagucauuugcaugcaacguagugauuuaugggccacuguaaagagguggcaaccugcugcucuccagcagcucccaggccugcucuggugugcgugucagcggaugucggggaggagguugggaaggaggcaaggacacgcaccaagugugaagguggcucagggcuccaugcccugcuuaccucucacgagguccccaggagguaaauaacuugauucuacuccuaagacaaggaaagagagacccagagaggccugugguuugugggauugaacgaggacacacgugguaaacgucuaagcucuucuccagguuugaagcuguccugagccgcuuucgcuuaaauugcuacagacugugcaggcaggagugacuucagaccccgcccacguucuauugugcuauuacucugagacaaggucucauuauguccugggccccuaccucagcuuccugggugcuaacuugguaggcgugcagggguggugaugguaaugaacacauguagcucaggcuagcccuugcacuugaaauccucugggauuacaaauggcacugcuuaggccugguccagacccuccuuucuugcugauuguaguuaggauuuugacugcuuuccuaggcucucugauucucggagucugacuuacagaaagacacuuauuuuaagaagugauacuuggcagagcaugcuuuauaugggcauaaugacagagaagguagcgauuaaaguacuagcccagaacauucuagucuggcuaucagugggaccagaggaggucucacucucuagguaacuucucaugugugucacuuugaagcuaaacacuuuuuuuaaccaaguugugccaaccuggcaucuucaaagugcaacuucucuuacauuuuauacuuguaugucaaugaagcaaagcuggaaguguuuauacuacccaaacauugcauuauaauguaguagucuaauuuuauuaaguuuuuuugucauuuuuuuaauuaacaguuugugccucucuuugucuuuauguguaucucugucuaucugugugugcauauggguaaauguguauguguaucuguauguuuauguguguguaucuguguauguaugugcaucuguccaugugugcauauggguauauauguagugugucuguccaucuguccaugugugcauauggguauauauguagugugucuguccaucuguccgugugugcauauggauauauauguagugugucuggucugucuaugugugucugcguauguguaucuguccauuugucuguguguauggguauauguguguguuugucugucugguguguauuuuguaugugugcguguguaggcauguguaggguacagugcacgugugcagguuagagcacagccugugggagucaguccucuucuucccccauguggguugagucccuggccauugagccaucucauuccaauuuucuuagugacaagcgagccuucuuccccuugguugaaguaugguauauacaccaaaauagaaggagauaucaagaauggaauaacauaagaauaauuuaauaucugggucaaauuucaguuccucggcccaacgugagaauggaagacuaggagaguaagcucuucagaguucaugaggaaguguuaauaaacauggguaugcuuagccacaauagccguggucuggaggcuaggggcaaaggggauugcugccuuaguauuugagagcuuauaaaggagccgugacuccugaucuauaaucauagucaguggcuaggaaugguagagcaaagagagaauguuuaaacaaacuuggaucucgucauagguuuuuuuuuuccaaaauauuuacuacaaauacucaguuacaugacuagcuuagcauaauagaucauuguaauagagaacacagacaauaaauauugugguggaggcaguaagaugacagugguagcaacacucacaagccugaaagccucaguucuguucugagggguccugugcaggaaggagaaccaacuucugcaggcuguccccugauccccauaguagugccagagcauacaugugauuacacgcgcaugcacacacacacacacacacacuacgugucuaauaagguagcagcauugugggaaacaucuuuaauagagguguuuaauagguugugugaacacaguauauccuaccuguuauuaaccuugcguuagcauaucaacuaucauguaguucuauguaaacagacuuagucacugcagaaugcuuccguuguaaaaucaccucugacaucaggaacacauggacgauacaggguuauguucccaaccugagcaugguuaauauucuguuucuagugcagccaagaaccauuuaaucuuaagaucccccaugcagaaaucaucaucucuuaccucauggcccggccuggaaccugaaagagaaguacugguccauuuagaaugagucauuauuuuucauuaaauacuauauuuccccaaagaaugcaaaaaaaaauggcuuuuacauauuuaucuaaaauaaaaaaagagggaggaggugagaugccaggcucuagcuucuggauucagacccuagggaggaacccuugcagcuguguccuggggggguuuauuuccaguugguuugcuguguacuaaucagcaucauaauaaaauacccugaaaggcuuuugaugugucuuaacuaguuaugauaauggauucaaaaugcaggcauuugucaccaugugccaugacaacaaaaugaauauguaauaaaacacaaagcgucuuaaaauguuuaagccucgaacagauugaauaugugcauuuagaccccuggaagaaagggaagaaaguguuagccuuagaaggagucuggugugucguccccacuuuuccgugggcacucgugauuucuaugaugucauggauaagacagggcggcaucucugcaaauaucaauuguuuucagccauagaggagaggucagguccccagaucuuaaggcuuaaauagugacacagugaagacuauuaaacaguucucauuucuuaauuggcaauugagcucaaaugaaagcugugucugaggauuugaauuguguguaucuuccuccgucugacagccggauuucgguggggauuuugucuuucaaacgccuggaauaguggaugucucuaucgacaguggcgaaaagaagccgccuacacugucuuucgacaugaaugugacauuuaaugugauuguggauggguuugugcggugcuguacuggcugacccagggaucucaguaucuaccgagaacugguuugguugguugcuugguugguuuuuaaaugagucacucaugcagaaucaguuucggaaaccggauuguacuggguuuuuaugcaagcuucuugaaagcuaggcuuuauugauaaacuguuauuuucuaacacgcacaugcacaaaguacugauauugguagaaaaugaaacacauagcuucccauuuaucuuucaaacuagccugcgucuuccuuucuuucuuaggccaauggaagcauuguugugaagaacuuaugagaauugagauuaugucaccacgaaaaccaccuuuguuccuggcaaaggaggcgaccucaguguauuaugauaugaguaaguggguggggcuugccucuuccgagccacagagugauggaaaagcaacauuguccacaccccagccucuuauucuauugacuuuaaaaugcuaaacuucuccgggcacaguaaaauugaauuuaaaaaaaaaagacuauagauuauagacugaggagcucauguuuguuagaugaauuaauacaaaauuaaugagugcauaguuuucauaguucggaugcucaugaucaaacaaaaaacuccaggcuuaaaagacuaaaguccuuagcugauggaauucagaaaauacgaacauacagacucuaagauguaaucguguuuaguuaccguuuucucuggguuuuuuuuccccaguggguuuugcuuuuguuguuuguuuguaugacaaauagggauauauuaaugaauaugaagcauccaccucuggucagaaauaacuaguucaguucaauucaaauaucggucuuucucgaguuucuguuucacuuucccauaccuugaaagguguuaauccugugggguggccucccagauggugcugcaaaacaucuggacaguaucugucuguacaugugcaaggauguguaugugcgugcauguauaaacauaugcauuuacaaucuuagauuccaagugguuccuuuaaaacaucagagacucaacucaguagacauuuaucucagaguucuuauuuuuccccaagggaaauuuuacccagcauccucaucaccagaguuagugugaggguuuaggacuccugcccugggcauugguuuuagaggauuuuguguuugcuuucccucugucuuuuacccacagcagagacaucaagggucuguagggaaaccugcugacuccuuacccuccauccccuuuuccauagggagcuuccuaguaggcaaaauaagcguuugaguguaggagaaguuacuguauaauaaauaguuaagaagcacuaggauguguccgccagugcuguguaugugugaaugcuaugcauuuucucuguguuuguuguauagaugaugucuaagcaugguauauaagagccuugcuugggggcccucuugguaggcuuacuuucauaaaucaauguuuuuauuacgcauccuguucccagguuuuuaauggucauuauagguagaauauugauuaggaaaaauaagagcuuauuuggauaaaguacauaugaccguuugauuuuuuuccauaaaguuucuucuuauaauuacuacaggcaucgauucacccgugaaacuggaaaguguaacagacauaauacaaaagaaaaucggagagaccaaccgacaguuccucauuggucgggaugaccaauccgcagcacccccgugggccgcugucuuugauggcaaucacgaaauggucauagagaagaaaguguuguccccaauaggcgaaccggcuccggauggaaaaagaaaaaagaggcgagccccacucccuccuaccgaucagccgcccuucugcauaaaaacccaggguagagcgaaucaguccaaggacagcgcaacccaggcuggggucucuggagccucaucuucgccuucggaucccagacugucgccgccuacgcaucaucuccagaaaccuguggcagccccucgcaaacuucucccugccaggaagaacaguucagcggacauugggcacacggacacuaaaaccagccuugaugcgaagccagugccaguuccaaggcagaaauccaucagagacauucuggacccacgaucuuggcuccaagcacaaguauaggaagccgggacuauguaaauccagcuguaaggcucuggucagaggcauucuauggguaauguuauguaauuguauagguaaaggccagagcaguuuccagaagccauuaauaagcuguuagguacagaaaagcaccuuuaaguagagaauuagauuucuccuuuccagaauagaaaugauccuccccuccccggagcaaaagaggcaguuucuagacaguagccuacuuuuuggaaggguuaauuuacuccuaauuuaguagcaggcagugaacagacagaaggcagaggaaagcauuguuuuuuuguuuuuuguuuuuuuuuuuugagagugaguuuaguaauguagaauguguucaauacaagccguauucucauugugagaauuguaauacuuaauagaauauuucagaguuuuuguuuaaaccacaaauuacagaauccacccaagaaaauguuuccccuccgcuuccuggaauuggcaucuaaggguccucuggcuucuccucuguuguuuaacucaauggucucuaggguugaucuuuucaauuccugguauaaagucuucgaauauuaaaaacucuuugucuuuaaagggaauuuguaaucugcuauucaaauucauuuccuugaugagcccugaaauccuguggacuuggcugcucaucagcaaggagcaugcuucuuggugagugaaguggcaaugagauguccccccauugcugggcuuccuguaugauguuaaucuccaucauggccucuggaguucagggagacaaguagccaauuaaugccuuuaaauuuuuacuuaauacuuauuuuaaaagcagauggcagauucaaaauuuaucaggaagguuugaccgcaguaauuuucagaauuaauccuuuuucaauuuuuuaauuagauuuucuuuuuuuugagugagggcugaugucgguuauugauauugcccguuaaaagucauauucauucaguaaucacauuggcgucauuuccauagaagguaauuuccauggcaacuaaucacagugacccaaacaggauuauaaauugaauaggggggauaacuagcaagagaaugaauaucuuaaguggacaaaaagaaaaacccacuuuuuauaauaaccccuuuuguaaacaagaacagcggaacgguuuuaaaaugucaucauaauuuccaagcaaaacuucccagaggguauuaaaacaguccugaacagaccaggaccucccaagcccuaacgggcaccacaaaccaucacacugaaggaaggaggcuccaggcugcugagcucuguccaucuggaugggaacuacaucuguguaaaguggccaacaaagguauugaucggaccaacccauucaucgcuuuuaggggauaguuugucuguuuugucuuguuuuuguuucucauuucugcacagugcuccucuaacuaacagguaauauguacacuauugcuugcccaggacccccaguaaaaaaggggaacccgagagcagcgacaaagggcccucugugaaggcagaaggcagaagcuguguggagacuccuacagccauggaaacuugaagaauagguggccgugguuuuguuuuuguuuuaaucuaacagggucucaaaaguuuuggugguaauugccauuucuuucuuuuuaauacuuacuuuauguauuuaaguacaccauagcugucuucagacacaccagaagagggcaucagaucccauuacagauggucaugagccaccaugugguuguugggaacugaacucagcaccucuggaagagcaaguccugagccaucucuccagccccaguaaaguuguauuuuuugcuugaaaaugccucuguuagcccucaccgauaucuucaacaaugcccaugaacuuuugaugcaaccucuuuuuuuuuuuuuuuuuuuuuaauuaaaagaugcugcuggcaaaauugcuucugauuccuggcacccaagugcccccgucccuccccgcugugccccucacuuacuguguuccucuauugcaggccgggauuuaaauucaccagccacuucugauuucgugugcaaguugccgcuggaagaauuuaggguguguguguguguguguguguguguguguguguguguguguauguauguauguguuccuggagacacucuggaggaguuguguucucagagggcagcuuugcaccaggucugaaaccagccuccuucccagagccucauggugagugaagcucugcccaacccccaccaguuccuggagguuccucucuguaucacucugcucaucaaaugcuaggucacgcccaccccgcacaacaaaagaaguuaggacaggcuuguccuucucucucuuacuccccuccuucuaacccuuuccaccuuccuucccucuugucucacguuccuucacaacuuaaaaauauccggagauacugacuuaaaagcuuccaaggaauuuuuaagaaguuuucccucauuugcugaacuagaacgcagagcggagggaugcgugauaggaaaggugaggcagcuuugugugagcaggucguccuccaguguccuuccgaaucauuucuucgcuaacagaucuugauaacauuuaaaauuggagaaacuuaauagaaaaaaaucccagauauuucauauuaaggugcuuuccaugacggagagauaacgucucuggcaguugcacuuacaccucuaggucugugcuauaaauuacaaacagcaauuuccuuauuuugacaucuuucgaagagaaagaacacccuuuuaaacguaaauacacacuucucaagcuaaaauccauccgaaacaccaagcacggcccgcgcuugcugauuucacagguuuuuaacugucugcacuguuccacacacaacuuucaagcagauauggcuguguguagaaaaccacacauuccuuaucaauauuugucucugccuuuuaggagaaaaucucccucacuuagcacuguucauuaaaaaucaauaggaacggucucuuagagaccaccggugcaagguagguaggcaaugcuggcaagucuucccuuuagauaccucggccaccuacugugaaguuaauuaauucaguccaaauugaaauuauaggggcauuuggaguaguuuguguucaaugccauuuaaaugcaaucgccugugcaacucagcaggggcagccauguuagagaugcugcagaugccuggagcaaggggggaagaaagaggcuucuugcagugaauuguaucuccgagccagaacuuuccggaacucauugguucguucaagagugcguugguggguagcaguuaaggugcaauuaaugaccauuuacauucuggcaguugucuucucuguccugugcaguuucaacggcauuucuagaugggcggggauggcguuucccuuuaaucucaguacuggggaggcagaggcaggcagaucucuggguuugaggccagccuggucuauggagcgaguucuaggacagcuacaccaacaaacaugucuugaaaagcuaaaaaaaaaaaaagcauuucuauuuuuuuuaauuuuuauugagagacucuuucugucucugucuggguauaugugcgcacacacacacacacacacacacacacacgcaugcaugcauauguauacacacccaugcaaacaugugugcccauggaugccagaagagguccuuggaccucgcggaacugaaucacaggugagccucucucagaauccaugcaaaagaacuccucugcaggagcagccagugcucuuaaccacuguaccauuaucuauccagccugaaauauaugucaacuacuuuauugcuaagaauaguucuaugaacacuguuguuauagauuguguuauuuuuccagguaaccacgcggaggaaaauacuuuugagcuuuuuuuaaaggacuuuuauuuuuauuuuuaaguguuacuuauuuguuuauguauaagguguauaugccacagcccacauaggaagucaggugacagccuggucuacagagugaguuccaggacagucaaagcuacacagagaaacccuaucucgaaaaaaacaaacaaacaaacacacaaaaaggaagucaggugacaaccuguggaagucaggucuccccuuuuaucaaguggguccuucaaauugagcucaacucuuugaguuuaguaggcaagcaccuuuauccaccgagccaucuagccagcccacaccuuugacuuuuuguaaacggccaaauuucacuugaaaguagauuguauaacuuucuaauauguugauguaauucgcaguguuucuuuaacuguguguggagcaaaugucuggauucagaaauauuaauucuaucagacuuuuuuuuuuaaugugugaucaaagguacuugaguggagucacaugauuaaagcuuggguaguaauuagagggcuugguucguggagacauuuuccgacauuuucugugggguccuccuucugggcugaucugguagggauggguggacaguuagcuucagagggaaaaaucacugucacacacuaagaaacuuaacguccagggaccuugggguccuucgugguugagcauuugcauggaacccuagucagagucuguauaccccaagucucugagggucccuguuuucaaguuaucaagccaggcuuugcccugccugugagucacuggucacaaggacaugccuucuaugaauuuuccuucucaguuaacguauucucauggagcacgucaaggagagagagagagcagugggcacccuucccuugaguuccucguuuccugauuuuuauuucuaaggguguuguaggaucagaaguguuuuaaaaggaaauucucuguuucucuugagagagaagauaaccaagcaguggguguggguaaagcaaaacaccucaagguugagugaauuaagaaaagaaaaaauuauuauagaaacguuggaaagcauuuuuucuucuucuucugugaguguagaagacucugauccuggcaugcuuaacgaucaagcaagaucauguagacaauugcguuuucgaaggguaucaauuugcuuuugggaaacauggucaucuccuaccuagacugcuaaagaagugugaaaagacagagacuaucuguaacuaugucaggccacaaacauguuucagaacaccaaaacguauuccuuuaaauguggaagacuuguguuuucauaucaaaauaucuccaggagagaaaacaaacagggcuugggacaaacaggacuaaggagcuggcccaguggccaugaggaccugaguucaaacccuugggacucacauaaacugcuggacauaggcagccaugugugccucucaccccaacauuuggggccagagacgagcagaucccgauuacucacuggcccaaacccucaacuucugacucaguagaaauccugccucaaaagaguacggcagggagcaguaggugacaggacaucaugcucugaccucccagugagcagaugugucacacacacacacacacacacacacacacacacacacacacacacacacacacacgagagggaugggggagggguagagggagagagagggggggucagcagggaugggggagggguagaggaagggggggucaguguuugugaauucaugccuuuuuguagagcuugguuaucugaauaaaaacacauucuuuuuuuaacuuagccuaggaaguuuaccauuuuuccucaaaagaagaaaaagucuugagaaugaucaaucuaaacucaaguguuaaaaaccaagugauuguaagcaagaacccuagaaucagacaguuauacucugugauugauuuuaugucucuuggucauuauuaguuuuuaaaucaugaauauggguguauguguuugugaugauuuguauaugcucaggucacggaguagcacuauuagaaggaauggcccuguuagaguagguguggccuuguuggaaugggugugucacugugggcgugggccuuaagacccucauccuagcuuccuggaagugaguauucugcuagcagucuucagaugaagauguagaacucucagcuccuccugcaccacgcccaccuggaugcugccaugcucccaccuugaugauaauagacugaaccucugaaccuguaagccagcaccaauuaaauguuguccuugagucaugaugguaucuguucacaacagaaaaaccuaagacagugucugagcacaugcaugaaugaauauacugaaggccagaagaggccgagggaaugaaucuccuggaguuggagucacaggugguugagagcuacugugugguugcuggaaguugaacucacaguuauguccucugcagaggcaguacgugcucuuagcuucccaaguucucuccuucaucaguauguucuugcaaacuaggaaaggacucuucauacuuucaauaggaguugcccagucugaucucauugagggcguccuucaauccugugaguggauccaauagguucucaauaaauuagccauucaguuuuucucccuggcuucuucauucaguuccaucuguugguuucuauucaaaguaaugaaggccacgucacgcuauaggguuugguuuaaacaccacuucuucuguccauccucccagaugcuccuggagagaguggaucuccuguucacaacugcuagguaauguuuucgggagccuuauggucaagucgauucuacccaaauccucccugugacagcacugggcagagcuuccugggccuggauuuuugaguucaagcuuuagauggccacguuacugugaggaguuuagggguguguccagugggcuugcucaggauguuuguguugcugccaugcaugcugugaguguugggggaugggggaagcaacucauaaugucuggugguguucagauccugccugguugcagcuauccuauaccucaagaggguccucuguaaaggugaggguggcuguccaacaccccagggggauaaagcacaauaauucagaugaaccuugccuguuuggcuguuugacaacuagcagaggcucacuugcuaggcccuauccugagaacaucaaacugggugcuguggguucuguagauuagagagagagucggcagccauuccuggucuccugccaauuagaaagcugaggaaguaagcaaacaagcuugucugaggccguguggccuagugauaaagaggagcuagagucuggguucuuccggucauacacggguggcucuuucuacucacuccgccaugagaguggugaugccagcucuuccuauagcuugacuuaguuucuagaaccaacauccaagguucuucuuguaguccaacaagucguaccuucuucccacccuguggguccuguggauuagacugaggucaucagauuugguggcaagugucuuugcugucugaguggucucaccaguccugcgccagccaucuuugggguuuuuguuucuuuguuuguuuguuuuuaacaaacaagugaagcauuaaguuguacccauaucagauaccucagcaggacuguggugauuaauuuguagggaaagccugaaggcucguaacagguggcccucagaaggagcagauugaagagagagcaaagggugaagaccuagggaagaccucagauauacaccucucucucucucucucgcccucucucucucucucucucccucccucucucucucucccucccucucucucuauucacccccccccauuccaaagucuuucuuuauuaugagaaagcaagcuaagccuacccuucuuuggggagaaguagaagucacgggcuauccuucaacuaugcuggaccaucacacacagaaagcagcagcccaagaauuaacauucuauaaaccguaaagacagaaucuccuccuuuagaccaauuucagcccaaagcagccacucaggagccauaggguguuggagcagauguguauugcaaguccuaccaacguuaauggaauggcuuuaaguuuuccaccauggauuuucuggaauuaacucagcgcuacacuccuguuagcugccugaguauuugaagacggaggccaaucuuuacacgcauggaauugaugaauuguggaguucagauucaguaucagaaaaaaaauccccuuuuaugaucaauaacuggcaguaaaaucauuauuuuacgaugugcuuuugccccacccccaccccagagcuguguucccaaaugcaaucuuacuuagaccuucacuaaguaagaucagcaucagaggaggaagugagcaaggaguaugugucuguccaccaugaugcuucacccaccugacucuccagccuuuuacaucucccagaauagcuugugaucacugacugguucaguguuaauagaugagucucacugaaggucuuucacuacucauucaguauagacacugguggguuguacagugacuaacuucacccuucagguuucagagaaccuucuagaaccccauaucuugaugacuuaguacugaacuauuugaguggaaaccuuaaacaauguuugguucaauaaaacacauuguacauacugaggaaaaaacaguacaaaacuuuucuucugaaaauuuuuggguuuuuuuguucgcuugcuuguuuuuguuuuuauugaagcagaaucucauguagcccaggcuagccugagauuuaccaucuuguuaucucacccucagaaguacuauaaagagagguaccaccacacuggaaagcauagcuucuuucucaaggacaagcuaucugcaaacccggguuaugguuccauggagaagaguuguagaagagugaggaccugcgucaggauccccagcccaugucaaagcuggauguggcccaacagaucuguagccuuggcaguagcagcaggauuaccgcagcuugcuuaaccaccagccuagcccuucugcucugucuuccacgugcgugcuccugaacccacgugcauguauguauacugcgcgcgcauaugugcacacaugcacgcacgcacauacacaaagaauaauaagaaauaaaaacuuaaagcuauuucacuucagugcccaguaagguguauacacguguaucugugagugcaaguacccgcagaggccagaagggggcguccaauucccaggggcugaaguuauagugagccaccaugauggugcugggaauuaaacuuggauccucugaaagaacuuguguuuuguguugcuuuuaguuaugaagggcucauaagggaaggcaccagagucucgaguguuaggaguagcccaugguuucauuccccacuuaagucagucccagugacaugugggacugcaagccauggcuguggcuggagcgauuccuucagccgcauucccccucccugcuucucaguggaaggcagagcuugcucuccguugcccuccacauccgcucuuuccaaagaucaagaguuuccuuugccagucucaaugccgauucuuacccacccauaagagagagagagcaagcaggagcugcagaugcgcaguuacuauaacgaccguuaccuggguuauagaaaaaggagccugucuuucaacuccuggcuguucaacccggccacguucagugaaaucuugaaauggauuguaggaaauucacaauugcaaaacgacaaaagauuagaguuuguguguuaagagcaggaggggguggagggagaguugaggggcgggguccaggagggugacugacagcccugagcuuucucaugcucagcacaucuuacuagcauacaguaugcauccaucauucuccaccagcuggccgucagcuggucaacuuaagccuguuaagaccgggaucauauuaaaugguaccaaaaaggccauacccagcauguaaucaacucuguaaaauucccaagaaagcaaugcucaauaaaugauuucuacuuuggcuaugauuagugccccaaccucaaccauugucaccuacacaagacagccgauaaacuguguaggaaacuuacaacuuaagguugguggggaguuagcggccauguauaauggcaccaucaguucagauauucgguaaucugggcaucucccugauagaaccaaaaucuucugugugaagcacccucugccagcuggccaucagccgcucaacuaaagcccuuuaaggaccggaucauauaaaaugguaucagaaaggccagcuuggaauugagucucgguaucuuugacaaugucuuugaaacauauuuuuacuauugaaagguaaagcgaaagucgcugguacccagaacugacacgagaaaugugccagauggagagggaggcguagacagugauggagauuuuaacaggauuucaugggagugguggaggggugacugccuagcaccuaaccauugguuauccguuaagucggaaauguauucuaccggagagugcucauguuuauuuuguuaugauucgugugucuguaugcacugcgugccuaagugcaugcaugcagugcucacggggaccagaagagggcuucaguucaucuccugggugcugggaacugaauuugggacuuccguaagagcagcaaaugcuuuuaauugcugagcaagucaucucuucagccccuggaguaguaaacuuccuaaaugagcauuagccaaaagaaccucucuagaaagcaagacuuuuucugugcagucguccaaagguuuguuuugcucuccuaacucggcucuuauuugagaucauuguaaaauaauuauaaagucugaacagaauguuagcaucuugguacacuugguuguugaggggucuuuccauggagaaaauuuaaguccuuaauuauaguucuuaggagcuccucgggcaaacaauggaccucaaaaauaauccaauuucucucaugggcagaacccacacccuagcccaggauuagccagccuccgaccgacugacauguucuuugcucugguuuuauguguggugugugugugcacguguuuauguguguccacaugugugugcaugaguguggcuggagauugaugucagggguccuccucagucacucuccaccucacucuucaaaaagcaugcucuuucguggaaccugaagcucaccaauucaguagccuggcugaccagcaggcuccggggcuucuccugucugcagugggaagcacuaggcuaggauuacagguagggacagucacaugcagcuucuauguggcuuccaggagucaaacucugguccucgugcuucagugacagggaguuuaccgacugagccaucuuugguuuauuugaagauuaauuuuuuuaaauagacauuucagccccguuucugguaaauuucaguucuaagagguuuucuugcccgucuagaauuuauuuuauugaaaccagcaacacuuuccauugacagcccuugucucucuugacuggcuggcuuucuagggcaauguuuucaaaauaguagucaucuuaguuaggauuacuaucgcugcgauggaacaccaugaccaaaagcaacuugggggguuggggggggcggggaagagaagguuuauucucucacagcuccauuaaaagcagugaaggcaggaaccuggaggcuggagcugaugcagaggccaugaaggguuuugcuuucuggcuugcuccucauggcuugcucagccugcuuucuuauagaagacaggaccaccagcucaggauagaccucacccacacugggcugggcucuaccaaaggaaucacuaauugagcaaaugagugccuggagcccaaccuaauggaggcauuuucacauugaggcucccuccucucugccaacucuggcccugaucaguaucuuugccuuugccgugggggaggggggagggaaggagagagagagagagagagagagagagagagagagagagagagagagagagagagagagaauaacaaauauaacaaaccauuaugacauucaacagugauauuucagauacucagcuagcuaauccacccacugauagggugaacuuugaauugaaugcuuugaagacuaaagucaaguaaaucuugauacaaaucaaagguuacagaaaucucauuugacaagagacacgggcaggaaugcuaaaauuaaggcuguuuggggggagagaugcucacuccauggcauacuuaaugaagagugacagaucaaacugccuccagguaagaagcagaaacgggucuuuauuaccgcaccuuuuacuauucugaaacucaugguguucugcccacaggagcacccauuuacucauuuuugugguaacucagauuauuugaucaguuuaucucaaggccugcucagcccccccccccaaacuuccuguguguguuggauaggcacugagaacacucaguuugguuuucaacgugaaucaagugaaugagagucacuccguauuucauuucacggaagccuuccuagaaguggaggugaaaacagcacugaguacuuacuuaggugaaggagaacugcagggccaagcacuccagagacagaggcaggugggccucugugaguucgaauccagccuggucuacacagugaauuccaagacaggcagaguuauauagugagacccugucuauaaguaaaauaagaaaggagaguugcgugagcugguauaccugcaacucuagcacucaggagaccgagacaggaggauuacuguauguucaaggcuagccugcucuacagagugaguuccaggacagccagggcuacauagagaaacccugucucgaaaaaccaaaaaaucaaagaggcuagugcauggguuccuaacauaacacuguacuuuguuuucuuucaguauccucuguugccaucucugaaugugacucauuugagaauucgacucguuuuuuuaaauguuuggaguuuuuuuuuucuccugcuagcccccgccccccaucccuguuacuacuuucuauauaauauuauaucagaggauaggguuuuuuugugaccugacuccuucuuacguauugagauuugguuuguggcuuagagugugaucucucuuuuuauguguuccaagcucacuugaaaaaaaaaaaaagaguccagcccggcagugguggcacacgccuuuaaucccagcauuugggaggcagaggcaggugaauuugugaguucgaggccagccuggucuacagagugaguuccaggacagccagggcuacacagagaaacccugucuugaaaaacaaaaacaaacaaaaagaaaaaagaaaagaaaaagagucuauucugcuguucucacagggguggaaaauguucuguaauuaucaguaagauccaguuuguaaucuccuguaagccuacugaauuuuacccaggcacuuagccugauacugggguggggcugguguuaaaauccuaacuacaucuauggcuuugcuuauuucuuccuuauaacccuauccguuuccaugucaaauauuuugaaagucgugaguauuuagggauuugggggcuggggggaguuucuggauaaauugaucuuauucugguucugaaaugaccuuccuucuucccagucccucgucuuugccuuagguuucauuucgucugcaucugugcaguuuuacccacuuucuuuugguuagcguuucuaugauguauccuguuucuucuuuucccguuaacucuauuuauucuuuacaucuaaagcaaguugguuuuuuuuuuuauggcauuaguaagcucaugcuacuucauauagucugaagccugcuuuucaaagauuucuuucacuuuuacuuaucuauagguguaucuauaggugugcguaucucuguguguauguggggguguguggguacccauggagaccagaagagggugucagcuccccuggagcaggaguaacaaacuauuguaagcucuccuacucagugcugggaaccaaacuuggguccuuuacaagagcaguaagaauucuuaaccuccgagccaucuuguucagccacuggggucagcuuucaaauuaggcuguuucaaucugucgauugauuugcuauauagcucuaacuagacuauaacuugcucuuuuagaccaggcuaaccuugaagcucugccagaccucucuccggauuguugagauuauaggugugagcuaccagucccggcuguucaaagccuuuguguucacaugauagcccgugugacuagguuuaaauccaucauaucacuaucagauuccuuuugcucucugccuuccccccacucugcuuuccugagaauuaaccaaguuguuggaauuauucagugaaucaccuuuaugauguuuaagcugaaacuuugugcuguaauagcucaccuggguauauauauaaugaaagucauuucaauacauaaacaguaaagugugucugcucuauuacagccucauaaacuggucagaagaaggacacuuuuuuuauuaugcccaacacaugauacaguugugcaucauacgauacaaagucgcaugauguauggagcaccaauuccacagcacaugagugagaagcgaggguuuagacaugcgguaaccaugggacacacugugacacacucuguguuccacggcaagauguuuucuagccuuuguuuuguuuauuuuugcucauaaucacacagcugguccaggaggaagccaggauggccccucccucuaaagccagggugucugccauucggccaguaauuugaagucaggguuacaauguuguaaggaccccauuugagaauguaaguucuuguuauugcuuuuauuguuacuguuuucccugagaaaccugucugcagccgcuuaagcauggggaaguccguugccuuuuuaauccucugcgauuuggagaaucgccauaucucagaagcucagggaggagccccugguuccugcaaauucauuggucaauaagaaacacagcauuuacuguuguaaauauuccuccauuagauguuauauuuaacucugucaucuuucaggguuucuggcuuuuaaauucccuacccccaaacuuuuauuaccaagauguaauuuauucauaaauuuuaaaaugucugauuuuuuuuauuuuuauguauuauugcguuccuuucuugacaagaaguuaucagacuaaauaaucagacuugggacuuuggaucauuucaguucgugugaauauaacuuuacaagugacuaucaaagugggccuugacuuuugcuggugaugguggugggugugacccuuugacaauauguguaagcaaaaugauauaacaggaaugcuaaaaagauacccugcuucaucaccggggugacauuuguccuuaggguagggaggagagcagaggacacaaguguugguggcuuagugggcaccagacuuuccuacuggcacuauguuucuuaacagaacauuuaaaggagaggaaaggcauuaggggaagggaaagaggagggagagaggagagaaaggagaagggagcgggagagguggaaagggaaaggaagggagagaggggagggagagaagaggggaagaagggagagguuuugacucauuuaaugucccuagggagcagguagcaauuaccaguuuuauuacgcauugacccuugauuacuagaauguucuaugugauaaaagaagaggcauacaaagccccccacauaaaccaaagcaaagugacugugcucagggaaagugguuauaugguuguuugagcuucugaguccagccagccucuagauuguuuuuaugugaauggagguuuagccuccaguuuucccaaaauugaacccaggcaaccugucagggugagacacacagcugagagucuuuguugcuaguagguaaauagcaacaccccuuuuuuuuuccuuccagggaaaaggagaaguuuggaaagccugcucugucaccuggcauggaaggcuuccggguguuuacaauucuuccagugaauggcagugauauugcaaaaugugauucuuuguauugugugacgaaauguuccaauauuugcaaaaccugggucagccaaucacauacuccagauuguggguacaugaaguuacaaaauccuacaugaugcaaaaguucaagggggagucuuggauacuauuguaacaguacaaaguguucaugaacaugacuguacggcaacaacuaugccuugucagcuuuugaaaugugaccagaagcaauggucaugucacaagacaaugcuguuaaagaaccuucucccuuauuaagcuggguaaggccuuuguuauacauguacuucagccaagucagcuuaacacaacagauuaagggcaaagucagacacugaguaucugccuguuaguuuaguuuuaaucaagccauauguuaaagagauuuguaaaauacagacauaaaaugauguuacucuucucacauauuucuaauucauuguucuggaauuuuauuuuaaucuuaagacauauuagcauaccuaagguuuugggguuuuauacuuuuuuaagauuuguuuuauuuuuaaauaccuguuuguccguguauggguaugugcacaugggugcaguucccauggagcccagaaggggcaccagaucucuucuggaguuauaagggguugugaacugccugaaaagggugcuggagacuaaauucagauccuuugcaaaaacaguauaagcuccuaacuguugagccaucucuccagucccaaggggaguugugguuuuuuguuuuuguuuuuuggguuuuuuuuuuuuuacauuuuuuaaugaauuaaaaaauuaaauugagaucucucuguuucaguuucuaguacaguagauuguugacagcuauacagcaaaugaacaaaugucuccugggggccccucaaagggauccugagaacaguguguuuaaggagcuguugauucucauuucccagacacccugagucugccucccugaugacucucagcccuucuguccauggcaguuguuauuuuccuagaccaugauccuuugcuucuucuuagauggguguguugaggggccaaaggguagauggaguuugggaaguguguuuugccuccacugaggcuuaccuaguuucuucuuucaauucaaauagggcugaaggaaggaagauugcuaucgccccaugugugucagacagggcccagcaucccacuuaccagaaagagcaaggaguacaugcugguuuucagaugagaagagaagaaagcagauaugcuaagggagagccccaaggggcagagagaaaacacacaccucgaacaucccagagaucuuacauccuugacucgaauaggugcccagcucaaaugugaguucuaagagacggccugguacuaugggcuagggugaguuuccaucggaauccucuacagcaaccauucggagucaucaguugccacugaagugggguccauacagcccauuaucaaacgcaguaaguaagguuuauucugugcucuacacuuuaggguuguauuaaacuagaaauauaaaacccauguuuccggaaaaugcaagaugcuguaucuacauugaggcugaacaagaagaaucaccaugggcuacacacagauuaauuacuaucuucaaagaauuacaauacuaucaaacauuccuaccacaaaauuaugcugaacaaaauuuaaucuuucugugacuguucaaaagaauuuaggaucuuguaauccuccagggacauuaccauuuuauaaaucgcaccaaaaaa

SEQ ID NO: 5557 - RNA, 1142 nt, Mus musculus
uagacugccaugggaccucucaggccauacaacaccgcuccugccgguggggaaggcacaguauuggcucugacucucgagcaccagagaccgcuggguaccaugggagagccaguuugggggucccugggccuuacaguggccaagggacgacuaguucucacucucggacaucccacacugcuguaugucaccaaagagcugggaaugggcccuuggauggauucuagcccugggguggaagggaggguagggggaaagcucuagcagguuaccacagugaugagagucuggcuaguucaggcaggcagcuuggauugguggcagcuguggcuggagcacaggaaggccuccaggcgggagguuugaugcucugcucauuagagggaagccugguccauugcuccagcauggcggaucucgaugagcagagaugguccauugucugaaggcauuuauuguagaaaggcagagggagagagaagggaagagaaguagaagccggccauggccacaugaagagagcggggaaugacacaugaagagaggggggaaugaaaggggagaaggagagugagaggcaaaagacaaggggagagcaagagcgagagcgagagcgagagcgagagagagagcgagagcgagagcgagagcgagagcgagagcgagagagagagagagagagagagagagagagagagagcgagagagagaggaggggcggaggcagccuccuuuguagugggcugggcuaccuugcuguugccagguaacuguggggaggagcuucccuggcuguagccagaauaccaggagcuugggacauugucuacaugacugauagucacaggauuauggaguugagaaguugauguggugucaggugcuugugucugggagcauagcuuaugguucguucccuuguagauuuuucuacugggucucccgaguaagccucgcucgaccagaacacaugguccaacaguaggugugugggaccacaucaagccuuuuuuuuuuuuuaacgugggugcucugaauugaacucaggucauuguguuuacauaguaaccacuguauugacugagccaucucccaacccguuuuauuguuuuuguuauuaaaauacauaaaauaaauca

SEQ ID NO: 5558 - RNA, 3362 nt, Mus musculus
ugagaggagaggcccaugggccugaggguguccaaugccccgguguaggggaaggccagcgcgggaagacaggagugaguggguggguaggggagcacccucauaaaggcaggggaagaagggaugggauaggggguuuccaaaggggagaccuggaaaggagaaaacauuugaaaugcaaauaaagaaaauauucaauaaaaaaagaaaaagaaaaaaaaaaaaaaacuccucuccacugcucuaauccaccuguuacugagcaugggugacaagaaagcccgccugccuuaauuccuuagacccacccaaagcucuuaguggccuugcaugaucucagugucucacugucuucgucuaguuuaagcuugagacugugugcaucuucuucaccaaaucuacauaccuguguuuaauuuccaugaaacaucuuugccagcgaccugcugccugccagacacuggugggaggcaaugaaucaccucugagguucccugccuucacuuagccugcagacuagucggggagaaaaauuuuaaaaaugacacacguuaacaugaaacugcaauuauuucaaguguuucagaggcggggcaggggccggggcagugaaagagacgcagcacaguggauagagcgcuugccuagcaugcaagaggcccggguucauuucccagcaccacauaaauuagacguggcagugcacgccugcaaucccagcacgguggaguuggaaacacaagcgucagaaguucaaguccaaccugggaugugcaacacguugucgugauuaaagauaggaaacaaaaacaaaggcugcagaagggauaggaggacccguaacacgagauguaaauggcauacaagcaccuccauaccuugagagcuggguuuauggaaguuuauaagaaaauccuccaguaggagagagcaugcgcaauguaggaaaagagaaggagggcugaccugccugauuccacaaguacugggggagugggggcaucacgguggaaaccucucugaccauaugccauaaucugcaguaaugccaggacuagugagcagguugggacuuuauguuccuguuucugcuugguggaagaacugugcucaguuacucaccuuuuguacucuaaaagaguauuucuggcuacagucugauggggaaaaaguuauaugaugcaguugaauauuuccaguggagagauaaugauaacugcggaggggggggggcguaaugugggugaguuacuaaguauauagggucaaggggguugggaagguaguguguggggcaugcaccaugcagcaguaguuacauuacguggagacaaugaggaacugucagaaagcagagauagacccgggcaugguggcgcaugccuuuaaucccagcacucgggaggcagaggcagguggauuucugaguucgagaccacccuggucuacagaaugaguuccaggacagccagggcuacacagagaaacccugucucgaacccccccacacaaaaaaaaagcagagauagguucugaauucaagacuagguguguugaugacaucacaggucaccacgagcagacacaggauuguacuguggguguggaguuugccaaagaggaugagggguuauauauaaacuuaugagucaucuucccacucuggcgucagaucgggauggauaugguuagagagagagauuguaaagggagucaacaaggacucugggacaaaggucuucaggaaggucaaacccacaacggcccugcccuggagggacacccagcggagaaggaaagaaaacacagcaggaucccacaauaccucuccugggcauauauccagaagaugucccaaccgguaagaaggacacaugcuccacuauguucauagcagccuuauuuauaauaggcagaagcuggaaagaacccagaugccccucaacagaggaauggauacaaaaaaugugguacauuuacacaauggaguacuacucagcuauuaaaaagaaugaauuuaugaaauuccuaggcaaauggauggaccuggagggcaucauccugagugagguaacacaaucacaaaagaacucacacgauauguacucacugauaaguggauauuagcccagaaacuuaguauaccugagauauaagauacaauuugcaaaacacaugaaacugaagaagaacgaagaccaaaguguggacacuuugccccuucuuagaacugaaaacaaucacccauggaaggaguuacagagacaaaguuuggagcugagacaaaaggauggaccaucuagagacugccauauccagggauccaucccauaauuagccuccaaacgaugacaccguugcauacacuagcaagcguuggcugaaaggacccugauauagcugucucuugugagacuaggccggggccuagcaaacacauaaguggaugcucacagucagcuauuggauggauaacagagcccccaauggaggagcuagagaguguauccaaggagcuaaagagaucugcaacccuguaggugcaacaacauuaugaacuaaccaguaccccugagcucuugacucuagcugcauauguaucaaaagauggccuagucggcuaucacuugaaagagaggcccauuggacaggcaaacuuuauaugccccaguacaggggaaugucagggccaaaaaaugggaauggguggguaggggaguuggggggaggguauggggggcuuuugggauagcauucuaaauguaauugaggaaaauacauaauaauaaaaaauauuuaaaauauauauauauauaaaagaaaacacagcaaaagaaacagaaggagaucccagaaagggccugucauaauaggcugggagcaagguucgaagaagugggaguagucagcuucugcaaagacagaggaugggugcacuggguuuuguugcauauggugacucccauccaguacgugcgagacagauccaagaggauuacaaauuuggggacaaauccagucuuaaaaaaaaauaaaaauaaaaauaaagaauaaaaaaagaaagaaagggaaaaaacucuucacuugagcaaaaguggaaagcacugaucaggagaaaaucauuuuuugaaauacuaauaaguaauuguaaaguaauacguaccaaaaacuauagcugucauuccuucugccugggguucuuuuugauucauggucuuaccugaucgauuuuacaugugucuuuaaacuguucccaggaagaaaacacaauaugagcgugugacacguuagugaccacgaggagaggagagaaaauggguauccuaugagcacgggacauuaccacggugcgcggucugaac

SEQ ID NO: 5559 - RNA, 3240 nt, Mus musculus
gaggaugugcugggcaggcgaagagaacaaagucuggcagagcaaguguuccucacuggguucuggccgcgccuggacaucaaaacgauggucacauacacgagugucucaucccaccucugucuguaauggccgcgugcuuccgugacauuuuccgucacaugucaacauuuugccuuacuuuugucuugucuuuugcuuugguuuuagaccggaaguuuguuugaaauacucucacacuguagcucgggcagggccggggcuuacaagugggagcaacuggaggcacccgcuuguuuuguuuuguuugagagacuggguguguaugugugugugucacuauguagcccaggcuagccuagaauucacucugugacacacacuaacgucaaacucaguguuaucuuccucuccagcuagauuaucauaggaacagguuugaugaucgucuccucgugcuaccaaacaguauggcccuagacuaugguucaguccgaaaugcagucuacacccacucuagcuaccacgacuggaaagagagagagggaagauaggagagagggaggaaggaggaggaaaggauggagagaaggauggagaggaaggagcacaacaagcaaguguacuuguccgaagcgguucuuuuucuuucuuucuuucuuucuuuuuuuuuuuuuuuuuuuuuuuuuuuucuuuuuugguuuuuucgagacaggguuucucuguguagcccuggcuguccuggaacucacuuuguagaccaggcuggccuugaacucagaaauccaccugccucugccucccaaaugcugggauuaaaggugugcuccaccacgccuggcuccccugaagcguuuucaugucauuaaaacaacacuuuuuuguaaagaaacuuguuuaucuccagacaagaaaaugccccaccccacuuacuaaucagauuuuuuuuucagaaauaaguuauaucacugcauuuuuucuuuuucaugaccaaaauuggaaacagucuaaacauuuuuauaucggaaguucccagucaauaaauucuagcacgcuuccuaagaagggauaccagccggcagccagggagauggcuugcuuggugguuaagacggccagaguugagucuccaguguccacaucagaugauuuacaagccaguaucuccaguuccacggacucccugcccucuuaccacccacguuguggcucaguacuuucucugacuccaguuccgugggauccagcguccucuucuggccucuucagguaccaugcaagugaugcacagguauacaacauccauacacauaaauaaaaacaaaaacaaaaaacaaaacaaaaaaacaagcccaacguaguggcccaugccuuuaaucccagcacgcaggaggcaaagacaagcagaucucuguaaguucaaggccaugcuggucuacagagugaguuccaggacagccagggauacacagagaaacccugucuggaaaaaccaaaaaaugaaugaaagaauuaauuaauuaacauuuaaaaaccaacagaaagagcagaaggcacauugcaaaauuguauggaaaccaugugcccaggaagaauuuaaaaagcguuccuagaguuaauuaguagaugccuuguccccugcuugcuaaggcuuuguaauguuacauuacuguuagcucuuaacaguguuguucagagcacaguggcagucugcugcuaggcuaccaauagaccacuaaagaaauauccacgcaugcggucacaccuaaaucccuggcgacgaacacacuuuuuaaacauuacgcccacucaccuuuagauguacaaagauuacacuaaauuuucaauaauacaaauuaucuuucaacucgagggccaugcuagacaaauguaaccgcuucuggugcucagcaugauugauguuaagucauuuuuacaagauccauucugucccugccacaucugguaauugaguucagccaccccggagaaggcggucuccucucccccaaggcucgugugaaauuccaguugccauuuuaagcuuccaauuaguucaugacauaaaaauuacgguuucccuuugaauuucuuuccucuggcccaguuacaugcaagacacacucauuccacacaguucccgaugucucaaaucuggcuaguuaaagcucugugcuguggaacggugccuguccauggagguaacugucccuuccgugccuguggaaaagcucugggaacccagcuagccaguaaaugcacugucucgcucagacucgcggcccaacauggcuggcuuuugcccagguuuguaaguacauucugggaacugaacucagguacuccagcuugcaagguaagcacuucacaggcugguccaucucaccagagcuggaccucguucuuaccugacgcauucaucucuauuuuucuuaccuuguuuccacagugccccacccccaccccaccaaaccggaaccaccaccacccgcagucucagaacuucaaagagaacuguuacaauuucucucccaucacugcuugggaagccaacugcggaacaggaggcaacaaucuauuuugccuaaguucuuuuccuauaguaaguaaccaacuccuccuuucaaagauuccugccuccgcagaaaucacucucuagcacugagagcacgggcaaacaccaucuccucucccucccacccugccucccauccuucaacaggucacccagcugacuaauuucaggaauucuggguagcagcaaguggugacucuggugugugggugagugugugugugugugugugugugugugugcgcgcgcgcgcgugcgugugugcauguguguguguguguauuuguaugugucugugugucgaggugggggguuugugucugugugugugugcaucugaguguaugugaaugucauguguaugucucuauguguguccauacaugugaugguggugauaauccagacgaggaggcccccccuccccccauaggcuugaguguaugugaacacuugauccccaguuggccaauuuggagcagcuuaggaguuguggccuucuuggaaggaaguuugucccuggaggcaaacuuugagaauuuaaagacuuacaccauuuccaguuguuuuuucugcuucaugcuuacaguaugugugcucucagcaucugcuccagcugcugugucuucugcuugcuacacugugucccugccaugaugguuguc

SEQ ID NO: 5560 - RNA, 472 nt, Mus musculus
accuuccuuucucucuccucggccaucuuggcggcugguguugguuggggguugucccgcaccuaaggcaggaagaugguggccucaaaaaagacaaaaaagucucuggagucgaucaacucuaggcuccaacuuguugugaaaagugagaaguacaugcugggguacaaacagacacuuaagaugaucagacaaggcaaauugaaguugguuauccucgccaacagcugcccagcuuugaggaaaucugaaauagaguacuaugccauguuggcuaaaacuggcguccaucacuacaggggcaauaauauugaacugggcaccgcguguggaaaacacuacagaguaugcacacuggcuaucauugacccaggugauucugauauuauuagaagcaugccagaacagacuggugagaaguaaacaagaaaguuuuccuuuaauagaacuuugccagagcuccuuuuggggg

SEQ ID NO: 5561 - RNA, 994 nt, Mus musculus
cauguuacuguuagguuuacugucuuggguaaaauggcauaguaaccagaugucgugaaaaagggagcaaaccaauucucaauagcaggcaaacugaggcuuggaaagucauuucccccgugaaccaaaaaagcauccaaaggccucuccacggccagccugcagccagcccucuucuccggcuuccugcuaacaagcaggguuaccuguuauauucuggcaacagaaccuuuguguaugggugguccuguucccccaauugguucuuggucucucaguaaagacgccaugggccaaucacugggcaggagagauaggcaggacuuccaggucccgagaggcaaggagagaccagaguuccuggugcuucugaugaagaaaaggugaccagccccgugagaucuuggguggagcagccguaugugaccacucccacaggcagggaagucggaagugauuaaguaggauguaacugagcuacuaaaucugagggcagguggagaagugcggagauaagaauauugaugagggcaagcuuuuccuggcgggagauaguaucgcccagcaauuguaucaaaaggcagauugaaauugaacaacugugugucugugucuuuuaucuguggauuccugggaagcugggugggggcugguagcgcugcccauucccggauccugggcaggguagcaaaagcuacuugcaacaccuuugacuggaacugaaggugagacacucagacagaccuggccaccacguguuuaagcugucuucuccucucugagcuucgcguguuauugucuucagaucguuuguuugaaaacagagcucauguuggcuuggaauucauuaugcuccugccuugcuagucauacaggccugugccaccucaccgagauuucaguuaccuucuggauagagccuggaccaguugcggaagccacaagcaucgccagccaucuuggucccuggaugacuaucuguauucagucacua

SEQ ID NO: 5562 - RNA, 1168 nt, Mus musculus
guuuucuguuugugaauaauccuuuuauuccgugccauuaggcacauuaaauuauugagucgucccugucuugggacaugcuggaucccaaauauaauaggagaaauuucucgaggcugaguucuuuguucuggcagcaggggaccgguguguaauaauacuuuaguacagcuagugucugccacguggcuggaaggaagcagguuuguccuugguuacuaggaagagagaaaaauacauaaaguaccaaacgguaacucauaaucaguucucaggcugaggcaggauuacauugaggcagccucgcuagugcugagagccuuuccagcaaaaugcuccagcaucugagauggcguuaggucauccaucaacauacucugaagaaugagcucccaaggaguaggcuagguacgacaaucuuacuuagucuauagcuggcuuacucgguugccucuucaagucugaugucugggaaccaaaagcccauuuuauacacccuucucagagcuagcagcucuccucucuucagaagcugagggguccucauuguggagugcgauggguuccaagcugucgucuaggcugguugagaacuccugccuagugauccuccugccucacacucucaagggcucagauuccaccugacuggaauguuugccccaccccccuuugcuuccauugcugacuacacagaacuugccuaggacuaaaucuuguccauuucaagaguuuucuaaaccaggagccagaaagcccaaguuccauuuccaacugcugcuuaagccuguggccuacccguggaggaaagcaaaggacuagagcaugcgcagcaggcuguuuagaggcuauuacuuugaagagggacuuacuacucaaagggagugaggcaaccaaagaugggguaaaagcgugcaaugcuaguucugagcuccacggcaugggugagagcuugucacaguccgcugggguuacagacugauguugguuaaacgugucuuauucuguguucugggaaaugcucaucucuucgugcuaacucacuuucccucagugcgaugguucuguugucaacccuccuaaugcuguaacccuuuaauaugguggugagcccccaccccaccccacccauaaaauucuuugucacugcuacuuccuaacuguaagu

SEQ ID NO: 5563 - RNA, 1168 nt, Mus musculus
acuuacaguuaggaaguagcagugacaaagaauuuuaugggugggguggggugggggcucaccaccauauuaaaggguuacagcauuaggaggguugacaacagaaccaucgcacugagggaaagugaguuagcacgaagagaugagcauuucccagaacacagaauaagacacguuuaaccaacaucagucuguaaccccagcggacugugacaagcucucacccaugccguggagcucagaacuagcauugcacgcuuuuaccccaucuuugguugccucacucccuuugaguaguaagucccucuucaaaguaauagccucuaaacagccugcugcgcaugcucuaguccuuugcuuuccuccacggguaggccacaggcuuaagcagcaguuggaaauggaacuugggcuuucuggcuccugguuuagaaaacucuugaaauggacaagauuuaguccuaggcaaguucuguguagucagcaauggaagcaaagggggguggggcaaacauuccagucagguggaaucugagcccuugagagugugaggcaggaggaucacuaggcaggaguucucaaccagccuagacgacagcuuggaacccaucgcacuccacaaugaggaccccucagcuucugaagagaggagagcugcuagcucugagaaggguguauaaaaugggcuuuugguucccagacaucagacuugaagaggcaaccgaguaagccagcuauagacuaaguaagauugucguaccuagccuacuccuugggagcucauucuucagaguauguugauggaugaccuaacgccaucucagaugcuggagcauuuugcuggaaaggcucucagcacuagcgaggcugccucaauguaauccugccucagccugagaacugauuaugaguuaccguuugguacuuuauguauuuuucucucuuccuaguaaccaaggacaaaccugcuuccuuccagccacguggcagacacuagcuguacuaaaguauuauuacacaccgguccccugcugccagaacaaagaacucagccucgagaaauuucuccuauuauauuugggauccagcaugucccaagacagggacgacucaauaauuuaaugugccuaauggcacggaauaaaaggauuauucacaaacagaaaac

SEQ ID NO: 5564 - RNA, 16337 nt, Mus musculus
gcggcggaagaaaccucuauuauacagaaagugauagauacagcagucauucucauggguuuacauccacagggaaaaaaaauuuuuuuaagacuucuuccuguagcccuggcuggucuggaacucaggcaggcuggccuccaacucaagagauaggacugccucugcugagauuaaagauugcgcgccacuaccuccuggcuacccaaauuuuuaguguauaaacuguggaaacaacaccccagccauucaaucgcuaccucauuccuucugaauacaaaguaccaacaguuguuagcugucaaaccagugcaacggcuuuuguuacccaguuacuucccaacagagaucugggugagcucaagcaaucuuauaaaaaguuaaaaguauaaucaugagagaauuuguuaacuucaagugugcuucaaaucgguaguucucaagucaugucacacuaaucaccgucuuagucaggacucuugaaaaugucagcaagacaaacccaaguauagaaaaccuggcgggggcggaggaccaaauucacaacuuaugauccgaagggagauauuagaaggcuuggauuucaagguguaaugcaggaacagaacccaugaucaaccgcagccccaagcucucuagucuugggcccaguucccagcagcagcagggaaccacaccaacacagguuucugcagcaguugguguuugcugaccacucuaacugaucugucuugggaguagacugccagcggcaggguuagaaaccuccaggauggucucugacacuggagugcccuaaaugcauguggcugcugacuacuucaaugaacguuuuaccuccaacugacagucucuacaaucaggagcgucagggcucagggcuggggaccuucccugacuccagcaaaugcaggaggcugaggcugagguacugguaaacugagguggccacaggaacaggggcucagucuuaccgagauccuccaaacaguagacaaacuuaagcaucccagccuuuaguucuaagaggagcagucgucucaggcaucccuuugacugcuagcagauaagucaggcugcuucuaagaauuacacuaagcagcacagcgauacggcuccuuuuccaaagugaggaaucucagcuaaauauuuggacaaggacauuuuuagacacugcuaagagaggacaggagauuuuaagcaguuuucaaauuggauuuagaagccaaggcaaauccucuaaccuaccucugaccaugcagagcacaggaauccaacuagacaacagcuuuacaacaaaccuaaaaauagggagucuucauaaauguucuaagcuguccugcucuggacagccccugaucucuagcugugaaacccagccagcuuuggugcacuuccaucugggggucauuacucuagacauccucgggucuuuggccuucucaucccaacugcuuaagcacaaguagaaaaacacuguccguagguggguuguaguuuccaaauggcaagaaacugaccaggaaucauauauauccagaacacggaggcacuugaaagcaucacgaggccugagcucagcuccuucaacugugcuccgagcugcaggaauggcugcugggaagucuagggagacucaagucuuauguuguaguaauuaacacuuguguuauaguaauuaacagccaccacagugacaucugcacauauacagaauuauauuuaaauucauauggaauaauauuuacauguuaauuaaguuauacguaggaaauuaagaaaaguccagaugacaguuuacaaacaaagaaaacuauacaagacaggaagagagccaacgguaaacaacacgaucuuccccuacgaccagcagacagggacauccauccagagggcuacaucuucuuaaucugauuguccaagucaucaaaguacgggugcuucagggccauuuugccagagauucguuuggcaggaucauagacuagcauuuucuagagagaaaaagggaaauaaauuuagaagccugcccucuauuuaccucuccaagauacuuaaaucacacacagacaccuugguaaccuguuauaaauuauaagauaagcacccagacagcuuaaaaccaaaacauaaaucuucacauuaucuagcuaauuauaucuacccuagaaauuaaauguccaucuguuauucacaacugaaaaaguagcaaucaguuauaguguuucaugauaguguccacacaaccccuucgucaagccaacaaaggaaaaaccccauagcauuuuuauaaacacaguuauaauagauggacuaauuauuguaaacuaauuuaaauacuccagaucuuaaaucugaucaugcauauuaucuucagagaaaauagauuaaggagguggagagauggcucagcaauuaagagcgaugacuacucuuccagaaguccugaguucaacucccagcaaccacaugguggcucacaaccaucuguaaugggauccgaugcccucuucuacugugucugaggacagcaacaguguauuugcauauguaaaauaaauaaguaaauuuuuaaaaaggcaaacaaauaaauaugaaggccuugaggauaugucugucaguccgcacagacauaugagaaagaugugccacacuguuuggcuuaagacaccaagucuuucaaggacagcaagaaacuugcccgaauccaucaaugugggagaaaauaaacugaagccaagucucaucaauaauccaguggucuccaacuggggcaguuugcuucugggguccugcgauagacacaggcccugcuaacucagcagucugccgcuggagugggggacagggcagugauagccacagugcucagcaggcagcagggccacggcaagcuuagcuauugcaggguguuggcucaacagaggaaauuggugcccagaacugaugucuguuaagugaaguccuuuguuuaaagacugagaaguagggcugcgccucaacagucaaugaccaaccuuccuacaccaccucaagaaagcucugccuucuguccauagcccccagcaacacacacacacacacacacacacacacacacacacacacacacacagagcuaauaacuuuagauaauaccagcagauuggacccaggcuacgggaaggcuucuaaguuagccaauaccaauauguaacaaacuaugugacagcuguaggggucuggacaaaucugagccccauuugguggcaucguuuauagauugcaagggagcggaaagaccaacugaaucgucuacuugauuccuucuacaaacucagauuuuaaacccugcucuaccuacagcaaauuuccuaaaggagaccuuuauuaauccugaacaguaauuuuguucuuugcauugcuaauauugugcaccaagacaacugaagaaaaucagaauuaauuagucuuugcuagcuuuucugaggaaacaaggccagaccugagcaauggaguuaugcugucaaaagccugaacagcucaguauccuaagcagucaacaguguaaaccgaugaacugagggcucaguagcaaacagagaggagugagucauuguaacucaucaacauacucucaagcaagaaggugugugaguccagccucuccuaccggaugagaaguaaaugacaaaguccaacaccagaggcuccucagaccaccaggcacuucacaccucaaaggcagcucgcugucacuacaggauuaccgggcauccgacucagcugcugugucuucgugcugacaaguccaggacugaguacauccagucacccuuaccugucacuacugacacccaagggcaccacgcucgaaccauaaagaacagcucacuuacugagagcaaauccaagccguucucguccagguucuugacgugggaugcgaggcuccccggcuuccacuugggaaagguguucuuguaguccugcagggacucgacuucuggccacacuucguuguuaggagugcccagagcucugaaaggaagcaaaaguccuaucacauacacggugccuuuauuauuuuaaccauacaggcuuuuaacagcuuagguauaaaacacaauuaccugaagauccugaagagcuggucaaucucugagucgccguggaaaagcggcuucuugguggccaguucugcaaauauggucccuauacuccagaugucaaccggaguggaguaacgagccgagcccagcaacacuucuggagaucgguaccacagcgucacuaccuggcacaggacagaccacacacgguugucuuuuaggaagcugugcaggugucaccaagaacuucagacaauuagcuauaugcaaauuacuaaguugaaccuauuuuauuucugauuucugcucauuaguggguaaguaccauagaccucuugcuuuucagaucucuaaagucaaaggaccaaagcagccauauccuggcuggcauauaccuggguggcauauaccuggcuggcauacaacuuuaauaccagcacucuggaggcagaguuugaggccagccuggucuacaaagugaguuccaggacagccagagcuacacagagaaacccugucucaaaaaaaccaaaaaaaaagaaaaaaaagaaaaaugaaaagaaaucuaagccaaagcgguaggaggggauucaaaugauuagugauuuagaacuacaguuuauuuaucaaaauagugaaugaccucaaugaacaaugcaaugaggucagcagcaguuacagccauuaaagacgagucauaucauaaacugugaaaaaauaaaaaagaauaaacaagacaggacugagaaggcugcucaguggguggcuagcuucccuaucaggcaaaacgagcaggaccagggccccagcagggcacacaucuguguaaucuuagcacccagagaaugaggccagucagggcuacaggagacccugccucaaaauccaaaugacacacaggggaccgacacuguagacuccaggcucacaccucccaagaugccaauguuccuguauuauacaagccaaugcccuuucagaaauaccagaggaaccuagucuggugcuguagaccuacuacugggaaggccgcuguaggagucccagguccaaagucuaucuacgccagugaccucagggccaaccagggcaagucagugagacguucucaaaacaaggagcagagugugugaguguguguguguggcccaugguucaagccccauugcagaggaaaauaauaaaacagacaaccacaugggaauccacugacaaagccugaugacagggccaagggcacagcucagugacaggacacccaagcaacaggggccaaagacugggguucaaucccuagugcucccucccccagcuagaguaggcuggcuccuaaaucuuucacaauaaucucccucacacagcaaaaccugccuuuuaauugaucugaaugagcacagcagguccaaucaggaggaagcacagcucugcggaaguucaacacagagaaacgagaaccccuaaaacuacaauaagccccuuccuggagguccccccaggccaucaaucuccccugacaaagaugccaaagggucugucuuccuuuucacagaccacacaaacaagagugaaguggcaauaaaaaagcaguuagccaacacuaccagaacagaacuuuuuguuugguuuucugagacaagguuucucuguguagcccuggguguuccaggacuugcucuauagacuaggcuggccuuaaacucaagagaucugccugccucuguccccccaagugcuggugugugcugccacugccuggcagcagaaacauuuuucaaccaaguauuucuaccuuggcuuaagguagaccagagggaggcagcaaccggacgcucagggcucuccuuaccucguguguguacacucguaucgguauuccaaacgcucuggcaaggccgaaaucagccaguuugauuguuccuuugucaucaaucaauagauuuugagguuucaagucucugugaagaacucgccgggaguggcaaaacacaauucccuggaggauuugguguaaguaacucuagaaaagcaacagccagacagacacuccgucacuccacaagacuccaaggagaaaggaguucugagaaaauaaaucaugaugcagagaaaacaauguagcuaccacaagacccuucaggccucuuuaaacaggugaguaucgaagauguaucuaugcccacaugagcauuuaaauuuuuggucccugucuuuaagucacauguuagcuuucugugcagaaguuuccucagcacucgugucaacuguuucuauccugaauaaagcugugcuuuuccauuucugucacuuuacacgugcauuuccucuuuugagacaacaggaaaauauguaaaacagcuuaaacugggaauguguaaaaguuuguucguaaccuacuucucuagugugugcaugcccacacaugugcacucuucaauguagguacccgagugacaggcagauauuucucauuaaaccugaaguucaccauuuugaucaaaauggauggcccugggacacaacagagccaucccacccgcagccccugccucuguccuucagccucugggcuuauagauguccacaccaccucaccaccuccauguggagccacaccaccaccucaccaccuccauguggagccugggaaccagagcucagcuccucgugcuugugccauaagcacuuucccucugaaauguccccaagccuuccaauccuaaagccaaaggaaucuuucccuauccauaacuuaagaaaaguuaggagauaggagagagcagaaaaauauugacauuauucuaaaacauuugaucuuauacauuauggcuuuaacaaaacaacaaaaaaaucauuaagaauacucugcuggagaguuuuaugucaacuugacagaagcuagaguuauuggagaggaagcuucaacugagaaaaugccuccuuaaguacagguuguaagcaagcuuguaaggcauuuucuuaauuaguaaucgcugggagagggcccagcucaucauggguggugccaucccuggacugguggcccugggcucuccacagccucugaaucagcuccugcccccaaguuccuggccaggagcuccuguccugacuuccuggggugaugagcaguuacaugcaaguguaagccaaacggccacuuuccuccucaaguugcuugcugaggccauagccuucaucucagcaauagccauacagugugagcacuggcaguggugggcaccacuagcaagucaccguguguuaguaauaaugacuuuugaaaccacugaaauacagaaagaugagugaauauguacagguuaugcaaaaaugaguaaacacaauaguauguuaaaugucaaauagaauaacuguaauaaaacccuucccauaauacacugagacuauuuaaaaguuacauacagucaagucuugguaacaauguaauaaaauaguaauugauuuuuagaggaccuaucaaccaugaucuuaaauauaaacacagauuuuaucacaguuccaagaagccaccucuaaaaugacauaaaguggugggugugguggcacaugcuuauaaugcccacacuugggagauggcggcuugaggaugagaguucaaggccagccugggcugcagaaugaaccuccaccaccacucaugacgacucacugcagccaucacuaaaguaggaaguaaucuaaguggaaaugguuuacuagcuguacaaaguauuaaaccacuacgaaacagagacaugagaggcuaacuaacgugugcagugcacauacagaaggaucccacuggguuuagaugcauacaaagucaacgugaacaucucaaggcaugcacagaguucaguggaaaaauaaagccgguuuaaggugaagaccccuuuaccauagacauuuacaaccuauacccauuugcugagaauaacacuugcccaauuauacacaaugcccuggauccaauacccgguaccacacacaaagaacaauaaauacaauuauaauuuaacugaaauacaauguuuacauuaaccaaagccuacuugucagaguaagaccacuuagcaucagcaccgggcucaggcugcugucgcugaucugcacauaaccacuguagccuggccugcccccagcaaugugauacauaagccacaggguagcacuuaggugcucagacgcuacuucucacuucuagaaccuucuggaaaugagacaggcagaugaugaucucauccgguggaaggaaggaaaauaaaaugcugucucuucccuuacagguuuucuaagaugcagccacaaaacgcaaggauggagcccacguucagagagcguauuaguaaaagcacgcaacucuuuaccuuaacgagugaagaauccaugaacugcccaggagggauggaguccagguacuucuugagguccauggacaggaacucaaagaugagauacagccuggaguccugcaugagcacauccugcaggcugagcagagcaagcgugaguccagccagcagccugccuccacuuccaacagcauaacugcuaacagugaccuucacucucaaguagaacuugaggacggaaguucaggacaguaguccacagccuccucugcaggaggagcuagcucacaccgccugcacuccuaaagcuggcugcucgagaagauuaaagcugcucccuagugccagccccagugcaacaacaguuagaacccaggggcagaggcaggucacgccagcuaccagaggugcuaaguaaggcaaggaucucuagaugcaaaggauggagugagcacaaggucacccuggguaauucugugagugcuggagacugggugcggugguuuaaacccauaaucccggcacuugggagcuagaggacagcaguaaauuccaggccaaccugggugagcuagaguaauauccugucuuaauaauuucaaaaccccauauuaggaggccagaggcuacagcucagugguagagcacuuucuuagcucuacccaaaggccuggguucagucccuccuaccaacagaaauucuaaugaaccaccagacaacguccucaaugacccagcccaagcaagucaauaaagcauagcuuaucuaccucagccuggccccuggucucaggagccucuggggaccugggcccuaaaaguaggagcuaagcaagcuccccauggaaggggucccagggcugugccuugcuccucuagccaauucuagcacccugucucaaauucuccaaacaccaucagcaaagcaggacuccaucccacuugaaccagaaaguacauaaaaauuucuacuuuaaaacagaugugcagcagcacagggagaguggcuucaguucuaacacagcacaccugacuauauuuggaugucgaaguucuuuuaauagagagauuucccgaauugcaguacugggcacuccuucuuccucgcuuucaagucugaucuucuucauggccacuaucuggccagugacucugugucuacccuuauacaccacaccguaaguaccugaaagaaagcaaagagauuuucuucuaaguugaacucuuugaguaucacacgagagaaaugccagcugcagucagauaggccccucacaucauuaaacccucacugcuuucaaaaaggcauugaagauaacuacgaucuaacauauacaugguuuggaaauaaagcccacugagucauccuacaucucccucccaguuaagcuuccuucacgugaacauuaggacauggaucagguugaaauucaccuaucaaauauccugcauguagucgcuacauuaaaaacuuaagauuggaaaucaguaccaagaggaggcacugugaaacuuccaaaaaacuggacugccuuaggacuuccuugauaccuuacacaucucaaaacacaaccaccuguccucacccggcagaguggagacagaagcaccaugcauuuguauuaaacccaauaaagcugcuaucuuguacuagagugggucuacccacugggaugugggaaacacuaaccugggugaagucacuugaccagcaaaggcaggaagaaaggacagcaugggcuguggcagacacagagagguacgcuaauuaggugucucacaccccugcuacucuucaggugcggauucccuagcuaucuaugaacuuuguugaaaagcuuuucaugguaugguauagcuucagcaaugacuacaacagcaggccuggugacacacagcugcuuguaagacugaggcaggagaauuacaaguuggagacaagcguggagaacuuaguaagacccccgucuuggaagucaaagguccccacguuuacaugccuguaauccuaucccuggggaaaagcugaggcaagguuagaacuugucuaaaagcaccaaagggugagagcagcuuccuccaaacguaaaagcuacuccacagcauuuacuggcucuaagacuccaucccagcaaucaacugcuuagaaaauuaagcagcuugcugcccacauaagcuuuauuccagcauucuuuaaauuccaggacuguuuguuuuccuaaacacuacaguuauuuuaauauuacuuccaauaaaauccuaggggauuaaauaaucaaguuauuccagauaaaaagaaccgacaacauucugucugcgaagccacaggaaaucugugagcucacauguuccugaaugguggauaucaugcuugucugaagccacgagcaagcuggcacuauccuagcagucacaguuagucagguaagcaauggucaauccaggauucuuucuggcaucuuguucccucccgguguccugcugcauuucuugacaaaugugcagaacgaacucaggaauggcagucaacacccaguaaccguugauucggagacaacacagaacugcuuguucugaguaucucaacuccuggcucuucucaguuaacugcaacagggcacuauucauaagcuaaacaguagauguucugaaauuaaacauuuguuuuagauccugaaguauuuuaaguaauaauugaggaggggaaaguaucagguaaggcuggggaggcucgggguuuagaccacacuguccuugcagaggaccaggacccacaccagggcucagccuccuguaaaugcaaugccagaggagguaacacuucuggccuccaugggcuaugcacaccugugugaaugagcgcgcacaaacauacacauacauacauacauacauacacacacacacacucugaauuuuagcaaaugucauacaagugaaagcaagaguaagaucccaguuauccuggguaaagucuugauaacacugccugguaaaagccauuaaaccucaucaaaaacaaauguuucuagcgugcuuacugaaugccaaggaaggccccaccaaccacauggagccaggcagcuguguaaccugaagacgagacagucuucucuguccugcugggcauggcgaccaacaauacacaggugacuacguaagaaaaugcuaacacgggacaaacacauauucgcagguuucacugaguacuuggaauuggcagaagaaaacgucgacagcaguauguaauuuucaaauuauuucaacaagccgcuauucaggauccccccccagagaauccagaacagccaggcacaauguagcagacaagccucuaggccagagaauucagaaaagcaggucaaaggucacagcugaaaagcugugagaggugcccgaggcccagagcaaacugggaauaccgaggcugccuggaagaaaaugaauaaauccuucaacuacaacauugguucucaaccugugggucgauagcucuuuggagaggcacacauuaucagauauucugcauaucagauacuuauguuaugacucauaagaguaguaaaauuguuaugaagaagcaacaaaacuaauuuaauggcuggggaguaaccacgacaggaggaacuguauuaaaggguugugguguuaggaaggcugagaaccacugcucuagaacaaguuaaagagugagcccaggaggggauggcuucagaaaguccuaucuaaggucaucaaaaagggggaauggcccaacuggaccggugaguggcaguggaugucacuggcgaggggaagguguuaccaaggaaggagacaguugaagagauguugucacauuaaaaagagaaagccccagaggcgcaccagacacugccagggccauuccugguuugcuaaguccccugccuugguuuucaugcccuguguaagcagggucucuaaacauuggugaaaacaacccucaacagaagccacacagaaacaaguuccucuguuugcuccuggagagcuaagaaugaagucuugacuccuacauagaaauauggaaauucuguugcggggagaagaaaacaacaauagagaggacuaggaaaggguucuuuucauuccuccuuaugucccauaggccucagcacuguuuaaaauacuacagaaggggacugaacaccaugugacagccacuagucauucuugcccacggugaccacacagaccaccacccagcuuacauaaaacucagaaccaguacuuagaaagacuaaaauguacugugaaguuagcauagauuaucucccuagucgacucccccagcacaccugcaccccaaacacaagcaucugggguacucaguucaauagccuagagcacaaggcccuaggguccuuagcaagaaucaggauaacuaaaacccuccugauggagaagcaccuugugcuucagguuauccguaaagcaugcuuucuuuuuuuuuucuuuucuguuuuucgagacaggguuucucuguauagcccuggcuauccuggaacuuuguagaccaggcuggccucgaacucagaaauccgccugccucugccucccaagugcugggauuaaaggugugugccaccacgcccagcugcgugccuuccuuuugcuggugcugugagaaacacccagacaaaaguagcccaaggaaggguuuguuugcacucaggaucgggguuagaguccagcagcagcagcagcaagagcacaggcagugggagagugagguucacuguggcuugacacccuucuccagucacacaguccaggaucucaggcaaggaaggcacccacacugggggagguuccugcccacgucaauuaauagagucaaagacaauccccuacaggugugcucagagugaucccagauccugucuaggaggccacaaacaccaacucucacagcacacucaugcgcacgcguacagaugcaucuacgacugcacucaguaaagguuucuguguuccacaguagcauuguuaucuucuuuucaaaaaacauucugcuaaaaccacuuaccuucuccaauuuucucuauuuugauauagucuuccauaguuacucaacagguuacgacggacccuaaaaugaggggaaacagugcugugauuccgugcuacuaacucaaaaacagucuaagcaucaucuggaagacaucuuuuccagggccucccgcguagccggcaaacgucagucaucccagauggucagauggucuuguuaggguuuagcuguucuugcaagugagccauucugagccuucucagacacugcguuuguauauucuacacagccaagggcuuagccccuucacaugcacaaagcaagcaggccugucaagccggccacuguggagacugauacacagcuagcuaaagcaacuuagugacacuaugucucaaaauuuaccaaaaaaagcaaaaggcccugauccccagggcugaauuucagcacacuacuaccguacuaaaaugguguacuguuuuaguuuuucuuaaaauaauaagagucugcgagaaggaaguugugcacgauguaauccuagcacagggaagaacaaguucaaggccaaccuguggccucguucgcugcaacacuguuucaaaaggaaacaaaguacaacuguaaaguccaaccacuaggaauaacaguuguuguuguuguuuuuaauaaaagcaucuguuuaccuuauaagcauucaauucuccaggcagugguggcacaugccauuaaucccagcacuugggaggcagaggcaggcggauuucugaguucgaggucuacaaagugaguuccaggacagccagggcuacacagagaaacccugucucgggggaaauaaacaaaaaacaaaaaucauucaauugaaugcuucccaaaagcagccacagacaaucccacucaagguacucaaagagaaagaaauguccauaagcaccuuagaagaaagaauggaagguguugugcugugcuggcuagcuuuaggccaggucacauugucacaagcugaagucaucuugagaggagagaaccucaguuaagaaaaugcucccauaggauggggcuggaggcaagucuuuaggucaguuucuuaauuagagauugaugggggcgggcucagcccguuguggguggggucauccgugggcauauaggguccuguguucuuaaagcaggcugagcaagcuaugugaaagaaggcaggaagcagcccccuccauggccuccugccuccagguuccuguccagacuuccucugaggccgaacugugacguggaaguacaagacaacuaaacccuuuccuucccaaguuccuuugcuuuggucaugguguuucaucccaacaacgcuaagacaguguguuugcuaaucaugcuuugaaaaauaucacgaacaagggagaaacaauuucuuggcucacaaagaaugguaggaaaaaggugugccuucuccuugaaagcccucugccacgggugacaagauccuuaugaaugagcaucaaggaauggcugaccucucgugagcuguuccuuacagaucucuuuccacaguaaaaucaacuccauggggugugggggcacagccaggaaucccagcucuuggcacugcacaaggaggcagcggcucaacagauaaaaauucagaaggaaaauguaaacccguccaaggguccugccaggcaucccacugaacccuggggauucucagacacauaagauugacucucaacuauggagauuauguuuaggaaauuucaacgcauccccccccaacccccuuucuucaauacagagacuuaauauaacuauagagcauuaaacguuucaaccaccucugcacagacagcaaagaguuaacaugucuugaaagcugggcuuauuuccuuccaacauuuuccagucucccgggccugcuguuaaaagcugcccaguguauccaaguugggggcaggcgaugguggcccgcacaucagaaccuucaucgguauuuauguuuuaagacgaucaaggacgcgaaggcauccgcgguucucccucucucuccuucuuugccuggguacagucuguggccuuagcacaggcaacuaaaaauaaacgauccuacacuuucuugguucugcaccuugguaggaauaagcuuuuuaaacgaccacgggucuguuucuccggcaguaccgacuuaaggccuccgaaggcagcuggccuggugcagcccagcuccacacuggcagccaacagggccugggacauaacuuggcaccccgcccacacccgggcccacuccagcgaggcccauccagucugcaggaaccuggagcucgcguaggggccugcacguccgcaggacccggggcucaagugagccuugcccuuccauaagggaccgcuggaucgggugagcccugccccccccccccauagggaucccaggcuccggugagcccugcuccuccauaguguccccaggcucagguaggccaugcuccugcauaggggacccuggccucagaugaggacaugcucauccauaggguaccccagaccccgggcucagggaggccaugcccgaccauaagggaucccggacuuaggugaggcccuacccguccacaggagaccaagaucucacguggaggcccuacccguccacaagggauccccaggcucacauggauguccugcccuuccccgggggaacccccagaucccguggagcccccgcaggcccagccugcacccaguccgacucacgccauaccucucugucccggcuggggccacaccgcaguuccggacugcgcggacgcagcaacuccaggagcuuagaggccgagugccagcaguuucaaacucgccgcggua

SEQ ID NO: 5565 - RNA, 1023 nt, Mus musculus
gaugguggcccgcacaucagaaccuucaucgguauuuauguuuuaagacgaucaaggacgcgaaggcauccgcgguucucccucucucuccuucuuugccuggguacagucuguggccuuagcacaggcaacuaaaaauaaacgauccuacacuuucuugguucugcaccuugguaggaauaagcuuuuuaaacgaccacgggucuguuucuccggcaguaccgacuuaaggccuccgaaggcagcuggccuggugcagcccagcuccacacuggcagccaacagggccugggacauaacuuggcaccccgcccacacccgggcccacuccagcgaggcccauccagucugcaggaaccuggagcucgcguaggggccugcacguccgcaggacccggggcucaagugagccuugcccuuccauaagggaccgcuggaucgggugagcccugccccccccccccauagggaucccaggcuccggugagcccugcuccuccauaguguccccaggcucagguaggccaugcuccugcauaggggacccuggccucagaugaggacaugcucauccauaggguaccccagaccccgggcucagggaggccaugcccgaccauaagggaucccggacuuaggugaggcccuacccguccacaggagaccaagaucucacguggaggcccuacccguccacaagggauccccaggcucacauggauguccugcccuuccccgggggaacccccagaucccguggagcccccgcaggcccagccugcacccaguccgacucacgccauaccucucugucccggcuggggccacaccgcaguuccggacugcgcggacgcagcaacuccaggagcuuagaggccgagugccagcaguuucaaacucgccgcgguaaagcucccgggauccgccaauccgauugcacguagacguucaaaggagccaaucagagcugagcuacgcuugggcggggcugccugggagcgcagagcgcgaaagggagcggaa

SEQ ID NO: 5566 - RNA, 1352 nt, Mus musculus
accuuugucugagcauccacaugggcccccugguugacaaggaccucggccacauucacucggucuucuugagcagccagguggaguggggugagaccgcucugcaagagaucccaagggcauggccgucagucauagguagggugagugcgugcauguuugaaaucuggcuugugaguucuaggaaaguagcuuugacuacuccuuucuuaaaggaaaagcccucagaguaagggcauguaccacucuguaggagcccaacaucagcccugcugaccauaggcuucauaaaaauauuucagguguaccccagaguggcagggauguucaccacagacucauauugcuccagacuaugacauuugauccaucuggacucgcuuuccaucuuauucacuucuuuguagucauauuuuuaaagccaagagaagcaaucauacugugugccccaaaaaacauuugugggugaucacuauacaucagagacucuaaacucaaaaucaugcuggaguuuuaauauguuaucagugggguuaacuucagcaaaaaguuauugacaauuauuaaaauauuguauauuuuauuaauauuaauuaauaugaauuuaacauuaauauauaauauuaaaauaauuuauuaauuauuuauuaaugauuaaaugaaaauaaauaucaaaucaacaaaaucaauuaauuuaguuaauuaauucaauuuaaucaauuuaauauuaaugcauaauauuacaauacuauagguauuauaauaauauagugcuauaucauggcaauguucuugcuacauuguuaauguuguuaauaaacuugugugaguccguucucuucaucuaccaguggguuugagggaauggaacuugggucauuagacuugucaacaaauucccuaacaggauaagauguuuugccagcccugcauauauauuucuaugugaacugaaaauuuugaucaauuuucagacuuuucugaggauauaauugcuaugguuugcucuguagagaagggaaucaccuuauugcucagguugacauucgcguuucuacucaggagcagcgacaccauguccacgugcccuuccugugccgcaagauggacggacgcaaucccuugccggguaaccgcguuugcaucagcaccguacuccagcagggacguggcuauguccaucugguucuucuuggccgcgaugugcagugguguauagccauucugucaaaaccaaucacucggucaugucuaguaccaagaaaagaugcaugccgugcgucucccuuucuuguggcucucuuucaccauacggaaaaacaugaugaaguaaagaaacugcuaaaccaaau

SEQ ID NO: 5567 - RNA, 1212 nt, Mus musculus
uaaaaaaaauaaaugccuuuauugggcauuugucuuccagccugccaaucaacccuccugggcguggucaccuuuauacgugugcuuaggucucccuuugcuccacaguaccagcagcugaugccagcucugcuucacucauauacccacacaggcuacagaaguacaaauaacccuuuucucugugugggcugagcugcgaagggcuaaauaaauaauaaaaguauuguuaaagucuaaaagaaaaaaaaauaaagacgggagcuuuguuuucugcuaagacuggucauaucuacaggaugucucauucuuccucgggggcagaugugugucggggagcugaggauuagaauucauuacuaaagacucaaguccuagggacuccagguguguggguggucacagcucuggaagaaauugucucuuuccuucaaagugguugugggaauuaaaggccugaaaggaugugaaugagggagggggaagggaagaccuuggagaggaaaugaagagagaggagagagauaggaaggggcagacagagagacagagacagagcuacagaggagagagaagagaggggugucaugguggugagcccaguccugagggaaggguggccccucccacauggucaccuccaagggucagcuaucuugcaggagauuccucuggucuuuucugcugaccauuuaucuauggacuggaucugaggcccuggcagucaccuuaaaucucuaaguccuccccagaaggaaggucaggauccuguguccugcuuaguuaccaccucugagccccugccaccaccauuaagucuuccuguauucucuugucacaugggagcauccgagggcacaugacuucuuucuggcauucaccugcaguugaggguggagaggccauucuaucuccagggcagucaggacagaggcagcugucccuugccacaucucccugauuuucuuucuccuauagaggguggaggacucgugcugagcaccagcugccuggcaccuugggcauuaggaucuagaucccagcgaagccuaugauauugucaccgugggacacacggcucccucuuucugauucuuguucguguagauaagauaaucuaucucugacaaaaauuuaaaaaugcacggagagaguguuguaguggaacuuucccuccaggccugacaugaccacuagcuagcgcgaaguaga

SEQ ID NO: 5568 - RNA, 3601 nt, Mus musculus
uuuuuuauuuuuguuuuuuuuuuuuuuugcguaaggaaagcaaucuucuuuauuguacacaguacagaauauacgcagcucggcagggugcacgcggcccugugcagggggaaguaguucaaauccacacucuggaaaagaagcaaaugcaugaaaggagccccacaccuugacggggacggcucugcgggagguacaugaguccggugggaaugcaaaguggugugacugucccgugucccuugacuggcacaugugccgucaaaacaggagggacagcucaggcuacggaagauucuucucaauccgccccccaaaacagcauaaauucacuaaagaaaacuaaaacaaaccccacaccaguauaagugaagagaggaagaacaaaaaaaaaccccaaaaucuauacggcauuuacaacaaauaaaucucuagccaguugggguaaaauaugcaucuauggauagacuguguauagauuagaaagcuauaaauaugcuuaugaaagaguccuuucaucagaguacaaugcuaauuaaggcccaagcuucagguuugacgccucugugggcugacuagauucucauagcucuaaaacauaccccucguuccuauaaaccuucuucacaagucaugagaaggcuguggagugucccacgcucagucagcucugugucccgucccgcacguguggagugucaaggacagcaaacuccugucaaccaggagucaggcagcaaagcacugccguuuccugcugacguccucaccacuccaaacccaaucuguacacagcuuuaguuugguuguuuagaacauccccgauauaauacagcaaucagaauaaaaaauuuuuaaaaaacgaaaaaguagcaggaagccaguaaugcuagcuagcacugcucuaccugugcgugacagguaaguuucagaccccggggaacggcugugcaggguccaaaguccaaaacugaaagaaaaaggaaaacaaggcagaugccuggguccccagcaggugaccagucguuaaauggacaugacauguauguacuauaugacauguguguaguacaugacauguauguaguaugugacauguauguaguauguacaucugcuucccagagaaggagaguuagugagcauggagaacuauacacauagaauacuaagcuguguccaggcugcccugcacacuuaaaaaaauguacagaucagguuauacgccucaacagguugucuggugcagaaagcacuaagcaggcuucuguguggcgaaggggaagccccagcagauccccucgcaggcugcagcaucuuccaaaguaggcaccaccccacccgagggaugcagugcagguaccaaaaggggguuuguuuuuuguuuguuuuugcuuuaaauaccaaaacuguugcgcgcgcucaacuggccaggaagaacgacgcugcuacaggauccuucugcacacauuuauucaguccuguuucuucuuucuccauauaucucccuuguuuauaucucccuuguuuuuauaucucccuuguuuauaucucccuuguuuuuauaucucccccgaacccugggccucucacucuuuuauacucucaguucccauccacgcacagcaggccacgccgccucaccaggcacgcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacacaaaacuacaaaaaucaguuuauauaaacuguuuuuccccaaaacaaccuccaaaagcaagaugaacuccucccccccccccaaaucaaagcaaaacaaaauacugucauguucaucaucuuuuuaaaacaagccgucugcgcucagccgugugacugggaggaagggacuugauuuacggcucggcuggaaggaaggccaaagaggaacgcggucugagaaccauggagugaguaacagcucuccuggccuccccaguucuggacuacaggggaaagauuucagaaugagcuacaagaguuucgcaauuucaagccucaauggucugagccuccccgacucagccuuaucgacuguccuaugggugugcaguuucuucccaaagaauugugcaagucaaagccuccugugugaaggcauuuuaguaguccaugaucaacgcagauugucauacacucgguccccuuucaugggcgcuaacccugaacacacugcaguacugcucugcacauacuggccaugguggcaaggaggacgguauccacgucuccccaggaaguggugguuuuuguaucucccuguucccacuccucccgagccaagguauuugucuuaaagggugucgaauccagagacagcuuggguucuccugauaauauucaaagggcaagcuuuaggaacagccaagaacacaaacaaaaccacugcccucaguugccuggaugaggacugcuagcucuaggguguggcuacucggccauucagaaacuuaguaagcgaagccuucggcguaggggaggcugcugcagcgauccuuguccaggagguaagcaggguugucuucaaagugagucagaggcagcguguccuccucauugagggggcauucggauucugccuucaggaacgggcgcugauuguccgggaaggccauagagaagagugcauccgggucacacacaaauuuguagauguagcguuccccagccaccuucugcaugaugcccuuuucauaguaauagcggagagagcggcucagcuugccauaguucauggcuggccgauucuucuggauaccccaacggcgagcaaccucuuccgguucuaugagcuuaaauuccaugccugggucaguccaggcgaugaagugggcauuggcugggucauccaggagggugacaaggaacugccacagcugcagagagccucgucucugauaaggaggccccucucgauacauggugggcuccugcuugacuuugccuuccagucucucggguaccacgcaaguaucaucaaaguacagccugggguccuucucauacgggaauccuucauggcugcuggagaaauacccgccucucauguaggaugacuggcaguuaggcacuucugagucagcacaguaaucucggggcuccugcuugauccccaugggugacuggaacccaugugcuggaggaccaggcaucccagggaccccauguucauauagugggucaugguauuccugcuugaaucccugaagggguggcggagcugcggggacaaugggcucugacaucugccggugguagcuggggcgacuaucuccaggaacuccugacugaggagggaagggauggcugggcucagacagcugucgcugaaaucucuguucugauggauacuggcuuucaggcaucaucuuuggcauuugcaggggcugaugugguggccgggggaccgcaaauguuuguugcugugauccagguucuggaagugaguc

SEQ ID NO: 5569 - RNA, 20122 nt, Mus musculus
cacuuacccagaaaccaaucucgaccuaggcgggcaguccaggagaauccaaaggcguggugagcgacagaacgauggcggacgcggagaaaaacgcuguugcggagaaaaacaacgcuguugcgacgaaagagugaguguggaaggcgagggccuggggcggcggcucgggcaguggcggcggagggacaguggcgcccuaguucaggagugcgacuucugagggaucuugucacccuagcugaggagugcgggcccuaagagacgaugucaccuggauucuggaguguaggccccgaggagcaguuucaauuagaaaagauaaugcagcccgaaaagacugucauccuacuccaugaguguggccuuugaggguugaugucgccucaauucaggagugcagaauuugacugugugacaacgucucuuuuuuggaaugaugccuauuagggucuuuguggcauucugcugcagggguaugacuaagcagggacuucuuucuguaugcggagugauacaucuggauggcugacguaggucaccuuaugucggaugcugccuuugagggacauuaccucacccacccugagcccuguggcguaguauucuaaaaaagccagcuccauuacagaugucguaaccaacccuuuaccauucuaggaccuucugucacaaccuucuucuuuaguauuuuuuuaucuguaucucuguccucuaguggauuguuccagccaaucuggaaaggcuggguggguuacacaucauacguucugagaucagccauuacuagcaugucuuccaaggcuugccugaacuuuggcuuuucucuguuucuguauauaugccccugcugcuuucagacggauucaucgaguuuuuacccauugugacccccccuauuuaaacauguagucaugucugcacagucccuauccuccaguauuucaggugauuuccucauggcgcuuaguugcuacuguauguuguccagguacaugguguuucugaucucagccuaaagucccuuaagacccuuggguagccucugagcauuggcacccuccugacauagaugccacugcauauguuccuucgagcucgugugguaccauagcacaaucucacucaugccuuacaggguucuggcugaggcagcagccauucuagaaccuguaggcuugcaggaagaagcagagcugccugccaagaucauggaggaguuuaugaggguauguaugugcaaagugggacccagcguuucagaagacagggggcggggcugguccugggauagccucuugaaauagugggcagcaauggggaagaacaaaauggcuggucucuaguaucagaagggaagacuaaucccugcuucuguccccacgguaaacagaacucgcggaagaaagacaaacugcucuguagccagcuucaaguagugaacuucuuacagacuuuucuggcucaggaggacacugagcagagcccugaugcucuggcuucugaagaugccagucgugaguaggcuuggguuguagguagggugugggcugaaugguugaagcgggaagaugugagccaugccugugucugccucaugggaaggaaggcugugaacgagagcucuagaaggcuggcugcaggcaugacucacucguguucuuguucuuuguggcccaccuuagggcaaaaggcaacugaaacuaaggagcaguggaaggacaugaaggccacauacauggaucacguggaugucauaaaaugugcccugucugaggccuuaccccagguuaaagaggcucacaggaaguacacagagcuucagaaggcuuuugagcaacucgaggcuaagguauaccuagagaaccugaggggaugcaggacuggaggaaggggaggggaagcuggguuggaccucgaugcucucuccucaaaucaacccuaagaaggaauguccuuucucucccugcagaagcgaguccuugaggagaaacuucagcuggcucagaagcaguggguacugcaacaggugggcucugacuucucucuaggcucuucucugucuugaagugacaagguaucucugccugucagugagucugagccucaagcucuggcuaagcaggggagaugggagauauggcaggcgcugagaagaggagcaugaggugagucacggcccugcauucucaccccuucagaagcguuugcagaaccugacaaagauuucugcagaggucaagaggcgccggaagagggcucuggagaagcuugacggaucccaucaggaacuggaaaccuugaagcagcaagcggggcaggaacaggagaagcugcagaggugagguuugaauccuggguugaagccucaggcaguguacccaagacuccugucacuucccacaaacucugucccucuaggaaccagagcuaccuccagcugcuguguucgcugcagaauaagcuggucaucucugagggcaaggcugaggacaaagaugugaaagggcgagcccuuacagccaaauccaaaucuccuuaaagguaagcccugucaguugaguaaccacccuccccucguccccaagcagagaagaacagggcaacuguggggagagaucaguguccacuugacaagauugaaagaggagcugggaacuugaucuuacucccugcgggcggacacccuccauugauagcucucugggugauagcuguaugcacaagauccugcagcggacagaagccaacucagaaugugaugugcuugagcugccaagacggaaauccucgcccucugaacucuagauccgaggaacugaaaaaguggaaagaacaggaugguuaagauuuucagaccccagauuagguacaaaccauacucaagcacguguugucacagagauucuuuauuaagcagggaagaaaaguuagugucugcuuucugacacaggcaggaaaacagcagcaaaugaccucacagguauaguuuuuaagaagagaaaagugagggguugguuuggguuaaaauggguuaggauguggggguggggguggggguuguauauuuugauuggguaucuuaauuagauaagccaaagggagccuuugauugcuggacuugaauacuuugauggcuggaucuugugcaccagccucaggaggaggaaguggccaaauaagggaauagaccuccaguggcuagcuuuaauguuuuuuaauguaguuuaauguuuuuuguuuuuuuguuuuuguuuuuuuuuuuguuuuuuuuuuuuuagcaaggcagagggaagggagcggagagggcaaagccugccagaaccauguauuuuuagagaaugucauuuguaauaauugcuauuuuugauuagacagggaaaauaguuguagccucaauguagucuuuguuaaacauuucuuauuuuagaauugugugacauuuauuuuccuuuggauugugauuguuccuuuuuucuacuuaugucuuuaauguacuuguuuuguugaggucugagagaaguggguucaaguuuucagcuguggcccuuaauguacucaugguucuguuggccacuuuauguccacagaaaugccuuugacuagaaauacagcauuuuaauauuaauauaaccucugcaguucccuugcuuaccuuugccuugauuucaaccuugaguuuuagucuuacuuaguccuuaugucugucaguuguaugcauguuuagggccacuguuuacagauuggguucaguaauacuuuaaggaaucuuuaagauuucauaguucucaguucuguaaugaaaaggauuugauguuugugccauuuuacuguaauuucuauguuuugguauucuuagugccuucgcuuuaauguguuguuugguugguauuucuuucauccuuuucauuccuaagaaggucuucucuguaaguucagcuauuauuagccuaaaguuauaugugaaggacauugagccuuuucuuaagcacagaaugaacccuggaacgcauuaccaucgauacagcacccuaccuuuagcuaauacaguuguucauucuacuacuucuauccuuuauauucucacguauuaaaauuguagccauucaaugcuauauucauaucugcauguggauuuugaauuuccccucucuugauuuuacauugcauugcuuuccuauacaguaacuucaucauaaggaaauguuucauaauuuccuuuagaaauuagucuuuauuacuuuucuauugguguaaagagacuccaugaucaaagcaacuuauaaaacaaaaaagcauguaacauaaggcuugguaagguuucagagggugaguucaugcacauuguguacgccagggagaacgagagcaagcaggcaggcaggcauggcacuggagcaauaaugagggcuuacaucuagcccacauugcagcgggcagagagaggagagacuggggcaacuagccugggcuuugaaaccucauacccuacccacagugucacaccuccagagggccacaccuaauccuuccaaaacagugccaccaacuagagaccaaacauucaaacaugugagccauuggggcccauucccauucaaaucgccagagcacaaaagacuuuauaguaugaaaagacuuuuguuucauccucaaggugcguuucugacucucauuguuuccucugaggaaucagcgauacacuucacagcucuuucugugguauacuuuucuguuuucuagcuuuaugaaaguaaaauagaaaaacaggauauauauaguauuaagguauacaacauguuuugaugcuugaauaugcuaugaaaugauuaaauuaagcauaauaauguguuucuucacauacuuuccugcacugagacuaugaaagaugcacucagcagguuuuagaguacaguaaaccaacuuguccuggugccugcgcuauacaguagacugccagaucuuacccauagguuccuacucucccuggcugcucacaaucccuuuuuccauucuaucguuuuauuauguuguaaauaguugagaauaugcuuuuaucaacaauucuagaauauucucagccuugucucuuuaacguccacacuguuggguuauucuaaaggagcaguccgaucaguuaccuuuuuaaauauuuuuuuuuaauuuuuaaaaguuguauuccuucuacauggaauuuuaguuuucuuuuuucuuuuuuaauauuuauuuauuuauuuuauguacauacuguagcugacacaccagaagaaggcaucagaucccauuacagauggcugugagccaccaugugguugcugggaauugaacucaggacuuccagaagagcagucagugcucuuaaccucugagccgucucuccagcccaaauuuuaguuuuccuaacugucguaauuuuauguugcuauccaugauucagucaucugcuucuugacuuuggaauuuuaauuuccauuuuaagauauuauauuggagccuaguauagagugcauuuacuuguuuuucugucuuaagagugaugcucacagcaguuuugucuucuuuguuggcuagguuacuaguuugcaacuucagcucauugacacacugccuuuuugcauggucucauuuguuuauguuugaguaacccuaccuuuguuuuuggcaguauguuuugcuucauacacagcugaaaggacugugcuaguggcucaugguaucuuguguaaaccaguguguaacuuguaaaacauuuaaaguaugcauuuuugacauuccuuacaucuguaugcauccuaguugguauuuuuguuguuggaugguuuuuucucuucucauuaguauuucccagaaggcuuuugcuuuguuugucuuuccaagcucuagcuuuaggcugcggguacagcugaugcuguaaggcucuacaucuaauucacagcuccauaaaguaauaagagaaaugacagaauaccucagaguuuggccuuuuucacugcucuuuuuuuuuuuuaacccaaucauuauuuguuauuuucuuuccuuuggcauauauuuuuaauauuugaaauuuuaggcaauauuuuguagguaaaaaauauaugccuuuucguuacuguauagggucauauguuuuaucaagagauuguuauuuuauaaauuuuuucuuccaaacuuagguacccaaaaguacacuaaauuaucaaucauagcauuagaaaucccuacuaucuuugaaaaugggaauucuuguuucacuguuaguccucuaccauuucugagaugaaugcauuucaucccuaaauuacagaauuaauguaacuugcauuaaaaaugucuccuuguugagccuuuuugcgucuuuuuuuuaaugcguaagcuuugaaauauuagagugugaaauggaauacaggagauucagaugagaacaggcagaguuaguaggaagacaggaguccgguaccagggagguuaucauacagcagaggaaguggugaaucuaagagcuuguacccacauggucauauagaguaggagccuucauccagaacacacagaacccacugaagaaguuucuuugauacaaaaucuucgguugcauuuuaacuccagaaagucacaccaccaguauuucgguucuugguaaaauguucauuagaaaaaaaacaaacugugcuuccauccuauugcuuuugaggcuguaaugacaguagcagaaacucugaaacccacuucaggcaauuagauacugcacggaagcaguguuggagugguaacaagauggagccucuucugcaauguugcuauguugaaaagccuacuugaaaagaauacaguguaacugaacugccagcauauuacacucagggauaaugacuaaagcagucgcaugucucuugcauuccuagauggugguaguuagcaauuuaaaaaaauaaaagaugccuuuggaaaauauggaaccacauauuuuauaguagauccuucaugguaauagucacuaaggguuuaugaauguuuggaagcaguuugagcaaugcaaaaucauuucuugugucugaguaauaauaaucuaccuaucauggauguaggagguaauugaaugucugaggaaaagcacccccaucuguauacaaacauagccaagagcugugguuacauacuguuuagacagugugucugguuugucagucugucuaacgacuuuaacacuuagguucaaaaauauucuuggauuccuuaaauuuaaagcuaagaggacguaucaagugccucugacaugagugguacuagagauaggcugcuguaauuauuuugagaaauuagucaaaaauuuuauucaguggagucaaggagaugggccauuuggcaauaugcauuaugugcaagugugaagaucggagugcagucccucucaacuauuucaaacaagcaagaccugcugacgaaaguuccuugugaucccaguguuggagaggucaagccaggcaugucccugguacucugaaucagcaagcugcagguucagugugacacuccuaucucuucaaaacaagguggacaccaccugaggaaugacaccaaaggcuguccuucgcaauccacacacaugcacacauaugugcaugcacaccaacacacauccacauguauacaaaguacuuaugggaacacuugauaccauuagagguuuucuuuuuauugccuuguucacaaucacugaucuauuuaggaacuaauucacuaccuaaauuaagcuccauugguauagggguuuugauugaaagaguaacacuuacuagaaaaaaugugucacagcaaggaaagggugguaaauaggugauucuuaccaagcaucauugucaggauuuuguugcuauggugccucagauaaacaaauugacggaacccaaaucugugcucauggcuucagaagcuucagaucgcagucaguuguuuccuuguuuuugggaaugugagagcauuucugggauugcugaugcuguugaucauugcagaagagugugaugcaaggagugucuuaccuccuagaaaucaagagagggagggugcauguauaucuguguacgccugcuuaugugcaagcacagauacacccucugaagacuugcuccuagucacccauauccuccacauaggauccaccuuccaauccauucagcccuccugaucuagucgccucuccaucagcaauucugucuuaggccuuuagcacacgagcccuuuuauggcuuauuucauauauaauguauaacaaucacuaucgauaguguaucuuuugaggaagguuaaacagugagguuucauauguccaaagcauuacuuuuccauaaauuagaaacacguuaaauauguuuuuuauuuaauauuacuuuauaaguuuaguuuauaaagcugguucauuuuguuuucucuaggugcuuaguggcuaauaugaaagaauuucauguguauauaaaauuauauaugcugcauguauucauaugcauuguauuuguggacugucaguuguugguuuuuucccucuuagucuguccugccuuauuuuuuuaaagacucauuucagucauaaacuuguaaacuauaggaaucuuguccaacuuaguugcagucuugucuguugucaaaauguacucuauucuuuuuuauuggguguggugguuugaauaugcuuggcuuggggaguggcacuauuaggagguguggucuuguaggaagugugcuacuguagggcuuuaaguccucuugcccauuagcuauucuacuccuguuugccuucagaacaagauguagaacucucaacucauucugcaccaugccugccuagacccugccauguuccuaccuugacaguaauagacucaaccuccauauguguuuugaggagaucauuacugaacuguuugugccuuaaaauaucucauaagucauaaaauaccaccauguuuucagaaauacugaacacaguauagaaucaguuguguuauacuugggaagauguccuaagguuccacucucccucucacacagggaauaugacgguacuaaugaaugcuuuugcuggccugauacaugcuuguaucaaagcucguaaaggagggaaagcguugacaugaugcuucugacuuugagauauucuagccucugaggaaacuguucucucaguuggucugucuuagugaggagucgcuuaugcacauccaugcaggcucggcucccuaaccugucaugcuacacuuacuuaaccguuucuccggccucugugacucauacagccuggaggagcgggagagaaggagcggcaugaacgaaucaagacggaauacauuguuguauucucgucucaaggacuucauaccucaguggaaaguuucuuuuuuaaagguuuauuuaaauguauaugauuuuuguuuuugcaugcauauaugccugugugccauguguguguuauacccaaggaaacuagaagaggguguugaaucuccuaacuauaguuacagaggacucuuagcagccauguagguauugaguauugguauugaacccgaguccuuuggaagagcaaccagugcccuuagcugcugagccuucugucuagccuccaguggaaaguguuuuaugguugaaaugguuuccuuuugucuacuuuguaauuuucagaaccacauggauuuuuaaaugcuuuuauuauuggcuguuuuaauuguccuuaaagauuuauuuauuguauguauaugaguguuugcuuauguucucugauauguauguauguguuccauuguaugcaccuguauauaaggaauccugaagagaucacugaaucucuuggaacuggaauuagagauacuuaaugaggcccccaaaugggcgccgagaaccaaaccugggucuucuacaagaguagccaaugcccuugacugcugguggucucucuagccccuuaggcuuugguuugguuugugaagauucucuguuucagccccaucugucaucucucuuccuccuccuuagcuccugcuaaauugagaaguaugccagguaauguuuacagaaagguuuucucauuugugacccugaccucaaucaccuggaagauuuuauuuacccaugaacaucccaaguguaauaucugcuaaaggugugauuaauaauuaaacuggaaauguugauuuuuuuuuaaacuguaguuucugcauaucuccaggaaauugauuugccauagaaauacuuuauaagugaaaugcaggaaaaacuuaguaagagaagucuguacugcaucuguuucuaaaugcauuaucauugugugugugugugugucugucuguaugucugucucccugugcgcucacucaccgauucaggaacacuugugugcacaagcagaggccagccaacucuuaugacuuguauuagguaggugcauagcacaggugcagugcuauuugaaaauagacuggguaaaauaugguagaacugcaguuaaugaugccaacauagcauccagaaaggaaggaggagauaugaaagcaguagccuugagacaggagagcacuuuguaccuuugggaccaguuagaaggcuaagggugagagcagaauaaguagaugaggaacaugaaauacugccugaagugcucacagcugggucagaguaggcuuuguggacugcgcuuggcaguuuagauuuuauucugugcuaagaagcuagcaaggauucuuaacgagacaacuguguguaugugauuuaaacgaacuuaaagcugcuacguggauuaaaaaaaaguuuuaugaggcaaaagguuauuguugauugaaucaggguaguacuuuugggaggagugauagacaguaaaauguggauagauguaagaagagcuaacaagugugcacuuccugaauuucugaugggaaaacagcgcuaucaauauuguauggcgaauugaaagccagcaaagccuugucugauuggacaaaauuuaucuaggcagggucuuacuggccucucacaccucuuaagacacugugccuuguguccaaagagaaacuaugauggaauaauaaaagcuaacaccaggacacaccacagucuccuaaggacgauguugcuguagccucggagagcugcagaccgcugcugucaagcugccuuucuuccuuuccuagaaauccucuugucuugguugcugacagaagacuuugagggaguagugauaccugugucuuugcuugaccuugguguucaaguuugccacaggacauuagugggaaaugcaagcagacaagcguguagcuggggcucugucggggaggugcccugcugaaccuccagauggaggccaucuccccacaucugcauuccucagugugcaggcagcugcucucccugacaugcuagacucaucaaagggaaguuuguccuugguacucagcaguucuguugcuuagaaccagaaaauccgaggaugugggugcagagaaauaguuuaaaggugauuuuauuaaaaauaaaaauaacccuaguauguaaauaaauaucaaauguaaucuuuugauggacacugggcagagacacuuggaaagcagucacaccaucagagccauugauggucuguuauuuuaagacuuaaucugauuuaggaagauauaaugaagcaagaguuuaagaacuugaucacugaauuccaucuuuuuuagaaacaucuuuugguguguguguguguguacacacuugugcauaugcaugugcaucugucuuuaugugggucugggcacaugaguuacagguaucugcagagacagaagaaugugugacauuccuggagauggaguuaaaggacauuugugagccacuugagugggugcuggaaacacacugcuccucuacaaaagcagcaagaacucuuaagcagcgagcuuugaaccccaucuuucacauagcagauguaauuguuuuuggaauuucguauugacuuugacacaggcaggcuucuugguuugguuaugguucugaaaaauacuucuauauuuuauucuucacuuucuuuaaacauauauguauuauuuaaaauauaugcauauuauauauuauauguguauauuauauagaauguauguaucauguauacacauauauucucuuucuauauauacauucauauguauauauacauuuauauguguguauauacauauacauauauauauauauaugguuuaucuuagcacaaguuacaaugaggaucuuuaguguacuuaauaugaauaguagcuuucucagauaccaauuccuaugaaauacugugccaagguauuacaugcauuuuugucuguuaauaagucagaacuuauaguaguuuuuauuaaagauagcugaacuggcaccaggguauugaguaaucucuuuagcaugacuagguaaguaaugaugcuggauucagaugcaaagcucugaugcagcuuccugugucagcugacugcagugaaggauucuguuuguaaaacugaggauuugcaaucauuuaguaugcuaacuaagaggaauacagcuuucccaaagcucucauuggaucuuauuuugugaaaucaggccuguuuuuccuucucauaguuuucccagcacucaugauuauguuaggagaaacaagugcccacucuuaagugcuaugaagucucuuugaauuaauagaugugguggugcauacucauaaucauuauccuugggaaggccaaggcaugagaaccgcuauuuaauguuucccugagcaauaguuaguaauagauauggagugagaucuuuucucaaauguuaguguacacacacacacacacacacacacacacgugcacauacgugcacaugcacuacauacuguaaaacaaaaagaaaggcuggcuugaccacaagcacuuccuugaacuggcccagaguucugaaaucugaagucuaagaugcaauaugucagaacuggaaauggcuccccucuggugugcaaucugggagggaauuuccugucacaauuucaaauauuuuccuuuauaagggugaaaacauugaugggugaaauuugccuuuuugcaccgcauuuauggaucaucuugaaaaagaaaugagugcuuccaaaccacucagugaaggaggagacgaagcagcuuuguaaaccgcaaaguuaaauccaccuacuguacagcuguccugcaacgagagcauugagugagaagacagcagggaaggaagaacauuccaggggaaguggcaguugccauggggugguggugguuaugaaaaugcaugaguaaaggaaaauaauucugcacuaagauaaagcaaaaagccauagcgugaggacugagcccagcuaacaggauacuggacaugagccucucugagggagacaugucagugagaagcuuugagucuauaaacugauaaggaccacauugacuucucuguacagauuagaccagggaugauagguuugaaauacagauauuuagaauuuaugguuguauuaacaagauugaaagaugacuaagaucuggguuaggaauuguuggcagaaacgugguaaaucuugugguuauuggauagauuuaggcuguuuuacuuauaccauugauuggacguuaaguguuugaacuauauauugggggaauuccaaaguuucuuuauucugaacugguaggauccaguucugugcugacauaaagaauugacagggcuggaccuuaaccaagaaacagcuuaugguagguguacaauugagauuuguccaagugguacacuugaccacugcauucaugugucuaaggaccauugagcagacgggaauuaugcagcuucacuccaucuagggcugagauggcuaagaacacaaaaguaugguaacaacuagagauaggcugacacggucagcuucaacaccuguuauauuaugcauguuuguauuuugaaagggacaaagaagaacacugguuuggccuggaacaccuuuucuacugagaaugagaaguggccugauauacuuauagcuugacaagugagaugguuugaugaugucuucaagagcuaaggagaagggacugaaagaaauuuaguuaagauugaaagcugguugugaagccuguuagcagaucuucaggauggacguagugagaugcagcaaaccuguucuuugccugaagaaccugcaacaagacuuuguggccuggauuguugacccauugcauggauauggacuuucugggaaaccuuagauuguuggaaacauuuaugggaauaggaaucuuucauuaaauaccucaauuuucuuuguuguugauguuguuguuauagcacaaucuaccguauucugccugauuuaagauaaagagcauaaaaauagugcuagcuugugagaguuagccugccaaggacugugagggcuagauagugagagguuggaauugagccaagacacacugaugauaaaauagguggaggaguagugaagauaguugcugaaguaugccaggcuuuaguuuuauuuagaaaaaaccauaagccuuuauuacauuucuguuugauaauuaucugagcccccaaacuucuccucaaauagucuguuuuaaaaguacaauuuauuuacuuccauuuaucugaagauaugugccuuccauuucuaauuugaaagugcucagaguaaaucuuaggauagguuaguuaacaucagcugaugucuuugucuacuuuugagucugaggacaccagugauacuuaauugggucuuacucugugcuuucauuuuuacuugacuauuguuuuaaagccucauuuccaaacaaagucacaaagagccacugaaggcuagauuuuuguaacuauuaaacaguaaaaaguaugcuacauguauaagauguauaaauacuuauuuaagaauuauauaagaguauucugaaacuuacguguuuaguugcuauuuuauugcuguguguguaagcacuaugaccaaggcaacuuguaaaaggaaguauuuaaagggggcuugcuaacaguuugauggggucauuaguucaugaucaucauggcaggaagcaggcagccaugguguugaagcaguagcugagagcuucauauccuguuucacagccugcacucaggcauagugagacugugccuggcacgguguuugaaaccucaaagcccaccucugagagacacccuuucuucaacaaggccacaccucccaauacuuugcaaacaguuccaaaaaaaaaaaaaagaaaaaaaccaaaccaaaacaaaacaaaaaaacccuagggagcaaacauucgaauauauaagccuguggggccauucucauucaaaccacuauacuuaccaccugacauuucccagagaauacugcauuaacugugucauaguuacauugauaacugucuguguaacaacuuugucaauauagcuugugcuuccauucuuaugcccccaaaucccuuguugucaugagucauccugcaauuaggaaaauugauacuaauaucaaaaucaugccauagcagguuaauauaaugaaauugguaucaaauacaaguguacuuuauaucucaauacuugaguggauuuguauacaagcuucaguguaggugaugcacauugaucaauauagccuugaaacgauuauauguugacacuagcucauaaaguagcggcauuuuauuaugaucuugcuuagugcuauagaaaaauaauucccuggcuuuuguguuuuuaaugcgaaauuuagcugugggaggaaaaagacaugugaaaauaugcauuagacaguugcuuucaucacuucggauaccuuuggguuuaaauuguauuaucaucucagucucugccuguaauccuagauugauaaccuaauuagugcaccugaaacacgaggaugaaaacaugguauccaggaggaacaaaggaacuccacucugcauuuaauuucaaauuuuuccuugucaguccagcuuggauuuggaagaacaccugacagccuaugaucaaugaccccaaucaagcauccugucagagaggagcaugaaauugauuaaaggaugucccucgucucccagaauccaggcaguuguggggaaaaggcucaaauaauucagauauuuuauugcaguccugaucaaagaaccaucaaagauacauggaggguaucauuucucuacguguuucagggugacuuuaggaacucuggguuuuggguucaaucagcuacaugaggacagaacauuuuucuaugugaaggugaauguuuuagcauucauugacagaauaucccaaagcuuguguauaauuuaaacuugaaauuaagguguagcuucuagauaauaccaagagacauacuaaugcagacacgggaaacucagggcuccucaaccaucgacaaaguggggaauucugugaguuggaaaaauaaugucuuucccaggggagaacacacaaauugguuauccaaaagccaagugguuuuggauagggacagaauuacuauauggggcaaaguagguugcauucacuuacacauacacacacacacacacacacacacacacacacacacacacacacacacacagagagagagagagagagagagagagaaggaaggccaugaauuuggaaaagaguaaggacuguaggggacuggagggagaaagaaaucucaaaaauuaaaaagaaaaagaguaaggaccguaggggacuggagggagaaagaaaucucaaaaauuaaaaagaaauuauuaaaaaaaauaagaucaguuuguuacaggcccuaacacaauguuuagaauugugaguauugucauacagucaggccacccuagacaugccgcacaaccugugaaucauccaccaugcugcuggaagcaugcugcagcaugcucccgaagaugcaggugcccagcuuaauugagauaaaugacugucgaguguugugggaaguucugcaaauaaauaugaguaaaauggaguaagcuguaaguaaguacagcaaggccuaaggaaaacuagauucgguugcuaaguuacguugggcuuggggaaacuagggauauaaggagccuggacuugauguagggauuguccagcauucauucauguaauaauacauaauuaugggcaaucauaauuuuauacucugauugacauugugguaaaauguagcaauuaaaacaacccauugaguuuacaaguguuucucauguuguggaaaaauaagacugauuguuuaaugaguuacaaaggcugagguuucauuuuaguacugugauuggauuggcaaucauggcucuuagcaggugguuuacaccguaguaauaucagcuugugagguauaugggaaguagaauccagcuagccacaaacuuagagugaaaguaaauugaagagaagaugacaacuuauuauggugaugcaguaggcagggauuggggccuacaagggagcuggguuauccacacaaacuucaguuaacuuauuaguggaagcaacugugccucaggguuuugaaugcaccccagguucuaauccgaaccaaugccuuuucuaaauaaacauuuaaugacugucucaacuggcacuuagccagguuuacuugacuuucaagaccauggagcauccaguauguauuguaaauguucuguagucacaaaaguagccaugaaauacagacaccuguagcucucccaaggccauguuaugacugcaaugauauuaucuguagucaguauggggaguuccucgggugugagaaaaaacgaaaggcauccacugcuuugagaguaaacaacuuuugcagaaaaaacauaaauaacauacguaaaauaaguaaauacauucugauauaguugacuaucauuuugaaguguaaaauuguucuugagacagcaucucaaaagucccaggcugggaucuuaacacagugacucgagguaagcacuuagaaguucuacuccucugaaccuccaaaccucagaggaacugggauuuaggugugaaccacugcacagcuucccauguggaauguuuaauuuggaauuuauuaaaaauacaugaaugugcuacuauuuuuuuuuuuuuugcucuugguaccuauuguguacaaugaugucuguuccuaguuagcacuguuuguuagauuuuaguguaucagccauaugguaaugguaaucaaugccaguauaaauuaaguucugauuugauaauuugauuauuuucuaauuuaccauuucuaaaugugaagugacuugcagucucccuuuauaccaaauguccaguccacuuuaaaauuguugguacuuagaaaacucacugaggaaccugcuuaugaaucaaggaaggauuaaauauauuacacaggaauccuauauguuauguaauuaagcucuacuugggcagccuccucgagugcaaauuucaauaucucuguuucccaguaggguucugugaucucugaggaucugauggcagccuggggucugagggagggcgggcauaagcaaggaaauaugcccaccuagacccuguguuuuuuauguucaggagaccaaggcaagaggauuucugaguuccaagacaucuuggaguacagagcaagacccuaucucaaaaaagcaaugcagaagacaauaaaauauaaagauuauaauuggaaaccuuggcaaaggaggauggguggaaaguuaccagugauggaauucuauacagcaggagaccuuuggauuaauauugacugcaaaguauauauagugccucuauaagcacuagaacuaaacugcuaugcagaagaaaguuaaaacagcccaacuuuuucuuucuguuuuuaauugagaucucuuccaauguaagguuaccacuagcaaauuacuaggcuaaaaugauggugauggugcuguguuacuguuccugguauuuucuaaacacaugauaaaugauaaaauaugucaugaucagaauccuuuacuaauacauuuuaagauauucuucugaaauuacuacaauuugaaauauuagauugaaaauguuggcuagaagauaauaguucacagagcucauuguuaauuucaccuuuauuuccucagaugaaaggaugagaagagagccguauucauacccugcuugggcugagaccagauugguuccuucacuguuguaucucuaggccuaagccuggaaguuuguugccucuguacaaucuaauucuccaagcugauucaaucuggcaucucuuggcuuuucagugaacuguuguguuuugucucaugcuaacuuugacaguauauucuggcuuguucugucuucaccugugucuaacuugcuguccuugcaaccugucucuguaaaaguguaccagugaaacucacacgcaugcaugcacgcacacaggcacgcaugccacaaccacccuuuucucucgcugaucuucaguagucucuccucuuguccucucuuuuucuuugucuucucucccuaccagaugugaaagcaacuuuaugcgccugcuguaauuguugucugaggauuacugcgaguaagcucacccuuuguaguuacuaaacuggccggcuggcugggucagcuccgcuguacugguucauaacccggcuucaaguugacugauucaaaggggccucucuuggcuucugacugaacugcucugcuuggaaagucugauggacuucaggaacagaacuguacugacugcccugacucagcugaacucaacuacaccaaauucauugguucucucugcuguacugcucuuagguagccucucuccugugcuguccuccugagucgugcugucaaaucucucucugauucaucacuuugccccucaauuagacuggcaguuucaaacacggcacuuaacauuucaguuguagucacuugauacugcauuccgaacuugagucuauugaauccagaaugugaauccaugccuuugugacugugaccucacucucuucaguauuguguaaaaguuuuaggaacucuccaaguaaauacuugguaauugcucauugauagaacagaaaaaugcuguguagauaauaaauaaacauauaacuauaagauuauc

SEQ ID NO: 5570 - RNA, 19936 nt, Mus musculus
cuucuccuuccagaacccgcuacccguagguccuucccugaaacgcuccgggggccccucccccuccccgagccccgccccuccccgagccccgcccccaaagcccuuccccuagcgacgugggcuccccacgcucucccuccgcuaggucuguucuucugcagccucagauggaagcucugguucuccgcagugccuuaucgagacuccagggaacacuuucccgacuccuuuuaggucuucuuacccagacaaggaauaaugagaguucccagggcucagugcgucccuuaccugccgguggccggauccaaagcuuaaaucucuaguccaagccucacuuccugucuccccagagcacugggcucaagcccagaucccgcccaauccgccacuacaguacucaggguuaccauguucccuuguugggcuccaggauugguguuuccggcggucccccgggcccucuccggugccggaacuauugugcuagagcccugguuuccccagccggcuaagugagagugaagggcaaguaggcuuaaaggaaagggaggggccugcgcaaggcauucugggagcgcgugguauucgugagagucgggccggucguucucucgccuucgccuucuaacguuugugccagaaccggaaaaaaaauaaagccugcaguuaauuggugaggagaggcggcuaacgggagagaggaggccagggcuuccccaggggguuuaggagcuggaagggccgcugcggaggagcucagcggggcuugcuuagcggagggcgggaagccagggccuauccaaagcucaucucccgaacccuugaacaguuauuaauuuacgccuagucugcacguucggugccuucucaggucaccgauuuccgaagcuuacgggcagucauuucuugcuaauuaccuccuuuccuuuuggaucaucauuuacaacgucccuuucaucccugccuccacucccauuccugcaguggcccucuuuuccacgcugcugcagaaguuuaaucaaguugccgugcuauauguucgauccacuuuguagaugcuacucuuuuuuuuuugaaccuuuggcuaucauccugcaguguuucccuaccauuuucagcauggaaacccacacuccuaaaguugaaagccgugguuccucaccgagagagagagacuguguuuagcauccuuacagucuucucaugcaaauaaauggugugcuccgguuuugagucguuuccaaucucagcauuuuaaaagcccugugcauagucuuugucuuguagugagacuuaaagucgagcguuuacccuauuucucugcuugaugaacauuuccuauuuauagcaccguagccuugacaguuuuggucugcuuuuugguggggauucaaaacgcuggauugaaaagcgcaagcucuuuuuccuagcuuccuuggggcucaggucuauauguacuauuagguucuguagccuuuauccaaaugugguggcugacuacuugggauauuucuggugugacugaaagacugaguuugcuuuuauuugcauuuuauuuaacuccauguaaacagugauuuguuuacacuccgggucuauaucauagcccuuuuagugacuauaaagggucauauggcugggaugagaauggggguaguacucuuuguucccauuacuuuucauuguccagcuuaccauccuucccuacccuacguguugcgcuaauuugcuguggugguuccuugaggccaagagccacacuccuuccacaggaaacgcagcucuugacaucauuuacaaagcccauggcgugccaguccuuaagcucugaaagaugaccaucgucucucuuucccuguagcccgggaagaguccugccaagaugucuauuggugugccgauuaaagucuugcacgaggcugaaggccacauagugacgugugagaccaacaccggggaaguauaccgagggaagcucauugaagcagaggacaacaugaacugucagguauccugcuuggcaccagggcugggaaagggcuguggcuucuauccuguggguagagcgguguacuuggaggucuuaaugaaguuauucucaucaaacaguuauuaacuaaguacuuauuaccugucaagcacucuuacaggcucuaagauuuuaugucaguauagacuuagccuugaggcagaaaagucauuugacagccugugguuguacguguguauccgagcacuugagaggcugagguagauucucgaguucaaggccagucugggcuuuauagcaagaccacacugcuuuugguagggagucagaaugcugaauugaaagcacaaucucuuuuccuagauuucucugggguuaggucuauauuuacugucagguagccuuuagccaaauacaguugcuaaguacuugucuauaaaacaaccaguuaaguuucacuuuucugucucagagucggucagguucagagccagugucugcuucccagcacaguguauaauuugcaggaucuucuacucacguauugugugugcuuacuuuugucuuggagaaaguuucaucugauaaaacugccaaaguuuuggcauaugguuuggggguuuuccccauuaauuaagaacuugagcuuuggaaucagagaauucccugauuccaaauugaguugggccauaaugauaggaccuuggguauccuggucacuuguucuccccugaauaaaaugaggauggaguuguuuuggauccucugugcuguaaaugccaacccagaauuagauacaccagagacuuuggggagguggcgugaaggacgccagugaccgagcaggauugcggaagugauugguuacuuugcuuguugcugugaucaaauuccugaccaaagcaacuuaaggaagggggaguuuauuucgacucacagugugaugagacagucugaugcagaagaagucaugguggcaagaacuugaggaggguacuaacuagucacauugaaucugcagucaggaagcagagaugagugccaggacuuagcccaguuucuacuuuucaccuccaccuaaccuagacaaucccucgcagacacgccugucccuucaguaauucuaaauccaucaagucgguaauauuaaucaucguagcaggagggucuucaguccaggaaaggaaggcagagugagcaaaaggagccucaggcuacaacauggugcugaggaaguuucacccaaguaagaggaguaacuggagccaguaauggacuggcucugauguuucugcuguggucagucccuggcagccugcuggaagggcugucgcagcgugaaugcccuggcaggucccccagaguggcagcuggagggugccaaccuguugucuccugaaagggugaacauaguaccccaagacugcugcaugucuagagguguuagagaugagaugaaguuuguguuggcggcagccagcucagugcuuugcuguugggauaaauauauaaugucuagagaggugcagugccuuguuuagggucaugccuauggguaagguggccugacuguugcuuuuuaggauuugugcuauuuuccuguggcugcgauacuguaccauuaguauaguuccagaaggaugggucugucuuggcaaggaggcaugauaacagcagcaggaagcuuagagcuuacauuuucaauagaaagcaggaagcauagagagcaaacaggaagugucagagagugcucuaagucugcccccuuuccccccaugauguccuucagcaaggcugcauccccuagccgcugccccuuuccccaaaaaagcaucaccaacugggggccaaguguucagaugccugcaacuauggaggacacuucauuuaaacuacacgcuuaugcugguuagguuuuugucaguuugacacaagcuuagaaaagggaaccucaauugugaaaauaccugcaucagauuauccucuaggcaagaacauauuuuugauuagugguugaugugggagggccuagcccauuacaggcuagacagguuuuuucugggggcauaagaaagguaggugaaggccaggcauggugguacaacgccuuuaaucuggcacuuaggaagcagaggcaggacaaccaggacuacauagagagagaugucucaaaacaaaacagggaaugguggugaacacagaucucugugaguucaaggucagccugcccuacaaagcuaauuccagaauagccagggcuacuacacagaaaaacaaaaaaaaaaaacaaaaaagugugugugugugugugugugugugugugugugugugugcgcgcgcauguggaacaugagccuggagggcaaguuaguaagcagcauuccucuggagucucugcugcaguucuugccagcuugaauccugcuuuggcuucccuuaaugauggacugugaucccaauguguaugccaaauaaacucuuucccuuuuucccccacguuacuuuuggcugggauguuuauuagagcaauggaaaacaaacuaaaacaagaguuggauggugugugcauuuaugccuuccuuccccucugcugggaauggaaccagcgccucaggcaagauagguuaagcacucucccacugaguuacaccauuugccaauuugggguugcuuuugagaggaguucuuucuauagaucccaagcuggucuuuaaugcucaauccuccugccucagagucaauucuguaauuuuagguaggggcuaucccacccagcugugaggcuuucugaaguccugugcuaauugguuuccuuccaaaggaagguccuaagaggugugagugauuuagugcugucaagguccugaccugcaguggucugccuuguaaagagccacuuucauggguccagccacucacuuagaaugucuuuugucuauuuuagguuguuuagguuuuuaguagaaugaaagauuucagacaaugacuuaauuuguuuauuaugcugauauauauauauauauauauguacauauauauugcugauuuuaaagaucucagacaguccaaauauaauguguaagaguuuauuugacauacacauccuaaacugaauuugucugacuagaugguuauggucuucucagaagugcagcccacaugaucuugguauugccagguugcaaguuggaaaguaguaugucuuguguguguuuugugucucccuuaacucugcucccuucaaaaucagugauaaacuaaugggugaaugcucauuuugauuuacuuauagagucugaacauuuguaucucugggacagauagcuccuacauguuccccugaugucuccuuucuugcccccaguucuuuagaagugaggacaucuuccaaauaccuucccugcauaacauuuucuuauaaacuuggggcagugccaugcaugguaauacacacagucccagcacuugagaaaacugaggcagaagaauaucaccacaaauuuaaggcaagccuggacuuugugccacccugucucaaaaaaaaaaaaaaaaaaaaaaagacugagaaacagaauauuagcauaucacaaagauuugggaacaugagaggauuccauuauaaccacuucuuucccaugaauauugacacagauagacuucuuuaccugugucgccuuguacguauuuuaauuagaaaaauuauguagcgggauguuuuugcagugcuaggaguagaauccaguaaguacucucucuacuuagcuaugccucuaucccuuuaugugguagcuuuaguaggaaaugggccaugugccacuaagcuugauuagaaaguuaaaaagccaggcagcuaguacuugacugaaaaccugaauuccuguguaucuaauaaagguacauucaggugugaaaccaggcagagggaaaucauuuugagauacaugugauacggauuucucuggcauucagauauaggagauccuauuaagugaugaucuuaaaugcuagagagaugguccagagguugggagcacuggcuucucuuuaagaaggccuagguucaauugucagcacccacauagcagacagcucauaacuaccuguuccagggaauccgauguccucuucugaccucugagggcaccugcacacuugugauagacaugcauacauaugguuuuauuguuguaaugaucucaccaacaugacaguguaaaaucugcuuucuuuuagggucccaagagccuuggcacuugguaaggaagcauugugccauugagccacacaccuagaacuucguuguuugagcauagcuuugucauagcauauuugugucauuugaaaguauagcauggauaugcaugaaaucugugaugaguucccagaacuggaacuuaguggaucaggcacauuugggcaucuagguuuggacaggcagauugagaucuuugaucuccuacugcauauacucccaccacuuaaggugaacguguugcauuagcuggguaauggugccauauuccagguagauggaagugaucagaaguccuugugguuuuccacauguuagcuaauuuuuguagcagauguagaggaccccccagucucuuucccaucuucagaauggaugacuuagaggcuccucaaauggagcagucuuuguuuuuagcucugucuaguaaccauagccugaagcauuugucuuaguaguuaucagaggaaaaaaaacuaagguuuucuucaaaaucagaagaaaagauauaaccacaggcuuuuccacucuugcccauguuccugaaauaacaacucugagacugaauuauuugugaguaauugccuaagccaaaugcuggcuuguaacucaguuaucuaaauuauucuauucuaaguccagccucauggguaguuaucucuccucaaguucaugcgaccuucuccaucaacaucagcauuuggggcgaaucucuucugcaccugaccucacauugacuaucccagaaucccuucucucccuccucaauucucaccuccuauuuccugcaucagcucauuggccaaucagcuuuuuauugauaggugguguuuucaugcaguacacaugagaauucuacaaaagauuucuuaggaaaucuuaagucagguauuuaauaaauauuaaaagccagaacgaguugggaguauagcuuagugauacugcuugcuuagcauaccuaagacccuggagucuguucauaauaccucacacacauaguuuuuaaagaugucuuaaagcuagguuggugagguggcucaguggguaaaggcacuugccaacaagccugaaauacaauccccugagcugacccugcaaagggagaaaacugauucugaccaccacauacuuaaccuauggcaugugugcauaugcccccacauaaacauauaaauaauuuuuaaaaagagaaaaauaaaaauucuuaaaagcuuuaagaggacauuuugagccucuugaagucuggcccacugaaaaccugaagaacugcugagccaucucugcaggcuggcuuuugguaguuuccuagguagggggcaguuuuguuuuauucaucucucaaacccaagacuguucuuaaaugcauugacuccuaucucaccucacagggguguugugaucacaugugugugccaucaugaccagcuucuuaauuuuuacugugugauucacucuagaccauauuccaagaugcuaauaccaaggcuauuguauaacccuuuauggugggagguuacuauauuaucuauaaguuuuuuauaugucaguaugcccuuauugguaauuauguguaaauuauuacuuacagaucacacuaauaauccaacuuugaaaacaguugauagugcuguugaagaggucuuagcugggcugcaaaguguguuuuuccuggaaaauacuuagucuuuguggugccuccaguucauaaugauagacaaaguuauguuguugugugacccuuucaguguuauggguuuuuuuuguuuuuuuuuuuccuuuuuuaaugaccagucuugcgcgcaccggacuggucagcaguaacgacgcugcaacaggauccuucugcacacauuuauugggagagcuugauugcagaggcgaagagacccccaugcccagaacuggugcugcuuauauaggccuaggagagacgugucucacacccggauugguuaugcacuauaccucauuugcauguucuccucaucugauugguuacucucucucaguaccucacagaaccucauuaucauaccucauuugcaugucucacaacugauugguuauacucucuaagccucauuaucaugcccgggccaggcagugucuuugcaaaaaacuuuacugcauauguacacauugguuguuuguccaaacuuaugcgugguggccagcaguagucagcgccacucugcaacggcacauguggcuucccacagaccagcaaaugacuuauugguuagauuaucaaucauggagcuccuugauaacaauauauaagaaauggauuaguucaccagaaacuggcuggaagauacugauuugaauuacuuuaacaaaauuuaguuuguuuagcaagcuccuguuaucacugcuagacaguaaauccccagcagcuacccacauccauucauuucuugacagcagacgguaggacucccagagcacaggcgagugagucuuguuacgguuguaguugcuaaccuagcaccaugguuccaagcuuaggacucagaugcagcuggacagacgauacgggagauggggagaugcuggaaaccuaagccuaacacaacuucuggccugugcuggagcugaggcaacgcacagggucugagaccaacgaggaacucagcuuuggaugugguugugagagaggcaggcccccaggauggaacugguggguccagaaugcaguaccagaccggcaucaggaacuaggggccuucuucuuggcuucuagguccuuuuuaaucuccuuuuuagccagguuuggcaugucauaguucugagccagauauauuccaaccauguugcccaaaguaaagugaauccaagcaggaacuggagcaugaugucaguggggcaguguuguuuuucauacggaauaaggaaaacucugagguccaguaucucuguuaguagagcuaaaauaaguuauguaauuaaauucacaauguagcagacuuugaauuucugacauagugucuccacauccuaaauacaggauuguaggcaugugcuaaacaugccuguuuuguuuggcuuuucauuguuuauagaguauuuuauugguuucuauaaucaaauauacauagauaaaauguuauauaguuaacacaguguguugaccuuguacaaauggagaaaaauuauauuuaacauuucuagacccauguggcuguuaauuucuccuaauagucuuuuuaaaauuuauuuauuuauuuuauguauaugaguacacuguagcuaucuucagaugcaccagaagagggcauuggauucccauuacggaugguugugaaccacaaugugguugcugagaauugaacucaggaccucuggaagagcaaucagugcucuuagcugcugagccaucucuccagccccauggcuguuaauuucuauccagugccaacucaacacauuaaaguagauagguuuccaaaguugacagagcaacuaagguucuaaaacucaaaguuuacuucuguuuauuuaaaaacaaauauaagcauguucuacagcaccagcuuuuccaggaccugcaguuaucuguaucguggcugguuuuauguggucuaagggaucaaaccuagggcuucucucaugcuuggcaagcucuccaccagccuguguagcucgggaggcugaggccacucuaggcaucauaaagagacccuuucuaguuuuaaaagcaauaacuuuaaaaagaaaaugauaagcaugugugccaguaaauauaauuuaaggagaguaacagacaaguguauuucaccauacaucaagaaaguucucaaugauuugugugggagagaguagcaggaucagugguucuauagaaacuaaaaugacacuuuugaaaccacgauggcgcuguuugaucuaucugcuugguuguuacuaaccccucuguacauaaaugaucugcaugaauuugaguguuaccuuacaaaaaauauagccuauaagaaacuuaucuaggauuagguugcuuagaaaaagcaaaacacugugguaacuaacaccagcaaaguuugagauuucucaaugcaauguuuuuuuaagacaagaguuucacugugcagcccuguccagccugaaacucagggucuuugugccucagcuccccagucacugggacuguaaacaaagggcgcccuugcuuggcuaugugauuaaauuucuguagauaaccuaagcucuuuagcugggggggggggggggggggacggacacugguguucaggcuauaugaauugcuuucaaaugaguuauguucuuugcacugcuuuguacuauuaacauuuuuauguguuuccuaagaacuaagauaggucaaaucauuugauagugauguaacauaauuggcaacuaacguauauccagugugugugaguguguguguguguguguguguguguguguguguguguguauguguaaaauuauccucaacuguguguacaguugugugugugcguguguguguaaaauuauccucaacuguguguacaguuuuagcauguugacaaucuuggccauacagaaggaaaaaucacuucugcugccccucacaacaggaaucucuucugacacuggauaugagaguuugcccacaugccaagaaagaagucaguugugcagugcuguccaguugagugugcccucguguggcuuagcucuggugcuugagagagaaagggucagguaucugguuaaaggcucaacccuuaagacuguccccucuuuagauaccaaugacagucccaguuuauuuuagccugggcucugucugagcaggcaaaagucugugucccuacagucccuuccuuauuuauuuauuuaucuauuuauuuaucuauuuauuuuugguuuuucaggauaggguuucucuguauagcccuggcuguccuggaacucacucuguagaccaggauggccuccaacucagaaauccgccugccucugccucccaggugcugggauuaaaggcgugcgccaccacacccagcccuuccuuaguuuugaucaaccuuuguuuaaccagcucacagcauucggggaaguacauuuacagguauguguagacuaggacuaaggauauagaugugucaaacaaggccuggacacucaguuuccaugccuccucaugauacaccacccuccaggaacuuccauguguucagcuaucugaaacuucucuaaaguauguuuuauggaaacauaauugaauagaugggacugaaauauaaucaugugaaaaaaaaguaauuugaaaagaaaacaacuguagaucucauacuaggaauggaaaaauccagggccuugcacaugguagauaaguaucugccacugacuauaucccagcccaggcauuacucugucugaaaugaaggucauggggauuuacuuacagacaacuccagaacagaacagaacagaacagaacagaacaaaacagaaaggcagaucagaauucguuucucuuaauucuagcuuuugugcacuaucuuaaaaagucccggcacucagaagagggaggcagucagaucucugaauuccaggacagucaggucuacacagagaaacuugccucaaaacaaaaccaaaaagaauuaugaggucagaauugaggacaaaacacuauauucuacacuccagcauuacuucacaauccuacauugugcucuucuccgucuuggcccacagaugucauuuuaguugaauaucuagucuguguugcuuauuguggcuggcuauuaggaaaccauaaacuguuccugcuugacuuucaguaaaaccuaagugcucgaagcuggagagauggcucagcaguuaagagcacuugcugcuuuuccagaggacaaauaucagguuccuagcacucagggaaucuuaaccccacugcuucagcuucugcugucacauacacacuacacuuaaauacauuuuaaguauuuauuuuuuuuuaaauauuuauuuauuuauuuauuuauuuauuauauguaaguacacuguagcugucuucagacacuccagaacagggcaucagauuucguuguggaugguugugagccuccaugugguugcugggauuugaacucaggaccuuuggaagagcagucggcgcucuuaaccgcugagccaucucaccagccccauuuuaaguauuuuaaauguaauuaagauaaacauacugcagcgggccuucccugggacugugucaccauuuguccaggagcaggacaggggugcauuagaacauagcagucuggugcugggguauuugucagauucauugagaacccaucauggcacauuggcagaagcaccuaguuuaagccuuguugggucuguaugacagccuuguggagacuucgaggcacaguggagagagcugaguggggaggaagaugaggcguaaugauuauacaucucaaaaauagacauuacuggguuuguuauaucuuagguaguugagacaccauuuagacaugcuuugccguguuuaauugugguuuuuaacagcuccaggaaaguagucugugccacuucaagguagggaguaguacagagucagacagucagagagaccuggguuugaacucacaaaacacaugaaggcagugugacuuugugcaggaggauggggugaguaaaggcauggaccuucaagaacagaucugcgucucacagguugugucuccuguaggguuucauggucuaaaaucagccauuuggggcaguaccugcugucuguauuccugcucaggaaacacuggugguuguuauauuguguuuucucuaguaggggaacugagacugagaaaauucugaagauguguucaggguuaaaccuggaggaggguggcagacccagcucucacugaagguccucagccacuucaguggcuucuguggagucacaaauucgccuggaauugaggggguugaguggaaucuggguuuuucagcuggguaagcuaacccauaacuacuuauuugugcuagcagagguucugauacuugucuaggggacuguggcaaggacuuagaaacugagauuuuaaggaacugacaauaggaagccugcaguuggcuggugggaaaccggggcccucuugcccuugaauauagaacaggaacagugguuugcaauccuagaaaugauuccugaugcucagauacaguggggcagccucagagcuuugauggauuuugguuuugguuuucacauugguguucaaccagaaaccaccuggcccuucagaaggagcaaaggguaaggcggccggcagcauagaagccgguccugggagacagugcuccugaagaugcucugugagcagauuaauccagucuuagaaagauagcuguuuucucucauuuguaauuccuagauuuuauacucacaucaaaugauguauguauguagaaaaugaaaguagaaguugaguuuuuguuggcgguaaggggcuaacaguggggagaagaggcaauaaaaaaggggaggggaaguggguagggaaauauaucaaauguacaguaacaguauacaugauuuaaauuuuauaagaaagaaaucuaggagcugcacaucuuugcagcaugguuuacccacucuagauaaagccuaguccuuugugcccacaggaaggcaauuaagcaguugugguaaaaguggcauguaguggauuuggugcuggcaaguuuaugucacuuuccuguucacuguagaucuccugacugggcucaaauuccuccuucccuucauucuacgcuuacucauguuggcacauuugucuucccaaaauacuaccuuagcccuguuaggcauuucuccgcccacacccuugaguggucugccugcucucugaaguguccucaguacuguccagaugugcugcuucaguccaagcaugcugaaagcuccugcuuggguuuuccucuccuugugcaggcugggagcaggcucuaccauguuacuucucgguccuagucuagucacccgccuucccaauguaugcugagucagaacuaugccugcugcauauguaugacccugaagaugccuuuccagcuggagugccagcggguccaugaggcugcacuuuagacaugaacuaagaaaggcuuuaucaccugccacucacagccuggcccaggaggauguaagcuggggcucugcaucugaacuuggaguugcagcaugucagugaucugauguggguuguguuugaucguaaucuguaaaaaugggagaacucauacuuccgccugccguuucugugagguguacagucccugaugcguacagaaagcuccagccauugcuaggguaguucacccgcauugucugcuucuuuucuugaugcuggugucaggccucuguaauucuaaacuuaauccaguuaaggcucucuggcuuugugugcuccaaugcuuugaucuuacaaauaaacuggugauucccuuccagauguccaacaucacagucacauacagagauggucgaguggcacagcuggaacagguauauauacguggcagcaagauccgauuucugauuuugccugacaugcugaaaaaugcacccauguuaaagagcaugaaaaauaaaaaccaaggcucaggggccggcagaggaaaagcugcuauccugaaggcccaagguagguacccuuggcuggcuuuagaauuacuacuaaccuuguuucuuuuguugcauggggacaagugaaucugacuugcugcuguacccuguccugaucuguccccaggauugagaaaucauugauaauggggccuuucccuguuaccuuucuugucuuacuugauccuaucacagaguuuaguguaaaauccaaaaucucaagcaagguaugauggcucacaccuauaauuccagcacuuaagaggcugagacagaaagaauacagugaauuggaggccagccugagcuacguauauauagcaagacuuuggagggacaaccagagagaacacugucuaacucauacaaucuauagugaaggucccuccuuuucagaaauucuauccaagaagacugggcaacuugcucuggucuagugaggauauggauaaugccugaaaauguucgguagcauucccagaacuaugugugacacacacaaaagacaugcacgugcacauacacacacacuuuuuuccuacucacccaagacagaaaggguaacaagugaagacaaacugcacucaggucugucuugauaaaccagugagcuauuaggguugcucaggagcaugguggauuuuguggcuucacuggagcccgucaguuagccauucacuuucucuguacuuaccaccucccaaggcagcagccgugaggguaggagaguguaucagggaggcgagggucugcugugccuucccacagcugcugugaucucaugguguagacagccgugucgugucugggaaguaauguugugcagcagcagcacagagaccacaugcugucuucuaaugccugcacauguuccagacagauaugagcuucggguacccaggcuggaacaaccuugaccuucuagcgcucuugucucuaccucccaagagcuugugcagacccaccugguuuauggaugaacauggggucucaacaggcaggcauuuuaugagcugagcugcaccccagcccucugauuagcaccaucuuguuaauuuuuguuuauucucuaaaauugugaauuagcuaauuuggggugggggcagauguggagaugaggacaacuugcagggguugagcauaggcuggcaggauuggcaacacgcgccuuuacuugcugaacugucuuaccaccccuuguuucucacuuucuuuuguauuuuacauauauauuuuuuaagauuuuauuuacuuuauguauaugaguacacugucgcugucuucagacacaccagaggagggcaucagauccaauuacagauggucgugagccaccaugugguugcugagacuugaacucaggaccucuggaagaacaguggucuuaaccacugagccaucucuccagccccucacauuuucuuaaacuugacaguaaaucccuccuuugacacaugccagcaguuaugaccacacugucccccagauacuuauuagcugcucuuggaggcuagccugauuauggcuugcauuugagucucugaaaaauucugccacauuguuaggcacaaaagcaugguccuaagcaacugcauugguguuggaaaaaagaucuuagggugugaaaggcccagguccuccacagcagcauauguuaauguuuuauaugggagguagguucugugcuuaaagacaaaauaguuuagggguuggaggggggugggguugguugguuucuuuugucuuaagacuucuaaaaaaauaaaaauaaaauaaaaucuuugaccaguguuggcuugguguuaaaggcgguugucacacaagccuaacagaaguugucugaccucuacguauacacuacacacacacacacacacacacacacacacacaccacaaacaaauaaaaugcuaaaaaagagaaaauguuaccuuugccucggagagggcugcucuugcugucaugguuaggcuaacuguccaucuuaaccagucacauuacugugcacuucgggcagugaguuggcccaggcccacugacugcacacagcccugagccaccugugccuuucccagcgccuugcucccgucucucaucagcgagcguuguguaguucccaucagucucugaaagaacagacaagaaugagaugcguuuugucaguccacagaacuucccgagugacuauagagcuucuagccuccuagguacauugggucauagaguggaagucuugugcaucuuuauggguaguguuauuuuguuuuuguuauuaagcauuuuuuucaugcagaaaaacucaaaagacuaauacccagaauaguacccagaauuaacagaugcuacgcuagcacuuaggugucugaauugagaaccagguugguauagcucaguggguaacaagcuuaucacacaguguguguaccugagcucagucuaugugugguagaaccugcuuguaauucuaguacugacaggaccaagauagaauccugggcuuccuagccagccagucuauucuacuuggcaaaguccaguccagugacagaccuugucuaaagaaacaaaguagugaugguacgugaggaacaacauuugagguuaucuuauguccuguauauagucacaugccauggcccuuccucuuauccacacaaacagaauugaauacauccguaauagcucugagaauuugucauuccugugcuauuauucacacugcugugcugucggcacuaccucccaccaugacaccaguuaucagcaccaacuuccacuccucuuccuucucaccgcaugauuugguccaggcagccuuccaggccucuuccagacugaugcccaggcuucagcuggugcuguugugagcaucccagccccccugaccucucuucuucuucuuuguuucaguggccgcacgagggagaggacgugggaugggacgugggaacaucuuccagaagcgaagauaauauucuccauugaagagaacguuguccuuucuucucuuugauuauugcagggguuuuggggggaggggguauuacaugugcauaugucuuagauuuucuuuugauaaacuguuaagcuaaauaaaauuugguuguuuugugguuugugugaggcuuuuuuguuuuguuuuguuuuguuuuugaggaaauaagaacuguguguucguguuuguaguuugcuuuggcagcagguuagaaucugacaccuuuggacauguacuggggagaugccagcacucuucaagcagcagugugugauaaagagugcaagcacuuuucaggccucuuucuaguugaagggagaaaagccuaacuaagagaggaacccuguguuacaugaacacucaguguggcacuuucccagcuaaccugacacaggcaaccugaccugugaagaugacucaugcucugaucaguaauacaguaaucauagugucucagcauucgacagcuccagagggaacccugucuguagcuacucauauucaacucgcuccacacaguguuaggagcaucucagcauugauaagcacacuaauuuuuuaaagguuuauuuuauuauguaugcagcguucugcuugcauauaugccugcacaccaaaagagaacaccaucauagaugguugugagccaccaugugguugcugagaauugaacucaagacggaagagcaaacaguacucugaaccuccgagccaucucuucaguccucuuuguuuuuucuugcacuuggaguacucuggugguugccuuggccuaauggagucuuugguggugguuauaguuuggugugcuccuuuccugcagcuuucuuucucauucagugugaugccaacuuuagugggcugauucaaguugacaugugucgucucaggguugggugcaagcauaagccugcagcaugacccgucaagccccacccaguaggccaugugcgcuucaucaccagcuguuuauguggugaaauguuaacauccuuacccuccagcauuuacccuccaccauggcuguggguugccagggguggggugguugacacagauucucuuuacauagaccuacuugcucuguaaacuaaguagcucagacucgggugcacaugcauggacuuccugagugccaugguuaagggcgugggccacuauacccagccaaaaaacaaagcuugaguucaucucugccucugucgaaugucaugcagaagagacggagugugccuucauuucuaacaggauugcuaguauguguuggaaaccauuucuuucaggcugggcauggugguauagaccauaaucccagcacucaggcaaguggauuuccaagcucagggcuugcuacuuaaugaguucaggccagccuggguuagacacuuuuccuccccuccccucccagaauacauacauacaccuuacauauuuacacaugcuuagauuuuuuuuuuaauucacuuuuugaggaugccugccagcacacaugugaaagucagaagacaacuuuugggaguugcucucccaucuucuuuggaaucaaacuuagguugucaggguuuacaguaauucugcccgcccccuccagcuuuuagcucaucacuucuuucaaaugugucugcuuagccuuugcugucccaguuuugugcacuaucauuuguguuccccagcaccugucuuccugauuguaauucugccacugccauccauacuuguuauaucaugacugguuaaauuaugacuaguaagccacggaguagugcugaagacuguucccugggaguaagucccgugugcggccaccugcugguaucuugacuuuuaucuuggcuuuagucccuguauaucccuggaucaaagacuuggagccuguugcuauuuaucuguucuuuaucuguagucugaacugguuuacccugcuguugucaccccaaguucuugccauccccuuccucagcucaacuccuguuuucaguguagguucuuucuguuugguuuauuuuauuguauuaauaaauggugcaugaaaaguuu

SEQ ID NO: 5571 - RNA, 3289 nt, Mus musculus
uggcauugccaagccgggggguacgaagaugggggcggggggcaugcucaguggaaagagagugaggaaugaugggaaggccugaaaccaagagcucuucugcccugcacauguauuaauucugaucacgagagcacauugguggguccucacugcuccagcugccucccacuggaacauccugagaucauggaaagauaggacccaagccaggcucccagaggaggaggcucaccagcacagaaauagcccugaguucuucuggacucagcaagugggccucugagcugcagaaaaagggagggcacuugagcagggcagccucguccuuuagaggucuaagguugaguuuaugggucacuaugucccagcacugugugucagcagcacugggugucagggcacuggacaucuggccugccugcccacucccuucccaccccaugcucagauguuuggaugaggcugugccaggcuguaauaaaacggucccgacgaggcuggagagcuggcucagcaguuaaaagcacugacugcucuuccugagguccugacucuaaaucccagcaaccacaugguggcucacaaccaucuguaaugagaucugaugcccucuucuggugugucugaagacagcuacaguguacuuacauauaauaaauaaauaaauaaauaaauaaauaaauaaaucuuuaaaauauuuuaaaagauucauuucuauaaaaauuuuaaaaauuaaaacagcacgguccugaguggcuaccuuggucuaccuucagccccaucucuguaccagcugggugauugcauugagaggcugccuggguggaaccaguugggaguggaagcuggggaauggaguuucacccugcaggagacacccugacccugagcuguugggaggcaggaaaacagugagagagguucccugaguuccaugucccaguuccccugggugcaucaagcaucacauuuccaauggcacugggacugaggagucuuugggugguguuggggcagcagggcaggccaugggaucaacuggcgauggaagaguuaacagcggcagcuggcucuucucaagaaaaaaaaaacucccuguagaugccuggcuugccuccaggguugagccucgggagcugaaaacugcaaguucagaccuguggcuaguucugccucuggaggagaguguagcagcagccuggccacagccugccgucugucuauccauaaacccaggcuggcuggcuuccuguuucuccucuguaaccugccuggccaccuaucuguaaggcuguccgucauccuuucuguccaguugucuggccuguguggcugucugucuugacccaucgaucuuuccccucuguccaauagccugagaucacccuguguagcuucuuuucccuucaguuugucagucaguuugucugucucugucuguccacugcccuguguguccaguugccucccucucugucccugggccacugagccauggcuuggggucacagggccacggucugccugguccugcuggguguaggucuaggucugguuaucguuguguuggcugcgguccuuucuccucgucaagccucuuguggucccggugccuucacgcgugcugcgguagcggcugacuccaagaucugcucggauauuggacggugaguaaaaagugggugugagcucaguggcccuuggcagcuagcggguugugccuggagacuguguaacuguggugggggugugaagagggacacgcgagugccggcugugcuugcggugggguaaaggccaugugugguuuggcuuccuacaacagucccagggcccuugcacagaaugguguauguguguccauagggaagauggggacucuggacagcauugcaaagauggugugagucuauuauugaagaucggcuauacagugcugguuggaaaggcagacuggaugagaccugugacuuugugccugcugguucugaccaagacuggaccuuuuucagaaaccugggcaacgggcuucaggguuccauacauuggucugcccugccacagagagagggaggucccagggccaguauaagaaagcacguuacagcugucaggaccucccucucuguggcagggucuggccuuggugaguggagugacugauguggaggcugggaaggagggagagagacagacagagacagacacagacacagagagaaagagaggcagagacagagagacagagacagagagacagagagaggaagaguggggagagagagacagacagagagauagacagagagacagacagagagagaggcagagagagaggcagagagagaggcagagagacagacagagagagaggcagagagagaggcagagagaagcuacagugguuguuuccugaccuuccaggaaacccagcccaugggaagccuaugcuacccaccaugcugccacaggauuacccugaggcaagaagucacuccugguccccugccucccacuggggcccugaaaccuggacaagccucuccuuuuuucuggucaucugggucuccuucccagaauaucugccugguagcccacugucaggguucaagugcuuuguaaacccaaggcuggguccugcagcaggcagaguggugguccuggcccaaaauaccaugcuguuaugcuuuuuuuugacuguuauugaauguaccuucugucugucuguccuuccuucuuccuuccuuacauccuuucuuccuucuguccauccuuccaucuguccuuugucuguuuguccuucaaaccaucuguccuuccuuccuuccuuccuuccuucuguccauccuucuuucugucugucuguucaucuguuuuuccuuccauccuuccuucugucuauccuuccuuccuucuguccauccuuccuuccuucugucuguccuuccuucugucugucuuuccuuccuucuguccuuccuucuguuuguccugccuuccuucccgccucccuuauuccaucugucuacccauucucuuccaccucccucgcucacaguagcccgcaacccugcuaaccugguccucugaguucccagacuuccuggaggauucacaucuacauuuaacuuggaacuccaugggaauagcagcccggaucaguagggacaguccuuucuacgucacauggcgcucccaagggacucaagaguuaagaccaacaguugcucugucuccaugagaugcagcaucuauuuaauccuucuagaauacaaaauuguaacug

SEQ ID NO: 5572 - RNA, 7615 nt, Mus musculus
ucaagacaggguuucucuguguagcccuggcuguccuggaacucacucuguagaccaggcuggccucgaacucagaaguccgccugucucugccucccaagugcugggauuaaaggugugcgccaccaccgccccggcaucaccauucuucuaaaucccacccuaucuguggaaaagcucgggagagacuacguacgccaugggaagcaggagcagaggaagcaggcagggcucaaacucugaugcuauuagugggugaccucacggacaguuauggaaccguggggaaacacaaacagacgggaaccaggaaagauguaacaugagcuuguguucuuguauggggauggaagggcguuccugaguaugcuagagaagagguaagaguagaagccugggguacaaaagaggucucuucucugcuggacaguucucuuucucacugcucaggcuccggggccacucuucauugugggacugagccaacccgagcucucaaguuguuccauggggcaggaaucaaggcaguuuagcucugggggaccucacaggaaggcaggcaccaggucucaguuuaucaggcucuggggagugaggaacugaaaugggagcuuccaacgcagggcuugggacauagguacuccaguucuaggacgggacaagaaggccaucccuuaagucugaggaguuagagucauaaccaauagacaaaggaagugcagguuacugauggagaaguguugggggugggguucuggaguuaagacuauccgguaucaugucucagucagaaggacaggcuaggacagguauuggguccauaguguucaaggcacagauacuagauguggcauucauaggacuaggguacauguucuuugcgcuucucccggggagacugggucuuggugagcacguggcccgaugcugucagccaagugugcucuggucucagggcugugagcuccacaugguccuacaacagagauagguuuaacauggcaccggagucccgccaacugcucuuagguccuaagaaagcuaaagagcagcggggcugggggugggaguucuugagugaugcccucacacagguagggucuuacauguugcucuuccugcggcgaugcagcaucauauagaugauagagaucagugccacuauggccaggccuccgaagaugauacucaguagcaccguguagcuccgcccugagagagaugaaaguggcgacaaaggccaggaaggcacaggcaugcagaggcaggaugggaggggcagcucaccuggcugacacucugggguaggcauagaccacuuuccaucagccugacaggugcuacucuccggccccaccaagcuguagccauuguugcagcugaaucggacaacggauccuuccagguaccucaagccuuccuuaugcccguuugcagguggggguagccagccacaggauaccacugggcagagcagaggacaggccugaacugcuggccacugaaugggggggagggagugcuaggcgaucugagagguccaccccuugagucccuccccacucccuaccaggcugcaggcucuucagacggugcuggugcaguuggugggcaauccggguggcguugcccacgcucgagcuuccugugcucaucacaucaaggaugcagaaacggucacccucacacagucuggccacaucuucugucuggcuggggcugaguguggucucaucagggaagagugguuugaaguugggguugugcuuggguccguacacgaauugguagaccagaagccaagagucauaaguaaacagggaagacguguuggaaacagccccuggggagacaggugucacucuugugugggcacagacaaguuucucuccuugacccacugugucacccugaccaaucccucuucucccucccugcccugggucacucacagucggcuccaaacuggaacaccugcugagcacuggcauucaggggcaggaccugcccauugcgcagggugaagucaucccugggguuauuguugaguguccccaggagaccacgggugugggucagaaacuucucaggcaacagaaugcucacacucaggaaaggaccuuguacaccgaccucgaggccagcccccgaugacaacaugauugacaccuuauccugagcggccacugacaggaacaugccuggccacaaguagagacggcuuaggguuacucucuagggcccuguucugccccugcaccccuugacacagcccugccugagggaggguagaagauacguguaaggaaguaagaggaugcacccgucugcugacugugacgugcuagcucuccuaauucacgucuacacacauucagaugcccgaugggcucaaggcuauccccuccagggauuccuccuccuucaugcugagccugcgugucgggaggucagucccugaggaggcuacagcagccuggcccuuccugagggucuuuguauacgauguccucacccauucccaccaggagccaucucauugcucagcucuggagcaacacagccuagugucaggggaguuggaggcuaugcuguggcucccggcuggcacuuuccaucacuguggacauuaggcuucugugagcuauucggaggacuagcugcuagcccuuggccuuucaggacuccauguaggcccucugguuaacacaggcacucccguggauaugaagguaugcgaacagaccucaggcugagcaacugcccucauuggccuaaaacagucacagacggugccuaaccuggccaugugggucuugacuucugcaagacccaagaaccuuugccuuuguauuugagccagagucuaccacagcuuacagccaggacuaaggacagcgugaaaaacacggguaaccugcugaccauacuugacugcgucacuuacccuucagguccauccaauuuuguucagugaaacugagcacuuucugauucagcaacacuuccaagacccgagacccgccagcuaaccgcaccucuaucacauccgaauugucuucuuggacggccacugcagucagcccugugccacgggccugggugccuagguggggguucacaauggggcucuugucuacuacccuggaugauccagcagugccaccccccaacguagaggccacagggcccugccucaccauugggcauucucccaggcugggcccggcccugcacucucagaucacucaggguggucuccaauagcacauauucgccauugccgcugaacgagaagcuggugccaucaaaggugacaaaauggggguccccgaaggcagaggcugaaucaaaagcagaagaucagguagauuucuuuggucuuucccacccaggcaagacccucccucugugaucagguacccaggccagcaccuacccaggcgugggggucuguaguugcggcagucacuggagggccggcgcuucauauaacggggacacucaggagcccaaagacagcaguaauagaagcugaugacgucauagagccaaugagacaugccgggcacacggggaggaguccgguaugggggugcaccccagucguggccacggucaggggugcugccacuugucgagucugaagucaggagcugugucccugcugccguguagcagcauugcuggccugagccauaccuggggcuagguaggguaggaggaggucagggccacuguuggcagcugcccccaagcccugcccaucccuuaucccugaucggguagcucaccuggcuugcacagagcgcacacagugcacagccccugggugguaggugcauacgcugccauguucaaugucacaaccauagucagucugcagaauauccagugccugucacccgggcucugcauucccucguucccccgggaaccaacuccggggaaucuuuugaccccacccuaccuccuggccggccucccuaacucagucagggagguuggccccuucuguccuccucccgcucucuggggcccuauuggguucaggggcuuacgaagaagcggccagaaucagcccuggccugggccagggugcaggggcagucuggcagcuccgucaggaaguuggguaguuggucuuccaaugccucccaggccaggcacugugcucgggcccaggcuacggagucugcccggaagucgucacccaggugccaggccagugcgugaucguugguccagagcgcccgcacaucccugcaguagaaaugacgcgccagcugaaggcccgacccacaccucuggggcuucuucagcaagcucugcaagccugcaggcaggugguuccgcugcaucaucugcugaggcccuuacuucucuccuggguaguuccugcugcugcugauccucagagcacccacuuuccaccucugguacugaggugaugcggguuugggggugaaagugaagaagccgguauuggggauguuuguagccaaaggguacagauaggaccacuucgagguccaguucccagaguaggguuuuccuaggggaagagaaaaaccuuggucagcccuccaaggaucccucccuucccucagucucuggcacugauagccugaaugaaggaaagaaaguaauagaugcucccccgugggcugucauguucugaugcuuaagcagggucccuggcuugugugaccagcggggacgcgcuugaaucacuggcccugcuccaugucaggcuuagaggagauaggguugagguggcugcuucugucuucacuacauaccaucuauucgauagucacagcauccaacauucccacggucuguggggccuaccaugcaugccagcagucacugcuguuucugucuagcugcaaaccccuccuugaucuauaccaccagaccgaaaucucuuuuuccuuuccacaccccuuccuccauccccgccugagacuccuccucucacaucugagugucugaaaguuccagacacccccauccagcccuuggcaggccccaccugucuccucauagccccacagcucaauggugacggccggcgugggcagcgcugaagugucccaggugagguugagguuuccccuggugucugaagugccguaguauugccaaugggucucguucaccagcuggcucuucucggauucagacacuuuguagggaugugcuggacagaggggcgaguccguaaggaaugagugaagacuuaauggugcacaagagaccuggaggguucugagaaccuccaagagacagacagacagcagucaggugauggucucccucagggucccuugggaggaagauaccauggccgggaaagauaaagggucuuuccugcagaacugaggacccaggccagaccacgccucucaucuggccccuccccaggcccuugcugaggaaccaucagggggcugggucugaaucagacccccauggcuccaacuccuugugggccaggacucuggucuagaugccagugguggaguaaugaaugacagcaacccucgcccaagggacugguucagccagagcgacagguaggcagacugggucuaguaucagcgcacauggauuagcauuggggaaaguccccuggccugggguugcagauaggaaccagggcccagggaggguggagucuauuaauuuaacagccuagacugguuugaaagagugagagcucaccagcuagccaagugccugcaugagggaaggagcggccauuguccauugauauggugaagggaauauagccgcuuucauagagcaagggugauaugcagugcacuugauagaagucgucgacauagccaaggguuuggauacucuccuuaaaccugagggacagagauggguggaggcagccugagccaaaagcuauggaaauggguuaggcuaggugcgccaguguucuccugccugcccucggucccagggugcuaccuccagcucccccacucuaugcuugggauugagcguguaggagcccuaaugaccuagcuguuuagguccccaccccccaccugcaaaugaccccaucaguagggucaguccacuuuaaauguugcaccacgaagucuuugccacccaucauggacccugaggaggguaaaaucucuaggcaguaguccagaaaaucuucacaacaggugccaaggcccgagcagguugggugacaggaacagaguccauccugugccccgcagcgcagggaacagcuucccugggcaccuggagaagaaagccccgugucccagggucagcugccugaccaacagggcccguuuccccuggagccugugagaagcguccaugagacagaccagggauugcuauggcuaccaaguggcaugguggaaagccaccggcucugugggcggggcuccauuuuagcacagguaauggaguggcuuuguggguccucacagcuaaaaaaggguccccgugcuuucugauaggguacauagucaccaagaguccuacugaaggccggggagggaaugguaucuggguugagcuugucccaucucuuucugggggugggacacaguugaaucucagagagccccacccucugagaaggcagccaggacacucccuuuuuaggggauaggaggggacauuccagugaggguugcagcacaguguaguugggaauaccccauagaaacuguggaacauccugucuaggccuagcuguucagcccacuuccucugugggcuguggagaccugugguagggcuguacuucagccccagagcugaaaaguggagacuggggugagguacaaauucccaggccagaccacaccuuccccagacccuugauggagauccaccaggagccgggcugcggucuaagccauuagaccaccucacuaagcuuauacuccggagcagcaauaaauauuuaucggcuaagguuuaacgacugcaaggggugugggaagaugcuucaagaugccaugagauaaaguaccagaagggugguggcacuugugugaagcaggagacugcaggcugguuaacucccagcucagcucagggaaaggccauggcucuaggcucauccuuccugcuagacuuucuugguugcgccgagaaggaccagcacagggacagaugagaggcaggggguucccugugugauugcacccuucacagaggcugggcugcaggcucuggucuuccgggauucccucccaggcccuuaugugagugcagaaugagcuugguucagaccucccaucuccaccagaagugucuagauccaggagccccccccacccccccaguuucuucccaguacuccccaguguagucacagauggacugccagauggauagacagcugagcccagaggggugucugcuuagggccuggcugaucaggcagaugaacagggaggucagaaggacaaagugggggcauaccugcugugaacccggggccugguauuguugagagcagcaucaaaauccaaggcaggagggccagcuucauggugugcccugugucugcaaccagcaggcagcacaguggcucagagauuugcagggcaggcucuug

SEQ ID NO: 5573 - RNA, 1143 nt, Mus musculus
uaaagaauuauuuguuuaugucuaugaauacauugucacucucuucagacacacuggcagaggaugucagaucccauuacagaugguucaggaccucuggaggagcagucaaugcucuuaacugcugagccaucucuccagcccuuguaguaguaguaguuguuguuguuguaguuguuguuguuguugguggugguggugguuaguugguuuucccccaucauuuggagauuuggggaaaugaugaugucauauaggacuuaggugccccuggcugccacugaagauuccuuuucuuuuuuuucuuuuucuuuuucuuuuuuuuuuuuuuuuuuugcauuaggcggagaaguuuuauccaauccuaggcaugucuucaauccucccuccugcuagagggauuagcuggggugaaauaaauaagaauaaggaggccugaucauuucccucacgggguguggaccuagcauuuacauacuuggccacucauuacaaccaaccugaguccugggcccaaggaacuggaugggauugguagucucacuuccuucuuccuuucugugucaaggaucuccgaagccacuccucccucaaccuuuuuugugaguggagggaaagaaagugaauuugagggcaguuagcacggcuaaucugccccuaaauucaccaauagagacgccgguugugucaguuuuuccuuuacuggguuccguuccucauuuggcugaagcacggagguacaggggccaguuuggcuccaaaccaagacucgggcucauaguucagguucaucuguuucggggguuaacuugcaguccggcacugauuggcccaaaguucuuguggucauccaaugggaaggaagauugggaucgagcuccgaucgaggcuaagaggcacuugaggagcugggacccagccguuccugcucgccguugcggcugcuccggcuucuguccccagaggcaguucacccgaggcuaguucccgaggucugccagcggcuacucccacagccuccgccaugggucuggagcucuaccuggaccugaugucccaacccugccgugcugucuacaucuucgccaagaagaacggcauccccuuccagcugcguaccauagagcugcuuaaaggugggcu

SEQ ID NO: 5574 - RNA, 2549 nt, Mus musculus
ugccagcgcgcgcgcuaaggauuuuucgauggcugggcagaggcuggcggcgggcuuccugcaggugcccgcggugacacgcgccuacaccgcggccugcguccucaccacggccgcaguggugagcgggccgggcgggcguggcggcaccaugguuacaguccccgguggguuagggaugucgccugcuucccggggcuuacacugccuccugucccacagcagcuggagcuccucagccccuuccagcucuacuucaacccgcaccugguguuccggaaguuccaggugaggcggccuugacccaggcgccuggcagccaggacccugcccuccauccccgcgccucaccgccacccccaccucuuugcaggucuggaggcucaucaccaccuuccucuucuucgggccccugggauucggcuucuuuuucaacaugcucuucguguauccugggccaccuuggcgggggcuggggguggagugagcccgggauggggguuaugcugggguggugacgggggaaacugaggcccagucgacguggcacuuccuaugccaguguugcagguuccgcuacugccgcaugcuggaggaggguucuuuccguggccgcaaggcugacuucguuuucauguuucucuucggugguguucuuaugacuguauccuucuguauguucaguauuauuggaccaaagagucgccuucuuaucugucgugacccagacuaggagggacaggcauucggagccuggcagccauuuagcuuaggugccccagcuaguucuucagugucccugaacagcacaacagggagauauagggcagucugguagacuaccaaggcucugaaacauggaugcaagagccagaaggagcaggcacgggaacugauggggccuggguaccuggaaaucacagaaagggguucucaaaucucuggaauacaccagggauaugagggaacccguggaaagggucagaggcacugugggcagcagacugcuccaggaagccuugacucuugguccagcugcugggauuccugggcagccuguuuuuccugggacaggcccucauggccaugcuggucuauguauggagccgucgcagcccucacgugagggucaacuucuucggcuuacucaacuuccaggcaccauuccugcccugggcccucaugggcuucucgcugcugcugggcaacucgguugucacagaccuguuaggugagcuggcccaccguugccacucacccccaggccugcugcucccagggagccagcucauacaucccuuccccggcuccucccaaccccucaucuucuccuaacuucuuguucguuauuaaugccccucaagcaauccagcuggaccacaggauuugcaucugcaguugaccuucugaacugaguuggucugccugggggugguuacaguuucugcuuccuggcuccuacucccccaguguucucaagcuccuaguuccuccccucguccgcuuaugggccccuuuaagccugucuuucaaggccaguucugaucuuauucugccagauagcaggguacuugggcucuggaaccugggguuacccugggcugugaaagauggcuucuggcagccuuuggcucucucacagggauccuugugggccacaucuacuacuuccuagaagacgucuuucccaaccagcccggaggcaagagacugcugcugacccccagcguguugugaguguuggacaucgguucccccacggccccuuccgugccaaucuaccuacuccacagggagggggaugaccuguguuugcugcagugcucaguguaacuguccccuccccacaggaagcugcuacuagaugacccucaggaagaccccgauuaccugccccuucccgaagagcagccagagcucuaacugcagcuccuggagcaggaagcccacucugacagcacucuauccuucccuccaccucagcuccagcugagcagcccaccucggccagcaacacccuccacuucccuguaccaucucugcucagcgguaaugacaggacacagggcccagagaggucccggacugccugcagaugcugagcagaguucugaacuagguacccacaggccucaccuucacauugccuaugccuccauggagaccucagcccagucaacaggaaucccaccguggugccucugggcugaugccacccccuagccugucuucauuuaaagcaagcaagucuucaccuucuccagcuggugacacacaggucccauggucucaggugcagaggacaagccugacccucugccaugcuagugagcccagggccuugagcucuauuuaagcagcagccguguacaguggagguagaucugggacauuccuuccauuugccuuguagcggaaggccugugcaggccuuccuaccuagcuuucuuuguugcucuacaugugccccacgggguucacucaguacgggauuuccccaaaucuggccuguuauuucuauggcaucaaaaauguuuucuacugagucu

SEQ ID NO: 5575 - RNA, 9285 nt, Mus musculus
aaggggcggcggcccggccuggcccagcaggcccagcagccccggggcggauggcacgggccgccugucuccuccgcgcgauuucgcgcguccuccugcucccgcugccucugcugcuccuguugcugcugcuccugccgucgccgcugauggcccgggccaggccaccggugagugcccgccacuccuccccgagggagggcugggcacgcgggcugggcccacuggcugagcuugacccaccaagcgagcucccuggcuacccuagugcagucuguccccgaaaugccuucugggucucucugagcguacuauaaugagcuucccgugguuggcagugugcaaguggagcuggugagacgcgucucugcgcugaacucaguuuggagaccggcuucuccagcccccagcuagggaugcuggaguguguguugauagagguagcagagggaguggaugccaaggccccuuguucaucacuggaaugaagcaaagcaagucuggggggaggggggagcaaaaaggggcagccuccgggugugugguuccaguaagcaccccugcaagguguguaccguggauggagaauaaaggaagagcuaggaaggagaaaauggggcccaaguugagagaggugccccagcuugcaggagacaagucugggaguccugguagccgacagaaaaugcaccugagagagauagugugugcgagcaucaggugcagucagaauagaagggagcaccgggggaacaaaagcauaaagaagaagagaaaggaaagggggugcaaagaggcaaaggggaagaagagagauugaggguuucccagccugugugucccaauggcugcauccuucuuccagcuuggucucugaggcaccugucagaguagagacuaagcugugcuggggcuggagcuggaaccacuacagaucuacaaugcccacgggguaccgugcccucaguagccagcuaaggcagccggccagcucaaggaaugauggaugggaggaagguaugauaggcaggugucccaggacagguccagccauaccaauccaucugccaguuuugcugcacacuggaagagaaaggguuuggaaaggggaguggguauuguggaucaggaccuccucaagcaaaacauggaguucccuguucuagaacucggagcggagcgcagucguuaauccccucccuccccccauccguacccccacccacucccacccccgcagaagccagcgauagaacucaugccuucgagaauugcacuucuccugacuucuuacuaagggggcaaagcaggaaagagcaccgguaccuccuguugggcauuuaggauaaaagacgaggcaaaccacaccaaugcuugcuuguacagggcuugggggggcaagccuggggugggauccgagccgaggaucugucacacuuuagaugcgcagaaaggguuggucaccucuaacgcuuuuaucccuagacugccaucggcggggccaaaagagcucgguaaauauuuauucaccccagcccccagcuugugaaaaauccaccaccuagcagccagggaagcugcccuuccuucuggagcuaguagggaugggugggaagggguuaggcagaagcacaaggguggucuguguaucaguugcguguaugguuugggcuguuuccuuaucuccugcuccguugccucucacggauaccuacuacugaccuguuucauccccauuagaccaaaagcaaacugagguucaggaagggaccgcuugaucuuccccagugguuuccuagucuggggcuccuuucuuaacuaccuuccacuagguuccuccccauggucuggguugggagucacuccuaggacugaccuugagggucuaagauaggccaggagaaugggucagccaagagucccuugagugugccugaggcuuccuauuggcagcuuccagaccagaggguggggcagagugagucaggucccuuacaggggacaggccagaggaagggugcuagcuaagaaagagggaaugcacuagaaacauaaaugcugcuuaggaaugugcaucuuggagaugagccaagcuggcggggaacggguaagcucugaggagaggcgguaaaccccagcucuugucugguuugcugugcgaucccgggagucggggguuggggggggugggguagucuuuaaccucucuggacucggauuugugcucugggauguuggagauuuaggauaaauuuagaauaaugacuguuccccaaacucuuacuggcuacagaugagaccagggguucucugagcuuaccagucucccucauuaaauccuagaagucccaggaggacugagaacuugggaagaggagauuccuaagugugggaggcaguggagggccuacgcggauagagucugggaaggagcugcccugagucugggcugcugcagggucuacagggagucucucagcuccuucuucucccacgguugacaucugucagacggagaagcugaagcccagugaagauagugacuuguuguucaggucaccauggaauagaauucagcuuucagaagcucagagcuauuggcaaugaccucaaugccucauggggcggggagggauguugaagggaccaugguggagaugggaaggguuguucauguccauuaucuuucccaguuuuacuggguggcagagaagagggcccaagcugauaggcuggacuuugggguuuugggggcugacagcacccuaccauucuuugagagggucacugacucccccugagagaguugagaagaggacucugucuugcuggccagguuggacaggcccuguggcuggucauauacaaccugguccaccucuucuucauugugacacuucagggguccccaaguuguuucaaugauuaccugugcacauuaccugggaggcaaccggugcuuuguaaacccccccccaaaaaaaaaaccaaaaaaaacaaaggagacuuggaaucacuuccccugagggagaauaggggaaaaguuugccaccugugguccugagauauugucaggaugggaagugguugucccuacccucccugcauuaaaggggcaggucauagaccugucagggagugggcaaagugucucagaacuggggccucagauggguagggugccucucagagguagaguacaagugcagugugcccuggauucaauuaucagcaucgcacguacauauaaaagaaaccugaguuacucggugccuaagucccaugccuuaaaugcucaacacguaucaccuuggguucucauaacaacacuuauugggaguccuauacccauuuguuagguaaggaagccaagggccgggcugcaggcugcaugcuggaugcagccccuccaugccggcgaagcaugcucagaagcuuccuggguagaugcggagaaugcagucagggcuuccuuaaacacauguuucuguagucucaaugggucccaucuagaccuccuuagccagaucaacaggagcuggugacagacagcccagggcccucuagcagggcaggaggaggagagagugugaugccuuggaacggggucaggaaagucagaggucagaaauuaaccucacucaggcugaugaacccagcucugugccagcguauauuucagcuccuccauuugcccagcaauccagagggggcugggcuaagcaugcuuugcuaaagaacuauaucucaaaccuugggcccuggggaucugaaaucugacuugacucuuuuuugagacaggguuucucuguauaguccuggcuguccuggaacucacuuuguagaccaggcuggccucgaaccgaacucagaaaucugccugccucugccucccaagugcugggauuaaaggcaugcaccaccaaugccuagccugacuugacucuugcaucauuuuuuguuuguuuguuuguuuguuuguuuucuugcccaggagagucaccgucaucacccugugaagaaagggccucggcuccugcaugcagcucugccuaauaccuugacaucuguccccgcgucucauugggucccuaguccugccgguagcuccaggccucuacgauguggugugcccgaccugccugauguacugaaugcccggaaccgacagaagcgcuucguccugucaggaggacgcugggagaagacagaccucaccuauagguagggaccagaaggcaggggaacaagacucuaugacucuauguuauccuuacaccuucauccugagaugcccaagaccaaauucacaccacacacagaccugcaugcccacugacccucguccccccccagccauccaugaacuuggaaccuuagucuagacacacacagacagauuauguucucuuguagccaaaggagccucaguucaugccugggggaagauuucacacaggcucuaauagagaccuagaaggccugggccugggcccuauagugaauaggacaaagccacagcucugguagauuguucaacuccaccauaacaacguggaccuuuuguggguggacacaaguaauguggaggcccucagcagguggugaggaagcagagacuuagccugagaguuccucacacugaguuguacugucagauccugggaccccccuggccuuguagccuucccacucaggguauauaucuaaacagacccaaccccauacaaaggugaacccacacauccagaaacagcucccugacccugaggcccaggacuugccuagcuccagcccugaguacacacacccaacugaucauccagaggcgacauuucuuucuugaagggagguagcaagucagucgggcuuucucacacaauaaccaagauggccucaaacucauagacauccuccugcaugcguccccacauucagcuccaggggaagcuugacuccucaguccucaggggcuuccuugccccaugcccaggccccucccccuccccccaggauccuccgguucccauggcagcuuguaagggagcaaguccggcagacaguggcagaggcccuccagguauggagugaagugaccccacucacuuucacugaggugcacgagggacgcgcugacaucaugaucgacuucgccaggugaaacccguggccugggaccuuucugggagcacauccccguugucagcagccucuaacugugucccccacccccacccccagguacuggcauggugacaacuugccguuugacgggccugggggcauccuggcccaugccuucuucccuaagacccaccgagaaggggauguccacuuugacuaugaugaaacuuggacuauuggggacaaccaggguaugugcguauguguacuguagacccaucuuccagaugaggcaacuaaggagcacuuaaacugguggggucuagagauuaaucaggcuacugguggcaagcgguggcauucgcuaacucacucacucccacuuuccaggaacugaccugcugcaaguggcggcucaugaauuuggccauguucuggggcuacaacacaccacagcagcuaaggcccucauguccccuuucuacaccuuccgcuacccucugagccuuagcccagaugaccgaaggggcauccagcaccucuaugggcggccccagauggcccccaccucccccgccccaacuuugagcucccaggcugggacagauaccaaugagauugcacugcuggagguaaggaggagggugggaagacagaggugagaccccaccuccucccccguucccccugcagcccugccggucuuauggcuccaguaugugcucuauucuggcuccucuauuccaccgcagccggaaaccccgccagaugucugugagacuuccuucgacgcgguuuccaccauccgaggagagcucuucuucuucaaggcaggcuuuguguggaggcugcgcagugggcgacugcagcccggguauccugcuuuggccucucggcacuggcaaggacugcccagcccuguggaugcagcuuuugaggaugcccagggccagauuugguucuuccaaggugagugaggauuggaagucaggcaggaauagugacagaggacucagggacacgguggguagggagacagugcccugaggacuuagagccaggagagaguggggcucgcuccuuaggcauagcugagagucucggagguggcagcucuugggaucagagaagcgcugaaggucuugcaccacuguggcugcgcacuucuaugugggguggggcuuagagaugaggacucaggcucaggggcagaaugauucacuuacggagugaagcuugaaaaaagcagagcagaaaacggaucuaggcauagcgacccuggagccugugauuucaacucucaucuggcagaggugacaaccuagaacgcuccagguggcaggacuucauaaacacaggugaggcaugggaacccuguauauguauuccaaagcagccaagggacaugggcuacaggggcugggaccccgggguggucagcaaacaucugcaauggguaccagaauaaccuuaauuugggcuuacugaaccuaagcuuaucuuuguccucaacccagcucaucccagcuaguucuaacaucccucugggcucgggaugcugagaaagcacuacuggccagcaauguucugcagucaaaagaaacaggcagggagagucccuggugguggccgagcagauccacagugacugggguuggcaguggugacuuggcagcuccuggcaacauccccucucuggcaggugcucaguacuggguauaugauggugagaagccaguccuaggcccugcaccacucuccaagcugggccugcaaggguccccaguucaugccgccuuggucugggguccugagaagaacaagaucuacuucuuccgagguggagacuauuggcguuuccaccccagaacccagcgaguggacaaucccgugccccggcgcuccacugacuggcgagggguaccuucugagauugaugcugccuuccaggaugcugagggugaguugaggguaagguagcuggaggggagugaguggcugucauccugcuuccuccccccgacccccaacuucauauggcccagcuuaucaccacagauccuuuguccugguggccaaucaguguuaugccccauauuaaaaaugaaauggguggggggacuggagagauggcucaucgguuaagagcacugaaugcucuuccugagaucccaaguucaaaucccagcaaccacacgguggcucacggucaucuguaaugggaccugaugcucucuucuggugugucugaagacaucuaaaguauacuuauauucauaaaauaaauaaaaucuuuuuuaaaaaacugaaauagaaggccagagaggucuaaggacuugcccaggucccuuggccacagccaggacuuaccaaggguagacaaugcuucaggcacgguaccacacuccuuacaugucucaaguaggucucagaacagccuucugacaucacgagcucucuccaagcugggccugcacaguucuuuuugucugaggcauggucuuacuacauaucucuggcucaccugggacuugccuuguagaccaagcugggcuugaauucauagagaucugccugggauggaaggugugcaccaccaugccugaccuuaacagcucuuaccagcauagugucagaggggcaagaggaaugggcaagaaggucacuaaacauaccagaugaacaaugguacugucccuguuagucccugcucccaaccacugaaccacuaggcugaguccuaagugcagagaacucuccugcuugcgacucuccucugcuucugugccucccaacacugggagcacuacuuugaguagccucuggcucuccaucucugggacugccuucugugguguggacagaagggggagcuuuguagcaggggcaauauucacuuuccugaaagguaggaagugagcugagguucccaguaccgacuggaccugacccuguggacagacagacagagggaaagaaggcuguaguaaagccagcucuggagucugcaacuuauuuauuuugaaggcagggucucuuguaguccaggcuagccucaaacuuaguauguagcuaaggaugcccuugaacuccuuauccucuugccucuaccuucugaguccagggaguacagacacgaagcuaccaugccuagcucggcagaucccaaagaauucacuagugaccaaggccugcauggugugugucccuaggcucgugcagagcuuaguauccacuggcugacugauguccuucucuuuucaggcuaugccuacuuccuucguggccaucucuacuggaaguuugaucccgugaaggugaagguccuagaaggcuuuccucgccccguagguccugacuucuuugacugugcugagccugccaauacuuuccgcugacaacacuuuggaugcauucagggguacugacuccugccagggcacuuagaucauguaagagacccacagccauaucuguggcucugggcuucaggcaugggacagacagggccuaugucuccucaggggaguggguuggggugcagccacuguuuguaggaacgaccaugcuggucauggucaccugccaacaauugucucagacuaggcaaaggcuuugguguuacuuaaaaauaagggagguuuugggcuggcaauauuucagcuaccaauaauccacagucagccugguugcccaaggucuccaucucugucccucaaaguagaacccccacacaaacucaggaaucaccugcaaugagguuccuguugggagugguguugguaaugagaugcccaggguaccaugcugccccugcuaagcaacuggaccaguaucuuuccugguaagucagcucuggagagauagugaacugaucauauucuggcaggugauucagacaagugcuuccuggaacucaggccaaaagguacacagccagccaaggaggcagcugcuuccucccagagacacggaaccucaaaggccccacauaccucacagccuugccccaggccauuucuuucuggggcccucuuccuagcacagguacccucuaagccauguacauguguauacaguguauaaagacuuuuuuaaaaaaacaaaaaacaaaacccaaaaaagccaagacugucauuaaacaugaguguuuucuaagcg

SEQ ID NO: 5576 - RNA, 3101 nt, Mus musculus
uggcagcucccagugucauggagaccacuggaagcucagggagcugcuggcacccagaaagcagcagaagaaagaagaggccaguggucuuggacuagcugagccaguaggugagcaggggccagaccagagagccaggagccaagccuaccuaaugcagcaaaacucacaugcaugguuccuggguggagacuggaaaaggggcagcagcaggagguucaaagcuccaugauaugucuccuuccuucuacagggauguuuaucacugugauguuuggagguaagcagaguucccgucccuaaaccguacuuaggagccaugcucaggaguucuaucucccucuacccuagagaccuaggaaggagggauacagacugggacgggggauggguaggugagaaagcuguucucaagaggaaagaacaagaaauagggccagagucuggggaggacuucaguugugguccccaaccuucuacacagcaggagauggacggaagagucuguagucugagaagcauuugccaaggggacugggcccgaaacugagucuuagcccauaaucccaguggugucucugggugugggaguggaguucuuuuaguuggaggaggcggcugucacuucugcugauucaucuccgccccucccuuagcggguugccgggagcuggugaaccccuggugcaaccugcugaacuucacggugcaucugaaacagaaagcucggguucccccaggaggugagaagaccugaaaggacugggggaugggguggggggaggggaggguuuggggucccaugccaggauacugccuguccaugucuucccaggaaccauugcccuccuggcugaagaugggcacuuggugaaguuagaagaggagaccacucaggccccauccauggccuguucccugauacaggaacaagugaccuauguccugguacaggucauuaguaaguggggccuaagaccccuuuguauguuacacuauaagggagggacagcagggcacagaccaacuaagauccuguuuagccucagcuuuggcugggcccuguccccaaccaccccuacccagugcuuguccuaucccccggccugggccaggaaacagauacagaauuaaaggauauuauggggaccugcagauggucuaggacccuuuguccucucuguacucuguagaagggaaagaugggaccccuacucacuaugagucacuccuggacaaccuggaugaccaguauccagaguuagcaggugaguauuaagguaaguuuggguggggacacaucugugcaccucccagugacaggauuuccugggccuuccagaggagcugugcugccucucuggcuuuccaaccacaagcaauagucagagaagacgcacgggcauucgacguggccaccgggaacaaggucccccaccuucaaggucucgaagggugaccucccuaucaucuagaaaccgcuaacuggagccagagccagguacagaaaagguaggggaaaacugaguggcaagacuggaaaucugaagccugcuuggacuauagaguaaguucaaggacagcaugagcaacuuaguugguccuaucucuaaauacauacauacauuaauaaauagauagacagacagacagacagacagauagccugagcaacuuaguugguccuaucucuaaauacaugcauacauuaauaaauagauagauagauagauagauagauagauagauagauagauagauagauagauagauaaauaaagauuuugccaggcgguggugguacaugccuuuaaucccagcacuugggagacagaggcagacgaauuucugaguucgaggccagccuggucuacaaagugaguuccaggacagcagggcuacacagagaaacccugucucgaaaaaccaaaaaaaaaaaaagaaagaaagaaagaaagaaagaaagaaagaaagaaagaaagaaagaaagaaagaaagaaagagaaaaagaaaaagguaggggaacccaggaaaauccaaaagggaucuuuacugacuuucacacagagacacacccaggacuguaaccagagauaaaaccccacaguauugcuggacuaucagcauccuaaaggcacacauacucugcguuuaggaagcuggcccacguuucuccagccuagcacacaguagguguucaaugcauguuguugacugaacucagugaacguagcgacuguacgaugaagcaaucugagcugugucuuuuuuuuuuuuuuuucugagcuguggucuuaagggccugcuuccauuccagcagguucuaugagccgguacaccacagccaagcuggacuugaauccaaggggacuggcccugaccucugcuuuaugaucaacugcaaacagacagcaauccagcaggacuccucuuccaggaucuggcgguuacuaagaaguuacaucagcaagaagggaaaggucacagacaggaugugagaguugccccccccccacuccccgagcgcuugagauccccaccccaccccauuugagugcagaaaaaagaacucaaggacaaaauaagaagagaaaagacacagauguuccugugggcagagacaauaggcuccucuugagguuuuaggucccaggggaccacuugcaaauaccucuccagucucccugcuuaggaguguccuugacuauccacaaugcagacagauaggaguuccucccaucccagagguucaaggacagcucaggguucuauaacaagauccccaacucccacauccucucucccaccuccgcaaagaugaggcauagcacauuaacaagauagcuguuccccuaucuccccugauccugcccccccccccccccccccgccagccaacagggcaguaaaugggcacacagcaggcuguggucuaaaguaaacuuuuuaauugaauaauuaugucuccuguuagucugcggggugagaacgauccuuccuuacucccagucacauggaaccucuccuuuccaucaagcugucggugagggguuaggcgaugagcaggcccacagccucuucagggcagggagcucagaccu

SEQ ID NO: 5577 - RNA, 1304 nt, Mus musculus
aaacagauguaugcauuuucccaugacacagucauguuccuccccacaaaaggcccagcacaacuuuggaagacagucuuuaggaguuccgguugcucugucccauugcaggccucaugccugugucucaggugcugagccgggaucucuuugauacaguguuucucacagccccagacugggcauucccaguggaacucaagagacaaucuugaagaggcugcuucuguaagaaagaccagaagaaaggcccacauucuuucuacuaaauacuauuaacuugcccgccucuccuaaugagugaucagaauuccauaauguauuucaucccugugucgacugacuuuugcuaguuugaucugucucucaggcaacgagucuugcuuauugguuagguaagggaacaguuucucuggcaaguauugcuagcaguccagauagcaugggugaauucuagcacugcaugcugcuaagugucucugucaaggucaaagaaaauggagaacagcucuuauguucagucacaugagcagcagccaucucucacucuaccucacccuucugucugucugccccgagacaugcuucuuucugugugccccccccacccccaccccacuuuaauagagaggagauucaacaacucaacaacucacucuuugcaucugcucuucaguaaucaagcagugccaugcgaucucaugaauauuuauaacuagaaaaucgaccucucugcucuccaugacuugaggagucuaacguaccauguugaacuaugcccaucuuggggcaaagaguagugaauuucugagauccaagguccaacguuagugcaugguggaugguucaagggcuuucuuaacacuucauugggaccuuugaaagcuuuguagagauucuguggcuugcucugggaccagcagaaggacagagcauuugacauccuggaucccgagucccagcucuuuaucccuuuguauagaagaaggaucuuggauuggauaagccuacgguggaugaggagucugacaccaaucugucugaguacgguuccagaucugcuuccccucccccaagcucagaguugagagcacuaugacccggauguugauccaacccauacuucucucugcagaucaaguggccugcgucgugccuucggaaugccagaaguucuguggccgaggaaccgguuguagugcccuggcuuacccagugcuggucuuaggagugaugccucaugguaagaaguggaccuuuccaccgaggguuccauggcugccuuugggaaggcagguaagagg

SEQ ID NO: 5578 - RNA, 12477 nt, Mus musculus
gaaaaauuagauggguuuaaugaauuggucauaaagaaagauuuugccgaucaacaauugcuaauccaagaagaagaaauuaagcgccucgaggagacaaaugccagcauacaaagacaaaugguccagcuccaggaagaacuggaaaaacagaagaaaagcauggaagaauuaaagguagaguuccuaguugggccgcaguacuaagcuggguguggugggauguggaugggccgcauggcugugugggcaggccaugcacagagcuguagcaucucuugggcauguggcuugaaaugaaggaagggacauguaucuugaacccaauagcaggucugggcagauguccuuagugaccuccgggcagcaggguagccuugucaagacagggcugucgcauugccuagacuccguugugucuguguuugagcucuaggucaggacuugaacgugggaguuuuccuuugcuuuuugucgucagacguuacaaaagugagagccaaggagaggugcuacucaguaguccguagcucgagcgagacaggagccccacuugaggguaguggaggucucagcagugcuggcgggaaccugagcuuccccuuguuuccuugauccuccuguucaaccugcaaguucaggauucccacccugcugcccucacuuccugcagcucaccucagggcuguggcgaccuuauucugugacuugaacucacugaaccuggagggagggagggagggagggagggagagagagagagagaauaugaaugccgguuuguucuccucacauuggaccacuugacauuguaugccgguuucuuuauuccccaguguuuugugagcguguaaauguucucugaaaccuuucuuuuaaaagaauuauugcuguauuuuauguguguggcuguuuuguuugcauuauguucgugcgucacaugugcccuuggagggcagaacagggcauuggauccccuggaacuggaauuauagacgguugugagcugcuguaugggugaagggaaucgaaccuguguccucuggaagagcagccagugcucucaacugcugagccgucucuucguuccuuggauccuuuuucaugaauucauguucagcacauggagauaucauccaaccuguccugguguugucugugucccuguguuuuuauaauugccacuagcccaguggacacuuacagaugcuguucagcuauuacuaggaguuucucauacuagaguccuaggcacgccucuuuggcucuccuuaccagguggaucuaguaugaucucaguuagguucuguccagaguguauagucuggagguccagugaguguaagcaugcucagguaagcucagauaugugcaaacauacccacuucugcaggagaccucaugcuggcuuauaacaguugauuccuuaaaucccugauuccuuguauuugccuaacauacucauucccccuucccccauaggaaaaagagauacuaaagcaagagaacaugggugacuuacugcuaacaacuguaucacgguccgggcuggaugaagcuggguguccuaugcuuccccaaggcagcucuucuagggguccggaagcccaaccagauguaacagagagggcacucuuacagcacgagaaugagguaagcaacaugagcuggguggcacugcccaacugcagccccaugacccuggcugccccaugaccccgagcccuucugcauaaaggcucaccauccaaaaccaggcagcagcacuguggccagaguuuauacccuguaacuuuguagguuucugucacuaggggauaauaauaccuagacuuugaaaccuuccaaagcuacuuuauuuaauaaguauuaaauauguuaaaauauuagaaaaaaaugucaacacuucuucauguagaugaaagguuuuggacuuaaaagaacagcuagagaagaucaaagaugacuuaguagcuggguguggcagcacaugccuuuaaucccaagcacucgagaggcauucggaucucugaguucaagggcacucugguccaccgagcaauuucaggacagccagggcuacaaagaaaaaacaaacaaacaaacaaaaaaccaaacagcuauggcucucccuacccuaagggauuguccgcugauacuacugaucccggggugggggggggggugcggggggggggggugggcauugggagcagagaugaugaacuggggauuuggaaguccugugaguacucaugaucacaccagcuuuuggcuauuauacauaaggcugcuaugaacauaguagaguguccuuguuauauguuggagaaucuuuuggguauauguccaggagugguauggcuggguccucagguaguacuauguccaauuuucugagaaaccaccagacugauuuccugagugguuguucgagguugcaaucccaaguugcauuuuuuaaagaugauguauauuuuauugagguuguuagacuucuuggcauaagucuuaucuuugacuaguaacucuaucaccuguuccuuuauuuauuauuacauaccuauauauauucuuuauuuauucucuguauauucuguauauauauaauguauauauacucuguauauacucagucucuuuugauguauaugaagagcaggcugucauuuuuucucugucuuggccuuucugcauagguguuuaucagcucaugguucuucugcacuaggaguggacugaccaggccuagagagaucucccagcuugcacaugcauuucuguaguucccaauguguuuguagcaauaggucaauuccagaugugauugacaccagguuuccgcucgcaagggaguuucagaaacggugucuuucaauauuucuuagaguugcuaaaucacguccuuguucuccauguuagcacgguggacuguguugguggcguuuucaagcacggagucagccucacaucccaagagcacacucaccugcuuguggugcaggcuuccaugugcagauguucugugaaguucucucucugucuccaccagggacagcagucagcuugugaccucuugagucaauuuuuccccuucuuuacuguuuucuagaagagauaguugaagauugguauuaauccuuaaaugugaaguuaaauuuguuuauuuuguguuuuuaucuguguuuacuuguguuuuuaucugauuuauuuuaagauuuauuuguuuauauaugugaguacacuguagcuuucuaaagacacaccagaagagggcaucagaucccauuacagaugguugugagccaccaugugguugcugggauuugaacucaggaccuguggaagaguagucagugcucuuaaccacggugccaucucuccagccuguuuguuuuugagaccggaucuuucuguaugguccugucuguccuggagcucacuguguagaccaggcugcccuugacucacagagcucugcucuccuuggcccaggauuaaagacaugcauuuucaugcccagcuguggaguagaguuuucaguggagcugccugauuaaccuuguuuauugcaguuugauugcaucuuccuuucacuuccuuacuaauuacagaacaaggaaaauuaauuccuauugagaaauuuagagccauucuuccuugaaguauuuuuuuuuuggccugcccuauuuucucuuugcuugguguucuaguuacagauagacuauauuuuucauaagguggauaauuugagccaugcauaguuuuguuguggggggaccacgugcucagaauuaugcuucagacccucucccuggccugagccugugcagcacacagaaaagggggcagagcagagcucucugugcauuagaggacucguacucuucuguugcugugguaagacaccaugaccaaagcaacuuagaaaagacagcauuuauuuggguuuuuuuuuuuuugagacaggguuucucuguauagucuuggcuguccuggaacucagaaauccgccugucucugccucccaagugcugggauuaaaggcaugcgccaccaccgcccggcaagacagcauuuauuuggggcucacaguaucagaugguuagaguucaugaccaucauggugggaaacauggcagcaggcaggcaggcaggcaggcaggcagggcucuggagcaguagcugagaguuuucaucuugcuucacaaacugggaauggcaugugccuuugacuccuuaaagccugccgaagugacacaccuccuccaucaaggucacaccuccuauuccuucccaaucuacuaacuggggacccaguauucuaacaugaguuucuggggccauucucauucgaagcaccccaaggaucuugucuuuuacccagccauaguuguguaugaacuaugacauagagcuugcgaaauuacauguuguuuuggggcucuugauauuucaaaagcgacauucauuauuugaaaacauuuagaacacgaaucgguuaggcuuuuccugguuuugguaacugcaugugauggugucuucagagaauggaguugggccauauugccauggcuaccaaucccaaguucccacuaacuguuguuguagguuuacuucauauccagguuccuuuaaaguuccuggggacuaggugaaacacagcacgccaugagugugcucuuucaugccuagugaaggggguucgugucacacaccgcagagccugccaccauggauccaguggucacuuggguggcugaagggacaacgacugugggucauucagcucauuauaacucgguccccggccagugugacacccaaaguuuaaauuacugcuucaggaaaaugaaaacaagccaguuaaaaggauaacagaguaaggggucucaguguagcggagugcugugcgccuagauugggcagaccugccgcuacucuaccaucuuccacaucuaugagaccccuuagacuugcaguuucuccaggccaugugcuucuacucugcuuuucuucuucuuccuccuccuccucucuuuuccucucucucaaacuuccuccuuuucucuuuucuuuucuuuucuuuucuuuucuuuucuuuucuuuucuuuucuuuucuuuucuuuucuucuccaccuucccucuuucugcccaaucaccagcucuccuuuauuuuaaaaauugagguaggaagcagguuuauaggagaucaccugagugcugacuauuccuuguugacaaccacucacaggagaacagaauugacaucaaauaugauuagccccagggauauccacaacacuucccccuuucuguccaauaaaaggcuauuuuaucucagguauaauugaacauaacuauuacuauuuuguaauuuauaaaguauaagagaccuaauacccacauaacuauuacuauuuuguaauuuauaaaguacaagagaccuaauacccaguccaauauuuuuguuaauuaaacagaaccucugucaucuauccuuacuuaaagggcuuauaauucuacaucuggcuaugccuuggcuuuagauuggaugccaucugaaaaccacccucucaaacuguuccucucaaaguaaaaggccuggguuggcuaggagacuauguaguuguucaaccccaucagaaauccaagaacaacugauauuaacugaaaauauauaggaagccuaacacagcuucccaaacuuagccauuuuagagagacugcugaucacuuggacagucccuuacuucaacacguuggagcauuggucuuuagccuacuggccagggucaucugacagacuuagagaaacaggaauaguaaggacuagccuauucugucucggcagaaucaagcuguccuaaccuguaauuguguccucuuuggacaguuuuaugucuguagaugaaaugaggcaauucuugccuaguggcuaucuugccacaacuggaguaacucaaagaugcucaguuucuucuuugaauccgagacagggaaagcugucaggagcagacuggucucaacaacaagugaauaaauaacauuaaacgguacauucuguggacuucuaacguuuuugaaaaccaacuuaucuaugugaaguaaucuagacuguucugcuaacuacucucagcccuuucugauuaaagugacugaaaacacccuaacaguaaacucagagccaugaauguucuauuuggcccuuaacucacaggcuuaaacaucucagaucuguuuauaauaacagcaauagaagaacugggucuaagccuuguacuucaaaauuuuuaguaucaaagacaaccucuacuaaccacucccagucccaaagccuggggaaccgggaugacgacgcuucauaacuucuucaagcugaauaugggcguugggauauuuuugaagaggggaaaagguagggagaaugggaaaauucguuggccuuaagaaggccacaccaaugauugucucugaugucuguguccugacuggauccggacgaaaaccaaggcaucaggaguucaggcaggucagcucagcaugucugaugaugacauucaccaagguuguaacaucuaaaucucaaaacaaaacuuuaauaucaucaagacagucuuuuuguuuauucucuggaaucuaguucuucagggggucuccuucuaucaaaucugauccauagaacuuggaaggguaaauaccuuaaucaccuuuuccuuaaauuggcaucuccuucaacugggaaccaggaaaaccucuagcuugcccucugucccagaggaacaauaaaacaaccacuacucaaaaucacacacauuuuagccuauuuaggccuuucuaauuuucauaucaggauauuaacccaaaauucccguggaguccacguuagagaauacgaaucuccggcagacuuuaucauacugucuugaaaacaauugauucacacuucuaucuauaccugcuuauaagaggcagcuugucaaaccaggauuuaaacccaaaauucccguggagcccauguuagacagaguaugagucuccuguaagauuuauuagagcaauauaucuuuauaccaucuuuaaagcaauuaauucaaacuuccacuaauaucugccuauaggaagcagagaguuuuucauuguuaagcucucuaccuagagacuucugacguuuuugaaaaccaauuauccuauuuuguugauuagucucccuuuuuucucugucgccaaggucuucaggaggucucccucugucaugucugauuuuuauuaauuuggaaggaacccacagcuuuuccuuuccuguggaaagauaggcauaaccucucccccaguguaacacauuucccauuuuccacucugauguuaggauauccuuaauauaaacaggcugguuaguucaauaguucuuuccacaauccagugucuuucagcagcugugguguuuuguucauucgcauuuaaaaaauuuuaagguuaauaaagcacuauguaaucuaucuuuggggguuccuuguugcccccuuuugcccauuaagcuucucccagaguucgauuagaucacuccagaaucgcuuguccuguaggauugugggauaugccuguaacauguuuuauacuauaauauuaaaaaaaaaccuucaucuuauuagagauauacgcaggaccauuauccguuauaauuuguauagguauucccagaauguccauaacuucuaacaauuguguaacuacagaaucagccuuuucugaugccaaggcaguugcccauugaaaugcugaaugugucuguaguauggugcacauauuucaguuuagcaagcucuguaaagacaucauaugccaaaugccauuuuuggggguacuuaggguuaguuccgguuauacaacgagcaaguaggacauugccucaccuuuuccuuggcuuguugccaagugauggagaacccuuucuuuagaccuuugcuguuaacaugguguuuuuuauggacuucugaagccucuacuacucuugcuugcuugcuugcuugcuugcuuucuugcuugcuugcuugcugcuuccucgguggucggaugacuuccuugcauucauucaguauuugcauuuucaaaggcuaaaggcucaguuauugccuuucuugcagcugaaucugauauacuccuuuccacagcugauguuaaccuuuguaaaaaggcagggaagguuucuuguggaccuuguaugacuuaaguaaaugguuuucaagucuuuuuccugauucugcuacuuugucccccggccuaucugaagagcagguguaguguguuuggauuaacaaaacaaaaagccaugguguguguguguggggggggggggggguacuguccuucccugccuuucuuuuuuucuggagacaaaccuucagccuucuguguccucaggcuaauucacgagcgacugccaccucauggccugugcuuccucuguagguuguccacaggagaaacucugagauugaugagcugaaaagccucaucgagaacuuacaggaaaaccagaggcaauuacagaaggauaaagcagaggaaaucgagcagcuccacgaagucauugagaagcugcagagcgagcugagccucaugggacccaaggugcacgaagucagcgauccucaggcuggcagccuccacagugagcuggccugccuccggggggaaggccuggguggacaggcacuacggagugagcugcaggcugcgcaggcagccaaggagguguuuggccagcuccuggcagaccaggcccacgggcacagccaggcucuggaggcccugcagcagcgucuccaggacgcagaggagguugcugcaagacaccuggcugagcuagaacacuguguggcccucagagaggcugagguggaagccauggccucucagauccaggaguuugcagcuacccugaaggcaaaggaagcaaucaucgagcagagagauuuagagauugaugccgugaacaaguggaaaguaagccauucccuggagcuggaggccauccuuuuggcuuuggcucacuuccgucaugcucuggaacagcagaccugugccaccccggacgagcccccugagcuccggcagcugcgagugcagugugcucgccucagccaccagcuacaagugcuguaucggccuuuccucaagugccggaugcaguuggaccagcaccagccucauguggcaucuauuggcugugcaaacccuugugcagaugaugaacuggagcaggagggagucagcaacaggcuggccuuggcuccccacagccuggccgcacagguaggcuccguccucaggggcuacaguagguagccuucugcaucgagacuucugcuugucuuuuaccuuuagugacuucuguucauucugcacacuggucuucucuugucacuuuuggcuucuggccgggcagagaagagagcgagccugggguuuggcucaccugugcucaguagcucccccuagugucuccuccuggcuuuauuguggagccgaaggcccuacccaagcuggcuuugaaaauguuccaguuaagagcuugcagguuuagcugccugacuguucccaccugcuccucuugccagcggcuccacccugcgcuucccuaccacauguauccuuccaccagagcccgaagucuuugaccugcugugccuggcgguggguguugagcagagccagaagagcuucccucauugucucugcuuguuuuuggugcagcucuauugcucagguggucugaggagcagccaagucacaucugagucccugacuaacccaguugagaacauugacucccaacccacggguugcaagaccccuuuggggggggguggcuaaugauccuuucacagggguuguauaccaauaucagauauuaggauucauagcuagcagaauuaguuaugaaguagcaaugaaaauaauuuuaugguugggggcucaccacagcaugaggagcuuguacugaaggucacagcauuaggaaggcaaggagcacugcuguagaaguucucugguuuccccuggucaaggauaaccuacagucugccgaaguccugugacacuaaaggaugccaaccuccaccggccgacaguaugacaucagaacucgcagucugccagaggcggcuaggagcagaugcucuuagugagaaaggcagugcccuugagcacagaggaugacagcaggguucuugaagggaagcggccgcgugggcuugggguaaggugggcugggccugcucuacaguugagggccagguacaucaugacaggguugcuucuccgaggugagaggugagaagccuccuuagagacgccucagagucccuaaccccugguguauggacucuccuugugcgcucugcagucucuuacaagcuuuauucauguuugcugcagucugcuuacauaaccccuguucauuugaacaccaauuugcuccacuuuccaaauccaaaaaucuuugagauuuuuagccaugauugauuuccauugucccugccaaugugucucucuagcuuuggaacucuuuuauuuuuauuuauuuauuuuuauuuauuuguugguuuugguuuuugguuuuucgaggcaggguuucucuguguguagcccuggcuguccuggaacucacucuauagagcaggcuggccuugaacucagaaaucccccugccucugccuccccagugcuaggauuaaaggcgugggccaccacugccagacuggaacucuuuuauuuuuugagccuuguuuuuucuucucucuuuccuuccuuccuucucucccucucucucucccuccuuuuuucuuucuuucuuucuuucuuucuuucuuucuuucucucuuucuuauaucuuuuaaucuaagaaagggucaauuuuuacucugggagagaagggucccuugggaaucuuggcuuguuuagggucaggauuuaaugaggaagcauguggcagggcuugccaggccccuuguauccagcagcccuugcugcaaaucugcuccccgcccuggguguguguuacgugugucagucauaaguuccucugugagaacagaguccugcuggugagugaggccccauggccugcucacugaugcuuacaaagcaagcccaugacuccuuagccacucagaagauucaaaagacuccuaaagcugguuggucucagugcacgcauggcauuuggaaccauuacggcugugauggcgcccgugcccuuaguguugcugggagguggaggccccaaacucaggcuccaccccugccugugucugagagcaggaaagggucagaguuacacuaaccuugacuggaccuaggccaagagcaggaccuggaccugugccgugaucugagggaugcuugucuccaucuccagcccaucggacaccucagggaguaugcucugggaagucucucacgagcggccuacagcccacucccccgugaucuuaugguggcuccgucugugugacuguaagaagacucugccuguggcgccacagacagugccaggugccugccaacaaggaagcucugcauucccauagcaguuacagcugucugucucucagugugugcauauagaacuuucuaguuucuuuuucccucaaaacaaaacaaagcaaaacccccaaaucuugaguaaguccucacaacccuuaaugaugaucuuugucuuuuagguaaaaaaaacaaaaacaaaaacaaaaacaaaaaacaaaacaacaacaaacccagaaaccaugaaaaacaaaacaaaaaaacccaacuuucaagcuuuaguucuguuuucuaugccauuaaauaaaguugacauuuuaugucucuugaagguuuguuauaggggcucuuuuucugaaaauaguucagcaacacuagggaaauaucagcuuguacuucaccuguucauuuccauguucucucacacaggcuaaggaagaacuggaagacuguccccugggcaaggccaaucucauggcccaggugagacaacuucaggaggaacuggaccaccgcgugcauuccguggccuccagggacaccaacucggaaacuuguaaauuacagcagccaaaccugucggaaaaugggccacguaaucauuguuguaacggugaagaaaguaagccaucgccucccgaugauguacuuaauauugccaaaaccacaugggauguaauugauauuauuaaaaaucaggauuuguugguccaaguugaaaugccagauuuccccacucaagaaaaguuaacaucccaagguggaccuuucucuucccaagccagugggcacagcggcucccuccucccagaggaggcggcugagccccagcaggaccccgugagggcacuggaccugucguccuggagcuccccugaaguuguccggaaggacccauccuuggagccucagcacagccugccccugacc

SEQ ID NO: 5579 - RNA, 1501 nt, Mus musculus
cgagacagagggcgcuggauucaagauggcggcgccuaggaagugaauuccgcagaagcggcgggaaggacaagcgcccggcaguucccacugcuccaccgccaccgcuugugucaagcggcggucugagcaccggaaccgcuuuaggauuucuuccccaccgcaaagcugagagaaggaugcuaccgucuaaccuuggcucucccagccuccaccuuccugcgccgcugcuccugcucgucuuccaucuccaccugggcucccggcgagucgcucggaggugacagggcggcggcgacaccgccuucgcucuauuuacacucccucccuucacccacucgccuccccaccccccauacacacaacugucagcuucgccccgccaauccggagccccguguggccuugcgcacgcgcgcuccgcugacgcuccaagggcggagagccaucucucugguccccaauugguacgccgacgcucuccacccucuucauccacgccaaugagcgaggcgcggcguucccggggcucgcgggcguucgucgacugggcggcgggaagguuuggacaaaccguuuucccgaggcggugcuaccuaucgcccucucccgacaggaggaggacuuacauaccagcggcucuccaugccuccggugcgcucugggcacucucucccgcacuuugccaaagucguuuuuucugucgcgauguguuucugcgaacacuggggcauccucuaggauccaccagcccccacuuuugguucucaggugcagucaacugggaguccugcuucccuucuuugaccacuucggccccuccugaacacgguccccugucuucaauccaaauccaaagaacagaguauagccagaguuacucauugaaugacaccuaaaacuuagaccgcuguccccaguggaccccagaguugccacccagggccguuuugcauucacgcacacgcuucaauguacagagucgcuguguguucaggcaccugacucucacuccauccaucaccucuaccaggaaagucuuucugccauaaggaaauaaagaaacuaugguccauuuguaguaagaggcgcguuuaaagcucaucgguggauuacaggaaauuaggaggauugggcccuuggauucccuagccggcagcagguucuuucuugccuaacauuuauuaauuuaucauuggguugaaacguugcaggcuguuaacaugacuaacauaaaaggagaggaucugagcuccaggauauaugucaagagcuuugcauccugcacggauaggauagggaagcuggagagaggguaaugccuauaagaaugaauccuccugaagaacucaguaguguggaauuugggaacagggaaaugccguaagggcuauaaaaccuauuuuauaccaaaucugcaugacagccguuuuugccuucucucuaggcugacacccaacuuuacaagauccaaaaaauaaauuguuucacuuucaugacu

SEQ ID NO: 5580 - RNA, 46985 nt, Mus musculus
ugguccuacaaauuugauguccguagcgcacacccaagagcccgcuccaguggccgguuuguugcggugcggugggcccgguagaggcugcacgcagacugugggcgagcacaagcgcuggcgacaguggccguaucuggcggacuugcuccucccuccgcggccuccgcugucccuugugucuuugccgaguugcugaaggccuucacuagucuucgcucgaaggcgucuguuaaccuagcggccggcuuccggaguguuaagcaucggggauaaaaagcuauuauuucuagaccagggcaucgcaaguucgaguuaccgggagaaaaaugagaugguaggaacccaaagcaguaacauuuuaaauuacgguuuuuguguuuuuauuuauuuauuuauuuauuuugccuuggagaucgcaagaaucugauaagugauguguucccgucuuauuacugagguuuuguuuguuuguuuguuugcuuguuuuuuccccgagaagguaucaauugaauaaaaugcuuugcauuuuuauuuuaaucauaacggaucaggcuucaccuaagccugcuggagcacaccuguggucccagcagaagggagaccgaggcagaagaaaggaacuuaagguugugcuugauuguaguaagcuugaggcaagccugggcuaagcgagaccuugucuuuuuuuuuuuuuuuuuuuuuugguuuuucgagacaggguuucucuguauagcccuggcuggccuggaacucacuuuguagaccaggcuggccuugaacucagaaaucugccugccucugccucccgagugcugggauuaaaggcaugcgccaccaagcccguuuuacgagaccuugucuuuaaugaaaagaaaaagaaaaaaaaaucuuuaaaccucccuuacaccauaauccauuucuaauacccuguguccaaaaccuguugaucugugaguggucggcggcccguugugcccuugccuuuuaaauaauugucuuagaauuucugugauuuaagaguuggagcaaaauaugcugugauguccuaaccuuuuuuuuuuuuuccaggucauccugaggaugaaggagagcuuccccuggcaacagauaauuuaaagaggagagcuacuuguguauaguccauauuuauugccuucagauaauuggcuugaagaugcacccggugaaccccuucggagggcagcagcccagugcuuuugcgguaucuuccagcaccacgggaacauaucagacuaaaucaccauuucgauuuggccagccuucccuuuuuggacagaacagcacacccagcaagagccuggcguuuucacaaguaccaagcuuugcaacacccucuggaggaagccauucuuccuccuugccagcauuuggacucacccaaaccucaagugugggacucuucucuagucucgaauccacaccuucuuucgcagcuacuucgaguuccucugugcccggcaauacggcauucagcuuuaagucaaccucuaguguugggguuuucccaaguggcgcuacuuuugggccagaaaccggagaaguagcagguucuggcuuucggaagacggaauucaaguuuaaaccucuggaaaaugcagucuucaaaccgauaccggggccugagucagagccagaaaaaacccagagccagauuucuucuggauuuuuuacauuuucccaucccguugguagcgggucuggaggccugaccccuuuuucuuucccacaggugacaaauaguucggugacuagcucaaguuuuaucuuuucgaaaccaguuacuaguaauacuccugccuuugccucuccuuugucuaaccaaaauguagaagaagagaagaggguuucuacgucagcguuuggaagcucaaacaguagcuucaguacuuuccccacagcgucaccaggaucuuugggggagcccuucccagcuaacaaaccaagccuccgccaaggaugugaggaagccaucucccagguggagccacuucccacccucaugaagggauuaaagaggaaagaggaccaggaucgcuccccgaggagacauugccacgaggcagcagaagacccugauccccuguccaggggcgaccaucccccagauaaacggccaguccgccucaacagaccccggggagguacuuuguuuggccggacaauacaggaggucuucaaaagcaauaaagaggcaggccgccugggcagcaaggaauccaaggagaguggcuuugcggaaccuggggaaagugaccacgcggccgucccaggagggagucaguccaccaugguaccuucccgccuuccagcugugacuaaagaggaagaagaaaguagagaugagaaagaaggugaguccuaaacaugugugugccacaaaagugugcugccgagcucuugugaggucccuuguggucacuugauuuuaagucccacgaucuuggcuuuuaucccgugguggcuccuuuugccuggaaguguugucccugacagacuuacuugucugcucucuaaauuccagauucucucaggggaaagucugugcgccagaguaagcgaagggaagaguggaucuacagccucgggggcgugucuucuuuagagcucacagccauccagugcaagaacauccccgacuaccucaacgacagagccauccuggagaaacacuucagcaaaaucgcuaaaguccagcgggucuucaccagacgcagcaagaagcucgccgugauucauuuuuucgaccacgugaguacucccgagaaccugcugccugucgcuuuuucugcauugcaaagaaucacacccagggcucugagcaggagaugcaagcuccgccccucugagccuguguucucaguccucaacuuggucacuugaaaaauacauuuuuuaaaaaauuauuuuuaauuuuuguguaucaguguuuugcuggcauguuugucucugcaucacuugcaugucugaugcccauagaggucggaagagggcaucagauccucuagaaccagaguaacagaugauuuuacaauggguggaaccaugugggugcuggaaauaaaacgcaggccuccgucuggaauugcagcaagugcuccugccugcugccugucuaucucuccagcuccaacgucgucacuugcaaacucuuuucccuuuucagccauaagucacuugcuugauagaugguagggaaagcacucacguagcuuuccuuuucucuuuaaauagcucauucuagguucagaauuagauuugugugacugugugggguauggaucaugauagagaaggaguuugagaggacgacgagauuuuaaagggaagguugauaaagaggauaauggacaugugacguggaaacagaagggagacuuggggguguagggguauagguaaauagccagcagaggcccggggcaugauguaagggaagggaaccaauuagaguaagguauaaugauacaugcguaugaaaugccauaugaaacccauuccuaggcaugcuugcuaaaauuacuauuuuuaaaaauuuauuuuauguauaugaguacacuguugcugucugcagacacaccagaagaggcugucagauccuauuacagaugauugugagucacuaugugguugcugggauuugaacucaggaccucuggaagagcagucagugcucuuaaccacugagccaucucuccagcccccugaaauuuuuuuuuuuuuuuuucgagacaggguuucucuguauagcccuggcuguccuggaacucacuuuguagaccaggcuggccucaaacucagaaauccgccugccucugccucccgagugcugggauuaaaggcaugcgccaccaugcccagcucugaaaugauuuuuuaagaaucucuucuucacuugaggucgggaugacauaguuuguuuuccuaaccugggcgugugcaggucugaguucucuggagaguauggugcugcaggggaggaccgagcugugccuguggagucugguuccucugaaaggucugagagucacuguagacacauaguacuuuguuucccucuugagacaggguuucucuguguagcccuggcugaccuggaacucacucuguagaccaggcuggccccaaacucagagaucuguuuaccucugccucuuccucugccuccccaguucugggauuaaaggugugcaccaccaccaccuggcuugcauaauacuuuuucaaacuugaauuuucugcuuuugcuuuuguauuacuuggcuaaguucaugguuagucuaaacauucaaacaauacagagaagaaaaagucaugauccuauucccuagaaaaaacuguuggguuuguagcauuggcuauaugauuucaccuuguguaaauuuauaucuuuguuauuuuucuaaguauucauacagaaagaggaaacuaauaagaacuuaaaaaggagaaugcauguucucauaacuuucauuuuuguggugugugugugugugugugugugugugguauaggggcagaggcauaugucugggggucagaggacaccuugguggagguguguaugaugugugugugugugugugugugugugugugugguguaggggcagaggcauaugucugggagucagaggacaccuugguggagugagcucucucauucuaccuuuuuucgggguccggguauuaaccuugggucagaugcuucacucacugacagggcucgcuguuguuugcccauacguguugugucuggaagggucuguauguugcccgugcucuguccugcuucugccucccaggcccugggagagcaggcaugggccaccauuccuagcuuacagcuucuagucugauuucccgggauagggucuugcuguguugcccagacucacuuggaagugcagggcccuuaccucagccuuuggaggaguucaggauaagaggcaugcugcauccuauccaacuaauuguugcuguuuucugcagugaauaggaagccugugguuacuaaauacuacaaaguguuuuugucugucuuguuuauuugcuuacucagcuuucucugccuuuuggggggugggguggggacugcguuuggcucuugagucuucaggcuagggauugaacugugggccuugagcaugcuaggcacacgcugucccgccaagcugcaucccagugcucaccacccacccaaccccguagguaugcuaggaugugguguugcuguguagcuaauggucuauggcuugguguguugcccagcuuagucuugaaacugugagcaaugucagcuucccaagugcuuggguuguuuguacauaugccacuguaccuugcuucuuuauguauuuaucggauagcuuuuguccuuaguacagaucucagagaacaacguuuuugugccagaauguauucaguuugagggauuuuauuguuuauuucuucauaauaauuaaaaaugaauggcuuuauauucauaauuauguacauuacagucacuuccuuuggacacaaauucucuagccuaagcuggucuagaacuugaaaacauuuugcauaaauuauuauuuauucaaaauuauuaaaauaauaaugauuauuccuucuguauaaguauuuugccuauguguaugucuguguacuccgugcaugcuuggugccuguggaggagagaagaggauguugaauccuagagcuggguuacgggcagcugugagcugccauguggaugcugggaucugaggcuggguccucuggaagagccaccagugucauaacugccaagucaucucuccaggcccuggccuagaaccuuuggccuuuuccuuccccuuccugaguggccugauuaaaggugugcacagccaugccuggugaucauaacacuucuauuuccagaauguucucaucagaccaagcagauauucuguaaucaguaaggcgcgucuccacucucugaccagccuuugguuaccucucuuuuucuaucauuaugaauuugccuagucuagguauuucauggauguggaaccauacaaguugucuuuauauguagcucauuucacuuggcauguucuuucuauauuguuauauggaugagaacuugauucuuuucgaugggugaguacuguucuguuggguugucuacacuuuguuacuauuguuacaacacuacucuuguguuguugcaaugggcuauugugaaugcuugguguauugguaucuguuugcagcgcugacugcuguaauuuuguguguguguguguguguguguguguguguguguguguguauucuuggccauagaguugccauauuuuaugauccacauuuuaaaaaaauguuauauauggggcuagagaaauggcucaguaguuaagagcacuugcuacucuuauagagggcugagguucaguucccagaacccagauggugacucguaaccagcuguaacuccaguucuaguggauccggguauuacaugugaacugugcaccuacaaacccacaggcaaaauacucacgugcaaaaugaaaaauaagcaaaaucuaaaauguuaauguguaugcaucuguguguauauuuuaaugcuuguuguuuugggagacaguuucauguaguccaggcugacuucaaaauugcuauguugcugacggugaccuuaacacacacacacacacacacacacacacacacacacacacacucacucucucucucucucucucuuccucuucuucuccuccuccuccuccuccuccacuccuuccuucuccuccuuuuucucuuccucuucuuccuccuucuccuccuccucuccuccuccuucucuuccuccuccugucccucuccuacuacuccccccacucccacccccacccccguuuucuucacagggucucucucucucucucucucucuauauauauauauauauauauauauauauauauauauauauauauauauaguccuggcugucuuagaacuuucuuuguagaccaugcuggccucacacucccagagacccacuugccucugccucuugaguggugggaugaaaggcauugggcuuccacgcuguuguggauuuguuacaccacaccuagccuuuuuuuuuuucuuuuuuuaaguuuugugugugugugugugugugugugugaguauccuugaaggggaaggggguuggaucucuuggagcuggaauuacaggugguugugaggcaucugucugguagaggagcagagcagcaaguucucuuuaacgcuaagccaucucauuagguccuaagguuuacauaaucauuuucauucuguguguuugcacaugugcgugugugcauguauaggugugugcauguaggggcaggggcaucgguguaccucgguaaucaucuggaggucagagaacaacuuuuggagguccauuccuuccacucugugaguacaggagauugaaccgucuugugucacggugccagguuccagcucagccaucuugcuggcccuccuuuuauuuuugaguagccuguucugucuuucagcauuuuaacauagugucuggucucucuguguccuuacacuuuguguugugaacuguuuuucaggcaucggcagcccuggcuaggaagaaggggaaaggucugcauaaggacgugguuaucuuuuggcacaagaagaaaauaagugaguuuuccacucuuguguccccagucugaugcucucucucucucucucucugugcagggccuuugacgugcagguguggguucuuucccuaagggcagcagcagugcggcuagcuccagcugcaucccggaucucauagcuguuucuucgaguuuugcaaaccuuguucugacacuugugucuucaggucccagcaagaaacucuuuccccugaaggagaagcuuggugagagugaagccagccagggcaucgaggacucccccuuucagcacucgccucucagcaagcccaucgugaggccugcagccggcagccuccucagcaaaagguaggacucaucucccuaguaacuguugauggaggagaagcaggggagagcuucgaugguugcuauggggcagguguaugaagagcugcuuuugaaucuccucccucacagugcgugggucuucgcaguugccaguguuagcagugacauggcuuuauucugaaguuccccagguccuaggucuuugaaaaagcccucuuuggagugggacuaacuucaagcagauuuuuuucuuuuagggaaagccuuaucacaaagcugcaauuuuugcucuaguccuucauuuauguuuuaaaaaauguaguuggugguggugcuguacacucucaucccagcagaggcaagaacucuaccaacagacuaacauuucucaucccccaucucagugucuauaagauuugaaggauuucagaauuacugauugcucacugcucagccuagccucagaucacucgcucaagcaauccugugccagccuuguuagggcaacaucucauuuauuuaggcuuugugcuuuuuauuguuuuguuuuauugggggaggggaguugagacaggguauuaggacucugacuguccuaaaacucauuauguagaccaggcuggcacugaacucacagagauccaccugccucugucuuucuugugcugggaucaauaaagucacguguaacaacgccuggcuggcuucuuuaguuuuaacgcuguauuuucuuaacuuugaggaccagaaugucuugaaacauuaagaagugggaaugauacgaaggccccaaaugugcugucuucuccauagcucuccagugaagaagccgagucuucugaagaugcaccaguuugaggcggauccuuuugacucuggaucugagggcuccgagggccuugguucuugcgugucaucucuuagcacccugauagggacuguggcagacacaucugaggagaaguaccgccuucuggaccagagagaccgcaucaugcggcaagguacgacgcacagagacacacauuccagauucccuggcaggauuguaccaggcaguuucuagggagccacagaggcucuccuaccgcgaagucuugggauuucugauaaucuguuccugguauuacugcgcccuggucugcuagagaugugagcuguguguacuaaugugaugacuacauaugcuuauauguguaugggaggaugcaggggaauuaacugauuauugguagagaggaacaggggucugaaaugcagaacggagaggggaugcuccauuucaggauuguuccccuucggaauguuaaacugugaaugcauugcucucaaagaauguuaaaauaauguuacagauacacagaacccauauggaaauucauggacucauuuacaauuuuuaaaaauauuuauuuauuuauugguuuuuuuucaagacaggguucucuguauagcucuggcuguccuggaacucgcucuguagaccaggcugaccuggaacucagaaauccaccugccucugccucccuaguguuaggauuaaagguguguaccacuaccgccugucuacaauuuuuuuuuuaaagauuuauuauuauauguaaguacacuguggcugucuucuuagacauaccagaagagggugucagaucucauuauggaugguugugagccaacaugugguugcugggguuugaacucaugaccuucagaagagcagucagugcucuuaaccacugagccaucucuccaguccucauuuacaauuuuuaaacauuuauuuuuauuucccuugcauugguguuuugccugcaugucugugcgagggugucagauccucuggaucuggaguuacacacaguugugagccaccaucuaugugcugggaauugaaccugggucuuuggaagagcagcuuguacucuaaccucuaagccaccucuccagccccuacacguuucucuuaaguuucagcuguguggaaugucuuuacagcuauuaagcucauacucgcuuugaacuuacagugcuccucucucagccuccugggauuguacauaccuaucacaccugacaggauuugcuauuuaaagcugugaauuaguguaccaaucacagagcuuucuuagcauggugaugaaaacugucucuaugauuuauaggcuuggugauuuguacauuucuaauaaauuuguugucuuaggauuucucuugcugccaugaaacacuaugaccaaaaagcaaauuggggaggaaagaguuuauucagcuuacacuuccagaccauaguccaucauggaagaagucaggguaggaacucacacagggcaggauccuggaggcaggagcugacgcagaggccauggacaaauggcgcuuauuggauugcuuccaauggcuugcucauucugcuuauggaacccaggaccagcagcccagagcugguacccccacugugggcugggcucuuccuuaucagucacugauugagaugcacuaacuauagggccuacagauggaucuuacggaggcauuuuauugauugaguuuccuucucagaugacuuuuguuuguggcaaguuggcauaagaaucuccaguauacuuauuacaaggaaaaccugacucagucucacauaccuaccaccccagcaccuggcccgguuguagccuagugcucuaguggaagcaggacagucugcuguccacagugagcuccaagauagccugagcuauguugugguacccuuucagaaaagcaaaagcaaaaccaaaaaauuuaaagacgcuuauacuaaguuucuaaaaguggaacuaaaauguguauaugcuguuuugagaaguuuugcuuaaaaccuuucauucugugaguaaaaaguggucugcuuacugagggaacagguguucccaguaacaguguacuuagguaacuucauuaugcaguucugaacacuuaacagaaucccagacugggauauuuuuaccccucccuaccucaggguuucucuguguacuguagaacuggcuauuguagaacucgcucuguagaccaggcuggccuugaacucacagagauaugccugccucugccucccggaagugcugagauuaaagaaggugugcgcgcgccacugucguccagccugcagauguacuuuuugguuacacuccugcauuaguauugugauuuuuccaccgagguccugagaaccacagagugcuggcagagcacacuugucuaagugaaagugauguaacgcuucgucugcuuuuaacauuuuaaacuuucuuuuuauuuuauguguaugaguaucuucucuacauuuaugucuguguaccacuuguaugcccgaugccaacgacggccagauccccuuggacuggagucauagacaguugugagcugccauguggguacugggaauuaugccuagguucucuagaagagcagcuaauauucuuaaucucugagcucucucuccaguucugucuuccuucuugagucuguagugaauguguuugauuauuagagagggguguagccuuggcuaggggcuuuuguuagccaagauacccauugccuggcagggugggcuacgaggccuaucucagaggcccaaaauuuaagaaacauuucuuuuuaugugugacuguucaggggcagugcacagaugagacaggaucuuauauauucuagacuaaccggaacucauuauguggcccaggcuggccacacauuuaggaucccuuugccucagccuccugagugcugggaucacaggcugauuuuuuucccauuuuaugaaaguauacuucgugaguucuuuuuuuuuuuuuuuuuuuuuuuuuuuuuuuuaagauuuauuuauuauauguaaguacacuguagcugucuucagacacuccagaagagggcgucagaucucguuacggaugguugugagccaccaugugguugcugggauuugaacuccggaccuucggaagagcagucgggugcucuuacccacugagccaucucaccagcccccacuucgugaguucuuaguacuccuguggugcacgcacccuuacguuuggcuugguaucauucagcucgagugaagaggacggaccuggacaaagccagggcauuuguugggacgugcccugacaugugucccgagaaggagcgguacuugagggagacccggagccagcugagcguguuugaaguugucccagggacugaccagguagaacucuguguguccuaaugaucucugcuuuuuuuccuguuguuuugauuuugacuuuuaaaaauguauuuauuuacucuacaagugcaaauguguguguguguguagugcaugugugccacaaagacuaguguacaagagcagcuucucuccuuccacuguucugaagacugaauucaggccuugugucgugugcccucacccacacugagcgauccagcugggcuccuauuguuuuguuucuggcuuuggauuuuggagucaggguuccucuacauauuccuggcuggccuagagcucacugugugauccggcuggacucaaacucagagaucugucaccucugcuuuugaccgcugggauugaagguaugugcaccgacaccaccacucagcaccauuuuugcuuuuaaguuguuuucucuucccaagauacuaacuguuaaaugaaugugucgaagggcauggcuuccccucacuugaguuagagugcguguucugaguuguuugccaagaauuugcaccagucugcauucuugugcccuucagauuugcucuacccaggguccccagcccagcaacaugccucaccauagacccaggacugauccacagagcagccagcagauaagcaggggccucaucucugcaccuacccacguuuguuaucuucugugucugcgaauuccugggaaguugcaccugcuccaucaggccugacccacagggcucugcccuaacccuuucuggucuaaacuccccaccucugguuuauuuaugguguguugguuuaacuugacacuugaacacagaugagaucuuuccuguugccugagccccuuuaccugucacagcugugcuuugggcgggcugaugugucuucacuuagauuucuguuccucuggaugccuuguuauauuugcccaacucaaguuucuuagcuuacauuguccuugaaaugucucacguuuaacagaacguuuucaucuaagaguuacauucucaagcauuguucucauagggaugcaugucuuaggguuuuacugucuugaagagacucuaugaccaaggcaagucuuauaagggacaacauuuaauuggggcuggcuuacagguucagaggugcagucuauuaucaucaaggugggaagcauggcaguguccaggcaggcauggugcuggaggagcugagaguucuucaucuugagacuucuaucuugauuagagggcaguaaggagaagacucccucuguaggcagcaaggaggaggcucucucccauacuggguggacccugagcauaggaggccucagagcccaccuaagcagcgacacacuccucuaucaagggcaugccuccuccaauaaugccacacccuauggccaggccuucaaaccuccacaaugugugugugauuuccuccugcgucuuaagguccaaaaacugccauaaagcaguuugucccuacuucuugcccccagguggaccaugcagcagccgugaaggaguacagccgguccucugcagaucaggaggagccccugccacaugagcugagacccucagcaguucucagcaggaccauggacuaccuggugacccagaucauggaccaaaaggaaggcagccuucgggauugguaugacuucguguggaaccgcacccgggguauacggaagguaacugcuccccacucagaugauggaaaugcguguagauuuacaaagugaacuucaaacuuuuuguuuuauguggauauuuuuaucuggaacaaaaauauaauuuuauuugagccauuauaaaacuguauuucauuguuucguuguguuuguuucaaguugaaauguaguucaacucauaaucauaauuuuuuuucucaaaguugacucugcauguaucuuguguuuguguuuucugugugugugcucagugcuuguguguguauguaauucuccccucuaaccuugaacaggacauaacacagcagcaccucugugauccccugacggugucucugaucgagaaguguacccgauuucacauucacugugcccacuuuaugugugaggagccuaugucuuccuuugaugccaagaucaacaaugagaacaugaccaagugucuacagagucugaaggagauguaccaggaccugaggaacaaggguguuuuuugugccagugaagcagaguuucagggcuacaauguccugcuuaaucucaacaaaggagacauuuugagguagguuuucagagucagaaguugggcuuugauguauagaaguuucguagugcaguuggcaaauugagucagguguaaacauugggagcaaguacugagacccgugugcucuguauaaucccuccauguucauuccugaguggaagccucccagggaugcaggaggaaacuaggcacguaagcugagaagucccuuagaguuguuggcaguucagcuuucagacugcuuuguuagaaauacuagaaggauggguuaaaugaaaucagaguagaucaguuacuggagugaauggauuugaaaugcagaccugacauuucaguagaucuauaggugagaaauacagggaaacuaacauggaaagcgauucaggaagaugccaaacauccuuuggccaccuguguacauaugugggugcacauaaauacacacaguuauguuuucuguucugcuguuuugcuaacagcugccaaucagucggcuaaauuauuccuuacuuguuuaucauccuuuuaauuugucauuuuauuuauuuauuuauuuuguuucuuugagacagggcuucucuguguagccuuagcuguccuugaacuuauucuguagcucagacuggguuuaaaggcacaugccaccaugcccagcuguuuauuaucuuuuuaagauuuucauuuaguauuguuuuuaauuguguauaguaugugucugugugugcacauguggaaaugaaugcaggguccugucagggcuggaagagggugucugguauccuggagcugaaguugcaggcagcugugagccaccugacaugggugcuagcagucuaacuuggcuccuuugcaggagaagcaagugcuuuuaaccuuugagccauccuuccagccccacagcuuauuaucucuuuaaagaaacacuuuuaaaaccacacauguaaaccuauuagaaguucaaagccauccuugugacuacagagugaacuugaauuucaccuaggauacagaagauucugucucaagugaauggauggauggauggauggcuggguggguggguggguggauggguggauagaugauagauggacaaauggacggacagaugaacagacggaugaagacuguagaguaccugcugagugugaggauggcagcucugguuauagagcuuagacuuuagugguuugugucagacuugcugucacaggacugcugaaacccaguuauuaucagauugauuaagaccaguguccugacccucugccuuccuaacuuacagagaagugcagcaguuccacccugacguuaggaacuccccagaggugaacuucgcuguccaggcuuuugcugcauugaacagcaauaauuuugugagauuuuucaaacugguucagucagcuucuuaccugaaugcgugccuguuacacuguuacuuuaaucaggugaguagagccccugcuaccagguaagaacaggaacaacaauacuguaguguugaagugcuucucuguccugcgcucuucccgugggcagccagccagcugucaacucaugcgacaggcacagcccagcgagguguuucugcuuuaaucuuguaugaugggauaccauggcucuccauuaggaggggccaugcaguguaaacaugguucugugucucacagaagccuuuggagugacagguuuaguucaugaaagcaaaccccaaaccacaaauccuauauuguacaaaagccuuaacuuugaagucauuaguauuaauaacauuuuugagagaacaguagcauagaaagacuuuggaaaaaaacaguuuuggggggugagcuguguuuccacucugcccugcugugccuugggaugacagaggccuucagaagaccgcuggcuccucuguggugagaagugugagcagcagccgcagcagcagcagcacucugccuucccaugcugccucgggucugcaggugucugcuagcaggaagaacugggaguuauuacagccucugaucacaccaaguccuggaaaugcugaauauuagcacaguuauagucuaggcaaagaauucauuuuuaggaguuguauuuuuuuuuuaacuuuuuaguuuuugagauuauaauacaguuacgucauuuaucuccucccuguccucccucuaaacucucccauguuccaguccuuacuccuuuccaaauucauggcuucuuucuucauaaauugguguauaugugucuauguguuuauguauuagugcaucugucugucuguccacacacacacacacacacacacacacacacacacacacacagacaccuuaauauaaggauaccaugcucagucuggauaaugucuguagauuuucggggcugaccacuuggugagcucuucccuggggaagacuguuucucccacacucagcauccuuuagcugccuguuguucuguguguaggguuggggccuccugggcuuuccccuguccgcauuagcaugucuguugcuguccuuguugaacucaugcuuagacagucaugccggugagucuucaugaagguagcuucugacucugacacaaucuuauggcaaaccgccuggcccuccggcuucuacagccuuuccucccgucucccacacgaucccugagccuuaggugugggagcgggguuggaguugcacccuuuggcauuggguccaacaacucugcauuuugguugguugugguuuucuagaauuguuuccagcuugcaaagagacguuuccuugaugagggugaggacgacacaggacagauauuuaauaaaguggcaguuacaggaagauccauaacuucaccagccuggggagguggcuagguuuccuguaucaggaauugauugcccucuguccgagcaggccuuaagucuaguuggagagcuauugguuacuaccaggcuaugugugucaccaacacaccuggaaaggagguugccacuggggagcucugcaucuacuucucugugucauuacaguuuauguguacucuccuugcacacuugcagcgugacagcggagaaagucagggcagauucucuaacucuccagccacaggccugcccuucacagccccaacucucuaagcuccugcuuuccuuguggucacuucuguuuccugucucucaagucuuugcauaauccagagaaucuuaagucaagccaaagucacuugucuguccauugcccaaauguuuucaguccaaaugacaucugguguuguacauuguggugagauuuucccaaacuucugucuucuauacuguugccuucucaggcaaugaugugccugaugcugucugccacccugaagcagaugcuuagucaugaacuuccugguccagagcagugcugugucauauuagugguuguccucaagcagcuaaggagggagagaauaguauuacuuuuuaaaguaauaguaguaguaguaguaguaguaauaguaguaguaguauauuauuggcuacuguagguagcuucaaauaaguaaaauugggauuuuuuuuuagaauuuuauauaugcauauuuaaagacuuauuuauuuuauguauacaaguacacuguaguugucuucagacacaccagaagagugcaucagauccuauuacagaugguugugagccaccaugugguugcugggauuugaacucaggaccucuggaagaauagucagugcucuuaacugcugagccaucuuuccagcacaaaccaggauuuuuuuuuuuuuuuuuuuuuaaagaagaccuuuccacuggugguguucucccugguccugagucuuaggccccuucuccuugcucuuucggcccagcucuagcugccacagugccuuccuauuuccuuacuuaccagagcucgcccugaucucucucagggcucguauucccucagacugccuucuuuguuguauauaauuuuuuaaaagauuuauuuauuuauuuuauguauaugaguacaccauugcucucuucagacacaccagaagagggugucacaucccauuauagaugguugugagccaccaugugguugcugggauuugaacucaggaccuugggaagagcagacagagcucuuaacuacugagccaucucuccagucugucuauaauuucuauuaaguguucuuuacauauuuaccaucauugcucuagucucuucccuggcaugcuaguaguguggacacgggaacuuuguuggcuuugucugcauuguacucugagcauuaagaauacagccaggcauguaugcacucucucucucucuuucucuuuuuaagauuuauuuauuuauuauauauaaguacauuguagcuucuucagacacaccagaagagggcaccagaucucauuacagaugguugugagccaccaugugauugcugggauuugaacucaggaccuuuggaagagcagacagagcucuuacccacugagccaucucuuuagccccuucauaugcucucuugaguguuguuggcaauuaaugaccacugggaggaaacagcauaagugcucagaggcccugaaaccuaaccagacuuccguuaagauuuuccuguuuucuuugguugucuuguuuucguuacacugcuaugaauccauuuuguuuucauacuuaauuuaaugucuuacauuuuuuuccccuugcauuccauagauucccauaguuucauuaccucagcuacuucugguucaggggauguuggacacuugguuuucaugcccuuuccuugguagaugcaugcuaguuuuucuuacaaguaaaacuucgcauaccaucuuuuccuuuggggccguuuucacaguagucuuuccugagcaucugagugucuguaagagcgugcacaggagcuaagcuguagcaggggcucaugguuguguggcuggcuggcuguggcuuuucucugagcuugcauugacuugcuucuuucagauccgcaaggaugcccuccgggcacucaauguugcuuauacuguaagcacacagcgcucuaccgucuucccccuggauggugucguccgcaugcugcuguucagagauagugaagaggcgacaaacuuccucaauuaccauggccucacuguagcugauggguaagagcugaggcuguaucuauagccuuccgacuucucugcccccuccccucuuuuccuuuuuccuuuucugauaaagucugcuugcugggcucuucugugugcagcuuuccugcugugaaacuaggggcacucccaacagacaaggggccagaccaaguccauuuuuuguuuaagauagggucucccuguguaguccugccuggccugaaccuuguguguagaccaggcuggccucacucagacucauagagauccaccugucugugccuccuaagugguagaauuaaagauguacauacaagggauuugggaauaaaaaaaccagaccaacuucuuucuuauucccaagucauuguuuuugaucaguuagcugagaaccuaaagauaaagauuaagacuuuucuauuuucuucauuggagauugacuuuguucacccauguuuggccccugcacaccugauagaggagcuggguagaccaguaggccauggcaaggccuucuguuccuguagucagggugagacuggugauacucacaaacuguugucccaacaaauggcaccauuacauuuggcauccucuguuuccucagcccaccugcagcucuucccucucgaucuauccucagggaagugcuguggcuuugaaugagugggaugccaucauugaaaaaggagcccugggucacgauuuccugagacuggacgcuuuuucaucugauaccuguccagccuugcuuugaucgggggaucggguaguucugugugaggaggcuuagccgucuucuuucccugcugacuacuugcugugcucuuuguggucugcguagcuguguugagcugaaucggucggcauucuuggaaccggagggauuaugcaaggccaggaagucaguguuuauuggccggaagcugacggugucaguuggggaaguugugaauggagggccguugcccccuguuccucgccauacaccugugugcagcuucaacucccagaauaaguacguuggagagagccuggcuacggagcugcccaucagcacucagagagcugguggagacccagcaggugagucaaguacguuucccuucuuggaagccucccugucacucgaagauucugucuuggccagaugcuuaaauaucucuugcuuugccuggaucuggaguuuugaagccccuguuagagcuugugauagugcguuuccacacagggcaucugucauccugugccaugucccugaaugguugucaggagggcagucugccccucacgcuacagauagcuguguccuuuucuagagacuguaguugugugcucugcuagcaagugucuucagcaccuugugucucuuucuaggugguggcagaggagaggacugugaggcagagguggacgugccaacauuggcgguccucccacagccgccuccugcauccucagccacgccggcgcuucauguccagccacuggccccagccgcagcacccagccuucuccaggccuccacgcagccugaggugcugcuuccaaagccugcgccuguguacucugacucgguagggaucgugcguguuaaagccucaugacgucuguagcauucuguguaagggugcuguguugcuuggucucguuagauaggagcccgagucgggagggggagggggagaggcuggaucuacucagucagccucagguaccaacaggggcccaucuucaucauagucagagcuacacuugagugccuccuuccauaccaagcugaacccuacaugucuguucugcucaugugcagcacccagcaaauggcuguccagggccugugggucacgacacugcuuuguaccugucggcagagggaggcuuugguuuugagcagaucuuguuuguugcacaaguggggacuugauugugucucacuggccucucaggcagaugcuggacacugucccuacuggagggucagagggucuagagggaaaguucauaggucacaggaauugaggauuuaaugugcacacaaaaugauggcuaaaggugcuguuggggccaccuacagggcaguccucagcaggcuugcuugcccucaccucuguggaaggcaucuuucuguuguucagagucuuccugcagcccucuacacuaaggucccugugcuuugcugggaacaccuucacaaaugucacuaagaagucuucacgcaagaugucucuccuuaggaccugguacaggugguggacgagcucauccaggaggcucugcaaguggacugugaggaagucagcuccgcuggggcagccuacguagccgcagcucuggggugaguggugacuagcgugucagccuuucuugcuuggcugacaauugcuuucugggcacagucauguccuuccuaauaaagcuguucucucuuaccagcaagucccuguuccaugugcuuaagauccacggugacaauuucagggacuuugcaccucucugaggccuaaauguuucuucuggucucuagggaggugcgguuucuccuguuucugaccuuuaguucuuauuaguauguaauuuccauuugugauuccuuuuuuaaacgguucaagucuuaauuauuugauuguuuauuuuauguguugaaggguuuagcuugcagguauguguguccuccauguauacccaguaccugcagagggcagaggaaggcaucagcuccccuggagcugaaguuacagaugguugugagguguccuguggguacugagaaucgaacucagguccucaggaauacucagugcuccuaacugcugagccgucucuccaguacugcccuuuuguuuuagcuuuugaacuggacacuguagaccgugcuggccuccagcucccugagaucagccugcuucugcucccccucugcuggggcugaagcuauacuucaccaugccagccuguagccuugaacuccugacugccgccccuagccuccugagcaccaggauugcaggcgugcacugccagucuguccguccgucugggagugguggcucucugucucccguucuuugugacaggaguggcaucucauuaaagccugacuuguaugucccucauggcuggcggugcugcuucuuuucuguccuguuuguucuucuguuuuccuggaacuguaaguuaacuuguuggccucugcuugagcuauuuguggucgacuuguaggagcgucuuuauauucuggauguuaaucucuuaucagacacagaagugcauguauuuucucucauucucuggauggucuuuuuccccuguuucagcccccaccucucaaguacaccuggcaggcagcgcugaggugugagccuuugggccuguuagacaagcacucuacaaccgagccaccgcccuggcucugaccccgcuucucuucucgccucuuguaacgucucuaaugcauacaagagucaaaccuuuuuggagucuaaucuuucuaauguuucuuuuguuaccugggccuuuagggucuuaccuagaaaauuacugccaaauccaaugucaugaaaauauucguauuuucuucuacaaguuuuauagcuuauguuuuuuucuuugcuuugucugucuguuuguuugugcauuuguuuggacggugucucaguuuggggcccuggcuuaccugaacucaguguguaaaccagacugucccggggaugcucaaaugaccaacagggccuggaguuguagugcaaacuguuucuguccuuaguuuaacguacuagggauucucucauuccugaaucuaagcaauauaccuugugaaacuaguuuaccauuucauuuacaaaaauaagauuauuuaugauaagagauaugauaaacucacuuauauauuuuuuaacuuaguuuuuaaacuugauuacucuugaacuccuuugugaauuauaucuuuugagcuauauaauugcaaaagucacagaaucaucauguauauguguaugugugcauguguguguauauauguguguguguguguauauauauauauauauauaugcguauauauuacuauauauguguacaguauuaguauuaagacgauugcagcuuugugagguaguaaguauaguuguauuucuuuacuguagaugcuuuuuuagaagaacuuuauuuuguuuauuauuaguuauuacuauuguucagguuaccugcuagcacagcauggcagcuuuacggcugagccaucuuguccgccugugauugguuuucauguauugaggucucugccuucuagagacaagucucccauggcaggagggaaugguggcuugcuguugucuggguuugaaugccgccugcuuuguuuuguuaagcguuuccaaugcugcuguggaggaucugauuacugcugcgaccacgggcauucugaggcacguugccgcugaggaaguuuccauggaaaggcagagacuagaggaagagaagcaacgagcugaggaggaacggugggugugucuugcuccuauagacgggcauggagguuaguuugccccagcccugaccucugacuucugauagcccuucugucgucugacccuguuggaccauucaccacccuaaugauuugacuaagggaaggguguguguguguguguguguguguguguguguguguguguauuuguauguauguaugugugugugugugugugguaugugguguauguguguaucugugccuguguguguugcaggguggauggcauauugaugugugugcagguuccucuggguguuaggucucuggagcuguagcuacaggcaauuaugagcagugccaugugggaccugaaccugcaaaaacacugcguucuuaaccacugaaccacugaacugaauucuuuaaguauuaucuuugugcuuuucuuccguuuaccccuagguugaagcaagagagagaacugauguuaacucagcugagcgagggucuggccgcagagcugacagaacucacggugacagagugugugugggaaaccugcucucaggagcuacagugagugacauacuguguccugaaugucaggaggaaggagggacuguggccaagcuguuguaaugauguguaugcauaucauggucucucuuucuagccccggcuguccuguagacaggcuggucuuggccucagacacagagagcuccaucugccuagcuucccaaguacugcaucaaaagcuucuagacagauguagcaugcuguuuucugauagggaggcccucugagucagugucccuaucaggaagcaugagaugugucuguuggcagauuuacuagagaaccuuuguauaguaggccauaugccauuauucuucaacuaagggagccuuucuuucuuuucuuuuuuuuuccuuucccuuuccccaucuugcucugguccccgagagcagggauagggauuguuuguuuguuuguuuguuuguuucucucucauuacggaugguugugagccaucaugugguugcugggauuugaacucuugacuuccaggagagcccucagcccucuuaaccacugagccaucucaccagcccuaaggaagccuuucuaaacuugugugugaggcuuccuuggccuuuucacuugagagcuguugaggaaggucugcccugugcuucuguccugcugagagcauuagcuggacggagcacagugcacggcacagcgcccaccgcucagaggcaguguguuugcaguccguguucuuccuaguccgagacuugggagccugucucuccaguugcuauaaggaagagaucucacaaaacgaugucaaauguccauucucugaggcaggaucauacuuuguagcccagaauggccuagcacuuacuauguaguucauguuggucuugaacuuggguuauucuccuaugugagccuuccauguacuagauuaauuuaguauaucauuuguuuuguuuuguuuuguuuuguuuuguuuuguuuucugagacaaggucugacuauguaguccuggcuggucuugaacucacuuuguuaccuggguagucucaaacucagagaaagccacuuacugccucugccuuccaacugcuguaauuggaggugugccacugugucaagcuagugagcuuauuuuuauuuuuuuaaaggagagggaaguuuaugccuguuucuuuucaaauauuuaugugcaugaguacacaguugcugucuucggacacaacaaaagagggcauuggaucccauuacagaugguugugagccaccauaucguugcugggaccugaacucaguaccuuuuggaagagcagucagugcucuuaaccgcugagccaucucuccagcccugugaauuuauuuuuaguccuaaauaaaagcccagggcuugcuaacgugugagguaagugccugcggcucugggugucugagucuggcucggucuggagugucucuggcacuggcaaagauggguuauugggaaggggucuccucugcuuaggguuacuucugcuuuaaugggguagguuguuuuuuuuuuuuuuuuuuucugccuuauuuaguagaauccuuuuauuuaaaaguuucuuuuuuugggugagagaaauaccucagugguuaagagugcuugcuaaacccagagguccugaguuuaauuccuagaccuacgucaguuacucacagucaugaguaaccccaccucccgggacucugcuguccugauccagccucugcaggcugccaaacacagguggcaugccacaacacuguuucucuuuguaucuggguacagcaguacuugccugucgucccaguacuugugaggcugagggaggagaacagguuuuaggccaccucaggcuacaaagcaaauucugugucagcugggguuaacuagugagacucucuuugaaaaagaggaaagucugagauacagguuuaccugagggcaaccaccaucugaccagaggaagccauuccuaguagccacuaguauuuaucauguguggaagguacuucuaauuguagauaccacauauugcugauaagacuuugaaguugucuaaguugucauuaaaaauaaaaauucagaaucacuuguugccgagcuuaaugaccuggagccagucugcagaacccacucaguggaguaagagagcacuuccugcagccuccacgcacguguacccauggugcacuggggcccucacaccggacagaguaaaguuuguguguggcuucuuguuauguuagguucagcugcugugcucaaguggugcucucaccucaggcuccugggcguuaggguuaggaaguuuacgcaggccaccauagcuuuaugaguuaaaacuuuauuucuggauuguuacaguggccuguuuggacuugaucuggcacccccaugacauuuuucgcuuuucuucccaggugaucugcuuuuaaguaaaaauaaaagucuugaacucccucuuauaguggaaauguuauauuuguuacuguauuuccauaggaagucagacuccagcuucuucuagggugggugcagcagucagaaccagggccuuacacaugcuaggcagauacuguccuaauuugguuuucauugcugugacuaagacugugacugaaagcagcuuggacagggaagaguuuauuuuuuauuuggcuuacacugccacaucacagcucauuauggaaggaaguugaaacugccuuacggacuugccuauuggcaauuggauggaggcauuuucucaauugagguuucucuuuccguauaacucuagcugugccaagcugacauucccgacccagacgcacauuuuuaaagcaggcccguaaguguccaugcccuuugguguagcugcuucuaugguaauugcucucuauuuuaggagugcaguagaaauagaccagaagguccguguggcccgcuguugugaagccgucugugcacaccugguggauuuguuucuugcugaggaaauuuuccagacugcaaaagagacacuccaggaacuccaguguuucugcaaguaucuacaacgguuagugcuguguuccuacagauaacguccacccacacaggagcuuuuaucgcguucauaauaugugagcugucaacuccauuagucagacaugaaaggcucacagauugauaggaauggagaacugaaguagaguuagaauaucuuguaugugaacagauauuuauagaguacuugcuuuuuauuguuuguuuguuuauuggcuguacuggauacagggaaaugucuuugaauacauuaaauaauucgccauggcuucacgaauaugaaugaaucuuucaaacugguauucucuuacaaaaaucugauguucucucuaaaaucaaaaaaucaaaaccauguauuuuuuuagauuuauuuauuuauuuauuuauuuauuuauuuugguuuuuugagacaggguuucucuguauagcccuggcuguccuagaacucacuuuguaaaccaggcuggccucgaacucagaaaucugccugccucugccucccgagugcugggauuaaaggcgugugccaccacgcccagcuuuagauuuauuuuauuaucuuuuuuguauauagugcuuugucuucauguacguauguaugugaaccacacgcaugccuggagaccaaggaugucagaagaggugucacauccuuuggcacuagagucauagacagaugugaccugccacagugcuaggaaucgaaccuggguccucugcaagaacaacacguacucuuagccacagcacuaacucuccagcuccuaauggcgaugcuuuuuaugaugguguuuccccguagugacucauugugaacuacaaaugcauuuacuaccccugaccuucccaguaccauagcucagcaacagaacgcacucagcagugucgggugacugccuuccgggcugacugggcgguagcuagguguagaggggucucucaugauauugagaguauuguguagcauaucacaagucuaggacaaacuuucuugaauguggguucuguaacugacugugaggguugcagagagauauaauaaugacaacaguaagaggcucugaacgugcagugaccaaggucgguucacaguccaauguguaaugacugacacaucacugcagcuggagacacagcuguggauucuccgcugcugugcccccauaugagugaacauugucugugacucaagacuggucuuucuugauuuuuuuuuuaaagauuuacuuauuauuuuaugugugccaugugcaugcaaugcacagauaguguagaaaaggucagaggaaggcucucaucuccuaaaacccaagucacagacugugggagcugccgugugggugcugggaacuaaacccugguccucuggaagaacagccagugcucuuaacugcugagccaucucuccagcccaugaaaaagcuccagagacauaauauuuuaguaucauuaucccucagcagcuaucaaauugguauaauuuuggguuacauuguauuagacaaaacaagcauauuuguguccuuaguaugcaaauuuauauuaauauucaauauaugauaggauuauauauauauuccaaauuguuguuuuaaguaauucucuuuauaauuuauuaucacuaaauguuugauuucuauauuuuauauaccuauauaccagggguuuuauacaaauuuuuugggugaaaaaggaauuguaaauugaaaaaguuuaagaaaucuuaagcuaggaaauuaaauuuuaaguccauuuuuaaaaaaugaauucauaucacuuuggugaugucauaaaguuaaaaaaaaaaguucagguauuaaguuugaguuucucucuccauaguagaaaaugaucaguuuaugaagaaacauauacaaacaguauauaucuaaacuaaacaguguagcccauuucagguuggguaauggugagcguaguccaagcauggugggggcacagagaugccuguguaucgcuguggccucucagcaguaaggggcacccagugugugcuacuuaggcucaccgcucauguuguaugugugccaagggugauccauuuuauacugaaauuuaaagcaagugauaauggccuugaugguaacaacaguaucaaaaggaacacacccaggagaaaacuuccuaggacagaccgccguccuucagaaguagcagcugcugguacccuucaagaaacuguacccaauaaaaggugcaggccugaccuuuguagcauggugucagguucuccuguuacuauuauaacaguguugcaguaugcucuugggagugucugugccuuaagugacugacccucuagugacugucacauggcucucuguggcuguggcagugccuuagcgaccucucuuuuauuaacauuuuacaugucuguucacacauguuguugggaccuacauuccugguugcuggucugagggaucacuauacuauuaaguuuguguccagauugcuuuucagagguaauucaguguuuguacuuacguccagcagcucagagcucaccacuuuuguuuuucaucacacccacauuuuaauugagauuaauuuucauuuuaagcacucuugcugaagaaaaaaacuuaagauugucaaagccacacuuuuagacuggagagauggcuuagugguuaagaauauuugcugcuccugcagaagaccuguguucgguuccuagcacccgcuuaguggcucacagaaguuauguacaagguggacauacauguacacaggcaaaacagucacauacaugaaaauaaaauaaauaaaucuaaaaaaaaugauaaacaaaaccaaauuuccauauuuauauacugaacuauguuuuucgccaguggaugagccuuaaacacaucauccaauaaccgcaugcuguuuuguccucuagguggagggaggcuguugcagcucggaagaaauuccggcgucagaugcgggccuucccugcagcgccaugcuguguggaugugaaugaccggcugcaggcacuagugcccagcgcagagugccccauuacugaggagaaccuggccaagggucuuuuggaccugggccacgcaggcaaaguaggcgucuccuguaccaggucagucccaguggcguggccucagggcuccaugcccagcuaguuuuagcuugaguuagacugaugacuuugcagcuaaagauggauggagccugaaagugaggacugacacaggaaugcaucuugaaggcuguguuucccacaguucugagccugugacuucucuaccacuaggaagggaggcucucguucugcaugaccuugaaaggcuuagguucuguggguagccugccccagcucugcuuccagacacuguccuacugugcuccuuucacugugcuccauccaccuccaucuccucuggcagagucccuucuuucugugucacccccauccaggcccucguugcuguuccuccuaguuuccccauucaaugcaguuccugaggcccaaacuguccagucauagcaucucuggcuugguguuucuccguaggcacagugccagugcugucaguuuguuuguuuguuuguacagggggcuuucacagcuguccugccucccagcgggcaggccuuagggggcacuauggaggugucguaggcuuaaccugaugggguuaugucucuuccucuggucaucacaggagauucucacugagcaauuacuccuaagguuuugucuggucaguuagaucaccaggucaucuuuguauaacuagagauuauagucaggccuauacucugaagucagggauuaggggccuuacucugacccaugacuguugugacacagucuggcuuccugaagucauaguuaacuuugguuuuguuuguuuguuuguuugguugguuguuuuauuccgagacaggguuucuccguguagccuuggcugccuggcuagccuucaacuccgagaucaccugccucugccuuucaagugcugggaaucaaaggugugcgucaccaugccugguauguaggcauguucugugagccacaccagccagcacagaggcucuucucucccaugagagcgugcucuaggauggcagggauuuugucuguuucucauagccagcucacagugaauagugcagcagauauuugaugggguugggugacccguuauuuuaucagagucuauuauucucccccaggaaacauugagcaauuacuuuucacucagaaauaucaauaaauacuauuuauuacuuauuuuuaaauuuuucauacaguauauuuugauuguguuuuuuccucuccccuaacuucuccuagauucuuucucucucuuaagaacaaaagauaacaauaacaaaacaaacccgugaggucuguuuguauuggucagcuacugcugagcaugagacgugaggucuguaguccauuucugguacuggggaaguaaauacuacucguuucuucccuuuuguaguccuugucuuucuuuuuuuguuauuuguagguugaggcggcuuagaaacaagacagcucaccagauaaagguccagcacuuccaccagcagcugcugaggucuguccgucauucucacuguuugaguuguuccugcuuggguacugcauauuggcucauggugaucugccccuuccaggaaugcugcaugggcaccucuggaccugccauccauugugucugagcaccuccccaugaagcagaagcgaagguuuuggaaacuggugcugguguugccugauguggaagagcagacuccagagaguccuggcaggucagcaguuuccuguauggggaguguggauacugauccggaggaggauugugcuauugagagucgcaggcaggcaggcagaauguuuguggggguggacacuaaagguuugugucucaguguacuuugcucauauguauuuggauuuuuaucauuuuuccauguacuaggcauuauuccauguaaguccaaaagcucuaagauugaggauuauuuaaaccucuguaugguaugguguccugauuaguaucuacauuauuuaagauucuguauauuugugcaccuugugcuugcagugccuaaggaggcuagaagaaggcaucagauugucuggagcuagaguuagcugccauguguuugcugggaguuaaacccaggaucuuuguaagagcauccagugcucuuuacugcugagccaucaucuuucuagcccugaggaauauuuguuuguuuguuuugcaugugccacaggguaugggggucaaaggacagacuuacagaaaucugcucucaaacuuccuagugcugugacuuuaguacagcuacucacacuguggugaccuucaaccauaaaacuuucauugcuacuucauaacugucauuuugcugugguuaggaaucauaaauaucuguguuuuccaauggucuuaaggaccccugugaaaggauuguucagucccccuaaagggguugcagcccacagguugagaaccccccugccuuacaccaucugcauucuaggggcagaacucaguuggcagguguggccgcaagugucuuuuaucuacugagcugucucacuggcccaggaucagaaguuugauucuguaaaauaguucggugguggugguggugguuguuuuuugagacaaggucucacucacuauguacccugacuggccuggaacuugcuauguagaucaugcuggccccaaacacagagauccagcugccucugccucccaauugcuggcauuaaaggugugcgccaacucaccuuacugaaauggguauguguaacuccagggaugguuucuauugcucgggcccuuuccucuucagcucacaguuuucaaucucguucgaaugagccaauuucacaacuguccuuugcacuuacccaaguaaauaacccaguagagggccaaccuccauuuuaaaaugauaaccuguuuugugagcuucacaauuagauuuggugucugggacccuguauccauaugguauuucucuuguuuuccugaggauuucuguaagucauuuuaaaauuagacauucccugaaauguuacuuucuuucaucuacagaauacuagaaaacuggcuaaaggucaaauucacaggagaugacagcauggugggugacauaggagauaaugcuggugauauccagacccucucagucuuuaauacacuuaguaguaaaggggaucaaacaguuucugucaacguguguauaaaggugagugacagucacuucauguacauaucucuagguuucauuuucucuccucagaugucucugaaauuauaaauuacuauuuauucucaaaggugguuuucaaugacucugagaugaucgaaguaaaugccauugucuguuuuucuuuacaucuugauuaauauaccacagccaucuacuugguguaagguuuuaguacagauucugggagagcaauguacuugcccucugucgugguuacaaauaauaauauauaauauuauccagauauaauccauuuuuuuaagaggggaagcuuacuuucgcucauaguauugaagguuucaguccaugacugaugcccuuguugcuuuucugaggacgcacauagcagaagaaaaguguacacuugacagccaggacacagcugaggagguuggcagcccacaguccuucaaagucauguccccagugaccucauaucuccacagaucccaccucuucaguaucccucccaucucccagucaugccaagcuggaggccaagcaguaaacacuuggcuccucagggccagacuacagcaagcacugagccuuggcugccacauuccuccuugagaaugugaugcacucuacaggauuccuuucuacuuuaucuuuugcuugacucaagcugcagccucuacccaacagcagaccuuaggccccuuuuuguuuuauugcgagcacuaaucccuguuaaugucauucucauagcucuuugauuuugucagguuucuuaguccuuauuucuuuuaaacacaauauuccuacuaauuaaaguucccaacacgguguauuuccuuugcuagggcucugcuuaguaggcccuuggguuugaaguaaauuugugcauauggucuuggaacaauggcuaguacuugugugauguugguguuggugauaguaacaauaccuuuucuugguuuaguccuuuagaugauucugaggaaaggacauggaggggggaauuuuucugauugcuauccuccugaaaauauauuuaccuuauauucucucucucucugcuuuuucuuguuuuggcuugguuugguucuguuugguuugguuugguuugguuugguugggcuucucuguguagcccucacuacucacuguccuggaacuugcaccguagacuaggcugcccuugaauucagagauccaucugagugcugggacuaauggccugugccgccgccaugcguggcccagcuuugucuuugaaggacuguccagggcacagugaauagagcucugcaacuguccuugcugaggcagacugucuccuguguuguccucugguacauucacccugacaucuuugauuuuguugcagguggcucauggcacccuuagugacagugcccuugaugcuguggagacccagaaggaccuguugggaaccagugggcucaugcugcugcuucccccgaaagugaagagugaggagguggcagaggaggaacuguccuggcugucggcuuuacugcagcucaagcagcuucugcaggccaagcccuuccagccugcccugccgcuggugguccucgugcccagcuccagaggggacuccgcggggagggcaguagaggacggugugugaaggaagccccguuccugaucccauaccuuuaagaaguggguggggcaugagugugauggauggccagcagagcaguguggggagcuuugggguuagugcccuauuuguucuguccacagcgcagggccacaacuagcuugggaugugucgcaugugcaaaaugaguauuauuacauggguccuuccuguuucucuuaaaggucugauguuacaggauuugguuucagccaagcugauuuccgauuacauuguuguugagauuccugacucuguuaaugauuuacaaggcacagugaagguaugguuucaccuuuuaaaggucugucaggguacuuguugguuucucuccugagcuaccuaucuucucaucugucuggaauguaauauaugugguuguuuggauuuugagacacugucauguagggcaggcugaucucaaguuugcuaggcagucaggguaaccuagaagugaugcuuccucuuccucuucugugaguauaggcauguaccguccuguccagcuuauauuagugaucuccauuuuaaucuuauguuuuacacacacacacacacacacacacacuauuucuaaagauacagcaggcaggaauaaaaauaaaauuuaaaaaacacccauaguaugguuucaguaauauguuaaauaaguuuuuuggcuuugcuuuguuuuuuuuuucuuucuuuuuuuuuuuguuuuuuuguuuuuuguuuuuuguuuuuuguuuuuuguuuuguuuuuucgagacaggguuucucuguguagcccuggcuguccuggaacucacucgguagaccaggcuggccucgaacucagaaauccaccugccucugccuccugagugcugggauuaaaggcgugcaccaccacgcccagccuugguuuugcuuuuaugaaauuaaaaugaccauuuauauauuacaucugaaugucagauuuaucuaauuaauuuuuuagaaugaaugcuuuuacaaaauauaaagaagugauauuaccugagacuuccuggaaagguucugcuaaaaaugguuuaggaaaagaaguguagggauugcauauggccugaggauguagcucagggguacagucccacuugacauauaagaauguccuagguucaaaagauggccuagucagcuaucacuggaaaaagaggcccauuagacaugcaaacuguauaugccccaguacaggggaacagcagggccaaaaaaaaugggaaugaguggguagggaaguguggggggaggguaugggggacuuuugggauagcauuggaaauguaauugaggaaaauauauaauaaaaaaauaauauaauaauaaaagauauaauaaaauucucaauaaaaggcuaucauaguaaaaaaaaaaaaaaaaaaaaaaaaaaaaaaaaaaaaagaauguccuagguuuuaucuccagcacucuaugaaaaccaaaccaaagcuggacaggaagagguaauggcagagcgugaggaagcugccuggcguucagugacgacccuaguucuaggaauaagauggaguggcucugcuccuguggguggugaggaagcccucaugagguccuugguccuuccaggagggcucugcaggccccacuuacuaauuagauaagacucauggggcccucuguggugccucugggaggcacauccacaaggcucuagaagcccagacucaggcacgcagaggccuugugcccuuuccugcagcggcugagauuuuguuguuggggcauuuuccuaaaacagccaugggcagagugcuaagccccuuucgaaaacuacuuuuuaaaacgagugugacuuguuugagcagaucucucccaauugucuugacccucagguuucuggagcaguccaguggcugaucucccgauguccucaagcccuagaccuuugcugccagacccuuguucaguauguugaggaugggaucagccgcgaguucagccgucgguuuuuccacgacaggagagagaggcgccuggcuagccugcccucccaggagccuagcaccauuauugaguuguucaacagugugcugcaguuccuggccucugugguauccucugagcagcugugugacaucuccuggccugucauggaauuugccgaagugggaggcagccagcugcuuccucaccugcacuggaacucaccagagcaucuagcguggcugaaacaagcugugcuuggguuccagcuuccacagauggaccuuccacccccaggggguauguacccacccugagggaggaguggagggcuagccuccucuucuugcuacagagacacuauaccagcggguggauuccagggugaagucugcaguccacuuccucuguguaccuaucugcaucagccuuuggguuucuggguuaggaugaaacaggauuuuauggagugggagcuguuguccuuuuccccaggacaguccugagacugccccacaggcgcugcuuaccagaagagcuaggccagcugaaaagcaugagacuucugugccugccucugagcugcuggcccugcugcuaugacagcauuuaagugcuaguguaggucacuguucauuuaaagccugacugugccugugccugggggaugaggccucugggcuguuugauacagacuccacagauagccaaggcugacucaaaccuggugcugcaggggcugcucuuuccuauguuaauggcacugggaaggagggagccugcuuaauauucagcuaacaaagcuuguggacuuacccacuguagcccucuaccaagaaaacagcauuaauaauauuucguguucacugauucuuggucacaccuguaacucucucugcagcccccuggcucccuguguguuccauggucauucaguacaccucccagauucccagcucaagccagacacagccuguccuccagucccagguggagaaccugcugugcagaacauaccagaaguggaagaacaagagccucucuccaggccaggaguuggggccuucuguugccgagaucccgugggaugacaucaucaccuuaugcaucaaucauaagcugagggacuggacaccccccaggcucccugucacauuagguaguagucauucaggguuuggggacugaaagucaugagacuuuccuaggcuaauuuuacccaaaaaggggggggggagugagauuuuaguuaguuagcuaguuaguuaguuuguuuauuuuaaauagggucuuauuguguagcucuggcaagccaaacaaacaaaaccaucuccacucuuguuuuaaauuagaccagaaaagucuuagaaacuuuugaagcacuaagguuugacugggcaugguggucuauaucuuuaauuccaacacgcaggaggaucucuugugaauuugaggccagccugauuuaccuagcaaguuacaggauagccaggacuauauagagagacccuguuucaaaaacacaaacaaggccagauaugcugugcaugccuuuauucccugcacuaaggaugcagaggcaaacagaucuccaaguuugaggccagcauggucagucuauagagcauguuccaggacagucagggcuacacagagaaacccugucuccaaacaaacaaacaaaccaacaagaaaaggcccuaggagagcacagacuuccuucccuggaacaggccuccuagguuagcucuuagaggcacagcucugcgagcuauuccugucccuucacaaucuucaccaaugcaugucccauccaagcacggaaguuacauuagcgaauaucaaguggucaucuguugcuccuuauauaucugauuucuaaaaaucuguucuuguacuguuuucucagaggcgcugagugaagauggucaaauauguguguauuuuuucaaaaaccuuuuaagaaaauaccacguucccuugucaugggaacaggccagaaugcagacgcagcgggaacugcagcugagucauggacggugaggccuauguugaguguguuuucugucucuguucuggaccacagccccuucccuguccuagagcaacucuggcaacccugcagagugcgggguguccccaccgcguagacacuugagagcagaugcaggcaucucucuccauuuauccgaugagcucaggccaacccuaauugcaggaggcagauaaaaaagcugguaucucaucucauaaacccaguucauaaauacccaaugcagcaccugugcacauuccccaguagucuuccuuccagaagaaacaggaucagcaagagaacucuauuaauauaauuugcuguugcaauagaaaagccagguggucauuucaauacguguugaaauaauuuaaaauguuuauuuauuucauauauauaguuguuuugccuacauauaugucagugccccacuugugggccaccguuguauucccuagaccuggaguuacugacaguugugagccaacgugcaggcaccggggagaggguucucuggaaggccagcagccagugccaucaacagcugacucagcucuacagccccaaaaugaacuuuuuaaagcuuaagucagggucagauggauggaucaacauguugggauaaaggauggcucagcgggugggaguacuuacuguucuggccuggcaaccugaguuugaucccugggauccacugaguuggaaggaacugacuccacagaacugcucucugaccucuacaugugcacuucccacggcccugagcuacugucuuaguuucguuucuaaguuuugcuguauugguaaaauacucugacaaaaagaaacccaguggaaaggguuugaguuucucacugggaaaaucagagcaggaaccugaagcaguuaguugcaguccagagcgaauaaagaaugugcgcaggcuugcucaccucaguagagaauggcggccacauagggugguuugagucuucccacgacuacugaugucauuaagacaguccuccacaggcaugucugcagaccaaguucaucugacagucccucaaugugccuuccuucccagagaauucugcaugcuuucagacugaccacuaaaacuagccaccacagcuaccuaucauaaaucuauuaaaacaaaaaugcaaaacacaccccaguaaaauaaaagcaacaacaacaacaaagcaucaugcucuuccauaaagcauuaggcuugaaggccagcaccagucugugcugcccggguugucacugauguugccugauggccacugauacggggcagauaggcauaaauaucaaaaaugagaauuuccacacgguauagugccagcucagaagaaucagcauuguagcccugguuacgguccaggguucagcaagcuaacuaucagaaguucccacagccuugaaauauagaaucaguggauaagaacacucgcucuuuuagaggacccagguuugauucccagcacccaugugguggcucacaaccacucaugacuccaguuccaaggaucuggcaaucacuucugaacucuuugggcacaaggcacacauguaauacacauacacauauacaggccaaacacuaacauguaaaauaaaucuuuaaaacaacaacaauaaagauguacuuaguauauagagcuuaagagauggcucaggaguuaagaacauuuguuguucuuccauuuuuagggauuugaugcccucuucuggcuuccaugugcucguguauucuugugcuacacauaaguucaucacaggcaaacauuguaugcauaaaauaaaucuuaacauacacacaugagagacagagacagacugggauaagaaacaaaggccugauuuaaagcagcucuaguggaacguuuggaagcaauagcugucuuugugucugucugucugucucccuuuuucccucccuccccccaacccccucuuccuuucucccucccucucuuuuauguuauguaucccuggcuggccuggaacucacuauguaggucagguugucuuugaacucacagaagucugucugucucugccucugcuuccagaauguugggauuaaaggcacaugccagcaagccugaccaacagugucucuuguuuuguuuguuuguuuuuuuuuuguuuuguuuuugguuuuucgagacagaguuucucuguauagaccuggcuguccuggaacucacuuuguagaccaggcuggccucgaacucagaaauccaccugccucugccucuggagugcugggauuaaaggcgugcgccaucacgcccggcuauuuuucuguuuguuuuguuuuguuuugccaacagugucucuugaugugugugugugagucacuauauagcacauaguaugagagcugcccucucuuguugccauagucucugacuugagggaaaucgaggcaggcccagggccugacauggguauaauccacccacuagagcacuuggaucuugaggcuuuuguucauagagugaagacguguccagcugugucuaugugcugugcacaauguugucaucuucucucccaucuuucuugacuguaagaacuuucacccuugugcuuccaguucggggaugagguccauccauccuccuacaagcacuuuuccuacuccauugcuucauguacaccagaaagggaagaaaaaggaagagaguggccgagaggggagccucaguacagaggaccugcugcggggggcuucugcagaagagcuccuggcacagagucuguccagcagucugcuggaagagaaggaagagaacaagagguuggucugucuguccccuuccuggguacucaugcauucuuucuacuuccugcaagaggaaagucaggacagccaaggcuaggaaggggcggcugggcuggcaaggguuauagugaugagacuuuauuuaaaaagaaaaugaggaagaagagagaaaagaaaagaaaggaagugagacauuuauaaaguguaagugugggcuggagugcuugcucauuuuccagaggaccucacuuugguacccacauccauagcagguggcuccuaaacaccucuaacucuagcuccacggaucugaccccucuggccucugugagcacuugugcaccuacacagauguucacacacacacacaccuacacauaacuaaaaauaacuuuuuaaaaguagaagcccuuaagagacagauugugcucuagaaagaauauucuaaguuuuuucauuugaaauuggcuucauugcuuauuuuaagucuucuagaggagggaauauguguagcuaagucuacauagcuuggucugccauggcugaccacugcuucuuggcccuugggaagcccaaggcuucagugggucauuucuuacuagguggguaggagcuagugcagaccuuccucugcuuagcugacucccuuuccuuuguaccucccucuucuggccauucacacugagaaauagaacggggaagacagaacuuggucaagguugucuucccaccaugcuggugugucucuccugaugcuagagaggagcauugcauugugugcuugaggucagcucucccccuggggugcagugucaccuccagccuacacacagugcuccacccuuagggcucaccugagaccuugcuucuuccuccauuaggacauggaggucagcacacaaaccgcagccauacugacacaugcuccugacgcagcuccuuugucuccaguugccacucuggcccucugcauccugcaugcuugagucugcucacgaguucuugucccugucagugaccaacaacuucuuaaccuuguucugagucccugaaaggauuuaauaaauccaagagcaccacagagcguucucugacgucaugugggcauccacaucuguucacggauacucaggacgaggaguuaacagcacgggagcgagugccgcuuaagcucugucuuccucacuuuccgaucucauacugucucagguuugaagaucaacuucagcagugguuaucgcaagacucacaggcauucacagagucaacucggcuuccucucuaccucccucagacgcuaguguccuuuccugauucuaucaaaacucagaccauggugaaaacaucuacaaguccucaggugagaacgaguacccuugccauuuccagaauuaaagacggggaauacgccugccucaguggaccacaccuuuaaucccagcacuccaugagugugaggcagccuagucuacaggcuacacaggaacccuguccugaaaaaugaaggaggggaaaaaaaagaaagaaaaaagaaaaaacaaacuaaaaaccaauuuuaaauaccuuaaaaguucugucucuuuagaauauccaaaaguucacucuuucucuggccuuaucuucucucugccuucccuccccccuucucucucccuucccccucugcuucccucucuccccucccucucuaaccucuccccuacccccuccccacacccccccccaguguuccauggccugccucuuccuucucuaucaccuuuuuuucuauguccauguucccuucucaccccuguucucaugccccaaauagauguccuuuuauacuaaaaaaaaaaaaaaaaaaaaaaaaaaaaaaaaaaaaaaaaauccaggaguucucuaaaauauccagauucucuguaaaauauccaaagucucuaaaauuucaaugucuuuuugaaaguuaaaagucucugaacuauggcuacuuguaaaauaaauaaguuaccuagguucuuguucuaagaaggggaauaagggcacagucacggucaacuugcgagcacccagaguccagcaguguaaagccaggugucacacuacuacugucugacacucacucucccucuucugggcuccuucaaaaugccugguggcugucugcagcacaugcagcuuguccucuaggcucaggcuggcuacaugccacagcugcugcgaccccugguggucaggucaccaugguacugccauacccaaugcuugaguccccauugcagcugagcugcuccugggacaauaacaucucucgggcuuucuucagggacucuccaccccugccacaugauaccaagcauuauauugccaugacgccuucaauccugagccuucuacugcagggggagcauccguggccuggccuggccucucauggugccaaagccucagcuguucuucacaaccccuauaugccuucaaaaccaguauagggagagccuuccacuaccaaguucagaugccaacaugaggugcagccucagcucccucugggccaugagcuucugugugcucauccugaauaaacacuugagaauaauuuaccucagugcugcuggucuccuaaucugggcugauucugcagcucccagcugaccaguaucacuugucucagccuuagaguacuugagggacucaagacuucucucucaaacaucacaagccaggccaccaccaucugcacuacucuuuuuuuuuuuuuuuuuuuuuuuuugguuuuucgagauaggguuucucuguauagaccaggcugggcuggccuugaacucagaaauccgccugccucugccucccgagugcugggauuaaaggcgugugccaccaugccugguuugcacuacuacuuucaccauuugcugcauucccacaauucauuaaacucugaacacucgagugcuuuucuagucugaaguuccagaggccaugcacaauccuccaaaauacaugcucaggucugucacaguaaugccccaaggccugguaacuaauuucuuaauuagagcuucuauuccugucauaaaacaccaugacuauaagcaacguaaaggguuuauaguccauccaaagaaguuaggacaggaacucaaacaaggcaggaaccuggaggcagggacugaggcagaagccauggaggguccugcuuacuggcuuguuuccauggcuugcucagcuugcuuucuuauagaacccaggacaacuggucuagggguggccccacccacaauaaggcccucccacauuaaucagaaugugccacagguuuacccacaggccagucuuaugggggcauuuucuuuauugagauuuucuuuuccauaauaauaccuagcuugaaacuaaccagcacugcuaggcagugggggcacacaccuuuaauuccagcacuuggaaggcacaggcaguugaauuuggggcuagucuugucaacaaaccaaguucaaggacagccagggcuacacaaagaaacuuugucucagaaaauagaaugaaacaaaaacaaaccagcacacacaggaacaguagcucuugucuguggggccacauaacuaucugaaccuugaccagacucaguucugggauuaacuuucccuaaggaaauuaauaagggaagaaggugagcucacagaaguaaauuucacauuaggauaguguuuucaaagccagaucguccaggccccagagccucucuauguuuuucuuggcggauaaggaagcagaaagaguuuaucugaaggaucaugccguggggcaggggcgaaagguguuuccagaaugccuuaggaagccucacagaaggaaggcagaguacgauagcauacuguuuccauugaugaguuugcuuaauccuuuaaaauacucuucucucugacuuacugugaggcauggugguguacacucguaagcccagcacuuggagauggauggaagcaggaagaucaggaguucaaggccagccucuacuauguagcaaguuugaggcuaucccaaacuauauuccacccuuuuucaaccccacucuaccugcuccccaaauuuauauucugacuaauucucucuaaagacauugccagauaguuaacaaaguuuaauguacaaaagucuucacaauggaauugauuauaugucuuaucaauaaaugacccaaggcgggaacuugguuaagcuccguagaauacuggcuauuuguguguagcagauuaggcaggcaagauggaggagcgcuaccaggcgaggguucuguugagcccaagaggcucugugaugcgggcgugagcauggaugugaugugacgccgccacacaugacuacuuuuugcugcuuuuuuacucaauuagaauucaggaacaggaaagcaguugagguucucagaggcauccgguucaucccugacggaaaagcugaagcuccuggaaaggcugauccagagcucaagggcggaagaagcagccuccgagcugcaccucucugcacugcuggagaugguggacauguagcugucugacgggagacggaucucuaauucauaaugcuuugucuguauucaauuguguuauagaugcuguuggaaaugugacuauuaauuaugcaaauaaacuuuuugaaucauuccagagcc

SEQ ID NO: 5581 - RNA, 29805 nt, Mus musculus
ucauugcaaagagauuuuuacuagaguagagaaagaccuaacccaauaagauuaguuuccuuuuuaaaaagggcaauuuggaggaaagcaggcagcagggagacagcagcaaauccucguggguauagguuggggaacagcuguccgagagggacacugccuaguuucuucaggaccacaacugagauccguuccuugggaauuguugguauuaggaaacauuaaaaugcaaccaaggaugcuaaugagaaccaugugaugacagccuguaaacaucuuuuuaaagcaagcauucguugugaguauauucaaagcauucgauguucagcgggugaaaaagcaugucuuaaugaagguaaaccaaaagaaaugggaaagguccaaccaacaggcaaaaaucuaaaaagggaagauacagccagugggucccugagagagagauguuugcugugcauacaggaaugucacaggaaguggcugguguugauaccaauauccaaacaaguucaaagacaccagguccuugucuuuagguuggagcaggcagcauuaucagaggccaucagauguuggcauggcgagccugugaacaggagggcacaggguguaugugggaggggggaaggcugggcuggagagugagccacaaugggcaauggagagagggagaggacgacuugaugccaagauucuaccaacacaacucacuuuugaaggggaauuagcugcuauugauuggaauggcaggacuuuggaccuacaauaucagacagagugguaaaaucagcccagauccccggaggacuaguuagagcuugcuacuauauuaagggaagagucagggggaagacccaaagagucaacaccacugugcuugauccaacuucugggaaucagaaguccuccuaagcucugggcgcugaaaguaugucucuagaucuguguaaaaugcugcaaaguagcaccgucuuuccuaucgccucaugucggaaacuaagaggcucaguaaaaauuuaucuauuuuugaaaaaaaaaauggaaaaggggcaauuuggacagauaaacacagaaagaacaucucauggagacuacugugacacugucugccaccaaagacaaggagauugcuaacuuggagccaggccugaggcugaggauaaacccuccaugaugcaggcagagggcuccagcccuacucacaccucacaccuggccuucugucuuccaggucuaagaacccacaagauuccaccuuucugccugacuucuaguucuucuuuggucuuuucuccugucuuccugugcuagguuaaaagcuagggucucacgaauaccagguaagccauucucucugagccauaauguaacccaagaugguauauuccagacccuggguuccaugcuuugucauggagguugaacacagcacagccccuguccuggaaaacccuauucuauguucuauguguggcuuccaggagcauaaguguggaauaccugggacaugagcaaccccagagcacccacauugaaguagacuaucuuuugauggccauuugucccacaauccauuauucaccuauccuuccaugagugucucaaugaagccacgaggcagucuaagauaacccugccccaucggaggcuugagagacaguucacaaucacaggguggcaauuuuagcuggacauucacuggcuagaguggagucccuguugaggcuaugcuaaauguucauuagagacaguguagcacauuuugcaguaccugucuccaugaaggguggccuggggcuggggaucagggaaugauguauucuggugggcauguaaauagccuaagugucgucuuagagugaaaaagagacccagugauguaccugccugggguaaggcccuauugggcauagacacuggggaccuggcagcaacagggaggcucaaaaccuuuauugggccauugggcaugugauauggggcucucaggucugaucuccugagauaggaaauaacaggcagagaaagacagagccuugggcaggacuggugcaggccagcagacagcuuucagaagggacuaguggaugcaugaagggggaaagggaaguaagggggcagaggcugugggaaacaggcagugggaagacucugggguccuccaaugcuugagggcaagguauagguaggauggagacuugggguaggggaagccaagagagcugaaaguagguaaggggcuuuggguucagaguccuucuguccugauuuugggagaagggcuuucacuuucuagaaagacccaaguguaccgucuagcugggaccggcagggcuaggguccuauuagcaccacagaugggauggagagguggccgagcauggcggugcuaacagauccagcggaugaaccugucaaagaagcugggcugggccagacugucaaagucuuucucccggaagauggccgcccugucacccaggcugaucuuaguaagcacauccauguccacgucgccgcccacagcgaccacagugggcaccacguucugcuuacgcauagagugcacugacuccuccaggcugucauugccggugacaccguccgugaggaagacgaaggagagcucugcguggcgccgcgccccaccccgugccccccgcaccacguuguugauggcguguacgaugcccgugcccacgugagaaaaggaauugagguagguggcccucuccagggccucguggaugguggucacguuguaggucagugggaaggccaccuguugcugauucuggcugccauauugcaacagagccaugcgggcguugagugggucaucaucccuccgggccagagucaggcgccgggacacguccuccacgaagcgccgcaccuuguggaaguucugcucgcccagccgcuccgagccauccagcaggaagacaauguccacgggccguugugugcacugggccacauagagcucugcagggaagauguaaggugggggcccaggcaggcaaggggcggccagcuugaaacucaucccaucucugcauacaagcugcuuauuggauccccggucuugggacuuuggaguuucacucacagccaccaauggaggcuucaacagcgcaacuccuugggaguauguauacugcuccccgggaauuuucuuaaaugcccccaaacuagagaacuagagaucuggcuagaggcuagaagauucaucuuuuugucaccaagcauggucucagccuccaucaaccaccucugggacucucaauaaccccaaaucccuuacucagcccauauuucaguuacucacaaagagguuauucucuggugggaggguuaagauaaggccccugggccugacucuccucaggggccacuuacuucugagucaccugggcuguuugaaccacauaucucccagaaaaggaaggaaggguccauguguccugacacucacuguagccuuggcauacugcuauauaccaaauguauaguaguguauauuugguauggccgaagcaauccagguaggcccauaguggauucaaugcuaccaccaagccuuucauugguggguagucaccagcccagacacacagcacuaugggagcuaagaccacacacacacacacacacacacacacacacacacacacacacacacacacacacacacagagaagugucagagaucacuggcuagggccuugcuacccagucaccagacauccaucucggcucucuccgggggaagauauguucagccaaccuauguaugcugccauaauccaggauuugggaccccagggaaucacacuaagaacguuacucuugucauguaugaccaagaauguggaggcaggacccggcugccaguguaccuaccccaucugcgccucccccuucccucccccuugacuccaauugugugugagggucuaucccaguguaugcuagcccaacuuaccguuugaccacagcagugcauaguuacaggcuucaacuuuuuauaaaauguuugcaaucgcucacuaccucugagucugagccccgagucagguagugccccuggcaggcagggucuuucuuacugagccuauuaacuuuauuaaucacccauaaucccugcaauaugcucaggaugccuagaaaaguuuugggaacgacuggauuuccuagguccucauaacugacuggcccccucacaguuauuaccacaaacccagaggcagacaaauagugugggcugcuggcuugagaacuuuaccuuaauagcaacaucuacagggccuggaggagaccagggaacucuggugaacaauacaagcaguugggaguuuggggacuugggggacucugugcuccauuucugugggguucccuucuucuaccugugaccucccagcagggagucuggccccagccugcuaugggaugucacccucccagcaggauaugccuuauccugggagagagggggcacagauggggucaaggacauccauccaaccugaugagguuccuugagcucaaucagaacaugccagguacaugaacuugccuugguggcuugaacuggucuuggugacuuugcagugagucccuugcuacuccccauauuggaagagggugcuuucaugguucuuagucauguggcugagguaucaaaaguccugccuggcauacgcucuccucaugaugccuucagauacagagaccaggcugggcccacagccugguguuugaggcacacugggacuuugaccuaguggguaugacaguugcugagacacauuaaggcccuuguuacaguuccaugguuugugugagcuaugaccacauaccugacccccaacauggggcucagacaggaccaggacagggagaccuccccaagcguucaaauagcaccacccccauuugugcucucaaacacaagacugcucagcaggacagagguggugugcucugcugagagaugcccagagguuuacaucucaagagccuuaauauaacccugaugguacaguccuuugccagaugugacugagcuucuggggcauaaggugggccuccaaucacugaacaaaguggggcauggcagugcaugccuuuaaucccagcacugggagugucggggcagggcagagcaggaggaucccaggccuacaaagcaaguuccagaacagccaaggcuguaauacagagaaacuuugucucuaaaaacaaaaugcaaaacacaaggaggaggaggaggaagaggaagaagaggggaaaggaggaagaagaggaggaggaagaggaggaagaggaggaggaagagaaggaggaagagaagaaaaaagaggaaaaggaggaggaaaaggagagagaggaggagaaggaggaggaggaagaagaggcagagaaggagggggaggaaaaagaagaagaguaggaggaggaggaggaggaggaggaaaaaauacacaggcauacaaagaaaagagucugugggaagauagaagugaugcuggagaggugugcccacaagccaaggauggaagcucuaccagaggcuggaggaaguaggaggaacccuucagagaguaucauauuaaagacauaagauucuagacuucuggccuugggaguuucgaggacagguuccuagguuccuacuaccuaaggucccagcuugugguggcagcccugggaaucuauaagaaaugagggguuagcucuggcuaccuucccacagugaacccgaggcuuuagcagagugccagcacgcucucuggguccccugugauaucccugugcaccaguuuaaaggugucaaugaacagcugcauccaguccugccgcucgaccccuguggagaacuuggcccucucggcgguguagaccaucacagcuaccaguugggaguaggcagcuggauucugugugaacuccguggcguuuagcaacugcuggaucagggggauggucuuggggaaggugggguccggacccucuuccgugcggaggaaggugaccgggggcuuguucccaggccaugguucaucugcaagggaguggccagagaagacuuuaggagguccaguggguguggcuggccuccagcccuccuuaggccucugaccauggacaguaguuaggaccaaaggaaauaagcccagggagacaaguaggagaugggaggauggagcaggugguggugucugguauaggcaggaagcuagcggggcugaagaagcugaaagcaagcgauacagccaaggagacaggccaguagcaguuuuggggaauccacagagcucuaaagaaacucagcacagagcauuagugcccaagcccaacugagagaugugcacaaaugcuguaaacuucuccagaucaguucuacaucuccacaucccuaggaagagucagcuccggacagugcucacagacaaaacuacaacgcuaaccuuuuggucccagaguuaucaucugcuguucuaggacuguccaugagggucugagacugagugguacaggcaccaagggagagcaagauccucccugucuccuccucccuccucucucccucccuccucucucccucccuccucucuucuuccuucaucucuccuuuugugucucugucucccucccuuucuauuucuguccuguccucucccuuucuuucugguucuauuucucuuuccucauuucuuuaucccccucuccuuuucugucugucugucugucugucugacuauucccuccuuccaucucacagugucuacuggaguggaaggguaugccuaugacucaguagaugucacgacccaacucacucccuuuucucugguaacaaaggacacaugaguuuccucauguguccaucacagggccaggaccuugagccucucuggggagguuccagagcagugguccucaaccuuccuaaugcugaaacccuuuauacagucccucauguugugcugaccgccaaccauaaaauuaucuuggugcgacuucauaacuauaauucuaccucuaucgugaaucauaauguaaauaaccuguguuuuccuauaguuuugggugaccccuguguaagggucauugguuaccaaaagggucauaacucagagauggagaacaguucuagaggcucuucuuuuuuucaucuucauaauucaugcucaggucucucuacagucuuugguacuguggucauuacuaauuuucuuccuauaguccugagcuccucaggcacacucaguaguuccuaaugagggacacaacugcuggccugagguaggcccaagguaaccagguagacagauagggcuaguaguuacuugacucagacagucagggcuaggucagaguugguaguguuguugacaucauauucauaucagaaauguacucaaggaugcucuccuaagaccucauuuauaaagauaccaucuaaggucacuaugcaccccuuaccccaucaccgugucuaauuuaccuugaaauuucauauaacaauaaaugcaaaugugcuuuauggucaauagaagggggcuagggagaugcagaauguggagaggaccaauaugcuuugugggguccgaaggccucagaguaaauugagaugcccauuuccucuugaucuugccauccuccagaguuggucuguccagagguggaaacugucugaccuuguaccccauucuggagucucuauacccuaucaucuagcauugccccauacaagccagacauagaagccacuagaaaagaagaugcagagacagcucuuugaacauagaagugcucuccccauaagacacaaggcacucaaauuuagcaggcaucucugguagcccaugagcaaagggcucugccucagagacacaagacacagggcuuacucaguaauagaaaaucaacacaacugauuguugcuuucauaacuaacaaagccucacaaggcaucaccaauagagcaagcacaugacaagauccaaucaauaccuuuucuucccugauaucaaccaaaaggggaacuugcuacuccauaaagacagccccagcaauccacagcugcgcaacuugcugaguagaaucuugaaccuuuccaacugugaucaggagcaagacucagggaucaaggucuggcuucugugcuggagggguggagccaucuguggaaucagccuccccuauacaaaccucacauaaggcuuuacaauaccgggcuggaguuggauaccaucacccaccaaaguacagcuucaccuaacugcccagucaaggugccaggagccaggguugaagguguagcuguaaggucucacugcagacaugaccucuagucuuugacagauacuagaacaggcaacuugaagccagugcucggagccccacacaauccuucccagguaacuacgcuagguggcugaggcuaaggcuugcccugagagcauuuucuugguagugaucucuguuugaacagugugagacccugacucccaagccacacugucccuucuguccggugggcucugagccugugcacaugcucagugggccaccuugucuuugggagggaaucaaggaacagcugaggcuuuguagggagauguagcugcacaguucaggcuaugaggacuacuaccuguggcuccaucuccacaguaacuccaccaugcagaacuggcccagccccuacucaacacuccuggaugacuagggcuugcagaggggacugaguggcuacggaggccccaggacaacuuccugaggcucuuacccaggcacucugcagcagcaucuuggggggagguauugucagggacccucagcacagcagggacaccuccuacccucccuugggaguagcagcucugguuucagccucuuacuaugaaggccacaaaggcagcugcaggguuagaagcaaagcuaucaacugcuaguggguaucccugugcuuaucaccagauguccaacaccagccguuccacccauugguuuuagggcuuuaucuuuugagcagagcuugccaggucuuggcaacuggauggcucuagcuaugucugcccacaacggagccccuggaagagcaggaaugaagggaaugcaagggagggccuggcccuguggaccaaaaugagugcacccagugguagggagacuugggauucuugggagagacuccuuuugugucgaaauaccucuuugaucaauggccaagagccaagcacugccaggccagcagucucugcccagaugguacccugcaggggcucaggaugauacuacaugcucucaggagccaguucucacccugaaccucugacucuaccaugccaggggugaacuucaaggguuucucccuaaggaggugccuccacauugacaaacccuugagguugcacaauuccuguuagaacaggaaggaugcuggguugcucugcuugucuggaauuaggguuucagguaccccgguuaccuguuuggcagggaaguucuggacacacgaucugggggucuagaagagagaaagaaaccaggucucuauaaguuucugcugggcucucaguggucagcuuucuagggguaaaggcccggguccugccacucaccuggacaaaggacgucuuccaugucaucgaugaacuucucggccaccaggucagagaacagcgucauguugcgcacuugcuguggcuugucacaggcaauggaguagagguucucacucucaugagucucguggaacaugucaccgaugccaauggcugucacagugacaucucggucacacagugcccgaagauugaggucaucaucucgggggucauggcgcccauccgugaugaccacugcgaacacccgggucuucuggcgccggcuuucuuugaugagcugauuauaggcaaacuugagggcagagggcguccaagugccaccggcgauccauucaagguuuuugacagccuccuugaaacuagacagggaguugacucgcucgucguccagccggauggccucaaaggugcccucguggcuguacugcaccacacccacacgugugccuaugagagaagaucagcaugaacaguguccaccaugacugggccaccuggaaugaaucacgggguguguagcagagccaugauccuagcuagaaggagguucugguuucuaccucgggguccuccuagguuuucacugaccuguuucugacuugggguccuuggcaauggcaccuagccuguugaccacauugaugacaaaguucuucuccaaggugaaguugguguagccaauacucucagaacugucgaugacgaagaccacauccagggcaccacagcgcuucucacagucuggaaggguguucaggaugacagcauuagugaguuggaagugugaagauacuuagggcauggggcuggagagacugugagggauccauccccuccggcggccaugcacacauccugauguguugggccaacucaccgcagcauccacaggucucccucacauaggucaugacaucacauuccugaaagacaacccccauggguacauuuaggcagggcacaccuacuguuuccucugggcuuccauaggaaucccucacccugugucugcugaagcccaugcccauacauagaguagagcuggauacacacaucuccaacucuacccucugaucuuacccaugccaacuacacccaguaacucuucuccuauggccuuguccuuaccaacuugaccauggcugacuuugcccucugcacuggacuuaaccuuugccaaccuugauucaucuucugaccuugucucugccaacaucaaaccuguugacauuaacccuagucuacuaacuuugcccucugagcuucuccucugauuuugcucuggcuaacccucuguacuugaagcucuuggucuuugauuuuuagaagagagaaggacacucaugaacaggauccugauuccacaauaagugacaccuaccgugagaccagggucuccuggagggccggguucucccuggaggacaaaggacaauaguaaggggugaggcuucugaguccgaguugcuccugguacuaccacccaguacaugcugacccaugggcccacuaagggcagaaccaagaggcucaacauacauuagccuggcuggcucaggagcuaugggcuaaaggaacagaggugggcuuaccucagguccugggauuccucuuggcccccgagggccagguucaccagggggaccaggaucagccugaggagaaacagggaaguagguucaauaugguccugggaggucucucagcuccacaggaguauugaucccccugucucuauuaagaguauagagggcaugaaguacugcaucacccucuucaucccaagucuggcacugcccuagcaaugucuuuagcagucacuaucagagucucguaggcaagagagaguagaaggccaucgaggaacucaauacugggauaacucacacugagguauccaguggcuaucugggcacacuuaugugcccaaucugccuaccuaucuauccacuaccugucuguccaccuaccaucccuucacugaacugccaacccccacccaucuguccacccaccucaucugcuauccacuguuauaugugaugucuugcccucucuguucuucauguacccacaugaccaucaugugccagggacuuggaaaugaacaugacaugggucuagccugugccacugagcccacagggggugcuggcugaggaaggcugcauagaauagaggaggcuuuugagccugaccauucccuucaagggccuggugccagggaggcuggauguuucuucagcgaucuuaggcccuccucaugugccagcccauugcccaggacauaggauggugacacucacuggcuccccuuuaucucccuuccguccggguguuccuuucagaccaaagucuccucggccucccugugacacaagacacacguuagcugugggcaguggguggcacacacacccgugccccacacuaugagaccgaccuuccucagacaagcagggauucagaagugccacagaaaccauaugcagaguugagcuaagaguugaguuaaggaugcugggcauuuucagggaagcucuggguuuugcuuggaaaaagacacaacacaggcuaccaccaccuaaagcccacccaggggcccauuguagccaguccuggggcaaggaaaugaccaaaagauuguucccauagcagacaaggcaugcaggaaaaggcugauuaugauaaaacaucugaguaccucagggccugguggaccgggcucgccuuuuucacccugugaagcaagcaaaggcuuguugacaaguugcucagucacagacccuaaaucugugacaggcagagaagcccaccuuggagcuaagaucaccccucaugauuucuuggauaucagaauucauauaggagcucacacacaccucagguaaaggccacugagcccauacaugcugagccaugcugacccaauccugggcucugucugaccccugguauauccuggugcuggcuggauuuaccuuugcaccaagugacaggugacucacauccccucucuauuccuaaucccacauggagggacuuuaaaagccuugcuccuucucugcagguuuuuccugggaguucuuguccccugccagacuuacgggugucccucgaggucccggguagcugaauccaggccuuccaggaucgcccugaaggggaagguugaguuagucggaauggaugaugagaaggaaguauucaaacagugaaggguguuugguguaggguggggggcagaggcuaugagccuagccuugccugcccaccucugggaugaaguguaugugaacgaaguaccagauaacucagggccuguggcacacacuagaaggccacgggcaccaugcaguacccauaugacuguccaucccucaggacccugucaucuuuccaggaaggucauugcuggggagggcagaagagaggcacaugguccauuacugcucuccacucucagaggcccagccucgaugcccuggccgauucuuaucaggagcugggaacaggaggcccaagggaggucucucuccuccaggcgcccaagcuuugccugcugcccucuuggaggucaccucuacaggugacugccuuggacccaugucaagaggaaggauauaccuuggggcccggcuguccugaauccccucgagguccggcgucaccagggucuccucgagaucccugagggcaagaaagaaaucagagguggccuagucaccugaaauggugaugacccuaacuugauuugaccagcucugagaagauugcaggucuggguagcagagccaccaccuugccuggggcuaggaacugggaaggguagagaguagguagacaaggguuuguaucggguaggauggggggugggauacggggucuggggcagaguggggguugauggaacaggguuggaagugggagggacuuugggaggcagggugaaaagcggguggugagaggguugggggucuaggguagaguguggaguggguggaggguuggagagagagaggaguggggagaucaggaggcaggugaggaguggauggggauaagggguagggugaggagcugaugaaagauuaggggaagaggaaagauggagagucauggccaagguagggaacaggugggagggguggagccaggguggagaaugguuagcgguugagaacaggguaagggguggaugggagcccaaggauagggugcucucguggccucaaggcuucaagggucccgauacucaccugcuuuccuggcucuccaagagcccccugggggccucuggguccaggcaaaccucugucucccugcaaagaaaggagauggggguaagaggaugggaugccguggcuuaauacugcacccacagaguccuaacaucagcccugugggcgcuaugguucagggcugggaucaggcugcacuggacccacuaaccugccauggacuugccuuggcugggucugagagaagguuaagagagguacugggcacagaucucuucagcucccuuccuccacacacuuccuguccuggguguggcccccuccaccccagccuuugcuaccuccuguccuggguauagcccuccucccuggcaucugccaccuucugcagagccuaccuuggcuccuuuacugccaacuucuccagccaggccucgaggccccucaggaccagggucucccuaggagaagacaggucuggugagauuuaggucagggagcagcucugaaucaucccguccagaagcaguaucagagggugggugagggcaggguuagagggauaaguuauucaaccccucagaacagucauacucuccagaccuaccgccucgguccuccugaggccacucuguuguagggacccuaacuagaucagaggaaggcuccuccaccagcgaucuguggcagugacagccuauaggaauguguaugucugcaguggggaugcugcaagauggagcagugugcagccucugucgcuauacacagcaggcauuggaugggcggugcccuuccagaagccucagggacaguugggaguggaagccugccugucugaggcuuacccucucggacagugcagugacccccaccccauccucaucagugguaagacugcagaguuuuguucuucuggggggaaugaagauggaaucagcccaccagcuucauggagacauuccagaguagaaaccuuugcuccuuaaaacaccuuaccuucucucccuuuggaccaucgcugccggggccgcccuuggucccggggucuccucugcgucccuggaugaaggaggaaugucacugcugggagggccauguggaucacuucuagcccuccauuaggacccugagccugguagucccuccugauauccgucuggagcuguggcucuaucuucgcacuaauauuauguugguuuugccccagucaaagacucagguguguguguagguguuucuggucaggcuguaagcccuggccaauaacugggacggaucuuggacugccagguggucauuccugcucccucccugucugggccuccucagacugucucuucuaaggauuaacccuggggugaggucccuacccugaguuuagucuugggggagccuuguaggaggggcuagggaaaggguugguugggaauagagggcucuguguauccccagugccauuugucaauggcuucuucucaacucugcugcccaagguggugaggccugguccagguguagaggugugugggugcagaauaaacucacaggcucuccuuuugguccacgggggccaggcccucccuugccuccuuucacucccgggcuuccaggggcuccguuguugccuugauaucccuguguaaggcagggacaacucagcauggcugggagcauggcugaguaauaugcaggauccagugugcaauggcuccauuaaccugggcuccccaucccuccacaaugcaugagggcauaggacagugucaaugguauccugggcaaccgcagugagcaggccagggacucaccuugcuuccuuugucuccaggaucuccuggugguccccugcguccugggcggccagagucccccuggaaggguugggaggugacaucagcuuuguuuuauagacagggacugggcaguggggcuggaccaucuaaguucuccuguguucuuggccuacacaggauuccagguauaacggggccuuugccuugcuaaggugcccggaagaccaacccaugagcccaguauaaagucugcuggacucugggaaaggagcccuuugcgaggcacuggucagagugggauguagcuuagguaggggcucaggggagaagagacagggacaccuaccccauggcuaaaggucuagggcuaucaagggcaaaagggucaccagggccucaaggacuaggaaaugcugugaacagugacuagaacauccuucaaggucucugcaagcuuggaaggggaggugggagagcuaguacaugugaccugcucuuaaauagugaacgcgaggccaggaccucccugcuaggcuucacauucugggguguccccucacccuaaucuaagauggcacagggacccccaaagcagggauuccugagggugguaacccagccggcucucuagagcuguuucuggccauguccuuaccuuggcacccuggucuccucgcucgccugggcuuccagcuucuccaggguauccaucggggcccugugggaggugagaaaggcuguugggccauuugagucccugcuaagugcugccacagguagacugugcuccccucaagccaggaacacugacauggaguggggaccccagcgccugugagauccuggcucaacaagagcuaugucuaagcccgggcaucaaagauucagaacuccccagccucaggccaugagcuuaagccuggccuggucaccauacauguccaaggguuggcucaugggcuccuaaggggguggguugugaccccaagacuagcagagcuccagccaugggugagggucaagcagggagagguugggcagaagagagaauccaaagacuugcuuccaacucugccugguauccauguccccugaaugacuucucaugucaugugauaggcagugaggaugggggcgauacucacccgacuuccggggucucccuugcaaccaggaggcccaaugcggcccaguuugcccugaaaggagaaggcggaauaucagaguacagaucugggguccaugcaagucagugacaguaccacuuaggcccuuguaugacaaugucuagguuggcugcacccuagacagagcacaggaaggcgagaugauucucccaucuugcuucauucugucuccauggagacagaauccuaggaccaggccagguucguggguguggaauauccucaccaugcauguguguauauguuuauacaucuacauccgugugaauauaauuaugugcauguggggggggggugcacagaggugucuggcugcuggggugggguuagugacuaccuucuguccaucuguuccauucuugccagcuaggccaggcgcucccuggagaagaaagaaaagacgcuugguuaaucucgauccuuguuccuucugagcagcaaggcagggcacauccauccuuucagacuuaccuuccgaccauccgauccaaauucacccugugcgggaggaaagcaaaguguugguugaggucccaagcaucacagacacugcuggcuuuggggugcaaacaaagacacucagcccaaacaggagggcagaacuagaccuaggcuccucacugcagcgaggaaccuaggucugccuccaggagccgcugacagguugcugggcuaucaggugcauggaauggcuauccauguccugggccacaucaugacuuaccuucucucccuugaagccaggcacacccugagggcagaaggagaagacaagaguguuaccaagggcaagucagcagguucaacgaagccccagauaaacagauuugaaaggcagccaagacccagcauugagggugcacaccauggcugcguuaugccuggaacauacguggguucugaaaacaugcaugacagaggaggggucaggauggauacauaguuuuggggugaccuucaagcuguagagguguugcucuucuuuggcaacuggggcuggucugugaauacccccaagggcaggcagcaugaggaacugaccccaaacugaccucccucccuuccccuucccccauugcagcccuggguagggaacuugccuucggucccgggaauccaauggggccuucgaugccggggucucccugugaagaaggaacaaagaaccuugggugugauuccagcccugggugcagggagggugguuaggggucaaguccaggggccagaggucagaggccaugcggggaccuuaccugucguccuuucuguccaggcucuccugguucacccauguugcccuuggcacccuaaaagcagaggauggggagaagaguaaauugaggcacgggaacccugucaucuccugagagaggugguauggcaaaagccguuggucccucuccaggcuggaacaucuuggaaugggaucauuuuccccagagggccccgguggcccccaucaggcucugaugacuucucugagccuugauagacagcucuucaugaugccacuuugaaaaugggcagagcagcuucucaucgggggaugcuggugcugggaccucuguaccacagcccagaccacacucauggggcuaugaauuccucaggaaugggauggguguggguaagggguggauugaaggaacuagaaagauugggucuuggaaaaccacauaacauuagacucccuaggaauuuaaguuuuaagcuuauauccaggucuuacuaaauaaaugcgcuuguuuauuaauauucuuucacuuuaaaugcaaaaggauggaggaaaaggaaaaaagaagccaugagguaaaagauagaggagcagggagaucaagcagaacaaguagucagauaucuuagugggucucagcugugcucugcccggaaggacccuguggcauccgccucccagggcccagaucaccgcuccgcuguaugagugauaagguaguggcaaauucauucccagcugucacagggugggcauucuuguggccaggaacagcuagugcagaagauaucucagcagccaccuacugcuuucgaagcccucagugcacuagcaaaacccacuucaggugacuggucucagcuucuuccuacccuucagguuucugacacucgaguccuuaguuucagacaccgugguagugaaguuggagaggauuuauucuacucagcucuguuagaaaaacaucaggcaauccaagcagaguccuuacagccuagcauccagucagcugccaaguggaugccuuguguuaaacggcaacuguuucacugacagaaauguauuguauauacuauuuccccacaugagcaugcuugcuuacuucucaaauguauuuuaaguggcauauauuaauaguuuuuuuaaacaaaguaaaacauuuccuacuucucuuaaaauaucauuaaaaaggaaacggauaaaaucagaauuuuagucucuccaaguuuggaagugcugaggccauccacggccagcuggcuuuuaacguggaauuuaugcaggggcuuccugaaacagaagccauguggucuccaggcaucuuaccuucuguccucgguaacccuuggguccgugggguccaggaaucuccaggcagcucaccuuguagcacugaaaugagguggaaagacagcaggucugguuagaaggacagguccccacuuggguauggacugggaacagguauaaccuuggauucucagaggaaguuccuaaacacuuauacagacaagcaaagcuggaaugaaggaucagauacaggguacuagacaaaugggagccagcauuuaguuaaaucaucuagccacauucuggauaagugaggcugaguuaaacauucuggauaagugaggccaagucaaacaaugacaggcaguaagaagaaguaagaagaaccaaugagcucuagccacggcugugcaccacuuauauuauuugaacugauuugccauucuuuuaaguagcuuuucuagguuggauguuuccacagaaggaguagggagggacuuuggguaccucaucccuuuucccacagggacacaguaccuuccaaggcuguaggaccccucaagacaggcacaugguuucuagucuggguuggauaaagcuccccacucugguacaugccucaguuucuucagaagucaugugaccugccccccccccccaucccagggaggaacuaaaucgccuggguuugacuggaugagacuggaguuucacccaagcucaagaguuucaggccagacagagcagggacacuucaacucugcuucuguucugguuuguucaagcaaggcccuagagagccaggagcagggcguugguccuccgcugggucaacagucuugguugccaccagguagcauagguuguguuguagugacaggggaacucaccucuccauaggcuucauguuucugcagaaaacagagagacugagauuagcuugagccuagggaccugugugccaccuccugagucuggguggggaucauggacuugagaggacuugaccccaaucucccuuaacugacguauccacagagggacacacugaacucugauggggccaccuuggugggugggcagcauccuuagccucugccugaaccacaggugcuuaccaugaccuugaugaugcgguugaugguguccuggucaaucucgguagagucgggucgcaugguggcguaguuguuacgguagagcucauguggagaguuagcgaugucccucaggccuuguucguuuagguuccuguuaggggccacagcgaagagccggaugcccucuucacgggcacgcucagccugcaucuugaugcccccacacggacugcccgugacguggccgucagugaugaccacggcgaaguugaccacccccuugccuacgugcugccggaucugcugcgucauguuagccaaugcacagucagugaaggugccccugcggaaggagcggaugccuuguaggcucuuagugaaggaggcccggucacugcccggugggcugaacaccuccacuugguccgagaaguguagaccaccguagcgccagcucagggccaccugguccagguagaacucguucugcagcuggcugauaaacugcgguacgaacugcugcauaugauagagcaggcugucugucggggacugcauggccacgcucucugagguguccaacacgaaauacacguugacugggcagucggccuucucuggagguggggagcaggguagacauuggauccaucaggguaugcccauugggggcuaggaugugagcccacccuuacccuaugaguaccacucucucccauccagguaccuggacaauuguuguuccuuucagugguggagaugucuggugagacagcuuccugcuccuggggugagauggcuuccugcugcugggcauggaggacccccaagagucccccaaucaggagcacagaaagaggacccuggagcaucuugauaguagucaugugcccugauguccugcaaaaagagaaggggccauuauagacgcccccaauauacaucacugcccuuccagcaugggaugcacauagcuuguaaucccuugaggaaauagggaccuccaugccccaugugguugccccucacccacuggagaaucaugccuuuccaacucucuguugucugcagagcucaguacuaggcuggauucaaacagacagcucuucucucuucccugaaguugggguacacauagaugagcccauuuguguguguguugggggcacuaggaagcauugucucuucacacauccuacuccaggaucuucacugggaacaggaggaaggagacacaugcccauuucgcucaggcaguccuacccucagugccggacccugggcauaucccucucccuguagcuugguuccccuucacguggggcauuaguauggacugaguggagccaggucuagucagacacacugauuuuuuuuuuuuugugacuucccaucagaugcuggcagauugacggcagcucuuugcccacugugggugcaacgagaccgcuagacaagagguaacacagacacucuagagugauggugacuaugcuccuggagagacucuguccaaaccuguuaucugggaaauuacaucagcaagcacuucagauuucacacauuacauuauuauaguggaaaaaugaauggagccagugagcaguguauuugauauuaaggauggaagagaucaggugagacacacacacuugcaauuugggcaucuuagacaggagucacgaauucaagaccagcugggcuccauagcaagauccagucucaagcaaguaaguuuauuucaaaaagaugagauaaacuauaccggagugauuguugauacagaugguaagaacauccaagggacagagaacagaccguggaaaguauaacagacagucacagagaagacagguggccucaggagaaaccaagaaaugacagagggaccuuguguggaagaucaugaaagccccuuaucaccagggaaacagaauuaacuaggcacacucaugugaaguaugugaaguccaccaguuggcaaaucuaacuuguaauaagaauucuaaaacuaucugcauagggaaaaaaaaagcaacaacaaacuuuaggaaacaccuaaaggaaaagaaauggcaguuacagaggcagccgcaguuguuccaagauaaccuccaaucuucaccgccugguacucauaugcuaauggagucuucucauaacaaaucacaauggacaguggaacgacaacgcugugccgccuauguuugugaucucagcagacgggagauggagucaggggccucgagaguuggaggcaagccagagcuguagaaaaaggccccgucucauaaagcaaaacuaaagucaccaacauuuugauggaauauuacuggguggguagaauccuagaaccgugauacccaugagguauugagccuccuauugauagcuaauggccuucuuuguuucuuauuuuuaaauuaaggucugcuuugucugauguuagcauagcuacccccucucccucuggcuguuugcaugggaucucuuuuucccaucauggcacuguuaaccuuuuuuuuuuuuuuuucuucuuuagaucuaaagugaaucucuugcaaagaacaugaagugggguuguguuguuuuugguaaaguccacucugccgaucucugucucugguuugcagaauccaguuuuguuaaaagaaauuauggacaaagggugucccccaguuuugcauccauuuucucuaugccauacacauuuguguucccgaauuuucaaauuaccaucuauguguguuguuacagucugguugauuuuuuuguagcaaaauguuaaauacucuucucauuucuuugguauuuguuuacuuuuucgcuuggugguugcugagaacacuguauuuugguucuuaaacuugaaacuguuugaauguguacuaauuuaaugacauaaaaugucuccaccuuuaauauuucuguccccacuccuuucaguuaccaguaucauaaaacuccaccccagguugcagagacugcuugguguuaagaagcuguacugaccuuacaagaauacccgagugucuauguuagguggcucacaacuuccuguaacucuaacuccaacuccagaggaucuaugcucuuuucuggccuccauggguaccugcacucauaugugcaugcacacgcacgcgcacgagcgcgcgcgagcgcacacacacacacacacacacacacacaccacacacacaugcacacauacaugcacacacacauacacacacaaaccacacacgcaaugcacacacacauacacacacaugcacacacacauauacacacaccacacacacaaugcacacacacauacacauacaccacacacaugcacacacucauacacauacacacaaacauguacaccacauacacaccacacacauacacacacauacacacacaugcacauauaugcacauacacacacacaccacacacacaaauuuuaaaaccccauuuucacauaagugucucucaguaucuggauccaggaccucuccuagacacaaaagucugaugcuuaaauacccucuauaaaauaauauaguauuugcauguagcuuaugcauauccuccuguauaccugaaauuaucucuauguugcuguuaaugucaauuacaaugguaauucuauauaaauauguguuaugcaacauuuuaaaggcaccaacagggagcaaaggucuguagauacucacuacaggcacagcuuuauuuucaaucugugauuaaauuuauggaugugggaaaagugaauacagaaggcuggccauauaucauuucaaaacauaacuaaucuauauucuuuguuuuaacuuucuuuuuacuuuauguggauggguguuuugccugcauagauguaugugcaccacgugugugccugguaccuguggaggccagaagaggguguucaauccccuggaacuggauuuuacagacuguaaugagcugcuauguggguugcugggaaucgaaucuggguccucuggaagagcagccagugcucuuagccacugcuaagccaucucuccauccucacaacuaacauuuuaauauaucuuuuucuuaaauucuacagcaaagaaacuuugaaauuacacaucaaacaguaacacuagcuuuuaggcaaauaacuguuuuccuuuaaaacuuauuagcuuuucaaaucauguauagaacaaaacccagugcuacccucaauaacaguagcuuuuaacaguuguccacuguguuuuccuugucugagauccuccugucuuccuauggcugugaguuauuguccaucacccuccaugguaacccucaggauuuccuguaacccucuucucagggcagaugcuccugaugaugaauguccucggcuuuuguugaucuaguagugucuuuguuucuccuuuacauucaaggaacaguucugccagguagaggcuucuugguugauacuaguuugccuucaccacuuugccuauauuaguuaacccucugccucuggauucaagcuuugaaaggcaaucuuccaggaaacuuaucaaggaugcuuuguauuugacacaucguucuuacugccuuccagauucugucuuugggguuaaauuguaauagguuugaguguaggccucucugagcucauccugcuuggaguuuaagcuucuuggguguuuauauucauugauaaagcuugugcaguuugcccccagccccagauauuauuucuucaagcucucuacccccuuggcuccuucuccugagucucccacagugcacauguugcucuugaugaugcucuguggcccucugaggccuuauucacuuuucuugagaauuuucuuucugcuccacagacuugacaguuuuucacguucugacuuaaguucaccgaaccucucuucuggcugcucaaacaugccucagacucucucucuaguaagacuuucauuucaagucuguacuuuucauauuuuggguuuauuuuuaguuuuuuuuccuggcaccucaucgacacuuucauuuuauccauaaauuauuuucuaauguccuuuauaucuuccauuaguucuuuaagcauuuuaaagaugacuauuuuaaagucuuugucuaguagaccuaccagugggcuguucucauauacagguucuauugauuuauuucuucucuuuauuagccaagcacucuaccacugagucacguauccaccccuucuuucuucaucucucucucucucucucucucucucucucucucucuauauauauauauauauauauauauauauauauauguacauauauauauacugauuuacauauauauauauauauacugauauauaaaucuacugauuuuauagauaucuacuauaucuacauaucuauauauauacauagauauauagauauauacuaucucucuauauauagauauauagauauguacuauacacacauauacauauauauauauauauauauauauauauauauauauauauauauaugacaauucuuuucucuuccauucuggacgaucugucccucuucuuucacauucuuuccgaugguuuacugaaaaccagagauuugagccuaauaauggaguaacucugcaacccagaaucucugccuccgugcugauuugagguuuuaaaauuuugacucugauggcuacagacagccucugugacaagaaucagccugaaguagaacugugaaugugaggucuuccugggcucuuuccgagacgacccucccugggcacacacagcagcuuuccuguuuccugugguuccaucacugcuuuugaaugaaugacuccaacauggagacagaaaauaaagcagagaaugaaguuccagcccuuucauuacucgagaagucacuucauugagaggggaagcaauggaagacacaaaaaugcccaggucaauagcuuugcccagacagacacccuaaagaacaucuuagaucccaguggagccaaccuagagguuaguaacaaggggagacugggaccuccuagcauuguggaaauuaaauaccaugcucuuaaaauaaccaacaaguaaaaaaaaaaauacaagagaggcccauuggacacgcaaacuuuauaugccccaguacaggggaacaccagggccaaaaagggggaguggggguggguggguaugggggacuuuugguauagcauuggaaauguaaaugagcuaaauaccuaauaaaaaauggaaaaaaaauacaagggaaguaagaaaacacuugaaacgaauaaaaauuaauaagacauuucuaaaacauagcagaaucauuucuaagaggagaagcucacagcuguaacagcuuacaccaaaccccccccccccaaaaagagcucagaucaguaaccuaguguacaauugaagggacuagaaaaggcacaacagaugcauccaugccugucagagaauaauagagaugaagaaaggacacacaagacacaaacuagaaaaaaaauggagaaagucuaugaaaugaaaccccauaaauagaaaacauaaauauuugccuagaucaacaaaaacuuuuucgaagaaaacucaaauuaauuacaggugaaaguugaaaccuaauagccaguuugauacaccuauuuaauauuaaaaacaauugcagcacaggauuggggguguggcucagugguacagcauuugccuaacaugugcaaguaaguugaaacuugucuuagguuugaaucugggugcuugagugugcauguacgcacgcgcgcacacacacacacaccaugaaaccaaccaauuagaaaaugacaagcauuggggauauaaaggaauuugggacccugaguacagcugaugagaauguaagcacauuggugucagaacccuggaggugucuccaaagauuauaaacagaacugccaaauaauauaacuccuccauuucuggguacaucuuuauuuauucaaagaauauauaugcauauauauacacacauacacacauauauauguauguauacacacacacauauauauguauguauacacacacauauauauguauauauguauauauguauauaugugugugugugcgcacgcgcgcgcacacacacacacacacacacacacaccccuuucccuccucuccagggucucaccacauagcuaaguagaacaaaccucaagcauugcacaccacaauggguagauuagcagagagccagagaguagauggcaugcguucuguccagcuucucugguggguaacgggcaaugaguggaaccugggccccucagaacagaacuccccacuccuuaugccaguucccugccguguggacuaggaagcugccccuugucuaucuggcauuugugucuuggaucuccagugggcacucauggagaugcugcccauaguuuggaccagccaguacugagggcagaggcuggguuccuagguuugcucaugugcaguaccccuagguuugcucaugugcaguggggguucuagacucucagauuucaugaauggacaaaagagacacaacgaggcuggcuggauucugagagucauaucaaagaaccuccgaugcccguagcuucccaugcccugccgagagaccuccuuagaggccucucuaaagaagagcucacuggauuugcuggcaaaucacugcuggacaggaaggaacccacccuccagcacacaaacugcccaaguggcaguagucuugacuacuucuuccaaggucugugcuggcuccccaacaccauuucacugggaaacgcacuguucccaagacugaagcacagcuuucagaauggaugcucuaaaccccuauguucaaccccucccaauugguaucaccuguucccugggacccuagguccaagcccagucucuggccccaccuuuucucucuaagggaucccagacaccuguguaaccuccaguuucugugagaugaagcugcaaaugcccuguuucuuuuuuuccuuugcuaugugugugcuagccucaagagccagaacuauuuaacugggggaaggggaggaacccagcaacuuaaucuggaccuuaaauguuccuuguugguaccuugucccucuauggcacuuggcuccauguccucagaugaguauggagauacccccagaauacccaggcuucacgagggggcuguguugcugucuauaggagaggugucucugagguugcccacuggaguccccaagggacuggagugcccaagggagucucagggcuaggauagagccaagagugacagacuuuauuauuccuggguccacccucaucuuuaugauuccugccuggucucuccuuaagcacagugggaguaccucgagauggcgagguguccccuugagagcaccuggcuagcccacugcugggaccugagacucccuucucugccucccgcagaguacccuugaaguccaucugaggaacuaguucaaguggcucuguuaccuuccuuccccaugaagacuacccuucuuccuuagggccuacggagaggcuaacaacggacugugugcagguucaagucacagcguauuuucccauugaggcaauuuagguuccuuaacccuugggagacaacucagaccugcuagcaauggccaugggucugaccagaugugagacacucugaggacuggggaaggagcagggaucuggucugucaguggugagcagaaagcuguggagucuagaauaagaagccugcaccccaaccaggcucugucgaacagaggccuaggggccaccuggagacuagaaccuggggcaggaccuucgguuuggguagaacugugcucaccuuagaccccugaggugcagcccccgaauccuguucccccuuuucccgcgugucccagcuggacaccaugcgaagaagcuuaccuggcuuggagaagaugccuggguacuucccgaggacagcccggguccugacggcccgaggugcgggcgccgaguggguaggagggaggggacccaggcgcggcccgggacugaacgggaggggaccaagccaggggccucccacuuuaacucugucccgggcgggcggaugccuggaaaacucgaccgcuggggggcgcugcggccccgcggaugggcggggucagcggguggggcugcuggacggacuaagaugaagcuggggaaugagcugggggaggggaggaaaggaaggcgaggggagggaguggccaggacacgcagcaggguuggagcuggaccaucucugugcuguagugccuggugacuuuuuuauuuuuc

SEQ ID NO: 5582 - RNA, 29805 nt, Mus musculus
gaaaaauaaaaaagucaccaggcacuacagcacagagaugguccagcuccaacccugcugcguguccuggccacucccuccccucgccuuccuuuccuccccucccccagcucauuccccagcuucaucuuaguccguccagcagccccacccgcugaccccgcccauccgcggggccgcagcgccccccagcggucgaguuuuccaggcauccgcccgcccgggacagaguuaaagugggaggccccuggcuugguccccucccguucagucccgggccgcgccuggguccccucccuccuacccacucggcgcccgcaccucgggccgucaggacccgggcuguccucgggaaguacccaggcaucuucuccaagccagguaagcuucuucgcaugguguccagcugggacacgcgggaaaagggggaacaggauucgggggcugcaccucaggggucuaaggugagcacaguucuacccaaaccgaagguccugccccagguucuagucuccagguggccccuaggccucuguucgacagagccugguuggggugcaggcuucuuauucuagacuccacagcuuucugcucaccacugacagaccagaucccugcuccuuccccaguccucagagugucucacaucuggucagacccauggccauugcuagcaggucugaguugucucccaaggguuaaggaaccuaaauugccucaaugggaaaauacgcugugacuugaaccugcacacaguccguuguuagccucuccguaggcccuaaggaagaaggguagucuucauggggaaggaagguaacagagccacuugaacuaguuccucagauggacuucaaggguacucugcgggaggcagagaagggagucucaggucccagcagugggcuagccaggugcucucaaggggacaccucgccaucucgagguacucccacugugcuuaaggagagaccaggcaggaaucauaaagaugaggguggacccaggaauaauaaagucugucacucuuggcucuauccuagcccugagacucccuugggcacuccagucccuuggggacuccagugggcaaccucagagacaccucuccuauagacagcaacacagcccccucgugaagccuggguauucuggggguaucuccauacucaucugaggacauggagccaagugccauagagggacaagguaccaacaaggaacauuuaagguccagauuaaguugcuggguuccuccccuucccccaguuaaauaguucuggcucuugaggcuagcacacacauagcaaaggaaaaaaagaaacagggcauuugcagcuucaucucacagaaacuggagguuacacaggugucugggaucccuuagagagaaaagguggggccagagacugggcuuggaccuagggucccagggaacaggugauaccaauugggagggguugaacauagggguuuagagcauccauucugaaagcugugcuucagucuugggaacagugcguuucccagugaaaugguguuggggagccagcacagaccuuggaagaaguagucaagacuacugccacuugggcaguuugugugcuggaggguggguuccuuccuguccagcagugauuugccagcaaauccagugagcucuucuuuagagaggccucuaaggaggucucucggcagggcaugggaagcuacgggcaucggagguucuuugauaugacucucagaauccagccagccucguugugucucuuuuguccauucaugaaaucugagagucuagaacccccacugcacaugagcaaaccuagggguacugcacaugagcaaaccuaggaacccagccucugcccucaguacuggcugguccaaacuaugggcagcaucuccaugagugcccacuggagauccaagacacaaaugccagauagacaaggggcagcuuccuaguccacacggcagggaacuggcauaaggaguggggaguucuguucugaggggcccagguuccacucauugcccguuacccaccagagaagcuggacagaacgcaugccaucuacucucuggcucucugcuaaucuacccauuguggugugcaaugcuugagguuuguucuacuuagcuauguggugagacccuggagaggagggaaaggggugugugugugugugugugugugugugcgcgcgcgugcgcacacacacacauauauacauauauacauauauacauauauauguguguguauacauacauauauauguguguguguauacauacauauauauguguguauguguguauauauaugcauauauauucuuugaauaaauaaagauguacccagaaauggaggaguuauauuauuuggcaguucuguuuauaaucuuuggagacaccuccaggguucugacaccaaugugcuuacauucucaucagcuguacucagggucccaaauuccuuuauauccccaaugcuugucauuuucuaauugguugguuucauggugugugugugugugcgcgcgugcguacaugcacacucaagcacccagauucaaaccuaagacaaguuucaacuuacuugcacauguuaggcaaaugcuguaccacugagccacacccccaauccugugcugcaauuguuuuuaauauuaaauagguguaucaaacuggcuauuagguuucaacuuucaccuguaauuaauuugaguuuucuucgaaaaaguuuuuguugaucuaggcaaauauuuauguuuucuauuuaugggguuucauuucauagacuuucuccauuuuuuuucuaguuugugucuuguguguccuuucuucaucucuauuauucucugacaggcauggaugcaucuguugugccuuuucuagucccuucaauuguacacuagguuacugaucugagcucuuuuugggggggggggguuugguguaagcuguuacagcugugagcuucuccucuuagaaaugauucugcuauguuuuagaaaugucuuauuaauuuuuauucguuucaaguguuuucuuacuucccuuguauuuuuuuuccauuuuuuauuagguauuuagcucauuuacauuuccaaugcuauaccaaaagucccccauacccacccacccccacucccccuuuuuggcccugguguuccccuguacuggggcauauaaaguuugcguguccaaugggccucucuuguauuuuuuuuuuuacuuguugguuauuuuaagagcaugguauuuaauuuccacaaugcuaggaggucccagucuccccuuguuacuaaccucuagguuggcuccacugggaucuaagauguucuuuagggugucugucugggcaaagcuauugaccugggcauuuuugugucuuccauugcuuccccucucaaugaagugacuucucgaguaaugaaagggcuggaacuucauucucugcuuuauuuucugucuccauguuggagucauucauucaaaagcagugauggaaccacaggaaacaggaaagcugcugugugugcccagggagggucgucucggaaagagcccaggaagaccucacauucacaguucuacuucaggcugauucuugucacagaggcugucuguagccaucagagucaaaauuuuaaaaccucaaaucagcacggaggcagagauucuggguugcagaguuacuccauuauuaggcucaaaucucugguuuucaguaaaccaucggaaagaaugugaaagaagagggacagaucguccagaauggaagagaaaagaauugucauauauauauauauauauauauauauauauauauauauauauauauguauauguguguauaguacauaucuauauaucuauauauagagagauaguauauaucuauauaucuauguauauauauagauauguagauauaguagauaucuauaaaaucaguagauuuauauaucaguauauauauauauauauguaaaucaguauauauauauguacauauauauauauauauauauauauauauauauauagagagagagagagagagagagagagagagagagagaugaagaaagaagggguggauacgugacucagugguagagugcuuggcuaauaaagagaagaaauaaaucaauagaaccuguauaugagaacagcccacugguaggucuacuagacaaagacuuuaaaauagucaucuuuaaaaugcuuaaagaacuaauggaagauauaaaggacauuagaaaauaauuuauggauaaaaugaaagugucgaugaggugccaggaaaaaaaacuaaaaauaaacccaaaauaugaaaaguacagacuugaaaugaaagucuuacuagagagagagucugaggcauguuugagcagccagaagagagguucggugaacuuaagucagaacgugaaaaacugucaagucuguggagcagaaagaaaauucucaagaaaagugaauaaggccucagagggccacagagcaucaucaagagcaacaugugcacugugggagacucaggagaaggagccaaggggguagagagcuugaagaaauaauaucuggggcugggggcaaacugcacaagcuuuaucaaugaauauaaacacccaagaagcuuaaacuccaagcaggaugagcucagagaggccuacacucaaaccuauuacaauuuaaccccaaagacagaaucuggaaggcaguaagaacgaugugucaaauacaaagcauccuugauaaguuuccuggaagauugccuuucaaagcuugaauccagaggcagaggguuaacuaauauaggcaaaguggugaaggcaaacuaguaucaaccaagaagccucuaccuggcagaacuguuccuugaauguaaaggagaaacaaagacacuacuagaucaacaaaagccgaggacauucaucaucaggagcaucugcccugagaagaggguuacaggaaauccugaggguuaccauggagggugauggacaauaacucacagccauaggaagacaggaggaucucagacaaggaaaacacaguggacaacuguuaaaagcuacuguuauugaggguagcacuggguuuuguucuauacaugauuugaaaagcuaauaaguuuuaaaggaaaacaguuauuugccuaaaagcuaguguuacuguuugauguguaauuucaaaguuucuuugcuguagaauuuaagaaaaagauauauuaaaauguuaguugugaggauggagagauggcuuagcaguggcuaagagcacuggcugcucuuccagaggacccagauucgauucccagcaacccacauagcagcucauuacagucuguaaaauccaguuccaggggauugaacacccucuucuggccuccacagguaccaggcacacacguggugcacauacaucuaugcaggcaaaacacccauccacauaaaguaaaaagaaaguuaaaacaaagaauauagauuaguuauguuuugaaaugauauauggccagccuucuguauucacuuuucccacauccauaaauuuaaucacagauugaaaauaaagcugugccuguagugaguaucuacagaccuuugcucccuguuggugccuuuaaaauguugcauaacacauauuuauauagaauuaccauuguaauugacauuaacagcaacauagagauaauuucagguauacaggaggauaugcauaagcuacaugcaaauacuauauuauuuuauagaggguauuuaagcaucagacuuuugugucuaggagagguccuggauccagauacugagagacacuuaugugaaaaugggguuuuaaaauuugugugugugguguguguguguaugugcauauaugugcauguguguguauguguguguaugugugugguguguaugugguguacauguuuguguguauguguaugagugugugcaugugugugguguauguguaugugugugugcauugugugugugguguguguauaugugugugugcauguguguguaugugugugugcauugcgugugugguuuguguguguaugugugugugcauguaugugugcauguguguguggugugugugugugugugugugugugugugcgcucgcgcgcgcucgugcgcgugcgugugcaugcacauaugagugcagguacccauggaggccagaaaagagcauagauccucuggaguuggaguuagaguuacaggaaguugugagccaccuaacauagacacucggguauucuuguaaggucaguacagcuucuuaacaccaagcagucucugcaaccugggguggaguuuuaugauacugguaacugaaaggaguggggacagaaauauuaaagguggagacauuuuaugucauuaaauuaguacacauucaaacaguuucaaguuuaagaaccaaaauacaguguucucagcaaccaccaagcgaaaaaguaaacaaauaccaaagaaaugagaagaguauuuaacauuuugcuacaaaaaaaucaaccagacuguaacaacacacauagaugguaauuugaaaauucgggaacacaaauguguauggcauagagaaaauggaugcaaaacugggggacacccuuuguccauaauuucuuuuaacaaaacuggauucugcaaaccagagacagagaucggcagaguggacuuuaccaaaaacaacacaaccccacuucauguucuuugcaagagauucacuuuagaucuaaagaagaaaaaaaaaaaaaaaagguuaacagugccaugaugggaaaaagagaucccaugcaaacagccagagggagaggggguagcuaugcuaacaucagacaaagcagaccuuaauuuaaaaauaagaaacaaagaaggccauuagcuaucaauaggaggcucaauaccucauggguaucacgguucuaggauucuacccacccaguaauauuccaucaaaauguuggugacuuuaguuuugcuuuaugagacggggccuuuuucuacagcucuggcuugccuccaacucucgaggccccugacuccaucucccgucugcugagaucacaaacauaggcggcacagcguugucguuccacuguccauugugauuuguuaugagaagacuccauuagcauaugaguaccaggcggugaagauuggagguuaucuuggaacaacugcggcugccucuguaacugccauuucuuuuccuuuagguguuuccuaaaguuuguuguugcuuuuuuuuucccuaugcagauaguuuuagaauucuuauuacaaguuagauuugccaacugguggacuucacauacuucacaugagugugccuaguuaauucuguuucccuggugauaaggggcuuucaugaucuuccacacaaggucccucugucauuucuugguuucuccugaggccaccugucuucucugugacugucuguuauacuuuccacggucuguucucugucccuuggauguucuuaccaucuguaucaacaaucacuccgguauaguuuaucucaucuuuuugaaauaaacuuacuugcuugagacuggaucuugcuauggagcccagcuggucuugaauucgugacuccugucuaagaugcccaaauugcaagugugugugucucaccugaucucuuccauccuuaauaucaaauacacugcucacuggcuccauucauuuuuccacuauaauaauguaaugugugaaaucugaagugcuugcugauguaauuucccagauaacagguuuggacagagucucuccaggagcauagucaccaucacucuagagugucuguguuaccucuugucuagcggucucguugcacccacagugggcaaagagcugccgucaaucugccagcaucugaugggaagucacaaaaaaaaaaaaaucagugugucugacuagaccuggcuccacucaguccauacuaaugccccacgugaaggggaaccaagcuacagggagagggauaugcccaggguccggcacugaggguaggacugccugagcgaaaugggcaugugucuccuuccuccuguucccagugaagauccuggaguaggaugugugaagagacaaugcuuccuagugcccccaacacacacacaaaugggcucaucuauguguaccccaacuucagggaagagagaagagcugucuguuugaauccagccuaguacugagcucugcagacaacagagaguuggaaaggcaugauucuccagugggugaggggcaaccacauggggcauggaggucccuauuuccucaagggauuacaagcuaugugcaucccaugcuggaagggcagugauguauauugggggcgucuauaauggccccuucucuuuuugcaggacaucagggcacaugacuacuaucaagaugcuccaggguccucuuucugugcuccugauugggggacucuuggggguccuccaugcccagcagcaggaagccaucucaccccaggagcaggaagcugucucaccagacaucuccaccacugaaaggaacaacaauuguccagguaccuggaugggagagagugguacucauaggguaagggugggcucacauccuagcccccaaugggcauacccugauggauccaaugucuacccugcuccccaccuccagagaaggccgacugcccagucaacguguauuucguguuggacaccucagagagcguggccaugcaguccccgacagacagccugcucuaucauaugcagcaguucguaccgcaguuuaucagccagcugcagaacgaguucuaccuggaccagguggcccugagcuggcgcuacgguggucuacacuucucggaccaaguggagguguucagcccaccgggcagugaccgggccuccuucacuaagagccuacaaggcauccgcuccuuccgcaggggcaccuucacugacugugcauuggcuaacaugacgcagcagauccggcagcacguaggcaaggggguggucaacuucgccguggucaucacugacggccacgucacgggcaguccgugugggggcaucaagaugcaggcugagcgugcccgugaagagggcauccggcucuucgcuguggccccuaacaggaaccuaaacgaacaaggccugagggacaucgcuaacucuccacaugagcucuaccguaacaacuacgccaccaugcgacccgacucuaccgagauugaccaggacaccaucaaccgcaucaucaaggucaugguaagcaccugugguucaggcagaggcuaaggaugcugcccacccaccaagguggccccaucagaguucagugugucccucuguggauacgucaguuaagggagauuggggucaaguccucucaaguccaugauccccacccagacucaggagguggcacacaggucccuaggcucaagcuaaucucagucucucuguuuucugcagaaacaugaagccuauggagaggugaguuccccugucacuacaacacaaccuaugcuaccugguggcaaccaagacuguugacccagcggaggaccaacgcccugcuccuggcucucuagggccuugcuugaacaaaccagaacagaagcagaguugaagugucccugcucugucuggccugaaacucuugagcuugggugaaacuccagucucauccagucaaacccaggcgauuuaguuccucccugggauggggggggggggcaggucacaugacuucugaagaaacugaggcauguaccagaguggggagcuuuauccaacccagacuagaaaccaugugccugucuugagggguccuacagccuuggaagguacugugucccugugggaaaagggaugagguacccaaagucccucccuacuccuucuguggaaacauccaaccuagaaaagcuacuuaaaagaauggcaaaucaguucaaauaauauaaguggugcacagccguggcuagagcucauugguucuucuuacuucuucuuacugccugucauuguuugacuuggccucacuuauccagaauguuuaacucagccucacuuauccagaauguggcuagaugauuuaacuaaaugcuggcucccauuugucuaguacccuguaucugauccuucauuccagcuuugcuugucuguauaaguguuuaggaacuuccucugagaauccaagguuauaccuguucccaguccauacccaaguggggaccuguccuucuaaccagaccugcugucuuuccaccucauuucagugcuacaaggugagcugccuggagauuccuggaccccacggacccaaggguuaccgaggacagaagguaagaugccuggagaccacauggcuucuguuucaggaagccccugcauaaauuccacguuaaaagccagcuggccguggauggccucagcacuuccaaacuuggagagacuaaaauucugauuuuauccguuuccuuuuuaaugauauuuuaagagaaguaggaaauguuuuacuuuguuuaaaaaaacuauuaauauaugccacuuaaaauacauuugagaaguaagcaagcaugcucauguggggaaauaguauauacaauacauuucugucagugaaacaguugccguuuaacacaaggcauccacuuggcagcugacuggaugcuaggcuguaaggacucugcuuggauugccugauguuuuucuaacagagcugaguagaauaaauccucuccaacuucacuaccacggugucugaaacuaaggacucgagugucagaaaccugaaggguaggaagaagcugagaccagucaccugaaguggguuuugcuagugcacugagggcuucgaaagcaguagguggcugcugagauaucuucugcacuagcuguuccuggccacaagaaugcccacccugugacagcugggaaugaauuugccacuaccuuaucacucauacagcggagcggugaucugggcccugggaggcggaugccacaggguccuuccgggcagagcacagcugagacccacuaagauaucugacuacuuguucugcuugaucucccugcuccucuaucuuuuaccucauggcuucuuuuuuccuuuuccuccauccuuuugcauuuaaagugaaagaauauuaauaaacaagcgcauuuauuuaguaagaccuggauauaagcuuaaaacuuaaauuccuagggagucuaauguuaugugguuuuccaagacccaaucuuucuaguuccuucaauccaccccuuacccacacccaucccauuccugaggaauucauagccccaugaguguggucugggcugugguacagaggucccagcaccagcaucccccgaugagaagcugcucugcccauuuucaaaguggcaucaugaagagcugucuaucaaggcucagagaagucaucagagccugaugggggccaccggggcccucuggggaaaaugaucccauuccaagauguuccagccuggagagggaccaacggcuuuugccauaccaccucucucaggagaugacaggguucccgugccucaauuuacucuucuccccauccucugcuuuuagggugccaagggcaacaugggugaaccaggagagccuggacagaaaggacgacagguaagguccccgcauggccucugaccucuggccccuggacuugaccccuaaccacccucccugcacccagggcuggaaucacacccaagguucuuuguuccuucuucacagggagaccccggcaucgaaggccccauuggauucccgggaccgaaggcaaguucccuacccagggcugcaaugggggaaggggaagggagggaggucaguuuggggucaguuccucaugcugccugcccuuggggguauucacagaccagccccaguugccaaagaagagcaacaccucuacagcuugaaggucaccccaaaacuauguauccauccugaccccuccucugucaugcauguuuucagaacccacguauguuccaggcauaacgcagccauggugugcacccucaaugcugggucuuggcugccuuucaaaucuguuuaucuggggcuucguugaaccugcugacuugcccuugguaacacucuugucuucuccuucugcccucagggugugccuggcuucaagggagagaagguaagucaugauguggcccaggacauggauagccauuccaugcaccugauagcccagcaaccugucagcggcuccuggaggcagaccuagguuccucgcugcagugaggagccuaggucuaguucugcccuccuguuugggcugagugucuuuguuugcaccccaaagccagcagugucugugaugcuugggaccucaaccaacacuuugcuuuccucccgcacagggugaauuuggaucggauggucggaagguaagucugaaaggauggaugugcccugccuugcugcucagaaggaacaaggaucgagauuaaccaagcgucuuuucuuucuucuccagggagcgccuggccuagcuggcaagaauggaacagauggacagaagguagucacuaaccccaccccagcagccagacaccucugugcaccccccccccacaugcacauaauuauauucacacggauguagauguauaaacauauacacacaugcauggugaggauauuccacacccacgaaccuggccugguccuaggauucugucuccauggagacagaaugaagcaagaugggagaaucaucucgccuuccugugcucugucuagggugcagccaaccuagacauugucauacaagggccuaagugguacugucacugacuugcauggaccccagaucuguacucugauauuccgccuucuccuuucagggcaaacugggccgcauugggccuccugguugcaagggagaccccggaagucgggugaguaucgcccccauccucacugccuaucacaugacaugagaagucauucaggggacauggauaccaggcagaguuggaagcaagucuuuggauucucucuucugcccaaccucucccugcuugacccucacccauggcuggagcucugcuagucuuggggucacaacccacccccuuaggagcccaugagccaacccuuggacauguauggugaccaggccaggcuuaagcucauggccugaggcuggggaguucugaaucuuugaugcccgggcuuagacauagcucuuguugagccaggaucucacaggcgcugggguccccacuccaugucaguguuccuggcuugaggggagcacagucuaccuguggcagcacuuagcagggacucaaauggcccaacagccuuucucaccucccacagggccccgauggauacccuggagaagcuggaagcccaggcgagcgaggagaccagggugccaagguaaggacauggccagaaacagcucuagagagccggcuggguuaccacccucaggaaucccugcuuugggggucccugugccaucuuagauuagggugaggggacaccccagaaugugaagccuagcagggagguccuggccucgcguucacuauuuaagagcaggucacauguacuagcucucccaccuccccuuccaagcuugcagagaccuugaaggauguucuagucacuguucacagcauuuccuaguccuugaggcccuggugacccuuuugcccuugauagcccuagaccuuuagccaugggguaggugucccugucucuucuccccugagccccuaccuaagcuacaucccacucugaccagugccucgcaaagggcuccuuucccagaguccagcagacuuuauacugggcucauggguuggucuuccgggcaccuuagcaaggcaaaggccccguuauaccuggaauccuguguaggccaagaacacaggagaacuuagaugguccagccccacugcccagucccugucuauaaaacaaagcugaugucaccucccaacccuuccagggggacucuggccgcccaggacgcaggggaccaccaggagauccuggagacaaaggaagcaaggugagucccuggccugcucacugcgguugcccaggauaccauugacacuguccuaugcccucaugcauuguggagggauggggagcccagguuaauggagccauugcacacuggauccugcauauuacucagccaugcucccagccaugcugaguugucccugccuuacacagggauaucaaggcaacaacggagccccuggaagcccgggagugaaaggaggcaagggagggccuggcccccguggaccaaaaggagagccugugaguuuauucugcacccacacaccucuacaccuggaccaggccucaccaccuugggcagcagaguugagaagaagccauugacaaauggcacuggggauacacagagcccucuauucccaaccaacccuuucccuagccccuccuacaaggcucccccaagacuaaacucaggguagggaccucaccccaggguuaauccuuagaagagacagucugaggaggcccagacagggagggagcaggaaugaccaccuggcaguccaagauccgucccaguuauuggccagggcuuacagccugaccagaaacaccuacacacacaccugagucuuugacuggggcaaaaccaacauaauauuagugcgaagauagagccacagcuccagacggauaucaggagggacuaccaggcucaggguccuaauggagggcuagaagugauccacauggcccucccagcagugacauuccuccuucauccagggacgcagaggagaccccgggaccaagggcggccccggcagcgaugguccaaagggagagaagguaagguguuuuaaggagcaaagguuucuacucuggaaugucuccaugaagcuggugggcugauuccaucuucauuccccccagaagaacaaaacucugcagucuuaccacugaugaggauggggugggggucacugcacuguccgagaggguaagccucagacaggcaggcuuccacucccaacugucccugaggcuucuggaagggcaccgcccauccaaugccugcuguguauagcgacagaggcugcacacugcuccaucuugcagcauccccacugcagacauacacauuccuauaggcugucacugccacagaucgcugguggaggagccuuccucugaucuaguuagggucccuacaacagaguggccucaggaggaccgaggcgguaggucuggagaguaugacuguucugagggguugaauaacuuaucccucuaacccugcccucacccacccucugauacugcuucuggacgggaugauucagagcugcucccugaccuaaaucucaccagaccugucuucuccuagggagacccugguccugaggggccucgaggccuggcuggagaaguuggcaguaaaggagccaagguaggcucugcagaagguggcagaugccagggaggagggcuauacccaggacaggagguagcaaaggcugggguggagggggccacacccaggacaggaaguguguggaggaagggagcugaagagaucugugcccaguaccucucuuaaccuucucucagacccagccaaggcaaguccauggcagguuaguggguccagugcagccugaucccagcccugaaccauagcgcccacagggcugauguuaggacucugugggugcaguauuaagccacggcaucccauccucuuacccccaucuccuuucuuugcagggagacagagguuugccuggacccagaggcccccagggggcucuuggagagccaggaaagcaggugaguaucgggacccuugaagccuugaggccacgagagcacccuauccuugggcucccauccaccccuuacccuguucucaaccgcuaaccauucuccacccuggcuccaccccucccaccuguucccuaccuuggccaugacucuccaucuuuccucuuccccuaaucuuucaucagcuccucacccuaccccuuauccccauccacuccucaccugccuccugaucuccccacuccucucucucuccaacccuccacccacuccacacucuacccuagacccccaacccucucaccacccgcuuuucacccugccucccaaagucccucccacuuccaacccuguuccaucaacccccacucugccccagaccccguaucccaccccccauccuacccgauacaaacccuugucuaccuacucucuacccuucccaguuccuagccccaggcaaggugguggcucugcuacccagaccugcaaucuucucagagcuggucaaaucaaguuagggucaucaccauuucaggugacuaggccaccucugauuucuuucuugcccucagggaucucgaggagacccuggugacgccggaccucgaggggauucaggacagccgggccccaagguauauccuuccucuugacauggguccaaggcagucaccuguagaggugaccuccaagagggcagcaggcaaagcuugggcgccuggaggagagagaccucccuugggccuccuguucccagcuccugauaagaaucggccagggcaucgaggcugggccucugagaguggagagcaguaauggaccaugugccucucuucugcccuccccagcaaugaccuuccuggaaagaugacaggguccugagggauggacagucauauggguacugcauggugcccguggccuucuagugugugccacaggcccugaguuaucugguacuucguucacauacacuucaucccagaggugggcaggcaaggcuaggcucauagccucugccccccacccuacaccaaacacccuucacuguuugaauacuuccuucucaucauccauuccgacuaacucaaccuuccccuucagggcgauccuggaaggccuggauucagcuacccgggaccucgagggacacccguaagucuggcaggggacaagaacucccaggaaaaaccugcagagaaggagcaaggcuuuuaaagucccuccaugugggauuaggaauagagaggggaugugagucaccugucacuuggugcaaagguaaauccagccagcaccaggauauaccaggggucagacagagcccaggauugggucagcauggcucagcauguaugggcucaguggccuuuaccugaggugugugugagcuccuauaugaauucugauauccaagaaaucaugaggggugaucuuagcuccaaggugggcuucucugccugucacagauuuagggucugugacugagcaacuugucaacaagccuuugcuugcuucacagggugaaaaaggcgagcccgguccaccaggcccugagguacucagauguuuuaucauaaucagccuuuuccugcaugccuugucugcuaugggaacaaucuuuuggucauuuccuugccccaggacuggcuacaaugggccccugggugggcuuuagguggugguagccuguguugugucuuuuuccaagcaaaacccagagcuucccugaaaaugcccagcauccuuaacucaacucuuagcucaacucugcauaugguuucuguggcacuucugaaucccugcuugucugaggaaggucggucucauaguguggggcacgggugugugugccacccacugcccacagcuaacgugugucuugugucacagggaggccgaggagacuuuggucugaaaggaacacccggacggaagggagauaaaggggagccagugagugucaccauccuauguccugggcaaugggcuggcacaugaggagggccuaagaucgcugaagaaacauccagccucccuggcaccaggcccuugaagggaauggucaggcucaaaagccuccucuauucuaugcagccuuccucagccagcacccccugugggcucaguggcacaggcuagacccaugucauguucauuuccaagucccuggcacaugauggucauguggguacaugaagaacagagagggcaagacaucacauauaacaguggauagcagaugagguggguggacagauggguggggguuggcaguucagugaagggaugguagguggacagacagguaguggauagauagguaggcagauugggcacauaagugugcccagauagccacuggauaccucagugugaguuaucccaguauugaguuccucgauggccuucuacucucucuugccuacgagacucugauagugacugcuaaagacauugcuagggcagugccagacuugggaugaagagggugaugcaguacuucaugcccucuauacucuuaauagagacagggggaucaauacuccuguggagcugagagaccucccaggaccauauugaaccuacuucccuguuucuccucaggcugauccuggucccccuggugaaccuggcccucgggggccaagaggaaucccaggaccugagguaagcccaccucuguuccuuuagcccauagcuccugagccagccaggcuaauguauguugagccucuugguucugcccuuagugggcccaugggucagcauguacugggugguaguaccaggagcaacucggacucagaagccucaccccuuacuauuguccuuuguccuccagggagaacccggcccuccaggagacccuggucucacgguaggugucacuuauuguggaaucaggauccuguucaugaguguccuucucucuucuaaaaaucaaagaccaagagcuucaaguacagaggguuagccagagcaaaaucagaggagaagcucagagggcaaaguuaguagacuaggguuaaugucaacagguuugauguuggcagagacaaggucagaagaugaaucaagguuggcaaagguuaaguccagugcagagggcaaagucagccauggucaaguugguaaggacaaggccauaggagaagaguuacuggguguaguuggcauggguaagaucagaggguagaguuggagauguguguauccagcucuacucuauguaugggcaugggcuucagcagacacagggugagggauuccuauggaagcccagaggaaacaguaggugugcccugccuaaauguacccauggggguugucuuucaggaaugugaugucaugaccuaugugagggagaccuguggaugcugcggugaguuggcccaacacaucaggaugugugcauggccgccggaggggauggaucccucacagucucuccagccccaugcccuaaguaucuucacacuuccaacucacuaaugcugucauccugaacacccuuccagacugugagaagcgcuguggugcccuggauguggucuucgucaucgacaguucugagaguauuggcuacaccaacuucaccuuggagaagaacuuugucaucaauguggucaacaggcuaggugccauugccaaggaccccaagucagaaacaggucagugaaaaccuaggaggaccccgagguagaaaccagaaccuccuucuagcuaggaucauggcucugcuacacaccccgugauucauuccagguggcccagucaugguggacacuguucaugcugaucuucucucauaggcacacguguggguguggugcaguacagccacgagggcaccuuugaggccauccggcuggacgacgagcgagucaacucccugucuaguuucaaggaggcugucaaaaaccuugaauggaucgccgguggcacuuggacgcccucugcccucaaguuugccuauaaucagcucaucaaagaaagccggcgccagaagacccggguguucgcaguggucaucacggaugggcgccaugacccccgagaugaugaccucaaucuucgggcacugugugaccgagaugucacugugacagccauuggcaucggugacauguuccacgagacucaugagagugagaaccucuacuccauugccugugacaagccacagcaagugcgcaacaugacgcuguucucugaccugguggccgagaaguucaucgaugacauggaagacguccuuuguccaggugaguggcaggacccgggccuuuaccccuagaaagcugaccacugagagcccagcagaaacuuauagagaccugguuucuuucucucuucuagacccccagaucguguguccagaacuucccugccaaacagguaaccgggguaccugaaacccuaauuccagacaagcagagcaacccagcauccuuccuguucuaacaggaauugugcaaccucaaggguuugucaauguggaggcaccuccuuagggagaaacccuugaaguucaccccuggcaugguagagucagagguucagggugagaacuggcuccugagagcauguaguaucauccugagccccugcaggguaccaucugggcagagacugcuggccuggcagugcuuggcucuuggccauugaucaaagagguauuucgacacaaaaggagucucucccaagaaucccaagucucccuaccacugggugcacucauuuugguccacagggccaggcccucccuugcauucccuucauuccugcucuuccaggggcuccguugugggcagacauagcuagagccauccaguugccaagaccuggcaagcucugcucaaaagauaaagcccuaaaaccaauggguggaacggcugguguuggacaucuggugauaagcacagggauacccacuagcaguugauagcuuugcuucuaacccugcagcugccuuuguggccuucauaguaagaggcugaaaccagagcugcuacucccaagggaggguaggaggugucccugcugugcugagggucccugacaauaccuccccccaagaugcugcugcagagugccuggguaagagccucaggaaguuguccuggggccuccguagccacucaguccccucugcaagcccuagucauccaggaguguugaguaggggcugggccaguucugcaugguggaguuacuguggagauggagccacagguaguaguccucauagccugaacugugcagcuacaucucccuacaaagccucagcuguuccuugauucccucccaaagacaagguggcccacugagcaugugcacaggcucagagcccaccggacagaagggacaguguggcuugggagucagggucucacacuguucaaacagagaucacuaccaagaaaaugcucucagggcaagccuuagccucagccaccuagcguaguuaccugggaaggauuguguggggcuccgagcacuggcuucaaguugccuguucuaguaucugucaaagacuagaggucaugucugcagugagaccuuacagcuacaccuucaacccuggcuccuggcaccuugacugggcaguuaggugaagcuguacuuuggugggugaugguauccaacuccagcccgguauuguaaagccuuaugugagguuuguauaggggaggcugauuccacagauggcuccaccccuccagcacagaagccagaccuugaucccugagucuugcuccugaucacaguuggaaagguucaagauucuacucagcaaguugcgcagcuguggauugcuggggcugucuuuauggaguagcaaguuccccuuuugguugauaucagggaagaaaagguauugauuggaucuugucaugugcuugcucuauuggugaugccuugugaggcuuuguuaguuaugaaagcaacaaucaguuguguugauuuucuauuacugaguaagcccugugucuugugucucugaggcagagcccuuugcucaugggcuaccagagaugccugcuaaauuugagugccuugugucuuauggggagagcacuucuauguucaaagagcugucucugcaucuucuuuucuaguggcuucuaugucuggcuuguauggggcaaugcuagaugauaggguauagagacuccagaaugggguacaaggucagacaguuuccaccucuggacagaccaacucuggaggauggcaagaucaagaggaaaugggcaucucaauuuacucugaggccuucggaccccacaaagcauauugguccucuccacauucugcaucucccuagcccccuucuauugaccauaaagcacauuugcauuuauuguuauaugaaauuucaagguaaauuagacacggugaugggguaaggggugcauagugaccuuagaugguaucuuuauaaaugaggucuuaggagagcauccuugaguacauuucugauaugaauaugaugucaacaacacuaccaacucugaccuagcccugacugucugagucaaguaacuacuagcccuaucugucuaccugguuaccuugggccuaccucaggccagcaguugugucccucauuaggaacuacugagugugccugaggagcucaggacuauaggaagaaaauuaguaaugaccacaguaccaaagacuguagagagaccugagcaugaauuaugaagaugaaaaaaagaagagccucuagaacuguucuccaucucugaguuaugacccuuuugguaaccaaugacccuuacacaggggucacccaaaacuauaggaaaacacagguuauuuacauuaugauucacgauagagguagaauuauaguuaugaagucgcaccaagauaauuuuaugguuggcggucagcacaacaugagggacuguauaaaggguuucagcauuaggaagguugaggaccacugcucuggaaccuccccagagaggcucaagguccuggcccugugauggacacaugaggaaacucauguguccuuuguuaccagagaaaagggagugaguugggucgugacaucuacugagucauaggcauacccuuccacuccaguagacacugugagauggaaggagggaauagucagacagacagacagacagacagaaaaggagagggggauaaagaaaugaggaaagagaaauagaaccagaaagaaagggagaggacaggacagaaauagaaagggagggagacagagacacaaaaggagagaugaaggaagaagagaggagggagggagagaggagggagggagagaggagggaggaggagacagggaggaucuugcucucccuuggugccuguaccacucagucucagacccucauggacaguccuagaacagcagaugauaacucugggaccaaaagguuagcguuguaguuuugucugugagcacuguccggagcugacucuuccuagggauguggagauguagaacugaucuggagaaguuuacagcauuugugcacaucucucaguugggcuugggcacuaaugcucugugcugaguuucuuuagagcucuguggauuccccaaaacugcuacuggccugucuccuuggcuguaucgcuugcuuucagcuucuucagccccgcuagcuuccugccuauaccagacaccaccaccugcuccauccucccaucuccuacuugucucccugggcuuauuuccuuugguccuaacuacuguccauggucagaggccuaaggagggcuggaggccagccacacccacuggaccuccuaaagucuucucuggccacucccuugcagaugaaccauggccugggaacaagcccccggucaccuuccuccgcacggaagaggguccggaccccaccuuccccaagaccaucccccugauccagcaguugcuaaacgccacggaguucacacagaauccagcugccuacucccaacugguagcugugauggucuacaccgccgagagggccaaguucuccacaggggucgagcggcaggacuggaugcagcuguucauugacaccuuuaaacuggugcacagggauaucacaggggacccagagagcgugcuggcacucugcuaaagccucggguucacugugggaagguagccagagcuaaccccucauuucuuauagauucccagggcugccaccacaagcugggaccuuagguaguaggaaccuaggaaccuguccucgaaacucccaaggccagaagucuagaaucuuaugucuuuaauaugauacucucugaaggguuccuccuacuuccuccagccucugguagagcuuccauccuuggcuugugggcacaccucuccagcaucacuucuaucuucccacagacucuuuucuuuguaugccuguguauuuuuuccuccuccuccuccuccuccuccuacucuucuucuuuuuccucccccuccuucucugccucuucuuccuccuccuccuucuccuccucucucuccuuuuccuccuccuuuuccucuuuuuucuucucuuccuccuucucuuccuccuccucuuccuccucuuccuccuccucuucuuccuccuuuccccucuucuuccucuuccuccuccuccuccuuguguuuugcauuuuguuuuuagagacaaaguuucucuguauuacagccuuggcuguucuggaacuugcuuuguaggccugggauccuccugcucugcccugccccgacacucccagugcugggauuaaaggcaugcacugccaugccccacuuuguucagugauuggaggcccaccuuaugccccagaagcucagucacaucuggcaaaggacuguaccaucaggguuauauuaaggcucuugagauguaaaccucugggcaucucucagcagagcacaccaccucuguccugcugagcagucuuguguuugagagcacaaauggggguggugcuauuugaacgcuuggggaggucucccuguccugguccugucugagccccauguugggggucagguauguggucauagcucacacaaaccauggaacuguaacaagggccuuaaugugucucagcaacugucauacccacuaggucaaagucccagugugccucaaacaccaggcugugggcccagccuggucucuguaucugaaggcaucaugaggagagcguaugccaggcaggacuuuugauaccucagccacaugacuaagaaccaugaaagcacccucuuccaauauggggaguagcaagggacucacugcaaagucaccaagaccaguucaagccaccaaggcaaguucauguaccuggcauguucugauugagcucaaggaaccucaucagguuggauggauguccuugaccccaucugugcccccucucucccaggauaaggcauauccugcugggagggugacaucccauagcaggcuggggccagacucccugcugggaggucacagguagaagaagggaaccccacagaaauggagcacagagucccccaaguccccaaacucccaacugcuuguauuguucaccagaguucccuggucuccuccaggcccuguagauguugcuauuaagguaaaguucucaagccagcagcccacacuauuugucugccucuggguuugugguaauaacugugagggggccagucaguuaugaggaccuaggaaauccagucguucccaaaacuuuucuaggcauccugagcauauugcagggauuaugggugauuaauaaaguuaauaggcucaguaagaaagacccugccugccaggggcacuaccugacucggggcucagacucagagguagugagcgauugcaaacauuuuauaaaaaguugaagccuguaacuaugcacugcuguggucaaacgguaaguugggcuagcauacacugggauagacccucacacacaauuggagucaagggggagggaagggggaggcgcagaugggguagguacacuggcagccggguccugccuccacauucuuggucauacaugacaagaguaacguucuuagugugauucccuggggucccaaauccuggauuauggcagcauacauagguuggcugaacauaucuucccccggagagagccgagauggaugucuggugacuggguagcaaggcccuagccagugaucucugacacuucucuguguguguguguguguguguguguguguguguguguguguguguguguguguguguguggucuuagcucccauagugcugugugucugggcuggugacuacccaccaaugaaaggcuuggugguagcauugaauccacuaugggccuaccuggauugcuucggccauaccaaauauacacuacuauacauuugguauauagcaguaugccaaggcuacagugagugucaggacacauggacccuuccuuccuuuucugggagauaugugguucaaacagcccaggugacucagaaguaaguggccccugaggagagucaggcccaggggccuuaucuuaacccucccaccagagaauaaccucuuugugaguaacugaaauaugggcugaguaagggauuugggguuauugagagucccagaggugguugauggaggcugagaccaugcuuggugacaaaaagaugaaucuucuagccucuagccagaucucuaguucucuaguuugggggcauuuaagaaaauucccggggagcaguauacauacucccaaggaguugcgcuguugaagccuccauugguggcugugagugaaacuccaaagucccaagaccggggauccaauaagcagcuuguaugcagagaugggaugaguuucaagcuggccgccccuugccugccugggcccccaccuuacaucuucccugcagagcucuauguggcccagugcacacaacggcccguggacauugucuuccugcuggauggcucggagcggcugggcgagcagaacuuccacaaggugcggcgcuucguggaggacgugucccggcgccugacucuggcccggagggaugaugacccacucaacgcccgcauggcucuguugcaauauggcagccagaaucagcaacagguggccuucccacugaccuacaacgugaccaccauccacgaggcccuggagagggccaccuaccucaauuccuuuucucacgugggcacgggcaucguacacgccaucaacaacguggugcggggggcacgggguggggcgcggcgccacgcagagcucuccuucgucuuccucacggacggugucaccggcaaugacagccuggaggagucagugcacucuaugcguaagcagaacguggugcccacuguggucgcugugggcggcgacguggacauggaugugcuuacuaagaucagccugggugacagggcggccaucuuccgggagaaagacuuugacagucuggcccagcccagcuucuuugacagguucauccgcuggaucuguuagcaccgccaugcucggccaccucuccaucccaucuguggugcuaauaggacccuagcccugccggucccagcuagacgguacacuugggucuuucuagaaagugaaagcccuucucccaaaaucaggacagaaggacucugaacccaaagccccuuaccuacuuucagcucucuuggcuuccccuaccccaagucuccauccuaccuauaccuugcccucaagcauuggaggaccccagagucuucccacugccuguuucccacagccucugcccccuuacuucccuuucccccuucaugcauccacuagucccuucugaaagcugucugcuggccugcaccaguccugcccaaggcucugucuuucucugccuguuauuuccuaucucaggagaucagaccugagagccccauaucacaugcccaauggcccaauaaagguuuugagccucccuguugcugccagguccccagugucuaugcccaauagggccuuaccccaggcagguacaucacugggucucuuuuucacucuaagacgacacuuaggcuauuuacaugcccaccagaauacaucauucccugauccccagccccaggccacccuucauggagacagguacugcaaaaugugcuacacugucucuaaugaacauuuagcauagccucaacagggacuccacucuagccagugaauguccagcuaaaauugccacccugugauugugaacugucucucaagccuccgauggggcaggguuaucuuagacugccucguggcuucauugagacacucauggaaggauaggugaauaauggauugugggacaaauggccaucaaaagauagucuacuucaaugugggugcucugggguugcucaugucccagguauuccacacuuaugcuccuggaagccacacauagaacauagaauaggguuuuccaggacaggggcugugcuguguucaaccuccaugacaaagcauggaacccagggucuggaauauaccaucuuggguuacauuauggcucagagagaauggcuuaccugguauucgugagacccuagcuuuuaaccuagcacaggaagacaggagaaaagaccaaagaagaacuagaagucaggcagaaagguggaaucuuguggguucuuagaccuggaagacagaaggccaggugugaggugugaguagggcuggagcccucugccugcaucauggaggguuuauccucagccucaggccuggcuccaaguuagcaaucuccuugucuuugguggcagacagugucacaguagucuccaugagauguucuuucuguguuuaucuguccaaauugccccuuuuccauuuuuuuuuucaaaaauagauaaauuuuuacugagccucuuaguuuccgacaugaggcgauaggaaagacggugcuacuuugcagcauuuuacacagaucuagagacauacuuucagcgcccagagcuuaggaggacuucugauucccagaaguuggaucaagcacagugguguugacucuuugggucuucccccugacucuucccuuaauauaguagcaagcucuaacuaguccuccggggaucugggcugauuuuaccacucugucugauauuguagguccaaaguccugccauuccaaucaauagcagcuaauuccccuucaaaagugaguuguguugguagaaucuuggcaucaagucguccucucccucucuccauugcccauuguggcucacucuccagcccagccuuccccccucccacauacacccugugcccuccuguucacaggcucgccaugccaacaucugauggccucugauaaugcugccugcuccaaccuaaagacaaggaccuggugucuuugaacuuguuuggauauugguaucaacaccagccacuuccugugacauuccuguaugcacagcaaacaucucucucucagggacccacuggcuguaucuucccuuuuuagauuuuugccuguugguuggaccuuucccauuucuuuugguuuaccuucauuaagacaugcuuuuucacccgcugaacaucgaaugcuuugaauauacucacaacgaaugcuugcuuuaaaaagauguuuacaggcugucaucacaugguucucauuagcauccuugguugcauuuuaauguuuccuaauaccaacaauucccaaggaacggaucucaguugugguccugaagaaacuaggcagugucccucucggacagcuguuccccaaccuauacccacgaggauuugcugcugucucccugcugccugcuuuccuccaaauugcccuuuuuaaaaaggaaacuaaucuuauuggguuaggucuuucucuacucuaguaaaaaucucuuugcaauga

SEQ ID NO: 5583 - RNA, 17382 nt, Mus musculus
cggagaaaaauggaaaccuuuauuagcagagauagcuggcuuggaucagauuacggggaaugugggggagccaugaagaaacuaacuaaaggggagccuuuggggaccagggggagacaagucacuauuuugagggagaaagcucuggauugauucugacaggacacuugagugugaacuguccaagcuaagccucuggguguguagagagagcccuuacagauagauagcaccuuugcuuucagaguggaaggacuagccacuaaggaccagaccaagaugcauguaggucacugacaagcaccugaugaagaggaggggucuccuccaaguuuguguuuggaacuccuccuguguucaauuuccuaaaagccauaauccagcaagcugaacucaugagaaggucugcuucauguugagcauggaagacagaacacagacggaaacugcagugauggugugaagacaccacggauagguuaggggcagugaggaggaagacgagauggcuggauccagcccagaugggggaggggucagcaagauggccaccaugauguacaaaccaagggcgggaucuagauaggagcucaggugagccacaggggacauuacacaaagcaaagagugugcaucucagcguucccuuuaagacaguugaguugaccaguugggucacauuuccuauuccuguuuugucagugggaagggcgggaaggccuguugaaaugugucuccaugccauguguguccagccacguguguggcccucuagcccagugccaccuuccuggagacugucugguagaguacgccacguagcagggccugguaguuugguacacggaauagguggcgcucgccaaaggccacgucguacucugcagucuugccagugacaagcacacggauguggggcucguucaccuggggucccaccaccaccacaaagaucucaaugccugcacgcugggccuccugcacagccuucucaauggccucugcuguggcccccugagaguugccgucugaaaacaacagcacucucuucuugguggcaccugacgaggcuucccgguagaaacgagucacguagcucagagcaucguugacgucuguggcgucguugaugaaauccaugcuguccacagagcuggccagcacuguguaauucuguaagaacugaagagccgcccgaccuggcuguugcugccccuggccacuauacuguaccacggccacccgcacauccugggaaggauccgcccugccugcugacaggaaucgcucagcuaggcgcuuggcgaagaccuuggugguuucgaaguuguggcugccgacacuggcugagcugucuagcaggauggugaugucagccggggaggagaaugugacuguggggcagagaggguggccugagacuaggcagacugcacaggccagagggcacccagauuuucagagcugccaagcccccgagaagagugcccagagcccugagggacccuuaaucagguccugccuucccuacccugucucagcacauccuuguacucacuuggacagguauaauccggacacuucuuaucuguaaagaaaaaaauacaaaauaaccugaauaaguccacuaucaugugagccaucugaguucugcuuuggucggcugccuaugacgauggacagacagacagacaagcggugaccuagcaucauuuccugguccuggcuccaaaauacugaaaggaggagucgggcccuuggccuucucuuaaaagggggaaacugagucucagaggggaagagguaguuugcuguuccaugccacuaaucaacugcccgucaugaaucuggcacaaaguacaucccuugaccaaguuguccacagcauggagucagaccagucauaaggcugacaaacaguguguccaugguguugggggcaagggcuuuuucccaugcguguagcaugagaacagcuguccucauguugcucugcuaggccaggggucacccuggacagugccauacagccaggacacaaucuuucucgagguaaaaagugccaggcacauugugaggacuguuucuagcccuacagucccugaaagcagaggaggcaugucuaagacagauguaggcacugcccauucagccuguugaccaccagcacccaccuauacagaucugggcuguuauguucuucagaaagccgucaucgagaagcucugcauaguucuccuucaccagggagauaccuggccgaccuugcgauaagccuuggcaggaaaugacauugagcuggucggagcccgccacaaagccaaacacauccuugauucccacagaaacuaccuguagaggacaggguugcauggaucagcugauccuggacuuccccuccccuggagagcagcccccaccuccaccccgugcuugcaggagcacccugcuacccuuccccguucagccaccgcugggguuaugcaacugcccaccugaaugucugcaccacagagcacacugagaggugucgugucccguugagugucagaacguccauccguaaugaccagggcaauucgguuguucugugugggugggaguagccggucccggguguacugcagcgcuucuccggugaaugugccaccagccauccauuguagcuucuugacagcucuacacaagcagauaggcaggccagggucagagccauggucaggguccuggcuaggccagccugcuagaggccugggaauggggcggagaucuuggggaugcucuuacucuuugaaguccugggcguugcggacguuggggcuccgcauguccacgugcucuugcaucugguuguggcuguacuguaccacgcccgcgugagacugcccuggcucaaacugugggaaugacaccauugggucuggaguccaacaccacuaugucuuagagucccagccuuccaaggaccucuaccccgaggcccaagaccccugcucauucacccagagcccuccauaacuacuccccagauccacaagccucuguacauggcccuccaagguucuguccuuaaaggauaagcucuggacccacuaucaggauucucuguguggugagaauacauauuguguguguguguguguguguguguguguacauacauacauauguauguacauauauguguguauauguagauauacauauauauacacauauaugcaucuuccauauauaucucuaccauacauacauauauaucuuccauauauauguguguguguguguguguguguguguguguauacacuauauauauuuccauggacauuaaggaugaacuguuugacuuuguugaaggguccggccagcucaauguauacgucaaucaauguuuacaguggugagccuagaagcuuugguggaggggaccagcucucuguuggcccuaccuguggucccagguuggcuuguacucacuuugaccagcucauccuugcucaaccggucaaugaccuugaugaugaaguccuuggcaaucucaaaguucuguaggccaaugcucuccgagcuguccagcacgaagaggaugucaauggguccacaugugcacucuagggagggggaugggcagcccuuagugcccuucuaugggcuucccuccguauuccacggucccaccccuguguccugggaucugcaugguggaucaugacuccucucccaugucuccuugggagcuaggcuugucaggcuggccuccucuugaccagacccgacaguugcuacccuugcuccuucaucccagcucugagccuguggauaagacaggccuagaggucugcuuccugcuucagccuguugaugguuacuugaaacauuagggagaaaggccagggaucagcagcuuccuaggaggccugaccccagggcacugcucacugggaagggaaacagcagagcaagcgugugguugagugccuugcagggcugcagcauggcuggccaacugcagagccaggaugagucuacuuaucauugcacagggacucccaagaucgaagagacaucacucaccacagcaggcugaggagagaggagaaaaggcacuaaauaggacagcucuggcauacaaggugcccuguccugcucugccuggcuucaccuagcucuggccagguccucagcauauuagucucugaaaucucagaggguguguagcccagcucugguucuggaguaggagaccugccaauuucaguagagccuaggcccugcccaucuauaucucccaauuucugagacccuucuggagcagaagccugggccuuguagcugguaggaacuugcuggcucuuuaaaaaaaaaaaaaggcaaccugugauccaaauacucacagcacauuuucaugaugauauccaggaucucacacuccuagggaaagaggugagauuguuaacaaggcuugggcugaggccauuccugcuggucccugggcaccccuggggauuggaucuauccagggacuccucccagccuagaauguuccugacuuuacccccuaagaacauaagcuauggugcaguuaccaacacauagcugccauguguucccccauggccagaugucucccacaguuguuaccuguguccccugaagucaucacaagccucaacuauaguuguguaugucuguagccuggguacaaggcuucaagccucucucuccagcugccccccaacugcccccagcugggaacaguuuucauuaauguucucauucagauccauggucauaacggucagccccaagaucuuauuuacagacgcuguacuuacaucuggcccagguggucccacauguccuggaggucccugucagagcaacagcagaucaagacuuuaaauggggagcuuggaucaacggagcccauggauucuuaaacuauauguccucuggggaccucagugucccuaauugcccuuggggcaagucugguccccuuggucuuuugguuccugccucuaguuacuuuaucuuuucuuugcuucuaaagaagccaagcccuccagcuauaucaccuaccugggguccuucugggccucgguaucccuuugccccuuugaccccacggggugaaaugucguuguucuggaaggaaauggaaugggauuagcaggaacagccauguauaucaguugcccagacuccagcccagcugcucuggucccucaucuccagccugcccuuugccacuguuccagugagcaaagccugcaggguuggaaugcuagagagagucuuccccucaccccgccccacuuacauccucuccugggucucccacuucacccucaucccccuugaggccaggguagccuuuugugcccugcaggagacaacauauauugguuagugggaucuugggaguaaaggaggcagagaagguagaugugauaugguggggguguuucugaauucaguggugcaaccucagggucacauguaagugaaugugcaugaugccugguaucaugugggaaggugcucacggaguguugauugugcaugugagcagugugggccuacauacauggccugucagaggcacgguagagauacucacauuuagcccaggagggccucuguugccuggauaccccugugaagaaggauaggaugguuauacuaagcuccacuggggagagcagccaagugaaaacaacagguggaugugcccaggguuggcagaaucccagguccaaaugccgggacuaacugauagcucuggucuaucccaaccauccagauguccagcuuggcccgagggauaccaaaggaggcuugauaaacaugucucugauacucacagggaagccggggaaaccuuccgugccguuuccuggugguccauccucacccugaaagaagguagaguugcugucaucaugccagauggcagcgaaauggcuggggacagcuguguccccagagcugcuccugucauucaaggagcagcccccuccccgggucuaccccgagcugaaccuuaaagcaagagagucuugaaugaggcauccuuacucuugagacccagcuguggaugccccucaacaccucucucaggggcaaguauggcaagucucagcugccagagucucugaugaacagcaguagcccagcaggguuguucucccaaauacuuacucucucacccaucaguccggggucuccaggaggaccaacagguccuggggcuccucugaggcccuauaggagaggaacagguaauugcuaggucauaaagaauguaaguuugggcugcacuauccuucucugggacccucuuagggcaagagagagaagacuggguguaaagaaacgggguggggguagggagauacugcaagccuaggggacuccucagggugacacucagggguagccuaggugaauagcagagaagagaggacaaguucuuaccucaggaccuggaggacccucaucaccucgguauccuuuagguccaauggggccagccucacccuagaagauuaagaacuaugagaguucagcucaccaccccugggccacaucuguuugucuucccugagaacugagagucccaggccaugggcuccgucguugucaucuagggcccugggcacaggggcauaggacccuuggggccucaggacagguguggccaguggccaguggcuaguaugggguacggucaggccgggcucccugcaugucuuucuaguauccaugugggagccuuuacuuuaggugucaggguguguggaugucccuuuuguucaggggaccuuaauggcuguacuuuccugggaaguaccucuagcccuguagaaccuccauaugaaguggguucucucaccaagacuuccaccccuucccuacuagacacaagcaaggucaacuccagacucaagcuaugucugucccugccucguuccuuccagauggcucugaggggugcuggugaccugaggaccccagugucuccagaaugagccugacugccuuccagggaugcaaagagcucaccuccauucauccuguagccuaggaacucauaucaguccucaccaaccuagucucccucccuguuguagccaggucucuauuacccaucacuacccccccgcccccccccacacgcacuaccaggcccugugaacauaacagcucaaggucagagaucuaagguuauggcauggagccuacaagugccugcaucgcaugaccuccacuacauuucuuggccucaugcuaagcacugacacacauucaugcccagccaaaccaggcuagcauggacacauaucuaugggaggaccccccucccccaccaugcugagccacugggaacauuuccuuugaagacccgagugaaacucuuggcguaguucggcgucauggcucccuauaauguaucaggcuuccuaccgagucuccagggaugccgacgggccccucucuuccuuggucacccugugguccagcuucacccuagggagaaauaagccaaugaguguagagguagaagccauguggccaccaguaguuugcucuaagaagagccacugucuugguggcgaguaauuggggcacucuagugaggguugccugggucuguugaacucaaaacuggaggccaaggcuggcccuaccugcagcuucuccuucuccagaugcgcccacuaaugagcaagccucugacaggauuuggauugaugcccuaccuuggaugcccuggcagagcccuggcaguuccagcccuccaucggaaagcaggagagcugaggcauagacaccuaugagguggcauggcuggcccugcggaucuaugcucaacucuguccagccucaguguucccccuagacagucccaaggcacgacucaccgggucuccccuugguccucucacaccaggggucccccgagguccucuuucaccagggccacccugugugaagagaaacagaugugagggugccuacguuccacuguuaggaaggguggguggaagaagcuugagagcuaggccuuaugaucucagcagcugacucuguggucaugugagaccagcccauggguaggccucuguguuccucaggccaccuaucuccagagaugccccaagugacccaaaggccagcacacaaggugaaaucuacaaugccuggugucuggcuucccaccuagccaaggcauguacuaaggaccuccuaagaccaggcccaggccaagcucacacaagccucuccuggcaauggggaagacagcagcgacaguacuauccagccgacucacccucucuccaggggcaccgucugggccagcauuucccugggacaaggaggaauagcucacguuaguuugugcacuagccugcacucagucuguauguggggauggaagcuggggaagaauagagacaacucacuucaucaccggccucuccuuuuucuccggggggaccaggcucuccaggaucacccugggggaggacaaguugagaaugaccacaauccccaguguccaugaggcugaucccaucccgccucaugccacucccucucaccucaucuccaggugacccugaguucccuggucucccagccucaccgucugcuccagcuucacccuggggaaggucaggggucaggggucauggguccauacagugaaagccacaccacagcuuagugacuaugcucuauuacccuaaccucgggccaccgcaaccaacucuggaagaguucugaccucccaggauccuccaagucacccacacagcugcagagcacagucuugaccaucacagccucaaaccuucucagguucagaccugagauguuggguagugaacggcaaacuccaggcugccauucaaggcuuuauggcuuugcugcucugagccaggcuugguccucacacugugggucucaggaggaaugcuugacaccugucucuuaccuuuucucccuucaucccaaaggcaccagcaucacccuugggacccggggguccuugaaugcccuggugggaagauggagaagcaaauuggagcuagccaagacucucaugggccccagacaaguggccacccucagacugagcaaaugaaucaaaugacuccacguagugcucucucauugggaggagucaauacagcaagggcuggaccaaguuccuaagaacccacaauuccgagacauagggguagaggagguaacuuacaucaaauccuggggagcccuugcagcccgguaguccuggguaccccgucucucccuggaaggagaagaaaacgucaagauuggaaugguugaguggaggcuagaguucuguucauccaaccccccccccccgcacccgaacaucaggagcccucugagaucaaguggcucgcuugggguuuacuaggaccugggucuuggcaggaaacaucacccagcucacaccuccagguuucccaggaaagccugcuaugggaacugcacccauccuagauagcacaccccacccucccagcccucccgccucagcauuaccuucaugccgucgaccccgucgauuccgcgcuugccuuucucgcccugugaggcacggagacgcaagaagguuagauggaggccagaugucacuagcacuggccccauggacagcaucuauguccuugguccguccacacucaccuuguaaccuuucgguccucuggaacccuguggaaacaggaagaagagggucagagggcggcacccacugcaccuccauucucccauuaggugggagggcgacaccacccccaccaacccaagaaagcggggggaauuggagaucagggacacaggguagaauagguagaaaagacaacagggucuguguucugagagucuccaggaacuguccacugagguaacaugacacuccccacccccauccucucugacccagguggccugaggcugcagcagaacucaccuggucugucucuaaagaccacccacauucccccagaggcauagagaaggcaaggagggucuuccauuucccaugcuccccucugacaggaacaccagcugccucccccugaugcugucacucaagauaacgcucuguacucggagggacacacccgaaagcuggcccucacucaccuucucuccacggcuccccuuuucucccuaugagacaaacagaaaaggaagggaucuguuauuguugcacacggcagcuugggcuuugcuuccaaagccugauccaccccacccaagagaggccauuggacauuaaggacacguaccuucauacccugguacccgacugguccaagauccccaggucgucccuggaacacaacaagagauagucagacaucccuggauagcacuggaagguccuucucagcccaccuuaccccuugcuacagcuagacccacacagaauccuuaagggagcugcuguggggccccugaaggucaggagggagcccggcacacccaggauggaggagagguuaugcaccacaccccagaggaaagggagggggagccaggacacccgggggggggggcgcuagaagggagagagauuugccaggagacuuaucauggcugaaagcagaggcccucagacuuggucagccugaacccugggguaccuuucuucccccaacaaaagacaggcuguguggucucugugcucagaauuaugcuucuggaaguuuuuacagcucugauguccagccucaggcuugucugccuuuguccccacccucaugcagacaguaaccaauacuuacagggucuccagcuucucccuucucucccggaagaccuggcuuuccucgcucccccuggaaggcagaggaaaucagcucaggggagaccaggucaggagccacagccaucugcucuggaaagcugggcaagaccccuugugcaugaaaaguuucuucagagcgauuccauccaggcuccagagucguccuggccuuggcuucuggaccugccuggcaucugggagucuuacccaccaggguccuuaugcugugucaucauggcuggauuugggcuuagaguugugccuuugcaucaaggcugaacugaugauacguugcuccaggcccagaggaacagggagacccagcagagagacuccccaaagggccauagaagcucuguggaugauggccaugugguaggaaaaccauccuagaccugaccuucuguaggaaccaacaccgagugucucccucaguguucaaauuugugccacgugagucacacccaagagucccaguuucauucccaacuccaccgggaaugucaaacagaugcugagcugacacuuaagucugcaggcaaccuucuggaccacaaggagcaggcuuuugcaaccccaguucccauaccccaaacccacaugaagccuggacuuucucccuggauaagggcaacugacagccaguguugcauguaccagaugcccagguagguaggcacagagcuauggcguccacuguggccugucccaauaagaguuauuucagacacccaguguaugcauaaugauuauguguacaguguucagguuauccauccuuggcuuauuccaaugcugauuucucugucccuaaaucuuguuucaauguggacucggcauuauagcuuaggucaagaaucuccuaucucacguuuguauaaacaguucuuaccauuuccucucugccuugucaauaaaugcugaacacccaauggcuggccagaagagagaacagggcaggauuuccaccagccaggggaaggagaugggguaagagagucagaucagucaagaggaugauaagagguuagaacuacgagggagggggccagagagaggucauagaaacacaccugaagcucaaagagccagaccaauaagaagaagcaaguauauugggaucacggcugggaaaucgccaggucagcuuaagagguuaauauacaucacuuaacugcccagguauugagacgcagcuugaaagaaaucuugguuucucugugagguuauggggauuaguauaaggugaagaaauaaagccauggaugaauucacugcuuccaccuauauuaaaauaauuccauugacaauuuaccucauacccagggucgccucggggcccuggagguccucuggcagccugagggaaacaagagagacauuauuaaccccagauccuagacagaggucccaggccagcagagaggauggaccacacuuaccuggcacucaaaagaacaacacuguggaagagaaagauaggagagcagucagagaccaaacauggagagggaagagccuggacaccgucccccccaccaauagcgggcucacagcuagagcuaggaccuguguaagacccaggcccugacucaggucucagagggaagcacuuaccacuuguuccacguuauuuuucugaaaugaaaaugaaagaaagaguuacucucuccaaugggcauagcccuccuucccccuacuccugaccccugaccucugacccccugaccccugaccgggaagauguccaugcucacaaucauguccacaauggugucaauggucuggcugaugaccucuucugcaucgcggcuaugcccccagucagcugccgugaaauugcgccgguauguguggucuguggcaaugauacuuagacguggcuccugagaacgcagggaaggagagaugagugagucaccuccacaaagcgaugcgccacugugaacuggguaguaguuguggaacccacacagggauacccacgcuccucccuuugaagggcuaggacugucuacuggggagucuucaccccaagggucacaccagggacccagcagacuauauguacucaaacagugacagaagagaggaugccagugcucuggggcccaggaggccagaggcccuccaucugugaguuugguauaaggggaggagggacucuuaccagguggucaggugugauggccacagaaaagaccuugaugcccagguguuuggccucauuuacugcaucuuccagacccccgcaugguuccuuguagcccucuagaggaugcccgucggucaccacgaucaaguacuuguucuccuucaggugggagccccuggagaggcgagcauggugaggagcuucucuaggcucagagccugggaaccagagcugaggcccaggagaagaacccaaggcagcucugggcaugcugucuguccccugucacccagggaccagguuuuaccacugaucacaauuauaaaguauccggucucaugggguuacaugucugcaaguaucacuucaagauacacacuuucaggaaagacacuggcccucagcuugcaaccccuaaaugggcaucaucucaagaugccuuggaccccaaaucucugagaacaagaggcccggggugacccugggcuaccuggguaguccuguggaagguaauuggugucagaucuagagggacucagacagccuuugauuuuguuucacccuaaaaaaugcagugggcuuccccaaggaagaggccagagugaaacagggacccacacagacagacaugaggucuuuuccacaugcugggagccauaccacguguauucuagaaaaccugucuucacauuuauucaguggguugcaugacguggccaggcucuggauuccuaggcccccagcccagccuugcuuucuugccucauaaaguuacacgagaugagagcuaggaccugccaucccaggcagcaucaccacacauggguguugaggugggugcgcuaaaugaaccuuggacuggcgcuuagccuggcagccauuuaaagcuggagaaucucagcaaagccacagaagggaggugucaugaggaggcagguauggcuccccugcgcuggcugcacugggcagcugaugcugaggugggguuggguagauaugcagccugugccuaccggacuggucaugggcacccugugagcacagaguuauagccaccccuugcccaucagcucaacaccugggccauuacagaaaggcaucuagccgggugaggagagauccucagacccacgcaggauagcaagggagacagaagccacgcccccugcugcuaaaggacuucggcuggguggucccagggcuggacugucauagccguucugcaauaacuggcuucucucucuguaucucccauggucucucucugcuucucuauccuuuagucacgagagacacauggauguguggugaucggggcauggccccguggucccugcugagauuuguggcugcaggugcaucacucccucaggcaaauucucuagccgucggcccagugcuugauggguaacaggcagccugcuggaaguuuaccuggccaugaaaacgggccaaggaggcccuguaguacacagguugaaaaggccuauggguagagagccaccuuagacugucccgguucacagacacaauggguccagauuuggccauuguaauuggcccuccuccacucacccuaugagcagcuccuccagccccuucuuaauggcgcagucgguguaggugccuuucccgaaguacuugaccgcauccacgcuggccuugagcucaucgcggccacugggcaugcgcgugagcccucggaugaucuccaccucgucacuguagugcagcgcacccgcauuccaaaccagguugcggucacaccgguaguaccugcgaguuguaggugaaaugaggugaggggagcccagagagaccuccccacccccacccccaaggacaugcuaacccuugaccuucaugaaagaacuugcugucccaccacccaaggguaccacuguguccccaucucacagauaggcaggugacucggggucccaugacagaaaggggugguccccauccuggggcuauacaauggguauggcuguacaaaccaacugagucucaacugagacuuaaaggugacccccagcugggggucccagaccaccaccacacacugcagaagacugggugggacuagagucaggcacaagccagauuuaacuagagcauggugguuucugaaguuggucgaguucccucuacccugcucuguagcaucuggccccacagcugucuaggaucugagaugggggcccacauauguauuuucaagagacagagugaccaaggccccuauagugaagcuaauagaauuauauguaguuucaccccauuucacaggugggauccugagacaccagaagcuaaguaaaggaauggaggagacccacuguuaucuguacuuagaucaacuuuuuccucccuaccaggcucagacauuuucccuaaauucagguccccgagguggacagccuuggggguagcuggaucaccccagucugcuggagcucacuuaucuccaugggcagagagccccgggcccuggauggguaguuagcaugauugaggccuaagauagcauguaugggcuaaguuccuguccucacagugacugacuguggggacccugcuaggggaagagacucacgaucugcauccuuccucagggccugcccucggccacacccucugcucccagugccccguugaggagggagggaggaagagagugaaugaagcaugcuaugucccacaguccccuccucccaggcccugugaugaagacacuggggauguucagcccaggacuuaggugaaggcucuagugcccauguggacaggugggaacucuggccacaaggcauagcuacacaucuggcagacuccucagacccugucuguguguuuggaguauggagaccucacaacucuauacucagaacggucuucucagcccuauugacaaggugacuucccucucuccccgcugucccuucucccacccacucauccucucuccugucccucugagcugcagagacaugggauggagcucuggacagcuucuggaauguggaguuaaggcucagcucuaccugcagguccagucccccacccccacccccaccccuacccccaccccaggaccacagagcuacaggacaggccaaggcaagcucauucuaccugucucucagguugucaaugaagcgcuuagugaaggacuucaccuuguccaccaaggccccauaagguuucagccucaaggccacacucuccgaggugucgagcacgaagaauagauccacagggcagucugagccagagaagaucccaugagccaugcucugagccccacugggggcacaaggccccauucacauauccccauucuggccaggggcuuccuggccagacaccauccauucucaccagcagagcuccgagcaggugaucagugcagccccagccccucaccugccugguggguaacacccagcagggucugagugagagccaagucucaggguguccuguccuuggacagagccuugcucaguuacaguggccuuggccaguuacagagugcaggggcugccugggagaacuggacuauuucuccuuauggucucaacccaaagccaccagaucuaugaccucccccugaguugugaagaggcagguuaccuaugcuggcuaucaagcaaagagagauuaucagucauucgcucaggacagaaauggaccaggcuccccuugcugcucagucccucuggaguuuaccaaccugucaucucccuagcauggcaagauucggggugacaggacuccagggccuuuuggcugggagccggguauuauauagcugcuucaagacaggaaccaaauagaaugcaggcuuggacaaggggaaaguccccuucuuaguggcucuccacaagauuaagacaaagggugggggggaggugggacaccggacaguaccuugugggguauugagccccaucaacuuucaggccuucaggcagcuaaacacagcacacagggagcacagccaguuuacucaccuuggaaggcaaucgcuuuggagcccuggauguccuguguggccacccagcaggcuuguagcagcaggggcagcagagcgugggccagccucauguuucuggcuggccugcgagucaccgucaaaugugggccagggucagggugggcgcugggaaaggcagagugagagguugucucugcuugcugcagucagagcccagagcugaggagagagccagggaggguggagggagggagggagggaggugcaaagaggggagggaucaggagaggagggggagaggaaggggagggccucaaagcugagugagucacagcaucagcaucgggucucuggaaccuugaagag

SEQ ID NO: 5584 - RNA, 17382 nt, Mus musculus
cucuucaagguuccagagacccgaugcugaugcugugacucacucagcuuugaggcccuccccuuccucucccccuccucuccugaucccuccccucuuugcaccucccucccucccucccuccacccucccuggcucucuccucagcucugggcucugacugcagcaagcagagacaaccucucacucugccuuucccagcgcccacccugacccuggcccacauuugacggugacucgcaggccagccagaaacaugaggcuggcccacgcucugcugccccugcugcuacaagccugcuggguggccacacaggacauccagggcuccaaagcgauugccuuccaaggugaguaaacuggcugugcucccugugugcuguguuuagcugccugaaggccugaaaguugauggggcucaauaccccacaagguacuguccggugucccaccucccccccacccuuugucuuaaucuuguggagagccacuaagaaggggacuuuccccuuguccaagccugcauucuauuugguuccugucuugaagcagcuauauaauacccggcucccagccaaaaggcccuggaguccugucaccccgaaucuugccaugcuagggagaugacagguugguaaacuccagagggacugagcagcaaggggagccugguccauuucuguccugagcgaaugacugauaaucucucuuugcuugauagccagcauagguaaccugccucuucacaacucagggggaggucauagaucugguggcuuuggguugagaccauaaggagaaauaguccaguucucccaggcagccccugcacucuguaacuggccaaggccacuguaacugagcaaggcucuguccaaggacaggacacccugagacuuggcucucacucagacccugcuggguguuacccaccaggcaggugaggggcuggggcugcacugaucaccugcucggagcucugcuggugagaauggauggugucuggccaggaagccccuggccagaauggggauaugugaauggggccuugugcccccaguggggcucagagcauggcucaugggaucuucucuggcucagacugcccuguggaucuauucuucgugcucgacaccucggagaguguggccuugaggcugaaaccuuauggggccuugguggacaaggugaaguccuucacuaagcgcuucauugacaaccugagagacagguagaaugagcuugccuuggccuguccuguagcucugugguccugggguggggguaggggugggggugggggugggggacuggaccugcagguagagcugagccuuaacuccacauuccagaagcuguccagagcuccaucccaugucucugcagcucagagggacaggagagaggaugagugggugggagaagggacagcggggagagagggaagucaccuugucaauagggcugagaagaccguucugaguauagaguugugaggucuccauacuccaaacacacagacagggucugaggagucugccagauguguagcuaugccuuguggccagaguucccaccuguccacaugggcacuagagccuucaccuaaguccugggcugaacauccccagugucuucaucacagggccugggaggaggggacugugggacauagcaugcuucauucacucucuuccucccucccuccucaacggggcacugggagcagaggguguggccgagggcaggcccugaggaaggaugcagaucgugagucucuuccccuagcaggguccccacagucagucacugugaggacaggaacuuagcccauacaugcuaucuuaggccucaaucaugcuaacuacccauccagggcccggggcucucugcccauggagauaagugagcuccagcagacuggggugauccagcuacccccaaggcuguccaccucggggaccugaauuuagggaaaaugucugagccugguagggaggaaaaaguugaucuaaguacagauaacagugggucuccuccauuccuuuacuuagcuucuggugucucaggaucccaccugugaaauggggugaaacuacauauaauucuauuagcuucacuauaggggccuuggucacucugucucuugaaaauacauaugugggcccccaucucagauccuagacagcuguggggccagaugcuacagagcaggguagagggaacucgaccaacuucagaaaccaccaugcucuaguuaaaucuggcuugugccugacucuagucccacccagucuucugcaguguguggugguggucugggacccccagcugggggucaccuuuaagucucaguugagacucaguugguuuguacagccauacccauuguauagccccaggauggggaccaccccuuucugucaugggaccccgagucaccugccuaucugugagauggggacacagugguacccuuggguggugggacagcaaguucuuucaugaaggucaaggguuagcauguccuuggggguggggguggggaggucucucugggcuccccucaccucauuucaccuacaacucgcagguacuaccggugugaccgcaaccugguuuggaaugcgggugcgcugcacuacagugacgagguggagaucauccgagggcucacgcgcaugcccaguggccgcgaugagcucaaggccagcguggaugcggucaaguacuucgggaaaggcaccuacaccgacugcgccauuaagaaggggcuggaggagcugcucauagggugaguggaggagggccaauuacaauggccaaaucuggacccauugugucugugaaccgggacagucuaagguggcucucuacccauaggccuuuucaaccuguguacuacagggccuccuuggcccguuuucauggccagguaaacuuccagcaggcugccuguuacccaucaagcacugggccgacggcuagagaauuugccugagggagugaugcaccugcagccacaaaucucagcagggaccacggggccaugccccgaucaccacacauccaugugucucucgugacuaaaggauagagaagcagagagagaccaugggagauacagagagagaagccaguuauugcagaacggcuaugacaguccagcccugggaccacccagccgaaguccuuuagcagcagggggcguggcuucugucucccuugcuauccugcgugggucugaggaucucuccucacccggcuagaugccuuucuguaauggcccagguguugagcugaugggcaagggguggcuauaacucugugcucacagggugcccaugaccaguccgguaggcacaggcugcauaucuacccaaccccaccucagcaucagcugcccagugcagccagcgcaggggagccauaccugccuccucaugacaccucccuucuguggcuuugcugagauucuccagcuuuaaauggcugccaggcuaagcgccaguccaagguucauuuagcgcacccaccucaacacccauguguggugaugcugccugggauggcagguccuagcucucaucucguguaacuuuaugaggcaagaaagcaaggcugggcugggggccuaggaauccagagccuggccacgucaugcaacccacugaauaaaugugaagacagguuuucuagaauacacgugguauggcucccagcauguggaaaagaccucaugucugucugugugggucccuguuucacucuggccucuuccuuggggaagcccacugcauuuuuuagggugaaacaaaaucaaaggcugucugagucccucuagaucugacaccaauuaccuuccacaggacuacccagguagcccagggucaccccgggccucuuguucucagagauuugggguccaaggcaucuugagaugaugcccauuuagggguugcaagcugagggccagugucuuuccugaaaguguguaucuugaagugauacuugcagacauguaaccccaugagaccggauacuuuauaauugugaucagugguaaaaccuggucccugggugacaggggacagacagcaugcccagagcugccuuggguucuucuccugggccucagcucugguucccaggcucugagccuagagaagcuccucaccaugcucgccucuccaggggcucccaccugaaggagaacaaguacuugaucguggugaccgacgggcauccucuagagggcuacaaggaaccaugcgggggucuggaagaugcaguaaaugaggccaaacaccugggcaucaaggucuuuucuguggccaucacaccugaccaccugguaagagucccuccuccccuuauaccaaacucacagauggagggccucuggccuccugggccccagagcacuggcauccucucuucugucacuguuugaguacauauagucugcugggucccuggugugacccuuggggugaagacuccccaguagacaguccuagcccuucaaagggaggagcguggguaucccuguguggguuccacaacuacuacccaguucacaguggcgcaucgcuuuguggaggugacucacucaucucuccuucccugcguucucaggagccacgucuaaguaucauugccacagaccacacauaccggcgcaauuucacggcagcugacugggggcauagccgcgaugcagaagaggucaucagccagaccauugacaccauuguggacaugauugugagcauggacaucuucccggucaggggucagggggucagaggucaggggucaggaguagggggaaggagggcuaugcccauuggagagaguaacucuuucuuucauuuucauuucagaaaaauaacguggaacaagugguaagugcuucccucugagaccugagucagggccugggucuuacacagguccuagcucuagcugugagcccgcuauuggugggggggacgguguccaggcucuucccucuccauguuuggucucugacugcucuccuaucuuucucuuccacaguguuguucuuuugagugccagguaagugugguccauccucucugcuggccugggaccucugucuaggaucugggguuaauaaugucucucuuguuucccucaggcugccagaggaccuccagggccccgaggcgacccuggguaugagguaaauugucaauggaauuauuuuaauauagguggaagcagugaauucauccauggcuuuauuucuucaccuuauacuaauccccauaaccucacagagaaaccaagauuucuuucaagcugcgucucaauaccugggcaguuaagugauguauauuaaccucuuaagcugaccuggcgauuucccagccgugaucccaauauacuugcuucuucuuauuggucuggcucuuugagcuucagguguguuucuaugaccucucucuggcccccucccucguaguucuaaccucuuaucauccucuugacugaucugacucucuuaccccaucuccuuccccuggcugguggaaauccugcccuguucucucuucuggccagccauuggguguucagcauuuauugacaaggcagagaggaaaugguaagaacuguuuauacaaacgugagauaggagauucuugaccuaagcuauaaugccgaguccacauugaaacaagauuuagggacagagaaaucagcauuggaauaagccaaggauggauaaccugaacacuguacacauaaucauuaugcauacacugggugucugaaauaacucuuauugggacaggccacaguggacgccauagcucugugccuaccuaccugggcaucugguacaugcaacacuggcugucaguugcccuuauccagggagaaaguccaggcuucauguggguuugggguaugggaacugggguugcaaaagccugcuccuugugguccagaagguugccugcagacuuaagugucagcucagcaucuguuugacauucccgguggaguugggaaugaaacugggacucuugggugugacucacguggcacaaauuugaacacugagggagacacucgguguugguuccuacagaaggucaggucuaggaugguuuuccuaccacauggccaucauccacagagcuucuauggcccuuuggggagucucucugcugggucucccuguuccucugggccuggagcaacguaucaucaguucagccuugaugcaaaggcacaacucuaagcccaaauccagccaugaugacacagcauaaggacccugguggguaagacucccagaugccaggcagguccagaagccaaggccaggacgacucuggagccuggauggaaucgcucugaagaaacuuuucaugcacaaggggucuugcccagcuuuccagagcagauggcuguggcuccugaccuggucuccccugagcugauuuccucugccuuccagggggagcgaggaaagccaggucuuccgggagagaagggagaagcuggagacccuguaaguauugguuacugucugcaugaggguggggacaaaggcagacaagccugaggcuggacaucagagcuguaaaaacuuccagaagcauaauucugagcacagagaccacacagccugucuuuuguugggggaagaaagguaccccaggguucaggcugaccaagucugagggccucugcuuucagccaugauaagucuccuggcaaaucucucucccuucuagcgcccccccccccggguguccuggcucccccucccuuuccucugggguguggugcauaaccucuccuccauccugggugugccgggcucccuccugaccuucaggggccccacagcagcucccuuaaggauucugugugggucuagcuguagcaagggguaaggugggcugagaaggaccuuccagugcuauccagggaugucugacuaucucuuguuguguuccagggacgaccuggggaucuuggaccagucggguaccaggguaugaagguacguguccuuaauguccaauggccucucuugggugggguggaucaggcuuuggaagcaaagcccaagcugccgugugcaacaauaacagaucccuuccuuuucuguuugucucauagggagaaaaggggagccguggagagaaggugagugagggccagcuuucgggugugucccuccgaguacagagcguuaucuugagugacagcaucagggggaggcagcugguguuccugucagaggggagcaugggaaauggaagacccuccuugccuucucuaugccucugggggaauguggguggucuuuagagacagaccaggugaguucugcugcagccucaggccaccugggucagagaggauggggguggggagugucauguuaccucaguggacaguuccuggagacucucagaacacagacccuguugucuuuucuaccuauucuacccugugucccugaucuccaauuccccccgcuuucuuggguugguggggguggugucgcccucccaccuaaugggagaauggaggugcagugggugccgcccucugacccucuucuuccuguuuccacaggguuccagaggaccgaaagguuacaaggugaguguggacggaccaaggacauagaugcuguccauggggccagugcuagugacaucuggccuccaucuaaccuucuugcgucuccgugccucacagggcgagaaaggcaagcgcggaaucgacggggucgacggcaugaagguaaugcugaggcgggagggcugggaggguggggugugcuaucuaggaugggugcaguucccauagcaggcuuuccugggaaaccuggaggugugagcugggugauguuuccugccaagacccagguccuaguaaaccccaagcgagccacuugaucucagagggcuccugauguucgggugcgggggggggggguuggaugaacagaacucuagccuccacucaaccauuccaaucuugacguuuucuucuccuuccagggagagacgggguacccaggacuaccgggcugcaagggcuccccaggauuugauguaaguuaccuccucuaccccuaugucucggaauuguggguucuuaggaacuugguccagcccuugcuguauugacuccucccaaugagagagcacuacguggagucauuugauucauuugcucagucugaggguggccacuugucuggggcccaugagagucuuggcuagcuccaauuugcuucuccaucuucccaccagggcauucaaggacccccgggucccaagggugaugcuggugccuuugggaugaagggagaaaagguaagagacaggugucaagcauuccuccugagacccacagugugaggaccaagccuggcucagagcagcaaagccauaaagccuugaauggcagccuggaguuugccguucacuacccaacaucucaggucugaaccugagaagguuugaggcugugauggucaagacugugcucugcagcugugugggugacuuggaggauccugggaggucagaacucuuccagaguugguugcgguggcccgagguuaggguaauagagcauagucacuaagcugugguguggcuuucacuguauggacccaugaccccugaccccugaccuuccccagggugaagcuggagcagacggugaggcugggagaccagggaacucagggucaccuggagaugaggugagagggaguggcaugaggcgggaugggaucagccucauggacacuggggauuguggucauucucaacuuguccucccccagggugauccuggagagccugguccccccggagaaaaaggagaggccggugaugaagugaguugucucuauucuuccccagcuuccauccccacauacagacugagugcaggcuagugcacaaacuaacgugagcuauuccuccuugucccagggaaaugcuggcccagacggugccccuggagagagggugagucggcuggauaguacugucgcugcugucuuccccauugccaggagaggcuugugugagcuuggccugggccuggucuuaggagguccuuaguacaugccuuggcuaggugggaagccagacaccaggcauuguagauuucaccuugugugcuggccuuugggucacuuggggcaucucuggagauagguggccugaggaacacagaggccuacccaugggcuggucucacaugaccacagagucagcugcugagaucauaaggccuagcucucaagcuucuuccacccacccuuccuaacaguggaacguaggcacccucacaucuguuucucuucacacaggguggcccuggugaaagaggaccucgggggaccccuggugugagaggaccaaggggagacccggugagucgugccuugggacugucuagggggaacacugaggcuggacagaguugagcauagauccgcagggccagccaugccaccucauaggugucuaugccucagcucuccugcuuuccgauggagggcuggaacugccagggcucugccagggcauccaagguagggcaucaauccaaauccugucagaggcuugcucauuagugggcgcaucuggagaaggagaagcugcagguagggccagccuuggccuccaguuuugaguucaacagacccaggcaacccucacuagagugccccaauuacucgccaccaagacaguggcucuucuuagagcaaacuacugguggccacauggcuucuaccucuacacucauuggcuuauuucucccuagggugaagcuggaccacagggugaccaaggaagagaggggcccgucggcaucccuggagacucgguaggaagccugauacauuauagggagccaugacgccgaacuacgccaagaguuucacucgggucuucaaaggaaauguucccaguggcucagcauggugggggagggggguccucccauagauauguguccaugcuagccugguuuggcugggcaugaaugugugucagugcuuagcaugaggccaagaaauguaguggaggucaugcgaugcaggcacuuguaggcuccaugccauaaccuuagaucucugaccuugagcuguuauguucacagggccugguagugcgugugggggggggcggggggguagugauggguaauagagaccuggcuacaacagggagggagacuagguuggugaggacugauaugaguuccuaggcuacaggaugaauggaggugagcucuuugcaucccuggaaggcagucaggcucauucuggagacacugggguccucaggucaccagcaccccucagagccaucuggaaggaacgaggcagggacagacauagcuugagucuggaguugaccuugcuugugucuaguagggaagggguggaagucuuggugagagaacccacuucauauggagguucuacagggcuagagguacuucccaggaaaguacagccauuaagguccccugaacaaaagggacauccacacacccugacaccuaaaguaaaggcucccacauggauacuagaaagacaugcagggagcccggccugaccguaccccauacuagccacuggccacuggccacaccuguccugaggccccaaggguccuaugccccugugcccagggcccuagaugacaacgacggagcccauggccugggacucucaguucucagggaagacaaacagauguggcccagggguggugagcugaacucucauaguucuuaaucuucuagggugaggcuggccccauuggaccuaaaggauaccgaggugaugaggguccuccagguccugagguaagaacuuguccucucuucucugcuauucaccuaggcuaccccugagugucacccugaggaguccccuaggcuugcaguaucucccuacccccaccccguuucuuuacacccagucuucucucucuugcccuaagagggucccagagaaggauagugcagcccaaacuuacauucuuuaugaccuagcaauuaccuguuccucuccuauagggccucagaggagccccaggaccuguugguccuccuggagaccccggacugaugggugagagaguaaguauuugggagaacaacccugcugggcuacugcuguucaucagagacucuggcagcugagacuugccauacuugccccugagagagguguugaggggcauccacagcugggucucaagaguaaggaugccucauucaagacucucuugcuuuaagguucagcucgggguagacccggggagggggcugcuccuugaaugacaggagcagcucuggggacacagcuguccccagccauuucgcugccaucuggcaugaugacagcaacucuaccuucuuucagggugaggauggaccaccaggaaacggcacggaagguuuccccggcuucccugugaguaucagagacauguuuaucaagccuccuuugguaucccucgggccaagcuggacaucuggaugguugggauagaccagagcuaucaguuagucccggcauuuggaccugggauucugccaacccugggcacauccaccuguuguuuucacuuggcugcucuccccaguggagcuuaguauaaccauccuauccuucuucacagggguauccaggcaacagaggcccuccugggcuaaaugugaguaucucuaccgugccucugacaggccauguauguaggcccacacugcucacaugcacaaucaacacuccgugagcaccuucccacaugauaccaggcaucaugcacauucacuuacaugugacccugagguugcaccacugaauucagaaacacccccaccauaucacaucuaccuucucugccuccuuuacucccaagaucccacuaaccaauauauguugucuccugcagggcacaaaaggcuacccuggccucaagggggaugagggugaagugggagacccaggagaggauguaaguggggcggggugaggggaagacucucucuagcauuccaacccugcaggcuuugcucacuggaacaguggcaaagggcaggcuggagaugagggaccagagcagcugggcuggagucugggcaacugauauacauggcuguuccugcuaaucccauuccauuuccuuccagaacaacgacauuucaccccguggggucaaaggggcaaagggauaccgaggcccagaaggaccccagguaggugauauagcuggagggcuuggcuucuuuagaagcaaagaaaagauaaaguaacuagaggcaggaaccaaaagaccaaggggaccagacuugccccaagggcaauuagggacacugagguccccagaggacauauaguuuaagaauccaugggcuccguugauccaagcuccccauuuaaagucuugaucugcuguugcucugacagggaccuccaggacaugugggaccaccugggccagauguaaguacagcgucuguaaauaagaucuuggggcugaccguuaugaccauggaucugaaugagaacauuaaugaaaacuguucccagcugggggcaguuggggggcagcuggagagagaggcuugaagccuuguacccaggcuacagacauacacaacuauaguugaggcuugugaugacuucaggggacacagguaacaacugugggagacaucuggccaugggggaacacauggcagcuauguguugguaacugcaccauagcuuauguucuuaggggguaaagucaggaacauucuaggcugggaggagucccuggauagauccaauccccaggggugcccagggaccagcaggaauggccucagcccaagccuuguuaacaaucucaccucuuucccuaggagugugagauccuggauaucaucaugaaaaugugcugugaguauuuggaucacagguugccuuuuuuuuuuuuuaaagagccagcaaguuccuaccagcuacaaggcccaggcuucugcuccagaagggucucagaaauugggagauauagaugggcagggccuaggcucuacugaaauuggcaggucuccuacuccagaaccagagcugggcuacacacccucugagauuucagagacuaauaugcugaggaccuggccagagcuaggugaagccaggcagagcaggacagggcaccuuguaugccagagcuguccuauuuagugccuuuucuccucucuccucagccugcuguggugagugaugucucuucgaucuugggagucccugugcaaugauaaguagacucauccuggcucugcaguuggccagccaugcugcagcccugcaaggcacucaaccacacgcuugcucugcuguuucccuucccagugagcagugcccuggggucaggccuccuaggaagcugcugaucccuggccuuucucccuaauguuucaaguaaccaucaacaggcugaagcaggaagcagaccucuaggccugucuuauccacaggcucagagcugggaugaaggagcaaggguagcaacugucgggucuggucaagaggaggccagccugacaagccuagcucccaaggagacaugggagaggagucaugauccaccaugcagaucccaggacacaggggugggaccguggaauacggagggaagcccauagaagggcacuaagggcugcccaucccccucccuagagugcacauguggacccauugacauccucuucgugcuggacagcucggagagcauuggccuacagaacuuugagauugccaaggacuucaucaucaaggucauugaccgguugagcaaggaugagcuggucaaagugaguacaagccaaccugggaccacagguagggccaacagagagcugguccccuccaccaaagcuucuaggcucaccacuguaaacauugauugacguauacauugagcuggccggacccuucaacaaagucaaacaguucauccuuaauguccauggaaauauauauaguguauacacacacacacacacacacacacacacacauauauauggaagauauauauguauguaugguagagauauauauggaagaugcauauauguguauauauauguauaucuacauauacacacauauauguacauacauauguauguauguacacacacacacacacacacacacacacaauauguauucucaccacacagagaauccugauaguggguccagagcuuauccuuuaaggacagaaccuuggagggccauguacagaggcuuguggaucuggggaguaguuauggagggcucugggugaaugagcaggggucuugggccucgggguagagguccuuggaaggcugggacucuaagacauagugguguuggacuccagacccaauggugucauucccacaguuugagccagggcagucucacgcgggcgugguacaguacagccacaaccagaugcaagagcacguggacaugcggagccccaacguccgcaacgcccaggacuucaaagaguaagagcauccccaagaucuccgccccauucccaggccucuagcaggcuggccuagccaggacccugaccauggcucugacccuggccugccuaucugcuuguguagagcugucaagaagcuacaauggauggcugguggcacauucaccggagaagcgcugcaguacacccgggaccggcuacucccacccacacagaacaaccgaauugcccuggucauuacggauggacguucugacacucaacgggacacgacaccucucagugugcucuguggugcagacauucaggugggcaguugcauaaccccagcgguggcugaacggggaaggguagcagggugcuccugcaagcacgggguggaggugggggcugcucuccaggggaggggaaguccaggaucagcugauccaugcaacccuguccucuacagguaguuucugugggaaucaaggauguguuuggcuuuguggcgggcuccgaccagcucaaugucauuuccugccaaggcuuaucgcaaggucggccagguaucucccuggugaaggagaacuaugcagagcuucucgaugacggcuuucugaagaacauaacagcccagaucuguauaggugggugcugguggucaacaggcugaaugggcagugccuacaucugucuuagacaugccuccucugcuuucagggacuguagggcuagaaacaguccucacaaugugccuggcacuuuuuaccucgagaaagauuguguccuggcuguauggcacuguccagggugaccccuggccuagcagagcaacaugaggacagcuguucucaugcuacacgcaugggaaaaagcccuugcccccaacaccauggacacacuguuugucagccuuaugacuggucugacuccaugcuguggacaacuuggucaagggauguacuuugugccagauucaugacgggcaguugauuaguggcauggaacagcaaacuaccucuuccccucugagacucaguuucccccuuuuaagagaaggccaagggcccgacuccuccuuucaguauuuuggagccaggaccaggaaaugaugcuaggucaccgcuugucugucugucuguccaucgucauaggcagccgaccaaagcagaacucagauggcucacaugauaguggacuuauucagguuauuuuguauuuuuuucuuuacagauaagaaguguccggauuauaccuguccaagugaguacaaggaugugcugagacaggguagggaaggcaggaccugauuaagggucccucagggcucugggcacucuucucgggggcuuggcagcucugaaaaucugggugcccucuggccugugcagucugccuagucucaggccacccucucugccccacagucacauucuccuccccggcugacaucaccauccugcuagacagcucagccagugucggcagccacaacuucgaaaccaccaaggucuucgccaagcgccuagcugagcgauuccugucagcaggcagggcggauccuucccaggaugugcggguggccgugguacaguauaguggccaggggcagcaacagccaggucgggcggcucuucaguucuuacagaauuacacagugcuggccagcucuguggacagcauggauuucaucaacgacgccacagacgucaacgaugcucugagcuacgugacucguuucuaccgggaagccucgucaggugccaccaagaagagagugcuguuguuuucagacggcaacucucagggggccacagcagaggccauugagaaggcugugcaggaggcccagcgugcaggcauugagaucuuuguggugguggugggaccccaggugaacgagccccacauccgugugcuugucacuggcaagacugcagaguacgacguggccuuuggcgagcgccaccuauuccguguaccaaacuaccaggcccugcuacguggcguacucuaccagacagucuccaggaagguggcacugggcuagagggccacacacguggcuggacacacauggcauggagacacauuucaacaggccuucccgcccuucccacugacaaaacaggaauaggaaaugugacccaacuggucaacucaacugucuuaaagggaacgcugagaugcacacucuuugcuuuguguaauguccccuguggcucaccugagcuccuaucuagaucccgcccuugguuuguacaucaugguggccaucuugcugaccccucccccaucugggcuggauccagccaucucgucuuccuccucacugccccuaaccuauccguggugucuucacaccaucacugcaguuuccgucuguguucugucuuccaugcucaacaugaagcagaccuucucaugaguucagcuugcuggauuauggcuuuuaggaaauugaacacaggaggaguuccaaacacaaacuuggaggagaccccuccucuucaucaggugcuugucagugaccuacaugcaucuuggucugguccuuaguggcuaguccuuccacucugaaagcaaaggugcuaucuaucuguaagggcucucucuacacacccagaggcuuagcuuggacaguucacacucaaguguccugucagaaucaauccagagcuuucucccucaaaauagugacuugucucccccugguccccaaaggcuccccuuuaguuaguuucuucauggcucccccacauuccccguaaucugauccaagccagcuaucucugcuaauaaagguuuccauuuuucuccg

SEQ ID NO: 5585 - RNA, 28764 nt, Mus musculus
uaaauggaguuauguuuuauuuauguaugaaguaacaaagaucaaaaaaguucaaguuacuucucucaaguguccaaaacaucuccuccucucuguaaacaaagcaucaacaaacaggaaauggcucagaggaggaguccuggguccugcugaggccuuacgccugagggcccaggaccaggcuucuugaagcaaggagccuaaggcaggaaggcaguuuacacagcaggucucuaaugcacaccccccaugaggaucugugggugacugucagaaugauggagcgcaucucuccaggccccuggauggagagcgaucagaaaagccauuggucagucaugaacauuuacaaaugcaauucugaaacaaaacaaaacaaaacaccaugaccaaaaacacugaaacaacaacaaaaauccauuaaccaggaguaaauuuaagaaaaugugugguccuuacacaaaucaaggaaggcaggcgggguggagaggggaguacaagcuguguaguuaguacagucugcugcugucucaguacgauccuaaccuaccucccccacccccacccccaccccaccccaacccucugcagggcaauuccccauugaccucuuccaccuggaagcggaaaugaagguaggugagguuguugaucaaguugggggaacgcagaugucuucauuggguggcugguguccagccaggugccuuuguccccgcugacaagugucuaaugacgcugagccaagaaaccacuuucuuccuucucccaugaggaacacuggccuuuugguaguguccugccaucuggacacucccugcccucccuugccagucugggugaagcugaugcaguaggaggugggagcggagcuggaucugggcgggggcagggaaagcauuaaggaccaaggaggugcccaugacucauggggucagagccaaccuauaauccucaucuggcuccgauaaccauuuuagggggacaagggagaccgaggggaugcuggacagaaaggagagaggggagaaccuggggcuccuggugguggauucuucagcucaaguguaccuggcccccccggcccaccuggauacccuggaauuccgguaagccugaacccccucccccccacaggcuuccuguagguguccacacccugugaacuugggcacagacaagggacauugguuguauaccuugaaaggcucagaccaaacccugcaagcucggcugcuaauaacauggggauguuauuaguuucuccgugggcaugagucugggugagcacacgggcaggcuagccucgguugugccucaugguuguucuuuugcugccgucccuagcuuugagcagcauugagcagaccccggggguagggcaucauaucugucaugagaacucaaaaggaaccauggaccuagcuucugacugguacacugggaagcuuuggggcuguuccuuuguccugggaccauaucuccagcaaaaaggggcccuaugguaggcagggcuuauauaggccucaaaggcuacuuccagcucuggggauaugagcagauagucccaguacaaugaauggcuucucuguuguuccuaggguccaaagggagagagcauccgggggccaccuggcccuccuggcccgcagggaccuccuggcauuggcuaugagggucgccagggucccccaggaccuccgggaccuccaggaccucccuccuucccuggcccucacagacagaguaagaauguggagcgugggucugggucccugagggcuacucauguggucgggaguucucaacuugauuucucuuguagcugucaguguuccugguccuccgggcccaccugguccuccaggucccccaggagccaugggugccucugcugggguaaguguccaguuagcuaaggucugacaaucuggaguagggguggggaggcaggugacaugucaggaaguugucgccaucaguccgcugggugcagcgauuggugucuguggaaccaugggcuccccaagguacuucuagaaccuucacuccucuuggggacagccugacaaaggauaccuacccagagucacuuucuggccucugaaaucuugggagcucuggaugcucuggacagugggucucauauuggacuuuggguuggggcuuccagcaggugaggaucugggccacauaccagaccaugcuggacaagauccgggaggugccggagggcuggcucaucuuuguggccgagagggaagagcucuauguacgcguuagaaauggcuuccggaaggugcuggugaguucucaggagacccucuccccucugauauuuauaacgggauggaaggauuucuuuaaaucuucuaaagaauaaaaacuuucaagaauaguaagcgggagccaggcaugguggcgugugccuuuaaucccagcacucgggaggcagagguaggaggauuucugaguucgaggccagccugaucuacagagugaguuccaggacagccagggcuacacagagaaacccugucucgaaaaaccaaaaaaaaaaaacaaaaacaaaacaaacaaacaaaaaaagaauaguaagcguguuccucugcuuacuguuagaguuagcaauaaaugaacauucuauuacuuauuugauugcugagaccaaagacccagcaugaggggccugaggcaccuuaagggaggacugguuuccuugggcucaugguuugagguacagcccauuguggugaagaagguauaguggcagagaugucaggcaacuggugacaucaucucugcugucaggaagaugaauggccccaagauucaaaccuuuagcccugggggaagaggucagauuccacuuacagcaacauagcaugagguaggauccuaacccaagcccccaggugacucauggugauguccuugagcuauccuguaaggggauuuaaugugaugaaguauuaggccucaucuuggugccugauggccucuggaugcauguagguuaccuaugcuucguauccuagugcuacgcuauauaaacaccacgguggggauggccacaugggucaguggguagagacaugcgccacacaaacuugccaacgugaguuugauuuccagaacucacaaaagguggaaggagagaaccaguucugccaaguugucuuccaaccuccacauguacaccauagcauguguacauauauauuaugcaugcauguguauguauauaauauguacauauuauauauauauacacacacaauaacaauaaauaaauaccacgaugaugaguaaucuaggaugccugaagaugaaugagcuucuaggugccagcuuuuggguucugggccuaugggccuggcaggccuauccugcaguuccuucccaucuggcugagaagagucuaugguaucaacucucggucuaaccaguacccacuguucacuuggaaccaaacaguggggcacagucacaucccuguuuggacaggccucuuccagggggaggggcugugggaagagggugacagaggagaggcccuggccucgaagcaugcuggaguaacccuugcuguugccuuucagcuggaggcccggacagcccucccgagaggcacgguaaggaggauuuuuuuuuucccuccguucagcuguuagaagguagcacgggccacggagcacaggaaggccaggccuugagucugugccucuggauucgcaucguuacuuggcagucacuccaggaagcaacugugugucgcuggcaguugauguuaggucccggcagugcaaagaaucagcuacuauaccuuuauuuaaugaguggauuuacgaaguacacagcaagccaaagucaaagaauaauugccagccgauagauuaaaaaacaaagcaucaucaaacugaguacucaaaacacucagcagaaacugauggcugggaggcagggacccuuuaaggcagccagauggaguucccaagagaguugugggcagagagaggcccuugggugaggccuccaaguaaaacagaaaacagcaaccaauagaaaugccaucacuaaacuaggcacucagagcuuccagcagaaacugacuggggaagucggggcaccggcuggaguucccgauugagcuuucuccccguggccgagcuucccacggccgacccuccagcuucucucucccaccgugggugcauuuauuccuggaaauguugaccucuagcugugcucaagggcacugcguuucacuuuuggccuguuuugguauucucuuuccuccacuccacagugaguggggccaucuccagacaagggaccuuugucuucguuaggguuuuacuugcugugaacagacaucaugaccaagcuaguucuuauaaagggcagcauuuaauugggcuggcuuacagguucagagauucaguccauuaucauuaagaugagagcauggcaauguccaggcaggcauggggcuggaggagcugagaguucuacaucuuauuccaaaggcagcuaggagaagacuggcuuccaggcagcuaggacgagguucuuaaugcccauggccauagugagacaccuacucuaacaaggccacaccuacuccaauaaugccauucccugggucaagcauagagagcacugagugcucuuccagagguccugaguucaauucccagcaaccacaugguggcucacaaccaucuguaaugggaucugaugcccucuucugguguguuagaagacagcuacaguguacucauauacauuaaauaaauauuucuuuuaaaauaagaaaaaccaucacagaccuuggagguuacucugggauaaauaugcuugggugugaaauaggaggcagggggcagccccagagccaaccucucagugagcucaaaugacuugugacagcugacuaauacaagguagggacuuagcuugaccagcacccaggagcccugaggaggcugugggugagacaaaacugucuuccaggcuccuaccuggcucaagccuguaccccagaacucaggguacagcuuucuucuuacuaccucaggcccagccugguccugccuaagagcacagaauaaagugaggaaggggauaucucaaguaaggagcuacuccaggcauuguguguguccauucuuagggcaaugagguggcugcuuugcagcccccauugguccagcuucaugagggcaguccauacacccggagggaguacuccuauuccacggcacgacccuggcgagcagaugacauccuggccaacccaccgcgccugccagaccgccagccuuaccccggaguuccacaucaccacaguuccuaugugcaccugccgccagcccgccccacccucucacuugcucauacucaucaggacuuucagccagugguaaguguccaggguuuagggcuguuuccauccaacucugguccuggcaggacagagggaagcaccccagagcugccagcgggggaguauuuuggauagggaucuauagguaaguuucugacugauaaagguugcucaucauuuaggccuuaucucuggugacuuagugguuaucaaugaaauuaagcacgcaggagccagucucugcuagucuguaauacagcagauaagugggcagugggcuguguaccugcugugccucuguccuacggaggguggggcagccagggauggagaguaccuacucuacagccaggguggaacagccugagcuggccccugucucugcucacaggaaaagggauaucaggggcuaucuugggggucugcugggaucaccgugccugagacucuucuuugaugcucuaggcuaagagagcccaggacaggguugcuugaagguugucacuaaagugacuggucucaucccuccguggacucugccuaugugcgcuuugcuguggguguguaggccacagacuagagguuuucuugcgacgcugcuuaugaugugaccauucaugaccuuuccggcagcuccaccugguggcacugaacaccccccugucuggaggcaugcgugguauccguggagcagauuuccagugcuuccagcaagcccgagccguggggcugucgggcaccuuccgggcuuuccuguccucuaggcugcaggaucucuauagcaucgugcgccgugcugaccgggggucugugcccaucgucaaccugaagguaggugaaaccuguccugaagguucuggaaggccaaaagucugucuccauuuguacccaggccuuggucuccaaugugaauucacagcagggcuaaccauuccccuaauauuccuuacaaagccccucggaucccugccccucccagggcccuggcuccucuccaugggccuuucuaaugguuccugugcuacugaccauauagcccaaaguggcauggagucauuuauuugugccaccuagccuggcccuuccgccaugggacccaucacgugacucuauucuuggaucuuuccuauaaagagagcugggauucucagggcuuacagaccccacagucucaggcuuguaaggguaccuguggguuucacucacugugauaggcccuaccuuggagaagggacucucuaugcuucagccccauguguuccuuggugucuuguaaucucccugacggucauuccucugaccugaugugaugagugacugaugccccugcuguguuucuuguaggacgaggugcuaucucccagcugggacucccuguuuucuggcucccagggucaacugcaacccggggcccgcaucuuuucuuuugacggcagagauguccugagacacccagccugguagguuccccccagcauuaggagaugugaucaagaccucaaucucuagacugacacagucugcacauaaaaucauagaaccuagaacauggaaauacaugaucaugguaugucuaagcaaugagguuguggguacccucaaagccauagcagauuaugucaucaccugugacuacucagcuauacugcucagccauguaaaugccaccgaaaaguacugauccuggaaggcagcucuccagcauagcccuuggucacagaaggcaccugaacuguugaccaacagcuggacugucaucagaaugguguuguacccacgucucugcaccuggcagccaagacaccugcuucaaugacccugcucucugaagggugacuuggggagcuagacacaugugucuagugcaguauuugaguccuguccaucugcuuuucccaggaggcacccgcgagggcccuccuggccccuacacgagcugaauggcuaagucccaguagcagagcucacucuuagcauguaucaaggaaggcuuccggaaagccagcccugagguccuuuggcccaggcugcaccccuaacacccucuuccucugcaaggcuacacaucugagagguggaccuaaguccuguaggucacaggggccuuuuccugucucauugcccugcuguuuccaaagacagcggcuggccuccgucuucucggccuuagugguguccagguagcugacagucuguauaccuugcaggccgcagaagagcguauggcacggcucggaccccagugggcggaggcugauggagaguuacugugagacauggcgaacugaaacuacuggggcuacaggucaggccuccucccugcugucaggcaggcuccuggaacagaaagcugcgagcugccacaacagcuacaucguccugugcauugagaauagcuucaugaccucuuucuccaaauagggccucugccagcuaggguggcagacagaggccaugcagaacuuugacacagcgcagggagcauucagucagcacccagggcucuggcugggauacaauccuguauaguucccauuuuuauguaauccucaagaaauaaaaggaagccaaagaguauauuuuucuaaaacauuuacaacagacuuccugcccuuccucucccacuugaacuggccagucugugucacagucccuucuuccuccgugcuugguagagcuuccuggcgaagucggaccacagcuaggucuccaccggaggcgaugcccuacaguugcugccucagaccugcagacucuaucuagccugggaucuuucugugcagaucguucauacaacagucacaugccaugugcuggggacagcacagggcaggcaguccaaggcucccuucucaccgcccaguggcugugccaggcauauaggcgggcaccugcucauccaggugguaacugggucuacucauccuugagcagugggaaccagcucuccugacugccccacucuccugcagccacacucccugccaggggagguucccaagcucaguaacucacugugaccccagaucugacccccccucccgucaccaugggcauaggccaggaauguggccagacuuagccugcgugcucauuuuuccgagggccagacgugacauggggcccauccucagguuugucucucagacuggccucucuggcgaccccugagauccuguucagagaacccaaccccaaccaagcccaagcuggacaucagcuugaaguccagaaaucucacagcagccacaugaagcacuuguccuaugaagggacuugugugcccagggucacaaguggccaaucaaagccacugugccugccucaggcucugcuguccaaggauugggacaauccagugggucugguucugugacaaugugugcuaugaugccauuucaaagaggcaccaaauaaaaaugacauuuuauaccaacgcuugguuuauaagcugccuucccuguuacaaaaaggacgaaucaccugugaugagaccugggagccuccguuccuguacuugcuaagggagcucagaugagcauggauauagucguguguacauggauaccggccugugugcacacacaugaacaggcagauacacguguaugaguacacugauguacauggucagguggguauauccacuguuuuggauggauacagacugcacaugggaccauucaugugugugugcacagguguacaguggcaugcaugaaugugugguauacagaagcaugcauauauaggcagguauguuuguauacaaagguaagcaggcauaugaaugcacacaauguacuguacacacaugcacagaugcuaacaguacccuccaccugguauccagcagugcacauguggugacuucagaaucauguagagggggcuaggagaaauggcucaucaauuaagacuacucggugaucuugcaggggaccagcgcucaguucucagcaucagcuuggcaacuuacaaccaucccuaacuccaguuucaugggcucugauacccuuuucuggcucccagaguuaccgggcacacaugugaugcguauacauacaugugagcaagcacacaaguggauaaaacaaauuucccaauuuuuacacaguauguuuacucagccucacacccaccacuuguauuggcuaccauauccuggcuguggcuacccuaagggacugugcuugccuagcagaggagaccauguccaaagccuccagccaguauagguugccaggcguaggcugcagagcugcaaggaagggugggugggcaggugcugcuggggagagcauuugcugggagagccuugaguaccagcaagccccgucuuacuacaucaggagccacugaaggcuucaggguaggggcugguauagcggggguggccgcacaccaucucuguccuugguaaaggcccaucagagguauccuagaagaucaccaagccuaggagggauggagcuagcccuccucagcaaggcuuuagagugcuguggcagacucuggauguagcaggcccuguguccucuguaaucaccagcaggugacaggccagcuuugcuugcagccucuuucuuggcccagggucuccaagaugaccuuuggagaaguggaccugcagguagguccuaaggcacaauuggcucagcagccccaccuugcuuucugcugagcugauuacucauuacugcaagcuggauacugcuugugugcccuaugggagugaguucuugcucuggaguugggaguuaacucaaggacagcaaaggccuagucucugguguguguccucgcuuuagccaggugacagcgaucauacccauaugugcuaggcuaggccagcacggaaugagaagccgcagcauccuggaguccguuuaaaguaucgggaaaagugugcuugccacagagucuaaccucacagcuauggcuuucaagagcuaagccaggaaacccacuuccgcagugcaagccccuacaggcacuccccucuaggaagacuuugguucugaucaaggcuggcacaccugcaguccucugggcugugugacaagucauuuagggaugacaggagggacaagggaggacgcugggcugaagucugccgcuaccucaucagaugggaauaugccuagugcuccucugacucuagugucucacaacagaaaagcccaagguaguucuccauuuuaaugucaaguuaaaaaagaaaucagaaaaccauuuaaacaagcaccuccgauaguggaaggauguauggcagcauagccaggagccuagggcaggcaacuggcacccugcaggcucagcggaccuuggcuggcaucugggcuaccucacuagcccuaaggggcagacaugauuugcccagagcuucccagagcaaaaaaggcagaauggccuggugggcauaguugagcccgacacagguucuucuuggcaagcaauagacaacccagacucgcaguggccuggcacgugguucacaaagccagggagcugcccuugagugucgguagcaggcuacagccauugcuaaagcaugaaguaggcuggguuuaggguccucagaaggauaagcuaacagguggccccuuaaggaggguucuguggccuaaccuaaaggcuccuaaaaggcaacagcgggggcccccuguaugucuuggacucaaggcaacaucgacugggagcacuguguguagcaucaggcccaggcugguucagguggagugcaaacaggaggggcugccucugagucaggaaucccgccgcugaacugggaugaagcuaggaaggucaagccuuggcuucgacucuuaagucuccccugucguccuccaugccauccucugagagcagcuguggcgcugagggcugcgguccccuuaggucuccauccuguaggcuuaucgcuugcacagaagucuccaagggacuccucagcuccugggccugggccaggggcugguggcgaccacgcuggcaguaccuuaagccauccagccccgcccaggcaaagcaggugauagacagcaucaggaaguauaugaaguagauacggaacugaaagaaagagagucuggguaacugcaggcuuugugcccacccuugucccaaccccugcccuacuuagggaauuccacugagguucuccaucacccagccuccagguggccagaggacacugaggagucacaggcuuugcccugggguagaucucaagauggcugguucucuucucucacagcauggucaacauaaaagggcuacuuaucaauuccccaaagaucccccagaguacccaagccuaugucuggcaucugugugguccucaauggcuggucuuugggcucuaauuucauggaauugacucccauggccaccaggaggguuccaggacaaugcccuaggguuucuccuaggcccuggccacagucaagacugggcauagccuugccugcagugcacagaagugaccaacagaggccuggcaaucauaggccacaccccuucuugaaggaccaaguacauucccuuccagagaggaaucugguuauugccagaagguccuagaaaguggaguagccccaauggaggcaagugagcuuccugaagccccuugggacccuuucagaaaugaucacauuucaagcaaauucagaaacagccacugggacuucuguuaugaagaagacaggguugacauccuuuccccauuccccugugucaaucaaacuccuggaugcuguuagccacacccacuggggaaggguggagagaagugucagccagccagaccucaggacccacuaaagguacggcaaguacuaggguauuucuuuugcuccauggaucuuggaauggaagaagccuggaguccggcacagguagaacgcagcuagagggaaggcacugccugacuacuucagucacaccagacacaaagaaggacauuuuggguggggccaggcaaugaccuugcuucucaccucuaacuucaugaugucaguaacaaccacccagggcgacuggacccaccacacacacacauacacaacacacacacacacacacacacacacacacacacacagagaugaggcauucacugcccacugcacuggaggggagcaccacuggacuuagaacuccuacucuacccagaaggcacgccaaccuacacaaccagagcugugagggcaaggcaccaggagaccuuugaccucugcuacugcuucacuucaucaaaaccgaugaccucacaccaaggccuguggacaccaaaggcagucaguagguacugaaaucacgugggaaaauuuuuagaucauccaccaugaaauggguuagcaugcagcaacaauaauccagaaauacaaagaggagacagcaagaaauaagggaugaaagguaagagacauuuagaccaaagagggcuuguggaacaaggggaacuaacugaucaugagagaccacagcaaacaagaccucccucuccucccuugauuucucuguucuucuguuuuuugagacaugcucacuaugcagcucagguggccuugaacucacaauucuccuguuuuagcucccugagugcuggcauuaacagcaugccuggcuacguuucaugguaaaaacugauuugauuaacacugucuuaugugauucugaagguauccaggcaaaaugucagggcaacaggccugucaacaauaagagggcccagugauaacgucuucacacuacacauaacuugggaugcccuugcagucccaaacaucagaccauuacugccuucuaaagagauggguagaagagacuaaauucugguuucacaaaugaauccaagagaaaagcaugcaaccacccgugugaauggcuaauaggaaagaggugcgucacgcacuggugaagauuuagggaaaaggauucuuauacccugcuggugggauagcaguggcccccacugggaauucacagcuccacuucugggcucccauccaggagaaauaaaaccuacauucacacaaacucaagggaagaacuuguaagauccgaggacugaacacagcccacugcacuuuggaaguucagcagcuaucccaggcacacugacagccuauaauagcgauggcaccaccugccccaucugaggagaagcucaagggcauguaggugcacaggagaauggagccacacccagggagaacaccuauucccaggccacaggugaagggaguggcuguggccaagaaaggaucuuguggugauuugaauauucuuggcccaaggagggucacuauuaugagguguggccuuauggaguggauguggccuuggaguaggcauggccuugaaguggguauggccuuguuggagggagucacugugggugugggcuucaagacccuccuccuggcugccuuuggaugaagauggagaacucucagcaacuccagcaccaugccugccuggaugcugccaugcuuccugccauaaugauaauggacugaaccucugagccuguaagccagcuccaauuaaauguccucagucauggugucucuucauagcaaugaaacccuaagacagauuccaaggguccccgaagggaugaaauguucuggauuuugacugaaaaaaaaaaaucaauauccggauuaugacacugugcuaaagaaaugugacccugaaucucucugcaugguuucuuaaacuggaugcaaauaaaaccaaacuuuaaaaaaaaaaccucagcaaauccaggcuggcucuuacccacaguccccagguuccacccugcuucucaguggucuuugguucugcucccauugcccggacuccugcccuagccugucucccaacucaggaugaggcaugagaggacagagcaggagacugcaucucuuuugacuaugaacaagacacaaugcuggaaagaaaaccagccagagaaacgucaguauacaucucgaaauuugacugugcaaagcaggagauaagggucagaauacuccugauccucaggggaccccuggauauagucugugccaaugacuaggacugaccaggcacccucaagaagagaaguucucuuguggccagcccuuugggaaagagcugacccagaccccuuccuacugagccucuuaccccacuccacuaaagcacacuagcaagggggucuaugcggggcagcuggaacggaacaggggcaacacagggcagcaccagucuccaaagagucucccaggccccacccacuaggcagccaaaggcugaacaagaggcagcuauggaggaagaaggggacagaagagaacacaguguccuuagaagucagugacuaaaagacaaaucacauguuuaguacacuauagcugggggcaauuggguucccccggagguuucuuuggacagcccccuccucuuuaggagccccuacucuuugaggacagacagacuugacuguccuggguucagucugcaggaagucugcacugagagauuuuggcaagcuggaggcaaguucaagcuuuacauggcaggacugcgcccucacuucacgugucuccucagaugcucccagccgguuccuagugagaugcuggucugcuccugcaugcggaaacaccuucuccaccugccuccucacuggcccaccagacuuaacaccaaguuucaaugacagggcugugccaucuaggaacccuuggcaugucagcacuccuccauggcacacaccaaccugcaggccuauggcccagggaaaccaaaggcuuucacagguugccuaggugguaacccagccugguuaucaucccuccucaugggcugacuaucaaguccauacuuguguggcuaguaccugcaucaugcugcccccaucagagggguuucucagauacacacaagaaaaacucuggcuguugugagaaaacugagggcaucccaaggggggccgguaggccaaugcuaucugauaccagcuccaaccaagggguucugccuagcucccuccuggacuugaacacuucagacaucauccaaucugggcucaaggccaucaggucuugacgaucaccaauagggaugugacaugaaaguuaaggagcuguaaccaugcgaagucauugguccaggcccaggugaggacauacaaggucugaugaaggcuccucagaaauggccaacaacucagccagccuuggaggcccagccagggcuccaagucccaaagguccaaccuggaccuggacaggagcggguaggggcacauggauagauaaaaguggcuaacuucgggguuggagagaugguucagaggcuaagagcacuggcuauucuuccagagguacugaguucaauucccgacaaccacauggugguuaugaaaucauuuauaaugagaucuggugcccucuucugguguguaaguauaccugcagauguaauacuauauaaagaaauauauauauauuuuaaaauggcuuacuucaccacauccagugccccuggaaacgugagccuguccaaucgucuuaauuccugcuccaaaugugggccacacucugcauacuccagggacaauggaccugcagucucuguccccugacagugaagcacaccaggaggcccucaccaugaccacaugaugggcuucccucccccaaagacauggcacucaagugggggcuuaccugaucacggacuuggagacccagaccccgcuugucagagaccacaagugugauacaggucuuaagcgcaguagcuaggaaaguguugaucccaaagaccaaugcacagagcucuuuagacagggaagacgcaaucugaaaacugggagauuuuuaaaaaaaaauacugugaucaaacucaccguguagggcagggguaagaagacagccagacaucauuaaucacagcacaggaggcaaaagaugccaggucagcuuggucuauauagugagaucucaucuaauuagacacauuaucaucaucaucaucaucaucaacaacaacaacaaacccaaaaagcaaaaaaacaaaacccaagccagggagacuccuguaucuacccaggaauacagcaaaguaucaagucauacaacccuaccaccagauugagcuaagccacagacacaacucuaagguccccaaccagcacaccugugcauagcacugcccuccccucccacaugcacccaccagccaaucagagcugacccagggcaggaggacaugccuauagagacugacuccagaagacugggaacaggaaugcgcucucaacucacagggcagggauaugucaccaggggaugugagaagggaguccaagaaggaagaaaggcagguuaggaagcccugggagggaggaaggagccaagcucuucccagaagagguagacagugggcaggcaaaagguggcacguaccagaaggcaagugucuguauguggugugggcacauguauguaugcuaugcacagugcaaaugcuaaguacauaugguauaugaaaccuaugauauauaaaaauguacguguauauauuuguguguguauauauacaaacacacaugcauacauauacauacauacacacauacauauauacacacauauauacacauacacacacacacacacacauauauauauauauacauauauauauauauauacauacacacacacauauauaaaacacacacauguauuauauauggcagcaugcugauccauguacauguaugguauaaacauggacuguguagugcacauguaguggaugguguguguuuguguguugucugucuggugaugugagcaugugucugugagccuauuuuucauuucuuuuagacaaggucucaccaugaaucucuggcuggucuggaacucacagagaucugccugcuucugccuccugaguucuaggauuaaagguuguguaccaucacgcccagcucugcgaggauauuugaggccuaccuggcaugagcugaguguguccucacauaugauagugugugugcccuccauaccagccuggguggggucucaaguaaaguaugcuaguaugaucuggaagaggucaccugcuguccguuccgggcagcuuugaagcagugcucagaggagcugggagagcaaguaggucaaguccagaaaaggaaguggggcaggucaaaggcagcaagagggggugcagguuagaaaauggaaggaaaggggcuggggagauggcucagcggcuaagagcacugacuguucuuccaaagguccugaguucaauucccagcaaccacaugguggcucacaaccaucuguaaugagaucugaugcccuccaaggggaggagaagguggggugcuggucaacuuuagguggucuaugggacagcaacacuauagggguucagaaaggacuggcggaguugggcgagaacuaagacugcagggugugcucuguccuuauagggguugugaggccuagagaaagcaguguaguggacacagccaaaagugucuagacagucaggccucccacguaucugccugcauugccuuaugcuccccaacagaaccuuccagaagccccucccacaccauuucacucacguggcaaugggcacaaggaacugguaggccccacggaaaagcacaaaggucacguagcacacccagaugucccggaucuggaacauacagaaaaccaggcuggccuggauggcgaucacaccugcgaugaccagcuuggaccacagaguccagcggaugcucaggaagccggcggagaaggacgugauggcgccugggagguaggaggcauucagucauggcugagcucgggcaagcgcacucaugggagagauggacugcguuaggguggcucuggagcacgggcaggguagggcaagggauagggcggucuacauuaguggucuaucccagggcaagggguagggcuggacuacaggcccacugggguccagcugggaccagcaagggcccuccggugcauacucagcaguguggaggcggcaucuacggcgccauuguagcugaggcugcugucagugcuucuccacaggacaugcacauaguaggugaucagguaguagccugaagaguugaagacccaccagaggcaccagagacgcagcugugguugccgagcauuuuccaccaguucacuuagcaugcgcaccaggaaggagucccugcaagugcccagcaugcgaucuaguuuccugguuucuggccggucaggccccgggugcaucugauccagcucacagggcaaggcuccacgcgcaagcguacugcgguugaaaaagaggcuccgcuuagggcgcuuuagaaagagggagaggaccaggcugaagaggaugaagcccagggagacacaguugaguguauaggugcuuauauguccuacggugaccagcgccuggcccaacacagagcugaugaagacucccagcaguacugccgcccgugaguagcuggccaugcgcugguagcgggaggggugcaccagggagaauauguaggaggaguaggcgaugcgggccgccauggugacgcuguagaagacuuccaugaguugcaugugcacgacagaugugcccagcagcagcaacagccacacgcacacgaagcucaggcacugcaggaccaagacuggcuuguaucgcagguagucggugagcaggaagaccgggaccagcacagccaggugggaguagggcagcaucggaaugaucucguuagucaccuguggacgggcgggugcugguuacuaaugacacuuggcugcuccccugaguacuucagagugagcaugcaagagucuaccuugcccccgucucccugaucgaccacaacaugaaccuugaaaccgagauaguguuuccagcccgagaaacugcagaccccaggcaugugacucacaggaagcugucaaacuguggggggagccaccguucauuuacaugcggacuaccuuauccuaggcuuucugacuuacacucauuuucuuuaaaaaaagauuuauuuauuuacuauauauguaaguacacuguagcugucuucagacacaccagaagagggcaucagauuuuauuauggaugguugugagccaccaugugguugcugggauuugaacucaggaccuucagaaaagcagucagugcucuuaucugcugagccaucucaccggccccugcacucaucuuaaaccuagguagagaagaguacaaagagcaguagacaccaaccccgguuuccucaaucccuauuacaggaggauggaaacagaaguggguauggggggagcacaacagacagcuagggaggacgcacaggagggagggaaggccagcaagaggacgaggccauuccuccagcccaccucacuagguagaaccgggcaugcugccuguggaauccaaccuucguggccuuuauuaaggccagcuucugguagccacccucaccuggcucuugcuaaggaagccaaggcccacuagcagugugggcaggccaagccaggugccucaggccccagggaugcucuguagggagagccuccaucccugugaagccauuauguccuccugaccucucucccuggguaguggacaugcuuggaaucuccucuuaggccaaaaucaguuucagcagaggcuccuuuagaccucauuuuagauccagcuaaugugcacacaggggagccagaugggaccuccugggcucccagagacugggacuucaggucauacugacucacaaccuagugugaccaaccauucacacccuagugcuaacucugcccaaccacuagcaaccaucaaccugacuggaaaggacccacuggccccagaaaccagcagauaccacggccagcccagugguauggaaaauuaaagagcccgaacagagcgugggucaguauagaagggacaugccaagcccaaauggacugcuggcaccccuaggccaagugcaggcugccccaggccacccacaggcuaccuugggcuugggcagcugaugaaucagaccucagagacugaggcucaggagggaaguaggagggccaauacacauagaagcuccagagaaucagagaaucaagagauuccuucuuuccuaccuagugacuccuccugauccugugcaccacagagaucaaguuucaccccaaauaauccuaacaacccuaagcacucaaggucccuuccacaaugauccagccuugccaggacauuccaaagaucuuccgcaccagggaggacucaggcuguaaacaaccugaaguuccuggccugcuugacuugauucuagcucaguuaagggauugaggggcugugugugugugugugugugugugugugugugugugaaggggugagggguaggggugucucugugcugggcuguaaccuggguccuacuuagaagguuacuggggaagagacaucuauaaaaaggucucuggaaaguggaggaugugucagguagccaaccaguugguauaagcucucuuccugccaccuaagcccagcacugcccaauaauccacaggcaucagagcaucccaguugguuguucaguacagagcugagcccugauccagaugcaggagggcacagggcaaaggucacacuaugaguacaggaucgguugcucauaacagaacaggaggccugcucugacacagcaggcuugugucaagagagccgggaaggauggcuagaccugaguggggcaaggcacgagcaucaggaaacagcaugguucccaagagccacagcuaaaauggaaagaaccaggcagaccuagaccacgaggaccuucaccgacucagaacagggaaagucucagaagauggcuaaccuggccagugccuggcuugcagagcaacgagaaaggcaugcauucucagggauagcagcaaugcacuggggcugccaggagccccccauccaggagagaaauggaggggacucaguguccagcuugugaacaguaccugugaccaucgucuccuagugacagguaaggccuggcagacgucuuaaccucugggaucuguguaugugugugaguuugugugugcaaggguguacaggcguaggcacacauguggaagcuggaguauucuucaggugcuuaucuacuuguuucucaaggcaggguuugucacugggaccuggggcucaguggcuaggcugccuggcaagugagccccagggaucugcuagccuucaccucccccccgccccccagcuaguuuuuuauguaagugcuggggcuugaacuugggucuucauguguggcuaugacauuaccggcugcgaaucagaaaggacuuuuuuuuauuauuauauuauaauagaaguucuauaugcaagcuuguuccuguagcaguaauggugagcagcacccguucgccaaaagcagaaaagcuacaaaucagagugagaaggagucacacccuucugccuucuuuguccagcccugucuuauauggugugaggugcaaguucaacaaaauaaaccgucuccacgucugccuggacuuaagcucauuagcagacuuucaauaggacccucuguccccauggcugaguaagaagaaaaugccuucaauaaucucuuuacauaaacagcuaagucccugcuggaggcaggugccaagcaagguggggcguggcugggcaugaacaagccguuugguaguagaagcuggcacuccuuggguuacauucuuccucaggcccaaagcagggacagguguacccagugucucacuaucuggcuggguucaugaaucagagucaacgcucucugugggcucagcacagcagguggaggguuuggguagagccaaacacacauccgacccagucucccacagccucagcugcccauauaucaaacucagggaaccccacucccaccccaugcugcugcuuccccaacccccucauagcucagcaacaugccugcuccuuggugaauuuacguuccaggaggaagggugugaugaagcuuuccccaggacgcaacugggccaugaagccgaagaagcagagauagaacaccaggcaucgccaggauuucaguucgugguccugccugggcucuucguaugccugcuuuucugccaccuggccagugggcaccauguugcccagguccucaugggaacuggcgggccaagaugacacuccaccuggaaggaaggaaaagcagagagucuggugucagcaaagcagcccauagguaaccacuccuucccaaucuuucagcugagacccaguguuagccuugggaggcugcaggccccagacccaaaucuucaaccuacucugccaaccugagaacuaccaggagcccaaucccucagacuaggccagcacagccucuaggagaaugucaagcaaaccagucucagccacacaggccgauuaaucaaguacuaauaaaagucacauuaacuaauuagcuuacuuuauuaaauaaguuaauaacacuuaaaauuuuaguucaggagccaggccauggaggugcgugccuuuaaucccagcacucaggaagcagaggcaggcugauuucucaguucuaggccaguuuggccuacagagugaguuccaggucagcuagggcuacauagaaaaacccugucucaaaaauaaauaaauaaacaaacaaacaaacaaaaugaaauaauauaaaauaaaauuccguuugggagcaucucagauucauuucaugggcuuggcagccugugggugcucaggacuuaggaacagcucaccucaggugguguugagagcuacuguucuaguggaauccuagguguagaggugacaagagaaaggggcugugcaccaggacacaacauggaggucagucaggguggcuucgaguacaacauaucugacucauagccuccccacaguaguggaacguagcucuaagggacacuagucaugggaagagcagucagagggacagacagaugagcugaagaaaccgagagccaccaaggacaaggcaacgcaagcucugagaaggguuaaggaacagagcaggagcugaccugagggaccccacagucccuucaaggacuccuagaggaagagguggaucugauguucaaauggcuacggaccuccucccaagguaggccagguccagccccagauagccagcccaugcagcugcugacccugaccucacagcauguaggcccagggaagucuugaguauuuguggugcaugugagaaccaagcuucucagagugguucugucucacgauucuguccuggacacgggcugcucugguccaggugaguacugccagcaguccucgauaagagaaaggcaggagcugcaccccccucagcaggaccccaaguuauccgggcucaugggcaaagccacaucucucuacgucauagguucaugugcuucgggcuuguguauaaagcauugguguaggccaaaagggagcugugugccaacuccuggagcugaggcugggcaucguuuacaggagcuaguggggcuaagggcauaccccuuccacaacaggcuccccaauguccccucugcuccucacugcagccugauccaggaagugucugggcuaaguuagaguccccuucaagcccugagcaagaggcaaagaaaacuccccagauauaagaaguagggggguccagauucucuacccauggaccccacauugagaccaaggguguucucagaguucccacuaaucacagagguucaagaaagaaaggugaccugugggccuucggagugugagcuccuuguaaggacugcccaggagcccuuccuuuaacuccugccuuugcgacaagaagcagggugacaguugggaccuugaagaaguagggguuugugggcuuguugggagcuucgaggaagggugagccagggggcaucuagagguccagaaggaaggaaugucugggaagaugcucggguggcgggugguuccccaccucccuggaagcagcagggccugggacugggacccacauucuuucucauguaagaauggaaacaggcauccaggcagggggccuggcuggagaaaacacaaacacaggcuacgucaccucagcugaacaaacucugagcccugcuuagccucaucucaaauguccccagagcagcacaaacagccaauaagggcacagcacucaggagguucacccuguggcauugacaucuccagaggggaugaggcaggugaaggcagaccucaacacauauugcuaagacuggccagguugggcaauugcccaaacuaaagcagcucccuggcuaggugguguccaggaauauagcuaaaucuagaauucugagccuacuauaggcuuagguggcccucaucggagaggucauccccagagauaacaggagcaccuuuacuuggugucucuuagaauccagggauaguagacguuaucagacaccaguacagaauaaacucuguauuacuccauauguauagcucaccgacucccaaggcugcuacacccagggcacuauagguuuauaccauggagagaguccaucagggcccuccugcucgggggucuguaaaaugaucuggcuccgguccuucaacagguacuguaccauggcuagagagaccaucugaagaacuccuggagcccgcuaggauuaucaggcuguucuacccuaacuagugcaaaaaaaaaaaaaaaaacaaaaaaaacaaaaaacgguaaguggcugggcuaaaugcucaaggcccaggaaauagacucugagguucugaaaacuccauccacccacacacccgucccacacucaggucuguucaagggagcuguccuacaucacaagauguuuugcaaucucagugacaagagccaggagccuagacugagucccugggcuucucugcucagaccacguuacugaugaggauccuggcaugugcucacaggggacacaugggcaccuccuagucucuggggaaccacguaccaagucaucuccccugcccagcucacgcuuuccaccauaaacacccguucaacagaaaaaccuagaugccuagagacuaggaauuagggacuggcucuugguaaagccacaagcgccugggaccugccucuggcucuucccucaucuaagcuaggagguacugccugggucugaaguaagcccagggcccucaugccuaggagguagaaacaggaacagucaggcccucuggccuucuccagcugcugcucugcucaaacuugaaacguuuccggaacugccucccccaguuccagagccgcaggcucggcucugcuaccuucccacaggacuugcuaauagcaugggauggacuagggguugaaagcuuagaaucgcaaacuucccagagcuucuaggucuggaguagugacuacugggcaggccacaggccagacagaggaaaagcugcuauucagaauaguggccagggaguccaagguccgagucaaaaaaacaggggcccaaacucuuguuugcacggggcagguggucucagccuggauucuccaggcuguuaccuaggcagagacugccuggggcaguuuaugacacucuacuggagguaacaucacugccacauaguuaguguccagcucugacacaauacccucuuucucuagcucagagcccaggcugcucuuccuaacaaagcuagguucagcucuauucagccaaaggaaagaugagggggaauccuguucucuacauauuggaacugaguauggaaggaagcucauggcuugcgggccucacaguggaccaggacuccauaugcccugagcauccuguggcuucuuaacuugcaaccucuuccaggcaacugaaagaaauucuuggcagcccggguggguuguagugucggggaggggcacuacacaguccuuucugaccagccuagcacccgugugagagauggggguagggguggagguggguaagaaguguggaauacaacuguucacaaacuucuuuccaaggcccacuuucuuuuuaucuugaaacaggaagguuccuuuuaauuaaggaaggggggaaaacaaacgccaaugcccuucucccauugugguggcugaguguugacuguaucuuugccacuggcucaaaugcccagaaucaaucucuuuccucagccccagugccuuguuggaaggcacacauccggcucccuagcccggagaaugugucaggcucugcaaagucagaggcucugugcccugcugaguccaucugagcagcucccggaguccuugagucucacugggaggaggcuacuucuuaacagucaggcaagcaagucuaaggauuuagucuauccucuccacugagagaaggcccacaaacaucuucuagcccccugagguuccgaccaacaucgugaagacagggaaguuaggaugggaacacucaccgggugaggagucacgucaauaugguuuauuccuaggcuauuagccaagucuaguaucccugucacagagaugcuggaaguacagaaaagacuggcuacuacaggcagccuguacaagcugcagauuccaccuguuccaaagggaaguuguuaacaguugucagggugccuacaaccucugagcuaaacaaugagccuuggaggcgcgccacguccagggcgugggcagugggguuuccuugcaggcaacacgugcucuaaagucgcuggggcaggcgcacguggugauuccugaccugaggaagauacuuugaaagcaaaagaacuccguuccagaggaaugacaaggagagaaauggcgcucaaaggucccacuaggcagccuggggauuuauccucccgacgguucugcaaccaugagcccaggaugcgggccagcacucagacucuugccccgaggcucguaacgcugagguccucaccuauacucuguauucacagaaggacccugacaccccacagauacuagcccgugucccacaccuauccuacugccccuaugcaucccaaagacuucugcuugucuuccacccagcagaccccgcaugcgccuuccgcacgcuacaaacccugccuggagcuuuguagucgcgccaaggacuccgcgguccucuguaguggagaauucagcccgcuuucgucuucaggacaccggaaggaacagaaccguaccuugcacuaccccguggcuccccaggcacgcauagaauggauuccuagcucugcgucccacaggccuguggcugauucaacgcgcacacgcagacuacaacacccaaaaacccgcgcguaggcucaagggccgcauggagaggcgugguuaccugacugaccacgccccgaaggaguggccagcgugguagacaggaggcgcagccgcagaacuuccaggaggcggggcaaacaccuggcuacacccgcagcuacuuccacaggggguucaugcacgcgcccucuacacuuggagauuuacuaccgggugggucuugugguucccugaggagcggacgaccgguggcgcgucugcuagccugugcccuaagaaccuacaucucuagacuccaggcccccuucaguacgcucgcccaguguucgggcuccugugcuuccuccucaagccgacccucucuguccgccucuccaauaagucccuucuuccccgcccccuuccaucccgucuccucuucacccaaccccugggccccgcagcccgccugagccccuuuacgagcccccuacccguccagcgcuugaccgggucucagcucacagcagauugcuugaucugaucgagcacagaggugaccgcccggccuaagaccaagcaaggccccuccccggguccgccccugaccccugcuggccugcagaagucugcgcuggcucuguccggcuccucuugagacgagcgccccgcgaccaccugcuaaagcauuccaggcaccaaggcauugaccgcuagauauagacugcaccagcugugcacgcccuucguuuggguaucagcgucuuuagguuccaagggcaccgacggauugcgcugagcuaugcauggagacccccuacacacacacacacacacacacacacacacacacacacacacaaaaccuuacucaccuuguaucaaccuacuugacuguuaacagggacagaagucuggccuaagcguuuuaggccccaccccacccuccuucaccaccaaucccccaaucuuucaaacucucaccccagcagggauguucagcugaugcucagcagguggaggcugcuagcagcc

SEQ ID NO: 5586 - RNA, 10371 nt, Mus musculus
ugggucuggccgcguugccguagcuacuggagacgcgcuccguggggcggacaggcgcacuuccggaccggggcgcggcagccggaagugcguggccgccggggccauggcggcgcucagcgucgucugccugcugcuggcagcggcauccuggcggccggucucggcuucaggagaagaauucuggccuggccagucggcggcggacauccugucgggggcggcaucccgcagacgguaagcgcguccacgccggccgggcggagcgaggcaucugggacagggucagcagcgggcugggggcagcgggaccggggcugcgcacgcaggcugcaggagcgaaggcugcguggcgaaggucgcccuggccuugggcugagcuggccgucuacucccgagagaucgcuaccagaagguccgggagcguagguggagcccggcucuggccaccucaggcacgcugucccgaggccgaucuuaaguuccagcgagacagaaguucgugugggcugucguggagauggcgcuucuuccgcggccgcucuuccccaaacuggagggaggguaaaccaggggucuggugccgacaaacccagugaugacgggacugaagccugcccgcgauuccguagaaaggaaucuugcuuuggcgaagccuuaaauaaaguuuuagaaccguuuucacggagggagauucuucgucacuuugacuuucucagaugucauuaguguacuguggaguuuuuccaccggccagccaaccggaccuguaauaucacagugaggcuuaaucagaauauuaucauccuauccuuuucacuguuuuuauuuugaaaaugcauauuuuucauuuaaaauaaucuuuguuaauauaacgagacuguuguuauuuuucagugaauggaugaauacuucuagcuuuagcuuccaacacaggaacugucaguagauuuaauuuauaaaccagauuuguccaaccugugcccauugaccacauacaucucagaauagcgaugaauuauugaugacagacagcgucaugccucauugucaaagguuuggcccccccugaguaaacaacuggccuuugggcaucucauuaauuuuguucagacugugaaggagucaaggagucuuuggaugagacacugugggaauggcugugaaaccgauucucaggcucagccgcugagguuccguuuacauucugauuugucagagagugugaaucugcuguuggcacuuaugagcucugcuggucauuguauagucacugcccucucuguaagccgggugugggugccccaugaagauuccccacaguucacacacggccuaugucuugcucccuucucagguaccuccuguaugaugucaaccccccagaaggcuucaaucuccgcagggaugucuauauccggguggcauccuugcugaagacgcuguugaagacugaagagugggugcuaguccugcccccguggggccgccucuaccacuggcaaagcccugacauccaccagguccggauucccugguccgaguuuuuugaccucccgagucucaauaaaaacauccccguuauagaguaugagcaguucauugcaggugaggcgggcaucagucugggaggcuuuucugauguggacagcuggcugcccgguccagccugcccuggcacguuccacucgguccuucugguagugcuugcuuugcuuccgugcuuucucuagggaagggggucugagcagcuguggcagguguggucagugcugacgagaaagcagcugaaaccaucuuaaccaagagaugcacaccagugugugcaucuuguggggucacaccagggugcugaguggucugugaagaggccuuuggccugaccucgcccugcuuccacuuuuugagaggacccauguuuuccugagcacagagguguuuagaguugagcguagcuuugguuggaagacagauccuuuuuucucugcugcacuggaggccccggggaaggaagugguucauuuagagccuggcugguacccaugauguacaugagauucuuauuccaccacgaccuccgccccugcccgggacugcugccccaggaggaucugcuuccagaauguucucuaccccgaugaucacaucacugucgaaaguucuguauuauagucgguccuaggaacacaagaagcauuuuuuucuuacuuuucauucaggcuaaagauguaaaaguaagagcauuguaagugccugcuuagaacacagccuuuccuggcccagcucauagacuugcuuggggguccugggaaacgaguggggguuggguuuuuagggugcauagccugaccuuugccugagcuucagucucaggugccuggagaugcuuuuggggccucucuguggagcaagguuaggggauuucucacugcggggcaggcguagaugaggcccccaccauuugguauggcaucaggaggcauaaggcugaaucucccuauugccaccgaaccucccuccagcugaagcuggaguaggucuggggaagcccacagagaaagauggugccugugccaugggccuccugggagaacagaguggcuuuacccacuugccgagcagaacgcuaggguaaagcugugcuggggccagcccagcacuucaugagugaucagugugaggggagccgcuuuagcuugggccacgggcccaucagccaugcgcagaccucacgcaguguggaucuaaagacacaucaauugacuuugcugcucaacaugacuggggucauucucugcacaaagccucauugguacuuuggguacaguuggggguuaagggugaagcagacuugcugauaggacaugcuggggucuugagggguggaaacaagcucuggaggggauauaccaguccagugaacguaugcuggcagacagcacaaagcagcauacaggaggaggggcaaggguaguccugucucaguguguuaggguacagcgaggaaaagcagaugacagggaaaggccaaagagaccucagaguccccuugugggucccagguccgcacgcucauagcagugauucuacucuggaagaguuuccgagccucugugggcuaaggaggccucaaagaaaugccaugcuggugugcggugcgcagccacacucgcagcuguggucgcugucguguggcacguuguccgggggucucuuucagaguccggcgggcccuuuaucgaccagguguacguccuacaagguuacgccgagggcuggaaggagggcaccugggaggagaagguggacgcacggcccuguauugacccucugcuguacucgcaggacaagcaugaguauuacagguagcacugugggcacagaccuccuccccccacgguucacagagaccagcuaccccugagccccaguacauuagaucaccucacauuguuagacaggcucggccaguuuuaaaaacgcaucccuaggauaccccucuccuuuuuacacuuagcuuuugugguacuggggguugcaccugggguccugugcaggccgagcaggcccucucccacuugagcuacgccucccugguuucuuccuguucuaacacaggucucacuacuuaccccagugcagucuuuggcuuucagucuuccugccuuagccuccgaaggacugagcuuacagccaugcaccgccuugcccggcuccucucaccuguuauguauaccugagcgugggcaugcaggucuuagccgaaaguugucugagguccuggcugucacuuagcauccuccgugcgugaggagcuuuuggagaggggggcuguuuagccgaggcguggcuucugucagcucccccuccacugcccaucuccuguuagugaccugggaaguguuaaguuguauggguuuuucucaagaguucuuacaagaaccuggccguccacagugcuggccugugagcugcagagcgauggggcggugucagcagggcuguauccugguugagagcugacagauggccgggcucuguuuuccagaggcugguuuuggggcuacgaagaaacacggggucugaaugucuccugccuguccguccaggggucggcuuccaucgucgcgccuguccucuuaaaaaacacaucugcucgguaagugcccaggccuuccacugggauugcaauguucaucaccuuccagauacccccaccaggccccucccugcacuccagaggucugugggaugcccacguccacaucggcggcucuaggcuaaggaagcugugugucugagaagaaccccagagagacuccaggcugggguugucuccugugcucuggcaugguggguguggucugcccucuccugaacucccugcucaguaaaguaauuacugcuguucaccuccugugcccugaguggccgcugcagagaugggagauaggacauacuuguggcuucuuccuucugcauuccuuuuuggggugcugugaggauccuagcccgcugugaauguguguguguaggggggggcugugaagaggugacuguguguccaguggaguggaggcaugaacaguuguggggcucgggggcuuggccagaagguggaaucuguugggcuugagccccggagcuuuuaaaguauugccucgugauguuaggguccuuucuuugcugagggcuggggaucguagagcacacccuguuucuggaaucaggcagcugcaguagguaggaguagcuuuuccuacucucacuuggaaauaggcauaaggaaggaguccacccagaaaugcagguggggcaggcguaagagucugugaguuuugugucgucacaucugggacaagugccggggugccaugucccaggaauguucuggcaucccugucugucccuucaguucccucagugucuucagcagcuagcugugagcaucaugcuagcccaggcacugcaggccacacuccugccuucaggcuccaugucaccucuaaggccucccuggccgugauugugacugcagaacgcccagccuuggccugcucucagcagccgguugcagcaggccuggaaacugcagcuucccugucaguguuaaacaugcggugacagguuccgagaaaauguauauuccguacacagauguaucagccuguuuuggaaauauuuccuaccaucccaccccgugucaccucagugucaaguccuccacauuccgcugugggguuucauuuucuguggccccacccccacacgggaaaucuguggugagaggacaggcuuugcucacauccuccguucucaguccugucaggacaagaugguacuauaagcuugacacuuggagacccaaagggguggcccucuucccuugagugagguaguugccuuuguaacagacguacacauguucuugugccuccgugggacccacagccgugugccuugcucugcugucugcuaggugacagagccuuggcacacuggcagacugcccuagcccuguguucugcuagcgcacugcugggcuuuguccucaugacccugguuugucccuguucugcuccucggagcucugcagccacgugcuggguccccgacacccuugaacugucugucgggguccaaggcuuuucucgcauuuuguguccuuggaaaguacagaugucaccguuuugauucuuagaaucguugacgucuuuuucuucccuuacguaaaugcaggucugugaugcuggaccgagcugagaaucugcuucaugaccacuauggaggccgggaguacugggaugugaguaccucacagcgggcccucugcaugugcucaugguuuggaaacuuaacagucagcaacagcuuucagcuuccaugacugaaaccaugggcagugcccacugguuugcccugccccgcagugagcuguccgcucucgccucaggacccacugcugucuuaugauucuguguuccagaaacauaguggucucccuuugccucgccacaucuguagguggcugggacacuucuccuuuggguuggggaaggggacauuuugugcagugaguccuaacgccaugaaccauuucugccuggaggggagcggguagccugcgugauucugcagacacuggcuaaccuggcaggcgucgggucaggagcaauagcuccgcuuacaaagcauuugguuugcaacagagacacggucauccaguucaguuuaguuuaggaaaaaugaagcccaaaucgagcagagcagagcaugaagcuaggagcugggcagacacugaggugaugaggucacaugauguuguuggccaagggcagauggugcgggccagccuugcagccuagacagucuuggcucuggggcuagcugggguggcccuacaugggccuuucccgaucucugggugacaccacugcuggcugaguggcaaggaauuaacuagagguccccguagccaaccguggugugggcagcaggaguuaccuaggaccuggucgguggcgccugcagaaaggaagggcaggugguagacagugaagcugugacggcucaaccgucccaaggcccggugacacucagcucagcccuguccgugcagacccggcgcagcaugguguuugcaaagcacuugcgggcugugggagacgaguuuaggagccagcaccucaacucgacggaugccgcugauaagauggccccggaggaagacuggacgaagaugaagguagccgcgcugcucuugcccgagaaggagcuagggacggggcuccucccuuaagcuagcaugucugaccugugagugacacucauuaucugaccugcaagagggcugguggggggcugggguggggagguggaggcaagcuuugccaaguccuugucuugaugcugaguuaggguugugauuuuuuuuuuuguaaguuuucagauuuugcccagcaugguggcacaugccuaggaccgcagucuuuagagguggaagcaggaagguugugggauccaggcuagccugggcuauguagggaaauccugucucagaaaauacaggcaugagagaaaggaaggaaaagaaggagcggggaaccccaaagcagaagugggcaaugaauggugaauccgucagcacuuccugcggccucugcccggcagagaggaagcaggccagcccaucugccucagagcuccuucaggccuuuggucaugcauuguccucuccugaccguguguguacuuccuccucaaagcuggguuuccuucauugucuuccccaugggcuggcugagcaccgugggccccuccccugugacacugugacacuggauguuaggacuccauuguaucugcucugugggcggucccggcugguuccaggugcuguugcuuaaguugcuuagaugcuccuuccuggaaaguauuaaauagcuuuuccuuuucuuuuuccuagugaucaaauucugauucuuauuuugccccgauaaaaguauuugugauaaucaugguccucauggucuucuugacaagacaucuguuucccccaggaaguucugugugagacucagucaggccucagcaucaggagggaugcuuuagagagcacguucaucccgcucugcguuucaggauacccaggugaacccuguucagcaauuuuccaacaguugcaugucuuuuguaggucaaacugggcucagcacuaggcggccccuaccucggaguccaccugagaaggaaggacuucaucuggggccacagggaggaugugcccagccuggagggcgccgugaagaagauccgcagccucaugaagacucaucagcuggacaagguguucguggccacagacgccaucaggaaggguaggcagcccuaaggccaggccuuccucaugccccuccacagugugaccuucauucuggaaggucaguagccucuccuuugccucgcagagcaggaagaauugaggaagcugcugccggaaauggugagguuugagcccacgugggaggagcuggagcuguacaaggacggaggcgucgccaucaucgaucaguggaucugcgcucaugccaggugcuuggguccacgcugcucucagagguccccguugccccaguacucagcagccagggcaggugguuguggccguccacucucucuguccccauuuagaaaguuucauugcuuuccucugugcuguacaccggucccgcaucauccaucugagagaggcgaacuucccgggcugcuuggccuccuugguguguuugugcuucugaaguaaccccgggcugccuggggccagaggccucugugucacugcuccaggagaccaggagagcagcuggccucagaccauucuuuuguggagacucgggaugggcucagguuggaauguccugauuagaauaggaacguccaacuuccccguaguuccagaugcugaggugccagagugugggcauagggcuagagggcuagugugugccugucuugcccgcugcuuuucugccgugcucuggccuccaggguccccgcugacaccgucccagcaccagggguaggcaggugagggccucauccuugaucugcgugggucuagcugcuguccccuuccaggcauggcuuguuuagugcgcacgauggggagagccaggccagucugucuuuuuucccuguuaaugcucucugaggagcucggcgcuugcccauucucucugccuggaguucuucccaggcuccgcuagacacagcugucucaggaacuaacugacugcaacuucagcucggaaaggacuucacacagcugauuguaguugcuuccgccaucagcacugucuacccugaugcuaaugcagccuacccgaugccuccauagguguggcgagccucaggccccagaguuucaggagagucacaugacauagcaugccagcguuccucuugaaucaguuggccacuuaagugccaucagagggccgggauauaggagucagggcuggcugcauugcugucaccccaggaaucugaaggaccuuggaaaagggggcucccuuagcuauggcagcaugcguguggauggucccugcuguugucagggugccgagguggacacaaguccuugguguuaguugaacagccaggugaaggucugcaaggcacaguggccacugagguagggacugacccaugcaggugccagugcugagggccccagagccucuggugggugggugugaccgaugccuccacugcuggucccggguaacgucuccgucucguugcucugcagguuuuuuauuggcaccucuguuuccacauuuuccuuucggauucaugaagagagagagauccugggguuggaccccaagacaacauacaaccgguuuuguggagaccaggagaaagcaugugagcagcccacacacuggaagauugcguacugagggccaccuauccaccgccugccaaucacucggucacagggucccagaggaggcccccacaugggaggcaacacaucuagagcccaugcucccacguguccgugggccgacaucuaccugugucuaggcucugccaccuucaggauucacaacugugucuucucucaggaccugagaacccacguccccaucacagaugucacaugugugcuaguccagaaauagaagaacauuugucagcuccgacacaggccucucagccaccuuccugaacaaguugagcauggccagccuguggcaaugcccucagguguggaugcgggcuccugagguguuggggugacugacgacugaggucacuucacacauggccagcgugagccgacaccaagccuugccucagccuccaccuguggggcucccacuaauuuccuccuggauggaacgacucgggcacuguugucaucagagugacagcccuggagccuugccagugacuuccucgccucacauggacccccagguucacugcacacgcugagaaauagaauugagaaguaaaggaaauggccuucaaaaggccacaccugagacccgccccugcuuuaugacacccuucccugggccucaugcuguaccacaggaggcagagucagcacagccguggccagggcacccccaggucccugaccugguacuuagcagugcaccccuccccccagugcugugcacugagcagcccccacucagcuacugccaggucuccgucccaagcaccaagguagacucugagcacagacagggccccguggcccagucagcugaccagcuagaaucacauauuuauuuuccauuuguacauccaagcguauuaauaaaauacuuuuucaagaaagcugcaguccua

SEQ ID NO: 5587 - RNA, 1100 nt, Mus musculus
aaccuuacauguaauuggaguagcauccuaauauuuuuuuucuuucucaagauaggguuucucuguguagcccuggcuguccuggaacucacucaguugaccaggcuggucucgaacucagaaaucggccugccucugccucccaagugcugggauuaaaggugugcaccaccacugccuggcucuaauauauuuuuuuaaaagauuuauuuauuguauguaaguacacuguagcugucuucagacaccagaagagggaauuagaucucgugacaaaugguugugagccaccaugugguuguugggauuugaacucaggaccuccagaagagcagucagugcucuuaaccgcugagccaucucuucagcccccuuaauauucuuuuuuaaaacgacaaaugugaugaaucuaaugccucaaaucuuuugaguucagcuucuuauacucagggucccagcaggaacuuucucuuugucccuacaccuaguccugaaagccccuuuuuucggagagccacgucccgagcuguaucccucauguccacuuagcgaaggcaguggugcaccuaagaaaauaccaagcaucuaucuggcaguuccguaugaugaggaaguacagcuuacuuggcagagucugaguuuuuuuggccagagaggaugggauauggcccgggaacuuuauccuuccuuugugaaaccaagguacucuuucucuugcuagaagugucaucucaaaucaccugggccucaaaaaccagguguaguggcacuugggagacagagguaggcagguggcaucucugugaauucgaggccggccugggcuaaauaaugaguucuaggacauucaugccuacaaggggaaaguuucacgaucuggacagccacuucugaggggcgagcccaagcgcaaggacaugagucucauucaggaacaauccaugaugagccauuagcucucgcacuauuuuucaagacuaaagggccgcagggcgagcugcgcaaagccucacggcggcguaggaaaccuucaaugcugaggguguggccggccgagaagauucuggaagccgagcuccgucgacccgggccauuacccg

SEQ ID NO: 5588 - RNA, 2697 nt, Mus musculus
gucuagcauugggcuagcagcagcccuuaggacacuaucuuuacucaggacaugggccacugggaggguaccucagccuccacaugacaggaccagcuugcuuucaagggcauuuuaguugguucuuacagugguugguuggucugcuucagagaaggguguugaaguucagaagaagcgaugugcuugcuuagugguggcuggcuucuggcagcuugggcuggaaucugcaucucugauggcuggccuggacacugucacuugggaguugggccuugggguguugucaaaacaaaagaccagagcuugguugacuacagauggaagaaaggccagccgccagugugugaggcaaaacagacugguucauguucccgaaaccugucugcauggccgccacagccaggggcaggaugcuucaagcuuaaacuggcucugcccuuguaaccauggcaacaauacugcccagaaagggagcggacacccaagugucacugggugacauuagccaucagaaguagccaugugcugccacugggaccaguggaggccaucuuacccccucccuuacauucuguacauacugaagcaaaucugccaccuaagggaccugaagccacaguagcagccagccccuagagaggggagacucaagcagaggagcgguugcuaugguucacuccacuugccccgaacacaguggguccugggaugguuugacacaugccgccugguccucaggggcucucauguucagaguuggugugagcaauggacagcuggaccuaggccucaccagguucccuccaugguggacaagaguaggagcccuuggugucuccacucucucaggcuuggcaagaugugagcuagugggaggcuaccuacaauucccccucagagcucacguuccaagaaagagcaagacaggguccauggguuuaggggugcugguuggcucagucuauugucagugucucgugcuaugggcaaggaccugggaaggggguuaccucugucgccuguggaugugacaugcccuuggugaacauauaggucauuucccagguuaucagucuguuccagagguugguaucugaccccaccuucuuggacaaaugcccccaugugguuuccccgcuuggguccacuuauaggagcagguggagcaagguggagccucaccgugccagcgauucggguugguguuacuucuccacaugcaaagccacacaccuucaagcagucacuucauacacugucugucuuucauggucccuggucauugcuuacaccuucagaaaguugcuccucaccccagggggcagggaaggucuagaaacuuucaugucccauauuugaaacuugaaccagccuuccuuccuguccaccuuccugucugccuuccugccuuccugccuuccuucccucccucccucccuucccuuccucucacccuccuuccuacuucucuugguacucagaguagaaccuaggcccuggaacaugauuagcaagcaaacaggcacugcacuaccaagcuacagcuacagcccuguaacuuggagcuuuccagauaauaauaccagccacagcugugugucugccaagggcggacuaggaguugaggcuacuucccuccuguccagggccuuuauucaguucuuuuugaaaugcucuuguacccucugaggaaggguggcucuuggauuuggaugagaacuaccuaaaaaugacacacauauagggucacaguggccaggugaggaccaggaugggaagauuugucugugcauuucguguccugcuaucugauuuugugccuuccuuaguucccaucuggggaaugugggcagcuuuagcuagguacuuccaggaugacagguaagcuuugcacacagugccaccuugcagaagaauagcaagaaagauaacaacacagccuauuuuguccuucugucccauuaggcuccuggaggugacaagucugaaaagaaaaagaggagaacccaggaacauucagaagaacaguggccacuacagauguccuaccucaacgcuagaauccaugcuugcuucuuuacauagcagaaaaggacgucagguuuccacugcugacugugguucuguggucauuguugacuguuguuauuguagaccgugauccuguagccauugccaacugugguccuguagucaucgggggacaauggccauguagucauugccaacugugguccugaggccaucggugacaaugguccuguggucauugccgacugaggucauguggcccuuggugaccuuguuccuguggucauugccaaccguaguccugacgccguuggugacuaugguccuguggucauugccaagugagauccuguggcccuuggugaccguggucuugugaucauggccgaccgagaucuugcggcccuuaccgacuguggucauugccaagaaaaggacuggagguugucauggauaacuggagcagguugagaagagagacucagaggcucuggaggaaaagagauacagccacagcggcuggccuuggaaugaggggugagaucauaagucagaggcugucagugguucuaggagcuagaaguauucagagacaggcuccuuuagggaggggccaucucggucagcacugcagccaggagucccugugggccuucugcucug

SEQ ID NO: 5589 - RNA, 5776 nt, Mus musculus
cuuuccugcacaaaaaguuuuauugagggcucacagagaggcugggagaggacagaaucagguucggggcugagcuuccaagaaaggcaacauagaagccauccuaggagccuaguccuaguccugagagcugccacaggcucagaacauuccaucucagucugugacuuaccaccccucaaccucuaaccccacccaaggauuucaauuuaaaccgugucuuaggcaaucacauguaacuagugggagggaaagugcccaaaggagccagugggugggaccugggaugauagguuuauacugaugggggugaggauggggcaggacacugagccauguggcaaaaauaaaaacaacaaaaaaaaaccccgcccacugugccugaggaacacucaagucggggugggguggggguggagaugcgcagaguaggggaggacugacccagaguccuggagaucuagagggucugugcagaguugggggaggagaauaucucauucaaggagagaaggaaggugaagcugguggaagcaggugggauccagggagaaagacaguuucaaugcaaccauccacaucugcaagucuccagcagaggcuccagccucauacacuuagccugugaguuggucaugggaaggaagggaaggguaucuauauacaugaaugaaugacauggaaugggacgacagggagauaagacucugaggcagcaggguuggaagcuuggaugagcaggagagugcugaggucucugagguccuccuuauaggaggacagggcaugcucucuccaggguccauacucuccugagucucccaucuccucuuuccagcaagggcugagcaggagcuguauagaugugcaaccagguagggcuaagcccuagguuaagagcagcaagccuggcaguggguugagcagccugggacggagcccuaccuacaccgguguaucuaaaagacccaauaggguguuucugggacaagagcagcuacagacuucaccaccaggccuccacccauguucuuuuuugaccugguuuugucgaugggacagacaugcuggauaguggcaagcuccagaaacagggucccucuacugaguaggaugguagaaaggccgcaggggccagcuaccucccaacuugugccccugccuggaagcagcuaccguccccaccacaugguaauaggaaugcaagccauacccucugcacuggcaccucccagaguaugugucaggcuagaggugucccuguccaugggacauacauagauagcuacuucagcacugccacagcaccagggugguaccugguccuuaauccaagcccucagcucuggcuuuuuuuuguuuguuuguuugguuugguuugguuuuuucgagacaggguuucucuguguagcccuggcuguucuggaacucacucuguagaccaggcuggccuugaacucagaaaucugccugccucugccucucaagugcugggauuaaaggcgugcgccaccacugccuggcucagcucuggcuuuuuaaccucuuuuccuuggcacagcacccuccaggguccaaaucauacagcccucagcaccugccuccucugaacacuuaacuggguacuggguauugagcaugucugugccaaugggggccaggcagcaucacaacguugacuggugucccuaaggaggcugcuucgagguuccaauucucaugggaaugggaaugguccuacuagcuccgccagggucugacccugaagacaguguagcuuggcccagggcuguggaagaauaguggacagcuugggagcucauccagggcucuguucacccugcagaugccaggcaugguggccccacggucaccauguaggugugggcauucagcaguggggaaagucuggaauucaugaguguuuuucucuuccauauacuuuugcagcugacagccauguagccucaggcaagugugucacauggugacagaacugugggucacacugacgguaaggaccaagucaggccaggcccccaacauagucucaccuugccccugcagaucacaagaaaauucccagcacacacagaagccacauucaauuucugcucagagcggcaucuagacccuauacucagcacacacacacacacacacacacacacacacacacacagacacacacacuaugcucauuuacuucucccagauacucgaugacgacauagcuuaggguauaaacacuuauacaaaaggacaguaaauaacaaaacuggaagucaagucuaguuagguggcuagaacaucuaccccugaagaugaaguaauuacagguaagaaaguugaucagugagcucugggauuucagcgaggugaagagaagguucuuguugcuagagaaaagcaguuccuguugacuggcauggcaaccucaaacuucagucccuccucuuucugaaaaaacagcugcuuuagauauuggcaguagaaagcaaggcacaagagccaccgagguugacagguuuccacugcccaggaauggauagaaguggcagaagcugaggcagcccauaaguggucuagcagcugacacggccauggugagcccaugcuggaccuuucucacguuucuccauuuucucccucucgauggacugacauuuuggcacaagggcaacuaaagaacucccaggacaaaggucagagcagaccagugcaggcuggacuuugcacugaccucucuggaaaggucuagauugccgguacuuugcucugggaaagggcaaacaucucuguguucagauguacugggagagcagggguaaacagaaaugagccauuccccgguggcaaaacugcuggcgccauccucccugccagggcccccauccuugcgugcacaaguauuuacuucccacagcauggugugggaaagggagguuggcagaucagacggcucacagaccuauaccacaaacagccuggguuuaaguggcagcugaagccagccuuggcaaggaguuccguuucucucgaccuccauuuaccuacccauuaagaugggcaaaccccccuccccccgcuacaguguuaggcaguggcugcagggaccaaauaccaacuaugaaagugcuuuuuugggcugaacagcugcaaugcaccucccuggggacacaagagcaccaucaccuccaccugcugcagaaagacaggguagccaggcucaguggcccaccggaggugggugcuagggcacagggcuaagaggcuccuuggagacuggagcacuaggcagggacuucagguacuccaggugucgucuggcauccuccugguuguggcguacguaguacacuacguaggcaaucaccaugguaaaccagccgaacauggugaccagcauggcgacaucgguggucuuccgguggguacugcagaagcuggcaccugaguccaggaccuggaucagcggcuugcccacaaacugcuccugcgcugagguguggcaggcaauuucauccacggaguccggguccagcuuuaguucccacagggccuccugcagggcacacucacagugcaguggauugugggacaggcggaucuuggcacucaacuugcccagggcguccuuuggaauucuucggaugcgauugugggauaaguccagcagccgcaggcccccagccagaccugagaaggcugcuggcccaauggccucaauggcauuaugggacagguccagcucccucagcugaggcagguguuggaaggcuccauuggggacucgggagauucuguuggcgucuaguuucagaagcaccgugucggcugggaugucccuagggaucuccugcagcccucuugagcugcaauggacagccacggccccagcauggucagggcacuggcaggccugugggcaggaggcaccuaaccguaagcagaagaggaugaagaagcaagaccccugggagggggccaguguggcugaggggcucugccugccccuggggcccauguugccuccaccugacccagguagcucuucuccacugggaugugcaagcgacuguccuuccucacguugcaggcagucauccaacacaaacucuugugucuucgccugcugaagagccuagugaucucaguucuacaagaaaaaaagaggaaagggagcugagggugaccgccacugcacauuucaauucaauuugggaggacgggaucagggaggaaaggaaucguaggcauaucagguuugaggcagggcuccgggcuaucaaacauaccugcuuuguaacuuacucuagaagauucccaaggccacccagagaaggcaccucccagcuaaguaagacaucuagggcugaccgauggcuggagacuggcccuagcuaggcaguuacagaacccuguccuagccucuggucacccacccauagcuggggacacaagucugggcggaggcccaaggauccaucucuuccccaucccccagcucuaggcgcgugcuggcggaggucuucccucucgaucugugcgagccaggucgggcggggcaaguggccgcguucaccaguuuguccccaagcacucggcuaccugugacaccuuaaagaucgcggucaucaauaaagcucgccgcgcacccugaagcagaagcuucaugccugaggcgcuggagacaccggagagaaaaagcagcccccugcgugcggcccggcugggcagggagcggcagcagagagcagggcggcaaagcagggacaguggagcuccgcgggugggaggccacgcgggcggaugggggcuuuaccugagcggccgccgcugcucagcgccuuccgagcuucccggagccugaccagaguccucccggcgccgcggcgacccgccccgugcccaccgagcggccaguaaagaagggaggcgggcaagccauggcgggaggggcgggggccuuugcuauaggggaggggccggcaagaggaggggcaggguggggcugaggccagaggggcgggguuuguguguugggcggggccuugagaggguuuugggaggggaggaauagguggagaggggccuugcgauaaggacggcgccggugaaaagggguccuaguaagggaccuugguguucugugcuuugggggacggggcuuagcauguugugggugggaggggccagguaagggcguggucugugugcugaggggcggggucucuaaagggcugucccgugcgagaggcggggaagaggggcuggggaggggaggguccuauuugaggagggccaaggccuuaaggggaagggucagauaggugaggggcuggguaggggcuggggccugcguaagaaagagcuaaacagaguucauaaaauccuacggggcgaacaccgaggggggagcccaaggaggggugcacaggguuaugggcgagguuuaugugaggggcggggccugauauguaaacugcacugacuggggcgggaugugggcggggccuguaggggcgugggcggguuuagguaccggcuuucuagggcauugguaagggaaggguccgugggcgugccacguggccaagccccgcccugagcagccccaccgcaugacugacgccccucaccccaagucucaggucuaaggucaccauagaaaggcaaaugggagcgucgacgcaggaccugauccucagccgggaaccuaucaccaccggccucaggaggaccccagucuuccuuugucaccugucuuccuccg

SEQ ID NO: 5590 - RNA, 9836 nt, Mus musculus
ggcaccgcaugccccgggagcagugguggcugaaucugcggcugaugcugaagaugcuggcacacuaccgcaucagcauggcagacuaugugucuggggagcuggagcacgucacacgccgcaccuugagcauagacaaggguuucugagcuuacugucacuacuguuccugcguucccggacucucacccucccagugcuagccacagaucccagcaccgaggggaacucaaggggaacucggagcccguggcuggcugagggaugugggggucuacugugcugcucuggggcucuucccuuagcccuccccccacccccaggacagagagccuguggggccccuaccuuccagucagacccacauugccucucccucacuggccagcuggcugccucaccacacggcugaaaagagccucacuuuuuuagaaauaaagucaccugucuagagcauggucacugggacaacaugaccagaggaguccagggagaggguugucaggacucaggugcaaaccuuacccaaggcuauaguuuguuuaauuuauauaaguacacuguagcugucuucagacacaccauuagaggucaucagaucccauugcagaccguugugagccaccaugugguugcugggauuugaacucaggaccucuggaagggcaguuggugaucuuaaccgcugagccaucucuccaguccugcccacagcuauucuacaagacuggaauuuagggaacccucccgggaagagacuagggagaccugagcccuuagagagcuacugaggcucgugugagccccauaccugcccuggaauggcugggguaucggccugugggcaaugugccccggucuggagaggagacugucauugucaguauaguguucuuggcugauugcugcccuucaggagguucuugaggucgggacguuggcuccucagagaaguuuaugaagggcugagcccuggccagccccaccucagaucccucucuaagccccuuaucaggguuucuuacgugagcugcugcuggguccauccucuacagugccuggauuuuuacaauauuuacaauagguggaggcuguuucugguuucuccguguauggaggucaaggguugugacuuuggcucuguggaccugcaggccgcauuggggcggugguuuccuuggguagacgucuccccccaugggucacuguaaggcuucuguggggguauugcaggccauguacccagcugcuucaucuggcuggagcccccaaagcugcugggagcagaguccuggaguguaagugucauaucacagcacccuggaggguuuggucuugagcacauggcaacaaggccuguauauuagggcucuagagaaacagaaccaauagaauguauauauacuguaaaaguggguucgccagacuggcuuacacaaaugggcuugguagccuaauugucuuaggguuuuauugcugugaauagacgccauggccacagcagcucuuauaaaggagaacauuucauuggggcugacuuacaguuucagagguuuagcccauuaccaucauggugggaagcauggcggcaugcaggcagauguggugcuggagagguagcugacgguucuccaucuggaucugcaggcgcaggaaaagacagugagccacuaggccuggcuccugaaaccucaaagcccaccccacaguagcaagcuuccuccaacaaggccacacuucccaauagugucacucccuaugggccugugagggccaucuuuauccagacuucaccaauaacagccaucugcuggcuggggaggcugagagcccuggagcugcuaaauucacagcagcuccauucuagugcugagggccuggaggaucuucacgccacacuggaaagucagaguuugugucugaugucagcagagggugguaacagcagcaagaagggcuggcaggcagcacugccuuuuacuuggagcacccaauaucugggcugccugcuagcggaggcagucccuggagagggccuucccccuuuacuaagccuuccuggaauagccucguaggcuaccguaaggccucuuaauaauucuccagguuaauugacaggcucaggucucucaggacugcugggagacaccugugcuuguuccagagucaccaucaauguccauaccuguuaguguguucucccuccacccccaaagcagcgcagggccuggggacauggcaggcuauaguuggacaucugaagauuagagcagcaccuacccagccgcuugcucagucugggcgucugcuacacaggggguucugcaauggggaggcaugaagggugggccuguguggcucauuuuguucauggccagguggagucgggucauugucaucagcguggacucaacucucaguauggaaccccugcuagauucagggucuaccugcuuggcugcaagguggcuuugggcccuggugauagcaauggcuucagguacagaguagccaucucuuuccucucuucucuugcaccacauccacccuuccaggggguuacaccuccagccuuagcucuccccgcugugaguuggaugggagggcaccaaacccuugaaaggccaauuccuguucugcucaaggggcuggaucuggaagauuccagauguggcugaaugucccacgcucggcuccagguagggauaugagcugugcuuuagcagaggcugggaguggggaucagggauugggggcucggugcagcugguagucugcccaucccugggguauaugugagugugccacaggaggauggaaagcuaggacguuacaggcauggggugugguccugagggaaccugcugggcauuuccagaaucuuacauccuggaacgaggaagugggccugggacacagacacugguaaaaacaguuuauuaagagagaaagcacucccagguuucgaagugggccagcgguggagcaaagccaagggcccagcugcccugaaccuucagcauuaagacccuuacaggucaucuacagagccagcaggcuucuuuggcauguucuaccugucccucuaagggcccuucuagacuuuuuuugcuuagguugcuuuacauaugcuaaucuuggggccuuuccuggcucguucucuuauggcagguguaaggucaccccaaggcaccaagguggcccugccuagguaagcuacagggccucccccaauuaauggcucuaacgaagacaacuuuaccaauggcaucuggcgccucagaaugacgagcaacagucacucaggugacaucccucuccugaagaagaaagaaaaaggacaguguccugaccagccuuguccugaaaaaacaaaaaauuccauucucccaggcuaugucuaaggacagcugggacacagugccccguaaagauauucuaggcaucuccaaggguaggcuugauacagugauacuagggcucccccuagcggcugagaaacaacaugaaccucaacgucaaggccccgagaugcuuccugucccagaccuuccagcucaaacagaaagugcuuuauuggaggguauggcuccuucaggccucccuugaggaagggucagacagugcccagagcuuugggccucagcagguaagucccagggaccaugcuggugggcagcauuucugccagcccucagcacaggagaggggucugcuuugcuggcagccacugggccugcuuugaaggcuuuccagguagggcuguguuuccucaggauauaaaaggguccagauacuggggcgucugaaaucacuccaugucuuccuggggcuccggccugugcagcgccuguagccggcugcccacggucugcuggacagucuccagccccuccguauccagcucccgcagcaguagcaauauggcagucaggauguucuggggacagaaagaaugaccuaagaccuggcugguggcauccuuuacaggauagaaagccucagaccuuccaggaagccacaguacagacccugguacacuguucccuauccaguugcagccaggcuugggucugaggguccuaugccccucagagugguauccucauacaaagugguggagcgggguguuuccaacccaaaggugagaggcaugcauagcugaggggcagcaccgguggcucacugggaggaacaggccaggagugaguaacuuacuuuagcuucugaccccugaccucuauagcauacuaaggccucugcaaacccuuguguguguccuuguucuacagaugcagguccaaggcaaccagcugaagguggaccuuguucacuaggcaggagcaccuacuguagcagcagggaggagggugcccgguagguguggggagacaagugcuuucuggcaauugaggaccuggugagggaagggagacugugaacacagcucugcucuuggaauagagagagagagagagagagagagagagagaaugugugugugugugugugcacgcgcgcacgcgcgcugggguagggaacagcagcaagugaagagggaagggauccugaggggacagugaccuagugaggcggugcucuggcaugcuggaguaggaagcagaacuaagcucaggugcuguggcugacacuccugccucauggaccgcacuccuccuaugaguucagcucugaccccguguuaucuccacccauggaagccugccuucugcugcugucuggagagagggggcaguggucacucacccuauucuugugacuccucaucgugucccuuggugagaaggaaggagacuggucugugguagucuggcccuggacucuguuggugagaggagacacuuaggguaugacagucacagggcucugagcaccacuaucucuaggccacggcacacuagcaugugguccuagcccagagcaggagacagaaagcaggcgcccucaaucuagguaccuuuauaauggccagugugcagaauaggggcccagagccaccaagagcaacuucucucugcccagggcucccacuggcaaugcuuuccacccagggucucaggaaaggcccagaagugacccaagugagacucagagcccaacaguggccugucgccacucccacagaguucaucuccaguucgucagcuauggccccucuaaaggacccacggccuggugugcacagacagguucuugaggucacgccccccccccccccccaaggagaugggaagucucccucuccugccugaggauacccuuggggcagugcgggcuugcuuccccgcaggcuuacucugucuccucuguguagcucagcaggugcuggcuggucucaguugcagagcugacagaguugagggcguaggggggcuugggacagccauugccugcaccuucucugugcggggcggcagugaucucaucucccuccaucagcgcgcgggucagcucuuccucggucacagcuuguggaaaggacaggaaggguacggcaucaggucugugcagcauggccuccacgcagugccuccuccaggcuucagcaggccuacugcugugugcaccaugugcuggagagggcagaggcgcugccccuggggacaguuaguccugcucuuuccaauccccagccccagaaugugugacaccugucagaagggcaaggggugcuugcgacccuccaggcgcagcaucuaagagcaacacuuccaauccagguaaaccucuguggugcugggguuggacccagggccuugcaaaugcuagcggguucucugcugucagccuggaaguuuuaaaaggaauggaguucaccuauuuacccugcuucacuuuuuguuuaguaagugucugggagaagacaacuguguguaacugaggaggaucagaaacuguuaagaacaucaucuccgcuggacagauggcucaguaguuaagagcacugacugcuguuccagaggucaugaguucaagucucagcaaccacauggaggcucacaaccaucuguaaugagaucugaugcucucuucuggugugucugaagacagcuacaguguacuuauauauaauaaauaaauacaucuuaaaaaaaucaucccauggagucagugagauggacucugccaagaguccagggcagggcuguccaccaugacagaggggcaugcagacauagcgucagugggcaugguguggcuccagaggucuggcugccagcugagaccaccacaugcugccuggucacugugcauucucaccacggcacagggauuuuucuuauggagggaggcagaaggaggagacuguugaggcacguaagcccaggugggauuaugacaggaccccugaggguacuaaacccugcaauggcaugucugaaagggaacacucucacaaggacugagcaauggguacacugggggcugcagaagauggggaggaggggugccuccucagugguuccuucaggaaaaacugggccccaccucaguugccaguggguggccaugccagagcccaccuugguugucuagcuucugcagguggggcagguugcgcagcacggucaugcgguaaaggugcgggcuggugccacagcacggguucucggccagccagagcacccugagguguggcaggucuuucagguagaacagcucguucagacuggggaugcgguuccuccucagguacagcucgcucaggcgccugcagcugcgcaccgguuccaggguggagacacuguugacacugcagggaccagcacacugucagggauccauacggucucaaccuccucgggccagcggccuccaccugugggucugccucacccauggguaccaagagaaggucucugccuuagaaugggucagaaccuaaucagcaggaucccucaaccugagauccacaugggcagcuccuuggccuagagcucugcauucacauggaacuauuguggcagacaagaugcuucacucugcuucuucgaugauacugaguccccagaggacacgcuuugacccacagcaggcacugguuaaaacucagcaaaaaugcccacaggcuccguaucauauauaaaccaaaacaaaacagggcguuaggaugauuuccaucccauaagaaaguguggagacacaggaagggaaaacagcauccacucaccgccaaaguccccccccccccccauggccucugcaucagcuccugcuuccuggccugcuugaguuccagcccugacauccuuuagugaugaacagcaaugugaaaguguaagcugaauaaacccuuuccuccccacuugcuucuuggucaugauguuugugcaggaauagaaacccuacgacaggcccuaagugucagccuuauccugggccccaggaugggcaggagagaaugucgggauggaagugauggaaucaggaaggcagggagauaggguacugggaauuucagggacagauguagccacagggaggacuggccuaccugaacuacuacucauuauuagggagccugcuacaaauacacagauuacuuucuggggugaaugugagaggacaagcagagguaagccuuuaggaggcccauguaagauccuuaaaaagcagguaggggcuccagguucuugaagucccauucccuagacaguuagcagaugcugcugucuuagauggcauugggagucuccagauugccuguuuucccacacuccagaggaaagacaugaguuccccggccuccccauugcuuccaugccccaggacuacagucagucacauaccugagugugauuaccucuaggcugggcaucucccggcauauggaaaucuagggagggaagaacggggccagugaguuaacaauaguguggucaccucgggucaggggacacauguguccuggguccugucaccuguacuaauggggccaagggguaugggcuugcacaaccagggcacucagaagaaaucagcugcaugcuggucucuguggcccagccugcucuugggguguucuacacuggguguuucuaccuggcaguuuacaacaguucugugucuaacacagaacaucauuacagucaauacccucugaggacgccuggccaaggaucuugugguuucccacccugagacagauacacaacccuuucuccuugcugccccugaggcacaaagaaaggacagacacucuccuugccaaugguucugggcucaaggcagacagaacugcaguuaaguuuggccacgacacaccaucagaucuguggaucagaccugggcugugggcuccacagucccagcugccugucauuucgggugggguuggggugucgccuccugaagcugaggaaggccaugcagagugccccuguugauguccuugagggaaaucaccaccagggacuccucucaaggcagagcuuugacucuguuuuccucugugcaggucuagcaagugacacggcacugagcugaagaucacaguucuguaacuuuagcuauucuucugggggaaggggcauccggaagaagauacaaucaaggcagagcuuacaucugugagcuggcugccccuggagaagaaaagaaauagacuuuaauuuguugaaugaaaauauuuuaaaaauccccaaagaaauggcaauugucuauaaaucuaaagauucuacauucggaacaguaaggaaggcugguugcccaaauaagggugagguugguuucugccaauacucccugcuuggugcauggggguacacaguuuucuccucucaggcucccauagcagaaagcucuuuccagucacacacauaaacaaagggaucuucauaagaggccaagcucaaaggccggucaugcaacuucugaagcaaacuucacgggccugcaauguguguuguuucugcuugcacagaggaagcccugaugugcucgcuggcucgacaaagaaaggcauuauugaaaacccaggacagggaggacuguggccccaacaccagaugugccagggcagggaaaggcuuuuaauuaacaaagcucacucuuuccaguagcccacugaccauuacuagaagcaggggucugcacuugcucugccacugcuaaaugcucuggccacagcaucccaccccaguccccagagacaccuguagcucuuccacacgccagauacaaacuccuccagaagcccggggcuuucaguauuagugugacucagccaugcaacuuagagugcauccauauaauagcaucuaaggucuaggcugucacucauaccaggucacccucuccagcaccggaucaugacuuuacaaccucagucucucccuguagacaugccacuaagcaccucugucuucagauaccagacacagacacagaggguuagcgaaaagcccucagcaacacuagagggaaauucuaguuauccugcgagggccgcacuccucugaagcacuggccucagagugagccugcaaccuagcuagccugggguagcaggcgcucagcgcggccucugcuuccucccgcuccuggccggccucaccagcaguugagcuuccgcacguugugcagcuccgaagccuuggcucgggacaggaccaucuuucgugucagcuucaugguggccacagggccgcgggcccggccgcccuccgcuguacacucggcuagcgggagaggccugcgcagcggcgcgucuccaggggcggggcccgcguuucuaggggcggagccugaggucccauuggcagucaggcgagagggcggaagcgcgccggcgaagcgggacggcccgacuuccg

SEQ ID NO: 5591 - RNA, 23134 nt, Mus musculus
uaaaaucagcuugcuguagcaugaacuccacuugcccagaaacuucagucaggcucagguugugaacuucauuuggugaggacguugauccuagcugcuggguaccuggggaguucgguggcgggccuggggaaccaggguuccggaaccgcugcgcagacauuuguagacuggcgugcgcuccgccuuucuuagcgcagcuaccuucuccagcagccacuagaggggcgaccagguccccgagccugucagucaaacguuauacugggggcggagccggggcggggcgggacaaaccggguacacaggcaggcgcacggggcggggacaggcgacagcggcgcggaacgcagagcggcgggagaggagcuugggcuccuggucuccgcugccgccauggcuaccguggaccuggagaaacugcggaugucgggggcuggcaaggccauuggagugcugaccagcggcggugaugcgcaaggugaugggacgcgggggcguguuuagggauggaucugggguuucugccuguccucggaacccuucgggcuuguccacugccccucgccuagggaucugggguguacuuggccagccaaucuccuguggagcaccguggcuucaggucccuguccccaagcuccgccccggguagcuggcguacgugcugcaggccacgggccuuggcacgccccgcccucgcgcugccuagguccgcccgguuuggggguguguccgcgcagcacgcagacuuagggcaccgggcuauuccuuucuaggccacacgugucaggaccucuaagagaagcacagccggccaaguuucacaggccggaauuugaaaggaucagggacccuguacccucccccgugcagccugugauuccuaccuucucuguacugggauggggugagacugaggcaggcuugcccacacgccuuugccugggcugcuuccugucccuuggauggagacuuaaguggagaacagagggcguggagcggggguauuuuuuuaccgguguaacagggcaagcaccacagggcuaauaguugagggugcacagccucuucucggccugguaaggcuagggaaaagucugggcuugggaggaucugcccucuucucagccccucucuugguggccugguuccaggcugacugcugaugugcgaagucuguggcucuaguuggguccggcugaaaagaaauacuacccaguugggggcugaggaagacacguggagcuucaaggggcuuggcuucccugagcacugcaguugagcuucgccauuuccuuccaaacauuucaggaaauacagacacacaugcuccuaagcgggguuccugacugcccagcccuuaccuaagagaucgguaggaacaacacaggauagauacaucuuacaagcaugauugcaaguccaggaaggcaggaaaaaaugucacucugacucccauaaugcuggaaaucucaaaucucuguuggguccccugggccuggucuaggcuggcagucagcauacccuuuuucagggcuguuucagcuuguacaucccagugcugucacugagacugggccggggaccuguggaagaaucacccaugguaguggaccacaagagaggcccugacuaggcccacaucacccauuagauaggcauuucagugaggccagcagaguccugagucccauuuguagggcuccugccucuggcaggcauagauaggcuauccaccucaggcuccugucugagcaagggaggccccagugucugagggaugguaauauugaguggucucugcgcgaggacuucugcugccuucugugagaggcagcugccaggccagggccaccagggugacagacauuuguuuuggaggcugguggaggaaccagagacaggaggcccuuccuggucaggagaggguaggcaaaaccugcuuacauuuccauucuggcuucagggcaagaucucuacagguuuucccagaguccucuuuggguagggucaguaucagugggcaaggggcagcagcugguaugggacagaguggagccuucuguugccugaauucuggaagcgccuguggguguguuccccaggcccugcuuucuucugugcccagucagcugcugggcuccucaugccuucugugugcucacggagccccaucugcaugcagugaacaugugaacaccaguccucauuugagaaggcaacacgggccuagaucccaguccuggccuggcuggagguaaccagcuccuuggccuaaccugugcgcugccucuggccuaugaaaagguuucuuuuuuccuuugagccaggcaggaagacccauccuuuucagacccaagucucucccuuccuguuggccaagagucauguuagggaacugaggagggcugcuguucaccaaagucuguuugacuggaggacuuuguuuaaaaagaaccacagguagaaaaaaaaaaaaaagcaaaacaaaaaaaccaauuaaccaaacaacugcaacaaaccagccuggcuaaucucagucacaucgaagccugguccacucuggcuguuccuucccgucucuucccaguaccuaaauugcucugugguucugucuucccugaggucaggggagacccugauuuccuguuuguguagcgagcugccugcgcugaggggggggggggggcgguucugggauuggacacagacuuuuuagcugauaaguaacacuuugguaggcccgggaucaucucuuggugucuguauaacacuuuguuuucccaaaggucucucucugagguaauuuuugcaacaaaugcauauccagccuuuggcucuucagagggcagcuauggcuauccguugacagaccaacagacaaugccugcugccugcuaauggcucuuugauugggccuggucuuugcccuuuuccuuucugagaaggaaaagcaaauugaagugcaguugaaaaggccuuuagcugggugcaguggcucaggccuguaaucccaguaauugugaggcugcggcaggaggauuguuaugaguucugggcuauaaaaugaauuguggggacagcggcacacauagagggugggaguccagaccucugccacagucuagcaugcacagcagaaacgugacauuagcacugaaggccaugcugccccuucuggccaucccuuguucccuggccucagugcagagcagaaagugucacugggugcaucaagcuggggggugccccuguccuccaaccccagacucuuagcccaucaacacagugacuggcacucuacagagugguucaacaguaacaggaacgcuuugccaaagcagcuuucuugcggcccucucgggcuucugcucucacagguccccucgaggacccuguucuaacaagaagggccgucuccaugagaguugcuagcuuguucucugcaaugcugagaacugcuuggguuggcaccuguacugugucuagggcucaguguaggcuuuguuuuaggauguaacggagggguaagcuguacauggcccugugcuacccuccacccccacccccaccccagccaccuuccaggcugccugguuagauacccuugacagcuaagacuggccuucccaagaguguguggcuuccccuccccugguuggucucuggcaucuucaaacucuaucucagcugcuaaggcuccuauccuaccuaccaggaccuaggcucccuccucugggccugcuggcaugggcuaaggggaagaaggaagcuuggugguugcugcagacugacuaagcucaucucucagagggagccagcagccuacgccucagccuuggcuguggacucuucuuucuaggccuuggagcuuagcauucugggugugugggauguccccugcucccuccaaccucagccucagcacuaauacugcuucccaucugccuaggggacuggaggcauuuguugcuucugcaacagugaccuuuccugcuguggguccugggaaggugugaggcagagcagaaguagaauuuccagucaggugggaggacacggggaggacacccuucagcuagguacagccagugacccuuggugcucugcucaacugcuugcugagguguagggggagggguauggccagagaggcagcauggucuucaaagcccaugccaccuuccugccccguacgcuagccuauggcagaggccugggacuuugcucuggguucuacuguccccauauaucaugccuaggccccaugguuagcaccuggcugugugagccugcaagagugggguucucugcugaacaggugagaccagggucuuccuauugccauacauagggcaacagagcccagaauggaaggaaaccaggcccacacaagagcagcugccauguuccuccauauucuucgaaguguuucagagaggaguuuaaugccaggcucugauuuccaggcccugagcucacuagguugggguggggggcuacguacgggaggguccaguucucccugccuggacugauggcguguccugacucccucacagguaugaaugcugcugucagggcugugacccguaugggcauauaugugggggccaaagucuuccucaucuaugagguaaggucaugugcggugggggugugugguggggguggccuguggugagguaaccugugugugugccugcaggaaacacauuguucuguggcacgggagagucuguuguguucuggucaccuuggaagcuucagguggcugggccuggacucacagaauggauguugucugggggaaggagauagagccuagacaucugcagaauggaaacauauuaugggguuugugcccacugauaauuugucccacagucacuagaagaccagccaggacaauaagaucaauaggaggaaccauuaagagggauccuaccuaugccggucaauagcacaaucccacaucccaccucacccaggggccuuugccuagaaccuuagggacauaggacugcccuccccccacucccuuucuggggccacacuguccauccugguuuguuuagacacuguggccuauaagaagcaaaguggggaugcaggggcucccuguugucacuucuggcagacacuguagucugugagcuauuuucuuuuuuucucuccccacccacucccugggugucugucuccuugccucacaggcuccugaauucccuuguauuaucuugagguuguauuguauucaccuuuuacacacaauguauccaaccugcuucccauagggccucugccccucccucucgcugcuggguguguccuugucccuuugcccuggccccaagugauggcagggccauacccagccuucugcucuacagauggaggggagggagagauaguuaggaggugugggggugugaguacaguucaggcuucaagcuuggauggggguggcacagaaagcccugcaaacccggcuguggcgucucagagaucugaggcaaaggagccuggcagauguggcugguggccugagaauaugggggcuccaaauggggacaacuggguccuagcuauagauaaggccucaauuccuuaggauccuagccucuuggguucugugggaauacugagagccugguguggguggugagugccucuaaucccagcacuccagcuguagaggcaggaggauaucuuugaguuaagagacuagccagaaaaaaucuuuauuuauuuauuuauuuuuaaagauuuauuuauuaagccgggugugguggcgcacaccuuuaaucccagcacucgggcggcagaggcaggugaauuucugaguucggggccagccuggucuacaaagugaguuccaggacagccugagcuauacagagaaacccugucucgaaaaacaaaacaaaacaaaaaaagauuuauuuauuauauguaaguacacuguagcugucuucagauaccccagaagagggcaucagaucucauuacggaugguugugagccaccaugugguuucugggaguugaacucaggaccuucagaagagcagucagugcucuuaaccgcugagccaucucuccagccccagaauaaucuuuaaagcaaaagcuuguuuguuuguuuguuuguugcauugacgugacucacagcacgucugucaccuaucaaugucucaaagacaucaaggaaagcugauuagcugugcucucaucuguccagccuugcgcuuccaacucuccccauucacgcuuaauccuaaacaauaccccucauaaaccucaccaucucaccuuuaaaccuguauauuucacucucagcagugggacugggaaagccacaaggccccacaugcccacuguuuaaaagaaaaaaaaaaucccuggagaaguccacgcugucgcucucccaagccucagaguguucuguccucuuuuaaaugucuuuauaaccccaccugcuucucacagcucucucugaaaucccucccaauuuggaaguaaggaaaucuuggugcauagaagucccugcagcagaggaagaggagcaaucgcuccccuucccuugccauagggaagcugacacacucaaagcccaggcaccucuccugugggucucugagcucaaaguacagcccccauuuacguacccagucacuaaaagaccaccuacuaggagauaagggaggacucauuuuccauuuaauuuuaauuaauuaauuaauuuaacuaauuaauuaaaauuuuuuauuuuagauuuuguguuuuagcacuggugucugaagucuuccgacuugcauggucuuuucccuaucauugcuagagcucucgaguggccagaggagcuaccuacaauuggccuggccuggacuaggaaagcuagcuaguccccagacuggggugccuugucuaccuggggcuccuuagaaccuucugguuagauugcagggcugaaggcugagcugcuuggguggcugcuguggccugagcugacccuucacugcccacccucuggggcccugccacuuggcacagggaggagcacggggaagagcacggggaagagcugaguuggacggcccaggauaagcaugaagguccuuucucccuggugcccccugaggcuucaaagcaucgugguagaggccauccaucuugucaucgccuuugagaaguacccgcaucccauguccaucuuguauaaaaccucccuguaggcagacacuacaguguggucgagguucuuggcuggcaccuugcugucugaugagcaacagcagaguuuugcaaaggagccaaguuggguccccauuaugauccaauccaaaaccuccaggaugaaagauaggugcucugugguccugugaggggcagcacccuggacuugcucuggugugaagaauugaccacagguaccuguggcugccuaugaguccaugggacuugugaguucucccuuggguaugagccuuuccaucuaaagcacguucccaugagauguguauagugugacagccugacuucugccuuuaguaggcauuacaaauguguguggguagggagggugucaugcucugcuguuguguagcaagauacacuuauauuccuguagaccacaaucaggucauuuccaccgcucacacugagcagaucuccuuugaaggauaucagccuucccuugggguucuguguccuggcuuugacucucugacuuggguacaaugacaugagcucagcuuggggacagucuuugagugucugcuugugccacagcacauacugugcguuuuccuccauaguaagcagaccuuuaggcauguggagcaugcucagagucccagaguaggaugcugggccuucgaguggcagggcuugccauuggggccccuugagcuugcucacugccagugagcacagugcuucuggccacgaugggguugcucucucaaaugucguccuucgcuugcagggcuacgagggccuuguggaaggaggcgagaacaucaagccagccaacuggcucagcguuuccaauaucauccagcuggugaggcucgaagccagguggcuccuucccacccugagagugugugagcgcgugugggugugcacucaugcacagaggcauuccggcacagagagcuggugggcccacagacauccagacauguagaaaugacagauagacacacacacacaccaagacauaauagucuagaccagggaggcuguggguggagacagggaagguucgguucugccuggugggugguguguaugugggauguguauggguggauguguguggauguguugaggucuguguuguauguguguggagggggggugugcuuucuaguucuaagauuguagaaacucccccaaggcuuuggacucaaggaaaaaggccagggugugggaggagcuauacaagauucuagaggcuucuccccuguuuaauucugugggguccaccucauccagcaauggcaucucucugaugccuccagggacauuuugccaccccaccugaaggcucuuguuucuuccaugcaggguggcaccauuauuggcagugcccgcuguaaggccuucacuacgagggaaggccgccuggcugcagccuacaaucugcuccaacacggcaucaccaaccugugugucaucgguggcgacggcagccucacgggggccaacaucuuccgcaacgaguggggcagcuugcuggaggagcuggugaaggaagguggguccgugcagagcuggcucuuaucuggcucuggugguggcuggaaguuaaaguuuguuccugaugugguauagucugcaggucauaaggucagcaugaggucaaggcuccuggcuugaggaagcccaggugguacccuguguuccagcauaacauguuuccuuccagcugugugguggucaugcuuguagcugauucuggagagagucugauguggggcauagacaucuauuugcagagguguagcuauggguugggugacauucgauucgaagucccaagguugcuguggggaaggugccuccuuuggggaaccuggagcacaguaccccccauugguccuccggaggcuccuggcugggcuguacgccuucuuauagaugguggacgaggcagaaaaagguguggagguugaaguggcuggcuagguggugguccucaucuggucuuugcuucuccgacccaggcaagaucucagaguccacagcucagaacuacgcacacuugaccaucgccggucuggugggcuccaucgauaacgacuucuguggcacugacaugaccauuggcacagacucagcccugcaccgcauuauggaggucauugacgccaucacuaccacugcccaaagguaagugaggauccauacacauuggcuggcuuggggucacgguagugaagcuggcuuccuagggggcugccacugcaggggccgugggugcugguggccaacgggcucugcaacuguauccucagcugauggccucuaggcccauccaugccuccuguuagaggagauucugggggucagcucccaucccucuacgugucaguggagcacuagcugugaaccccagcagucagaggcuaccacguuccacgguggugguacaccugaaggggguucuuggccuccagccagggaucaccaagucuggcucaguaccaggcucucaagcugucugguagacugguggguguuuccuagcucagggcagcccugggcaugaggagaugggcauugucuuuuuuucacuaccccugucuucuuggucuaguguaguagguuaaaauguguggcucccaagaccuggcuuugauaucuacacccauuuucuucuccacagucaccagaggaccuuuguuuuggaggugaugggacggcacugcgggugaggagguugauccuagucggcagggagagguggggcacuuggggccggauggggacagugggggugggggugagcacauagugucuggcauguacuaguugaucauuuaauguuaugaauaugagggagcccuggcaggcaguagggagagagacagggaggaagucccuagcaggcuggcuccucugcucuuccagguaccuggcgcuggugucugcccuggcuuccggggcugauuggcuauucauuccugaagcgcccccugaggauggcugggagaacuucaugugugagaggcugggcgaggugaguggccacuagggauuucagccacucgagaaucuccgaggcaauugucccugagaccuguccuucucuuacugguucacagcaucuaucccuucccucuggggaacuaggagggucauagugcuggcuauugucugcucuugccugugugagggucuuggugcucacugcuacacaugccuaggugagguucauagggcuggugacuuagacauuccugugguccuacccucugugggcagaaccaguggagacguucaggucacugucuggguccaucucuguggccaaugcagggaacauggcaaauuuguuucuuggagugcuggcuuuagcucuuagucucugagaaguggcuucauaagcuagggcccagagcaagaacccugugagagauaaccauguaaugacccaaagaguaggugaagggucugggggggggggggcuagcuacuugucuacugggccugugcuccugugaggggggguggggguucuaaaccagcauauaacugucuagaagugucugccgguggcguauaccaggcccuaacuagggaguccuggaaggaagggaaaugguaggagagguaccucuaagacagcuggugaacuagcugguuccuuggucuguagcaggcuacucgggacacagcucuugggaugaaacugaggugauucugacaaaaguagguaaacccuacucugcagagaccacucaaccugucugcccagugacucugcccuuuuuauuucuauauucuggggcaccuauguucugaaggagagguagaaucaugugaccagccccagggcacaccacaggucccuguccccagggaaggugguaccuccuuacaccugugcauccuauccaggcaguagagcuuccuggggucaugaccucuuucuagaaccuucuugagugaagcuucaggcaggauggagguggacuaguccuagcugucucagugaguccugagcaccuugggucugcguaccugguucuguucugucuguuuaggacgauuggcuucugugagcuuucgcuuuuuuuccugaagaggcaggcaguuccugccuugcccauugcucaagcaccaucgagggaugggaggagcccuggcuuuuacccuccaccugcaaccuuggccuggaaguugggcuccuugccagcaucccacuccccuuccaggaagcccuuucuuucccucuacuaccccuggggcaauucauaagcugcuuccagcuuccugaggcaggaggaagaugaguucuaugccagccugggugccaugcaaagucuaggccagccuuggcuguguaaugagauucucgagagcugcuuccacccugucccuacguuagccuugggggucauugcugccuuggaggcuuguggggcacagcgauucucaugaaagucugucugucugucugucugucugucaaaucucugagggagguaucauaggugagagugcuccaugaugauuggauuagcaagugggacugucauacuaagagagcuggugcugagccuuauggguccccugugcuaccuguuggccuccuacuaguucuuggguagaguauguccuggaccccuggcugaugguugccauuggcaggggugucuggcuggggucccucauuaaaggaugcagaaauaacuugagaugggaccugaggguccuuggugagcuaacuauaggaaugacuauauguggcaugcccccugcagacacccuauccaguaccugcucauccccugcccccacucccuagccuauugcuuguuacccgcuauggggacgguaggauccuaguuggcuggccuccgcucuacuauguacuucgggucucuuuuccucucucagagguggggagaaaguucacuuugcucaaguggguugcagauacaguuuccuagcccccagugagucuuaaagauuuauuuauuauauguaaguucacgguagcugucuucagacucuccagaagagggugucagaucucauuaaggaugguugugagccaucauguaacgcuggaguuugaacucaggaccucuagaagagcagucagugcucccaaccgcugagccaucucuccagcccgaccccagugagucuggcuugguggccauguguaucgagugguccauagcuggagagugagcccagugucucuucucugauagacucggagccgaggcucucggcugaacaucaucaucaucgcagagggugccauugaccggcauggaaagccuaucucauccagcuacgugaaggaugugaguauggcagcuucccggggcaggguggguccccugacuccagcagcaucuccugaagauuggugcugguccugcccugggcaaaaguaggcacugggacauuaccuguugugccguggcuggcugggaucucuagagaagcugaggauccaggucugguccaaggcacugucccccguauugugagcccagacaaccuguuggguccugacuuuauucagucuguguaucugacggggucccucagcaccccaguauuagguccuagcucugucagcucuccaagugauagagugccccuaccucccccuuccauccccccaucccccaccccccauccccacuccccacuccagacucagcacucaauagcauggagcugccagaugugugcacaccuguaaucucacacuagggaggcugaggcagaaggaaugugaguucugugccagccuggcauccguacagauucuaggccagcccuggcugcaucauuaaauuuuaucucaaaacaaaacuaaaggaucuggaacauaaguagugguuaggacugugaagagcuuuuucucuagccucuggugauaauggugguggugacagugguggugguggcaacgguggugguggccaucccucagggaaacccagccccuaccuuuuucucccccccccccccccgcccccucagccagugauugugcuuccauaucuucugauucucugcuaggucucuaccuuauuuccuguccucucuguaacuaggccuccagaaccacagagguccagcggacacugagcagaagugccagagacuacauucagcuuugaauagccagggcugcaggccaugaaacacagccgguccuguaugcacagauacaucucucuaugcacaaacacacggaccuuccauguacacucacacgaucacaugacccgcacauaucacgugaaccucacacuuggauaguguggcuuauuucucaggcugguuuuggggaaccucuguguuuguaaaucuaaggcaacauggguggaccaugggaucuaggcucauagacaacuggacugaagggaccuacagacccucugcucuuuugacaaauagcuggugguucagaggcugggcuucgauacacgagugacugugcugggucauguacagcgaggagggacgccuucagccuucgaccgaauccugguauguuuauaagccucugcaggaacuguguguguguguguguguguguguguguguguguguguguguguguguguauguguguacguguguacacauguacauguacugaggaacugggcuggcuugaccccuguauauacaacaucuacuuugcucugcuaagaacccugauguaccaucuccuuggcccuacugaagaauuggacauaaaccuaugggaaggggacucccuggcucauccaggccuuuccacacccuacaugaaacucuagucucuaaagaggccaagggaauccaagacuugggcacaaggucaauagauaccaccccaccaggaucugaaauguccugagagcuaugcucagccgaugcccuggauguuggugggacaagcugccugggcagaggugagggacaacagccagcucauuacaguuuggcuaucaugggacugccaacaucuuuuugccaguucugaguccagaugucuacagggugagccaggggacaccugcucaaggaguaggucuuucacgaguccuuuaucccuggcugccugccuguucucucugcugugucagugacaaguugucccagccugucagcucauguucaucaggagugugacauaugagggucccagugcgggauguuauagaaagaacccuggagcccuagcugacacuuucagucagagagaggaguccucucaccaggcccacuuagccaggcuguggggacucuggugggaauuggagccugguuaacuguuaugacuguugaucaucgggccacuuuaucaugaucugggccagugucggggaggcucagaaagcugggaguguguguaucagcagggggccuguguugguuugcagugcgucugugugcagcgagaugggcugugccagccagcccuuagccacgcugcccucucuccugaacagaguagcaagauggguauggaggccgugauggcgcugcuagaggccacgccugacacgccggccuguguggucagccucuccgggaaccagucugugaggcuaccucucauggagugugugcaaguggugagugcggccuccuucagaagaacccuuguccuuucagagccccuuccaagucccucugcuuauguguauaugggguggaggggcgguggcaaggacugcaguaggagagcaagggguuucugagcuucagaaagccaggagaaggggcuggagagauggcucagcgguuaagagcacugacuacucuuccagaguuccugaguucaaaucccagcaaccacaugguggcucacaaccaucuguaaugagaucugaugcccucuuuuggugugucugaagacagcuacaguguacuuacauauaacaauaaguaaaucuuugggcuggagcuagcggggccagagcaagcagggguccugaguucaauucccagcaaccauaugagggcucacaaccaucuauacagcuacaaugugcucauauaaaauauauaagaacaaauuuuaaaaaagaaaagaaagccaggagaagcuggccagaggguaggacaaguguuaucaggggcugggggaucgagaucucagcuuccugggggcaguggcauuggguaggggacuaggcguuugggauuaggaugggagggaaaggaugguauacuggguaaggcucuggcagguaggguagccacagcagggacuuuaggaugggguacaggugaggccaagcagggagaugcuggcuucggcucagguuugggggcucuguagcuggggaugaacaggggugccuggaaugcugggcuguggaguaggagggaggcuuggucccuagcccuaguuuagaccaguuuggguauugguugugggucugggaggugagguuggggguccucucauucccaagacucugaggggcuuggagccuggcgaagcacaggacugguuuguaggggaggacucacgcuugggucucuugagccuccugaaaacggggcuuauggcacgaaggugucagcuaagagucccuccucgagccccgcagccugugucagcauguguagucuggccuccuugacaaccuggcugucuuuucucuuuaagacaaaggacgugcagaaggccauggacgaggagagguuugacgaggccauccagcuccguggcaggugaggagggucgccauuguuucuggcagcagggagguaggggugagcauggaucucggacagugcuacgaggcacugggccgcgcuccccucugcgcucuguacuaauacccacuguuguaggagcugaggggagggagcuaacugugaggugugggagggacuuccgugccagggaaggaccuauagggagcguauggggagggcaggguaguaguacugcaggacggauagaagucaugaccaacuuuggauacuaugggugugccuuacuggaggacgggggugggggccagcagguguguggacucuaguccuugguggcacggcaugccaccuccugcaccuaccuggccccgaggucugaguucuggaugggugcucaggccauggggcuuugugaccugggaaaacacacccugguguccuguuggaucucauguggguauugaagaugcccaggugggacauagcgauaagauacaagcugacuguacaggaucuggcugguuuugaucugaguucuggcccugugcugggaagucacuaagcucccagagucgcaugcgugaugcccgugugccguucugacuguugagcagccagccuugccucucaccgaguucguggcuguguguagccagagggauggcgcagggccgggaacggaacggucuucuuccuuuccaggagcuuugagaacaacuggaaaauuuacaagcuccuugcccaccagaaggugucuaaagagaagguaaggaugagggcagagcccucaggugcaaugcggugguucucccaucuuccagcuuccucuugccucggcugcuacuacccugcuggcugccucguggggugcugaguuccaaguuuggggcuggggagugcacagcaggagcuccguccuccugccucagguguuagcugaggacugaggacugcacucagcucugaaugccgcuauagggcccagcuacaacacaaucuaucuaguguugcucaaggacuauugaaugaauugccccugauauaugauauauaucauaaauacaaugcguugagcuguuccuuuauagcugagacccuggggaaagauaucuccggaggaagggcugguuccugcugcuucagggaccagggucccacucagauacuccgagcuggcacacuggcuccuacagcuuauggauauauauauauauauauauauauauauauauauauauauaucacuuuauauuaaccuagcaccacagccagugcuucaguucuugguacagagcagcugccccucccccaccguggccguaccacuccugucugaggcuggcugaugcccgaggacuuggaagcagcuguugauccagcccaucaggcugugccugugagccuggcuguuacgugguguccacuaucaugccaggagaccuagcgauguaggcaggacuugcacuuucucccuuagucuuucccagaacuuucuagaaugagcaggauagcucuauuacucuguauauaagggagcugauagcauccaggcugcucaggugucccucuggccccguggcuuacauuucuguccuuucucuuucugaaguccaacuucucccuggccauccugaaugugggggcuccagcugcuggcaugaaugcagcugugcgcuccgcagugcgcacugguaucuccgagggacacacgguauacaucgugcaugauggcuuugagggucuggccaagggucagguaggugucguggugauguagguggugucugggcugugggcucagucacucaccuuugaagaucugaguggcgugggauguguaaacagggcaguccaguucaggcacaugaaggaacaugauagcccauggggaaggccugacugcuuuggguguggaaaguguagggcucuguccucauaaucagcccugagacccaggccccuccuuuggggugauggccagcucugacagggucucuguuaacugccugaggggucgcuggugaaacagaccacuuuccugaagccacggucuuccugcacgugcaagaagugggcuggcaugauguggcaggcuggcugggacgugguggcucgaugcuggggaccaagaggucaguagcuccuggacagagcacagccuagcgcaugggacaaguagagacucuaguccugaacuccaggccuacagcccuggaccucccagcucagcuggggcacaggugucccucaugagagacaggcuguucuuucugucugugggcugugguuuuuauuccaagaccuggugguuuuagggucacgauccuucucagaguuggccuggggugguuauggguggucauguuguaugaugaugggaaguuguccugcccaagucaguggggcuacaaaggcuggagagaaugccccuuccugucaccaccucagccagaagggacacccagaguagacugauaggcagaggccuggccauugcuagacagugcccaacgaggguguugaguacgugcccaggccucucgaaucuguguuucuguuccacaugaagccacggagaggcccuuuggggacagaccucuggcucugggaaaggcugagccacacauuuuucugagaugagaggcacucugguuuugugaguuguauguaugccuccuagccaggcugaugucucucuaaccacaggacacugcccaagccccaccuggaggccauuguggagaaucuccgcaccuacaacauccacgcccugcuggugauugguggcuuugaggugaggcuuucucauccugggucacuugcuguugugcccacaaaugugaccucaaacaugguccuugggcuagagcagccaaagggucaaagcuaugaguauaggggcuagguuggggauaggauuuuccuuucugaaagccuuacagaguacacuaggcuagcucuaggauaucaggagaaauagguccccaaaaggaggggcagcgaggucuauggggcucgccgauggcauguccuggugcuuggugaguucuugccacaugguucauaugaacaugggugggucugaacccaggagcugcaacccucugguccucauuaggacccugcuuuucuggaaggacgagugucuagacgaacagcuccauccaggcaucucacccagccccuggaugggaguagauuguguuaccaugguaucacacauagucaucaaacagggcagggcaagauggcucccuagcucuggugggacccugccucacagacaccccccaccccugccggcuuucuuuccugcacugcaggccuacgagggugugcugcagcugguggaggcccgggggcgcuacgaggaacucugcauugucaugugugucaucccagccaccaucagcaacaaugugccuggcacugacuucagccugggcucagacacggcugucaacgcugcaauggaggugagguauccuggagaguauaaucagggcaugugcugguugcuuagugggucuccuagccccugggucugugcagacccagcggagguagcccaggcucuguccuguccagcuguuauguguauugggggagcccuugguacuggacgcaauugcuguugccuugagauccuuuguagcaauguccguggagacugggaaggaugggcacagaggguucugcugcauucuguagcccaggcuugauuagaauucacuacauagcucaggcuggccuugaacuugccuaucaacauccuuacuaacugagauuauuguagugagcugccaaugcugggcucugacggcccccuugaucucuccagaguugugaucgcaucaagcagucagccucagggacaaagcggcguguguucauuguagagaccauggggggcuacuguggcuaccuggcuacugugaccggcauugcugugggugccgaugcugccuacgucuuugaggacccuuucaacauccaugacuuaaaggugagcccagccccgcuccugugcucugcagccacccaugagucugacuagccguccaaaucacuuaaugggugucagucagcaaguuccauuuuuaaguaguguguuuuagcgucauuggucucuuccucgcccugaggcugcuggguccugucugcccaccucuuagcuuaccgccucuccuucccaggccaauguggagcauaugacagagaagaugaagacagacauccagaggggacuggugcuccggugaggcuccuaugggugaugagcagaguggcacaggacugcgaguugcugccucuucucuuaguccacucuaccuuuuucugguggggcgggggugaggccagaccucaucaccuaucccauucuaccuuuauauggccugggggggggcagggguggggcggggcaggggcggagccagaaagcgcugaccgcuuuguaugucuccacaggaacgagaagugucacgaacacuacaccacagaguuccuauacaaccuguacuccucagaaggcaggggcguguuugacugcaggaccaaugugcugggccacuugcagcagguacagcucugagggcgguccccuggccccugcgguacaaaucugccgggguucccaucuccauuccuauuuuuuucucugggguuccugggaggacccuggagggagaggcuucgugcauggucuggagaagguuuuugucaagcuuuuuuuuuaauucuccagcacccugggguacugacuguucccauuucucuuucauggagaaaggacugaggcccaucuuuugaguucucaccucaggaggauggggcugagacccaaaccuggcacuucaacucuggacugagaccuccucuucugggaggugguccaagccucugucauucugugacuaucuccuccugucuagugucuagacccuguugucacaugguggcucucaggaggccuggggguggggccauucccuauggguccauuucugaccccugggauggcuucuaggcagcgcucugaggcccucagguggccaugcugcuugcaaggauacacggagacaugguucauguggccuaggauccucccccccccccccccccccccgccauugugucuagucuuuggucagcuccagggacaugguuuugacuguuuccaggguggugcuccaaccccuuucgaccggaacuaugggaccaaacugggggugaaggccauguugugggugucugagaagcuacgugaugucuaccguaaagguagguggguggacuggccggaccuggcgcucucggggucucuagaggcuuggacuugcuaacauguaccuguucccauaacagggcggguguuugccaaugcuccagacucagccugugugaucggccugcggaagaagguaguggccuucaguccggucacagaacucaagaaagagacugauuuugaguaaguccuuguggaccugaguggagaagggaggacccugggaggcccagaacuuuccaggacagggccccuagcaggcuuugaagaacaggagucuuguccaugcguucaauggccagcacaggguggucuggggaggguuugugacucuugcaucugagucuaccucagaaguacuuccccucacucccagccagaggaauggggcacccagauguacccuguauacccuggucaugauggcgacuagguauucgggguuuaagggaucucgggauucaguucuguaacuaacuauccaaccuugaccugcgcaggcaccgcaugccccgggagcagugguggcugaaucugcggcugaugcugaagaugcuggcacacuaccgcaucagcauggcagacuaugugucuggggagcuggagcacgucacacgccgcaccuugagcauagacaaggguuucugagcuuacugucacuacuguuccugcguucccggacucucacccucccagugcuagccacagaucccagcaccgaggggaacucaaggggaacucggagcccguggcuggcugagggaugugggggucuacugugcugcucuggggcucuucccuuagcccuccccccacccccaggacagagagccuguggggccccuaccuuccagucagacccacauugccucucccucacuggccagcuggcugccucaccacacggcugaaaagagccucacuuuuuuagaaauaaagucaccugucuagagcauggucacugggacaacaugaccagaggaguccagggagaggguugucaggacucaggugcaaaccuuacccaaggcuauaguuuguuuaauuuauauaaguacacuguagcugucuucagacacaccauuagaggucaucagaucccauugcagaccguugugagccaccaugugguugcugggauuugaacucaggaccucuggaagggcaguuggugaucuuaaccgcugagccaucucuccaguccugcccacagcuauucuacaagacuggaauuuagggaacccucccgggaagagacuagggagaccugagcccuuagagagcuacugaggcucgugugagccccauaccugcccuggaauggcugggguaucggccugugggcaaugugccccggucuggagaggagacugucauugucaguauaguguucuuggcugauugcugcccuucaggagguucuugaggucgggacguuggcuccucagagaaguuuaugaagggcugagcccuggccagccccaccucagaucccucucuaagccccuuaucaggguuucuuacgugagcugcugcuggguccauccucuacagugccuggauuuuuacaauauuuacaauagguggaggcuguuucugguuucuccguguauggaggucaaggguugugacuuuggcucuguggaccugcaggccgcauuggggcggugguuuccuuggguagacgucuccccccaugggucacuguaaggcuucuguggggguauugcaggccauguacccagcugcuucaucuggcuggagcccccaaagcugcugggagcagaguccuggaguguaagugucauaucacagcacccuggaggguuuggucuugagcacauggcaacaaggccuguauauuagggcucuagagaaacagaaccaauagaauguauauauacuguaaaag

SEQ ID NO: 5592 - RNA, 13591 nt, Mus musculus
guaccucaaaguacauagaagugacuuuaauuccaggauaugggguggccuugcaucucuacaaagaucagggccaucugcaagcugaguccagcaggccagaaccugccagcucuugguccuaaucagcccaggccucucagaacagagugccucauccgauggggcuggguggggagggagccaaugcugugcugcccaccccuuccugggccaccugucaucaggaagagaaggguggugucucggccagcgggcgugacaugcucuggauggcccacugcaggaugccgucaaaugagugcugagagagagugacacgggagguuagagcagucgcaccuccauagagccaucuugacaugaagguaucacccaaccugacccgcuaguucaaggagggggacugagagcuagggcccaugggacaugccagugaagggaggucucuugauccaguccuccucuagagcagccugugggcccuggguguggcuuccucugcuggguccuucuucucugccaacaggacugggaaguccuggagaagguccucaguuuuuccaguguccacccaugcuggauccucucucucucucucucucucucucucucucucucucucucucucgugcuucugcagaucugccugugcauggcccucugcccagggcaggucucugucccucagccaguugagucucccuaaaugucaguggacacugaagaaggcaugugggcucccugggguaugggaaugaccaaaggaguuugugcccuugcaauagauggggcccuauuucauuuucuagaagaaauucauucuuacuauuuuuuaauuuauauauaugcauauacacauaauauucacacacacacacacacacacacacacacacacacacacacacacuguagcugucuucagacacaccagaagagggcaucagauucuauuacagaugauugugagccaccaugugguuucugggaauuuacuacuuuuaaguauguauguaugcugggcagugguggcacacaccuuuaaucccaguacuugggaggcagaggcagguggauuucugaguuugaggccagccuggucuacagagugaguucuaggacagccagggcuacacagagaaacccugucucgaaaaaccaaaaaaaaaaaaaaaaaaaaaguggguauguacauguguguaugcaccuauguguauaugugugucuguguguauaaguaugugugugugcgugauguguguacagaugcccgaggaggccagagguuucagauccccuggaguggaaugauaaacaguuaaaagucaccugacauggcugcugggaccccccccccccaaacuuggguccucugaaagaacaaugcucuugcauuucuguagccccucagguuuuugagauaggguuuuauaauguaguccagauuaguauccaccucacaguccuccuacaucuaccucaagcacugggaaucaaagaccugggccaccuauccaccucaagaaacagaaaacugaguugggagggguaagagagaggccccuggaagacccucccagcuuucccugaaaagucaagggcuuaaacccccuggcucugaggucuugaugugaggaucccagaugugagguuccuggaggaggccagcacccuacauggaaacaagcucuucuaggaagagcagcuaugggggcaggguaacacuggucugcuggugcugccuacuaggggcagcaaagaaucugugagcacagcccagacuaggugacagauuaccucauugaggagggacuccaggucgucccuauguagaacagggucgugacuagcagagucguccccuaccuggaaccaaagcagagaaucaauagucaacccaaccuagcagcaggcuagggaccagacgcaggacuuggggcaguagacuguacuccaccacagagcagacucacaccuaguaccucaggcuggggacacaggcaggcugagggcaacaaucuguccuauauauucccuguagccccuaaagagacccgguggcuagcacccagccagugucucucugcuuucacuagucacaugagcugaacuuaguuggaccugcccuggccauagugacagagcuccagucagggaguggcaggcucugucaggaguucacagugaagccaguggaggccccauugcucaauccucgucuucauucuagaagugacuuucacuguuuguggcuagacucuaggacagugguucucaaucuucccaaugcuucaacccuuuaauacaguuccucaugaugugaugacacccccccccaccauaacauuauuuuuguugcuacuuuguaacuguaauugugcuacuguuacgaaucccaacucucagauauuuccaacagucuugggccauccugugaaaagaucauuuggcaccaaaggaucacugaggaccacuguuuuaaaggcucagcaaaccuugccccaugcuuuacuggguccuccaguagaauccuaggagcaauagauucugaugcagccucccagauguucucaaucagauaaggucaaccugcaacuaggggggcaauuuaucagggaaagcuggaaucuagcagugagcugcgcauacacucugccaccuugcauaacacaucuuuacaagaucacuccauuuuacccaugaaccugagagacagcuaggggcccaagccugggguccaugucugucuuagcaguauuaugcaauggcaaguggauagagguggauacugcccuuuccuccuugggccuccagacaaagcucggucccugccugguuaguaaaaauggaggugacauagagauccaccuggguagaggacuuggguagguggcucucggggucaucaaaagccagcagcuuuguuuggcucugcuccccaacucucucucucucucucucucucucucucuuucucucucucucucucucucuccaggccaauaguuggccgcccuggaggucccagccauucugauaccuguucugcagacgaucuggccccugggugccucccagucgucucauuucaaauuaagccaacugcucuuagguccagagcucccugaucagagcucugagcucugaggcccacggacucccaggaacccaguaccaacagugaguucauagcuauuuggaagguuucccuuuaaaauacuugguuaugucuagaaaggguucgacugcguagcccuaacuaaacuggaagucacgauacagaccagacuggauucuaacuuacagagaccaaccuaucuuuacugcugggggcuaggguuaauguccugcccuaccacuuccagccuuucccuuuuaaauagauucaacuuaucaaaauaaguugucuguuuauugaaaaacacuuuauaaaaguaauugaggagccagaauuagugacauacaccuuugaucccagcaauagucuuaaagcaaacaaacaaaaaaacaaacaagggcugggaagugguggcacacaccuuuaaucccagcacuugggaggcagaggcaggcugauuucuuaguucaaggccagccuagucuacagagugaguuccaggacagccaggggaacacagagaaacccugucuugaaaaaccaaccaaccaaccaaacaaacaaacaaggacuggagagaucuuccagaguccaauucccagcaacuacuuaguggcucgcucacaaccaucuauaauggggauccaaugcccucuucuggugugucugaaggcagcuacgauguacucauauaaauaaaaaagaaaucuuaaaagauaaaaaaggggggcuggugagauggcucaguggguaagagcacccgacugcucuuccgaagguccagaguucaaaucccagcaaccacaugguggcucacaaccaucuguaacaagaucugacucccuuuucugaagugucugaagacagcuacaguguacuuacauauaauaauaaauaaaucuuuaaaaaaaagauuaaaaaugauuaauuuuuaaaaacaaacaaaaaaguuaguccaggaauaagggucaugugcuuuuaauuccagcaguugggaggcagagguagguggaucucugaguuuaaggucagcuuggucuacgaguaaguuccagacagccagagaucuguaguaccucaacaaaacaaaacaaaccaacaaaaauccaaaacaacaaacaaaaaacaaaucccccaaacccaaccaaacaaaaaguaaugggacacacgguuauuggauauggguuuaaauucuccuccacucccacagggucucaccuggacugagcagacacugaccuuggcaagcccaggugcuggacggggcccagagguggguacagcuucgcccggugugccuggcgugggagucgagucugcagagcaggauuugcagcggagauugguccuguccgagagaagugggaaaagcucacuggcucggagaaccuucggggugggugagaucgcuggcuacucugccacccggugcccccuuacucaccccggccgggcggcggccgucgggaaguggcagcgccaguggaaggcagcggcacagugugcacaccgcaacaccucggugccaucgccacacacacugcaucgcgcgcuuggugcuggacccugcaggggcaacaugggcggcaacccagcccguguccugcucaccccaccagcccggguuaacugggaaaccucaggguuucaagucgcgugagugggacuguaaauucugaguucuggaugucccgaggggagcaggggucagaaagcggccuuuccaagcugcuuuccacggaccaguccauccugggaguccagcucugauccuaccaaaugugggacuccagaagagcuuuggaggagggagaggguggggaaagacugcgagaggaugauggggaaggggcagugagcgggauguaaagugaauaaguaaaauaaauaaauuaauuaauuaaauuuaaaaguggggacucugaaaaagaaaaaaagaaagguaaccaacagaaguggacagggucuguggauucgagauguuuguuguccugcuucaugaugggggaggguguaucaucuggauaaccaagcuaagccugucugucugucugucugucugucugucugccugccugccugccugccugccugccugccugcuugccugucuuacuucccuccuucccuucuuucuagcuaauucacuauuuauugguggucaugcacauggagaucagaggaccacuugcagaccgagucacucuuuccaccaugugaguuuugggaauccaacucaggucuuccaucuuggcugcaaacccuuuuacccacugagccaucucaaaggcccagcuggagaguucccuuggugcucuccccuacagucccuguguuacuauuauaugaacaagugucucuuggcagagcccuccccugaccccaggaauguccgucuaauuccuagccccgggaguccaccagaggucccguuuuggacauacaacuaucccguagguccagagccccucuuccccaaagauagcacccaggcccuaggggucuccucacucacuggccgccccucauucccagcacucaguagagggcacagugcugaaggcuccagcagaggagcugcagggugcggggccagcagguucacauaugugacagcagcaucagagcuggcuuugagcucccuggaugggccccugguuuucucugaagcugaccucagucccacgaggaucuggaauucaaggguuagcauucaggggccacaggguacugcucagcaacaccuaggagucaggacugggcugcuguggugggucugagguugggaaggcuugguacaagcuuaagagauggcucaguaguuaagagcacuggcugcucuucuaaaggacucggguucaagucccagcaccuacaugacagcucacaacugucugcaacuccaguucuaagggaucuugacacccucacacagacauacaugcaggcaaaacaucaauacacauaaaacaaaacaaaauuaaaaaaaaaaaaaagggauggagaacuggcucagugguuaagagcacugacugcucuuccaaagguucugaguucaaaucccagcaaccacaugguggcucacaaccaucuguaaggaggucugaagcucucuucuggaguuucugaagacagugacaguguacuuacauauaauaaauaaauaaaucuuuaaaaaauaaaacuaggagaagaagaggaggaggaggaggaggaggaggaggaggaggaggaggaggaggaggagaaggaaaggcugaguguguggcugguuccaugguucucagcaaaagccagggccaagccagagcaaacuagguuucuaacaggagagcuaccaaggcuuuuggagaauauuggcaguggugagucuggagggacagagccagcuugggaagcuguuuuuaaucccuuggccccucaaccccacagggaauucaccagaacagagcauggcgggcaugcaggacucacaggugaagccagaagauaggacuguagagagucagagagaagaaagggggugacccaauaugggcauaccggggucucugcagguagcuccgggggccuggacaccucaggcugggacagguucuguuggacucugcccuggaggcagcaggagcaucuccagaggccacuguguaggaggucacuagucacaggcuugccagacaaaguagagaccauagacacccccccuuccccaaauguauggcaaggauggcuugaggacccucugugucaccaugcucauucauaggugggaagccaaacccgggacuaaaagaguuagguaccauaagggcaguucaauagaaugugggcuauuuaccucgggagcauggcucuggacagagucagggucccuagaauccuuuuuuuuuuugguuuuugguuuuuggagacaguguuuuucuauguagcccuggcuguccuggaacucacucuguagaccagacuggccucgaacucagaaauccaccugcuucugccucccgaguucugggauuaaaggugugcacuaccaugcccugcgggucucugcuaauucuuaagaauacucuaugcccaguacccuucagcaccugugcuugcuugucauaggccuggcauuacugugggcucucucagcuacaauguuuccauccuaggugcacaaaccguccuauagggaugggccagugggggaggggagauaagcaugacucucagcuacacuguuuccauccuuggcacacccacaguccuguagggauggaccagugggaaaggggagaugagggaaaggacccugguggaagaggaucagagagaccugggucagagcccaggcuagcccgcacagacugcugcuuaccucuccucagaacagaggguugugcagucagugauagggguaacaguacaucauugugugagugagauuugaggggguggggguacagugugcuuaggaaaaggccugugcccaaauauggccaccuuugccuggggacaucauguuauggcugccuuuuggccuguuggcccugagugggccaugaggcagggaacacagauagguuucgguauggccagagaauccuaccauuuccauagcuaguacccuauucauuccacagaucuuacugaagggcccuuacugucuucugugaaggcuucuaggcuuccucaaugucagcggauaaggacggugauggaucagagauggagaggucugcuuaccuggggaucuccugcagagguggggacaggcaagccagguggaaggcccggggacagccgucacaacagaugagcucaccuccgucguggcacacggcacacucauccucguucuucugaccaggcaagagggacccagaauggaacacagcauccaccugagagacccacuugggacaaugcucaccacuaaggacugacucccagguucccccuggguucucucguuggccccugccugagcucugcaaggucucugaaguacuagguuccacacagaccuaggggggugucccucucuggaaggagugcugggugccaggcaguuccuagugggaaaacucugcuaauuaagaucaaaaucccaccaugacuggauagcuucugagcucagcgcaauaugggggacucccuucauuaacaggauuucuccuucuuugaccuugucuggggaauucuaagccccgcccccgccccccccccccccaggcuuaggaaugcccucagagaugcaugaagaaugucacguagccucaguuaaauuacaggaccaacuuccuuucuccugacaaagcgcccauucauucagcaccugagauuuccgaaaugcuuucccuugcuaaggagacauuuuagguaccccaagcccccagccaaugaccuuugcccauccuagauauuccuacccucagacccccccccccaaaacguuauaagccuugaauugggcucagcagguaagagcacugacugcucuucugaagguccugaguucaaaucccagcaaccauaugguggcuuacuaccauccgugcgacugaagacagcuacaguguacuuauaauaaauaauaaauuaaucuuuuguuuuuuuaaaagccuugaaucacccuaaguaaaguugaucugccuccugauagcuagucccgguguagcccaggcugacaacccacagaguggggaggcccacaguucccuggauugacuaccacucaccuaauaggacagcaggugggugggcccacgggguuucccguuagcccuagguaccuccugucauuccccauccccuaccuuaucaggauggaaggaguucugagucugaaccuccucaagaagcucccagaugccagguugugggggcccacacagugagcacaugggaaacguccauaggcccccaauaaccagggcacuuuuauggagcagggcagaacuggaccuucaaccuuugguguccggggccagcagaguaccuagcucugagguguuggacucaauaaucaaugauugcaggcacaaccacaucaguggugcuggggaggagaggauaacuugauacccucagagaauccccauacucaggcuuuaucugcagcccuacccgacccgaagcuaaugugcuuuuugucaucuggacagaaugugugauuuuguuuuguuuuguuuuguuuuguuuuguuuguuuguugucaagacaggguuucuugguguagcccuggaugucccggaacucuguagaccaggcuagccuccaauucacagagaucugccugccccugucucccaagggcugggauuaaaggcauauaccaaccagcugaacgugugauuuuuuuaaaagcagcucaccugcugugacuaauuggaaaucuccuaauaugcauccuugaaaacuuccaagaaagagcugagugggaggagguggaggaaagagaagggagagaagaggaagggagcugcccuccauauccugguucccccacccccacccccuucuugggacuuaccugguuaaccuggggcucacuggggagggauggaaggggaggaaccccacacugcuggcccacuuucugcucaucucuacccuaugagagacacagggucuuaacgaaguagccagggucagggaagaucuauguggccaccaaguaccacugggaagcaacucccacccucgggaagaacuccaggcuuucuuugggaggggaggggaggggaggcuauggaaggaaggcccagcucccccuaaauggacaugcuggauaaggcuuacagguauagugaccugggcucccuuggcucggaccacuggcuuuaggcugcuaccacuccgggccuuguucuucaaauugccacuggggucuucgaacuuguuggguguauaaaacucucccccaaccugaaugcacuucuuggaucuuccugggagagagauagacugaaugagcucacccugggggucuggcagaaccggggcuggguacagcuagggauucuuugcuggugacuguacccuuaaacagugcccuuccucacaagcucagaacgggaccuuacuggaaacagggucuuuggcgagagaguuaguuaagaugaugucauagcagggcauggugguacacaucuugaauccuugggaggcagaggcaggcagaucuacucgaguucgaauccagccugcucuacuacagagugagugaguuccaggacagccaaagcuacacagaggaacugucucaaauacaaacaaacaaaaacgaacaaaagaagcaaccaaccaaacagaaaaaccaacaacaaaaaaagaugucauacgggcuggagaaaugguucagugguuaagagcacugacugcuauuccagaggucccgaguucaaaucccagcaaccacaugguggcucacaaccaucuguaauggggaucugaugcccucuucuggugugucugaagacaacuacaguguacucauauaaauuaaauaaaucuuuuuuuaaaaaugucauacuagcccuuaaauccaauguucuuacaaagaaaggugaagucagagaggaauagucagauuggagaggggcuauucucagaaguaagcauuccaacagcacuucaugcuagaggcaacagagggacccuccaaagcccacgaagggacgugucccuucccacaccuugacuuuggaaccuguuguuacaagccuggggcuuuuuguucuaauaaccccagaagagucagacaagauucuuggggcugcucugacuagggcuggcaugagcucccaggccauucuggcuguccauggcauccaaguccagugucccggacagaggaggugcuguggagcagauucugcaauggugagugugucuggccccagcucugacuuguucagaugaucuggguggcuguauaaggugaccccacuagccagccuuguagguaggcaauugugggaggaaccuggacaaagagugaggggacuggacaggacauagauaccugacacagggcaguaggauguggugggcugucuuagugggcacuauggucucuugacagaacuagagcacacagggaaacuuaggauguccccugugacuagcagcaccccuugacguggaagagguggcauuccauggcugaaugugacuaugaaccacuggccugacaaaagauccacccauguagggagucuuccacaucagcacugggcuccaaagccagcagaccugaaugaagcacacuggcugccuugcccucagccacggccauggaugcucuagaagcacucccuuccauuuugaaaucugggucucccuggcagccugcuuccaugcauuuaccugacucaaacaccugcuggauaaggaucccuuccacggccccucggguuccuggaacauccccagaggccacggucacagcucucuggacagaagcugccauggucugaauuccuggagaggguuugacacaaguagacguaugugcaugagcacacggccguggggacagcaguguuggucauguugagcccaauggcagauugacaagaaucucauggugacgugggaccugcguuauucuggggcacagaguuccuaggccaucagggggugaggaccaggaagcacagguggaugguggaugguggguggguguggucaagguugggcgcagcugaggaacagggauaguuuccuugugguucuuuuucugggcuggcuagaagauugggagcauuaaaaugggcagaggucugggaggagacacccagggcauuguggguaggagaauggcaagacaguuggaucuaaggagucccuaucuuucucuggcuuugccauccagcugaggucaaugggaucagaccuccuccaaccuccacucuuggccuaacucaccguuuccaagaggaaggugcugugacuccaaguugccaucuggcuucuuagggggcuuagucuucaggugggagccugcgaaggggagguagaggcagccugggcccacuuuucugggcuggggucauguugacggauccaggguagaaagugaggaugggagagagagcagcugguaagggucagaucgacgguucuuaagcugugaugggcuguuuccuucuucaacagaaaggaaaucaaaaccaccugccugccucaccgcccagaaacucagccuuugggacaguaagacgcugagaggcugugggccuccuccaaugcucaggucugagggcucagaggugacucugugacccuggcaggcuggcccugggguggugucaguaagacagaagcuccuaagagccgguuggggagggcccagcaacccuggcuagcuccucuugaguguaccugggcuggagacgcucuuugaggccagaguugcuggugggguggcucgaggcuccuccagugcuuuucucuugguggggggucuggguggcaguaccgcggccuugggaccagcaaggggcuuucucccuuuccgggacugguuuagguccacaucugcagcucaggggcaggaacaaugguccugucuuaaagccuuaucuucagggugagcucuagaauggggcacucuugaggacgagaaagagcagaccucugcccuuugcuucuuaggaucugcccaaguucuaguggcucccugaaaacaugggccgacuuguauccauauccccgaugcuacccauuggcugagcaucagcuccagcaucaaucagcacacgcccaccuuuugggaagccguccaggaugcuaugcaggcggcuguaccgcuccagauuguaguccuuaaagagaauccuccagaaauccaggauggccccacugucccgggucaggagccaggacagcagggcguggaaggccugggggcagccuuccuucuccuucagacggagcgucuccugcagugacagcauugggcaccugggcauaucauucuccaacuccugccucuuugggauaagggagacuugccuauuccugucuaucccugggcccuggagcaguuagggggcauagggugugagguuagggaacucaccugggacuugaucuggagaggucuccugaggagggcuugggaccacuccuuggcugguagggggaggguauggguauaguauggguuuuggcugagguugggagggaacaccuagucugcggguggaggaguggggagaaugagaggcaccgggggcgggacuggagcccaccuggaacuuguccucagggaccacgucguggucggcuagagcaugcagcagcggaaaggcacugucuauggccaccgcgaucucggugcggugcagccucagcagacggcguagcauuccauccccaccugccaucuuccucacaggggcugcgccucggcgcccccugcuggcccacgcgcgcuugcguucccuucucccuuccuugggugucguggugcua

SEQ ID NO: 5593 - RNA, 7931 nt, Mus musculus
cauuggccaggcgcgaccccgccccacggcgcacguucuccugacaccacuguggcuggcugcccuucgugauggcugccgucaggguuuugguggcgccaaggcuggcuucugcgcuccuaccgcucuccagauaccaccgggcucccucccagcgcgcagcccuucacagcuccgcaccgcggcccggggccaggguggcguuggugagugcagagccagacucccaggccgagugccuucccuugcuagguccccgcagccuggggucgaccagcuguccgcccaaggucggcucuuggugggguucagccuccccucccucgguaauugcguguugggcccucgcccucgucagugccucucuuccugcaggugcugucgggcuguggagucuaugacggaaccgagauccaugaggccucagcguaaguccucagaguuuguaaacacucucuugguuuaaaaggcagaaauggccagagggugaccaagcgcaguggguucacaucgugauaaguccaaagccaaaguuagcacagccaagacacaaaagaugccacccggacccugggugaaggcagaaugccuggcagcaagcuggggucuugaacauacccaaaaugcaacaccugcggagucaacaacccucgcugcucaucagucaguaaaaggaugccuugccuacuuauucugguucuacccuuaccuugcagaagucuguaagcggcaggagccgugccuucguaaaagcaacuagguguccuauaaacuaggaauuccccagcacuuggugccaguccaucuguaaaaucgucaugcugugaggccggaggacacauuuggaagugaugucuuuguggauuuucuucauauaggauccuggugcaccugagccgaggcggggcugagguccagaucuuugcucccgaugucccucagaugcacgugauugaccacaccaagggggagccuucugagagggaaagcagguauggguagggaaaggaccuuacaagagcccuguucccaugagcagcuccuguacuguagccuuccugauuaugugaucaagugucugucccucaaagcaacugucauccggcuguucuggaaauacauggccaugggccaaauguuucugaccuccccgugaccguuacagggguagcaguagccuuugggugugagguggucaugcucugcucuggcuagucccugugugguacuguguucccuuuaucuuguugcuuuguuuuuggcagggagggguuguuuguuuuguuuuguuuucccaaaguuucucuauguagagagacuguccuggaacacacucuguagaccaggcuggcuuugaacucugauccuccugccucugccuacugagugcugggauaagaggcauacuccaccacugccucggguuuuuguuuuuguuguuuguuugagacagagucuguuuggcccucacaggccuggaacucacuauauacagaccaggguggccuuggauuccuagagauucucuugucuuugccuccaaaguguuggugggaucaaaagcaguugacucuaugcccagcacaacuacauuuuuuuauuuuaaagauuuauuuauuuguuauauauaaguaugcuguagcuaucuuuagacacaccagaagagggcaucagaccccauuauagauuguugugagccaccaugugguugcugggauuugaacucaggaccuuuggaagagcagccagugcucuuaaccacugagccaucucuccagcccacaacauuucuuaucugaggcuugguugcaggguaggggcugagacugaaaagguaagagagaggaacugcaauuuaacuaccaaggcugucuuuagggaguuccucuucugucuagaacccuggccccugaaucuaaccccucccuccuguuguacaacuguauaugagguugcaucucuaucugauguucagguggcuuugggcauccugaaaaauggcuucuuaggcagccccucccugguguggaggccuggauucugccugcuguggauacuuggugggccuccaguuccugcugaccccagccuacaaugccuguuguacuuauagcucacuagaauccacugucacugccuccagguguugccugggagugcuaacuagaagcaucuagucuccaugcucacuugaggcugugagccaguacuagggcgagcccaccgcgcugccuguguaccagccaugcuugcacguugauccuuugugccaucugcucuuuccaggaacguuuuggcagagucagcaaggauugcccgaggcaagauuaccagccuggcucagcucaaugcugcuaaccaugaugcugccauuuucccaggaggcuuuggagcugccaaaaaccugugcguguccaagaguaagggucuacaccacacauguaucugcucuuuuacaaggggugggcugggggcauuucagcgagaucaccagggcgaucuuugcuuccuccucugagccuuccagugccuggaagcugucagggugggcugaguggcuugaccuccgugcugggagucagguccccaacacgcucugcugcuuguccuugcaagugucggcucucacacagagcuguucucccucugugcugcugugaggagugacaauggcccccauaggcucaaucaaauguuugaaagcuuggucccuguuuggugacacaguuuuggaaggauuagaagguaugacaguguuggaggagaugugucacugggggugggccuugagguuucaaaagugaacuguagguccaguguguguguguguguguguguguguguaucuccccaucccuucuuccccuccgcgucccuccuugccgcccuccaucuuguggaucagauguaaguucucucagcuucugcuccaaugacaugccgcuugccugcccgcuuccaugcuucacaccauggacuaacccccugaaaccauaaaagugccuucuuauucaagucacguugaucacagugucucugcuucacaacugcguggcaucaggaaagagaaagaaagcccuuugugcuuugcuguuugagcuguugcugggggaagucgcagauacauucaaggagguccuuuccacggcucuuguugguucuuucuugagcauucaugguaccuccuucagcagggcccugccugagaggugcucacccagcugguugucagggagagccuugagcaggcucugcaauauccccaaggaauuucacugaguguccugcucccagaagagagggacacaaggcuuuaugcucugaagugucaccaguccaccuuucuugaucugaacucucugacuaguuugcagggccaucaaaaugucucuucucagauucugcacaccuccagccccuuuggguagcacccacccgcuccccauccugaaaccagcgaagccgguagugacagcccugaguccucuguggcccauccuuauaacagcauggcaugggaucgcuggauucugacuuccauugggaccccuguuuccugggcaccuaagcuguccucaccacuucugcuugccacuccugccuggugagagccacaucugucugcacagcugccuuguucacuuaggaguugggcucaggagugugagagguucuuguuguugagucuuucuggcauuuaaggagucugagccucugcacccgugucugagcccacuaaccccuguggggaagccaccaucuucauucuuucugaccuuuacagaagaaugucagguccuaguucacgggcugcugaacccacgagaccauggugcuaguuggugguggccucugucacugaaagguagcagcgcauguggcagccgguggaagagccuugguguauacacacagugaagggugacugagguuuagcagggaugagguaguggguggcuggcuuaugagccuggugucuggcaggugauggguuucacguguguaugugccagguuuccagcuggaagccgguuguuccaggcacuacggcuggccuuguguaucugcuagagaagcccuacguaugugcaucaccgccagcauccuguuggugcuuugccugauguauugaucugugcuuuccagcugacuugagaacuguucggcaguggcguagacuccacauggcgaacagggcgcuacgagucaugccacuugccagucugguggcucaggugaccuguagccuugcuugucaccuguuuuuaacagugucagagagaaagagacagggagagauugauuaaagggugaaaggauuuggcgagucuggcugacagaagucagcaccugauggugaaccugguccuucagugccagaccuccaggccguagcacaagagggcccggaagcugcguucugacagaaaggcgcugggcucugccagguugcauucucuaaggauagguaaugucccaccuccucagcugcccuuggccuucacccucccaggaagaaaagggagacuaggcagacacucggcgugcuagcggcugcuacucucuucagcuaacuguguuucuuuuucuagagcucccucuuugagguuuuguuuuuguuuugaugucccuggauucugaaggcagagugcagucacaaaucggccccccuccucuugccuuccacccugcuggcuggcuggcuggcuggcuggcuggugaauuggaagcuagagaagccauuaggcauucagugugauagcaagcuguucaccuggccuguggccacacugggcagcuccucagguaugcggugggccacucagauuguggggacacuugaugagggcagccucuccucucgcggcaggagcacauucgccguggacggaaaggacugcaagguuaacaaggagguagagcggguccugaaggaguuccacggggccaagaagcccauuggguaggugccgcgccggguucaaaaggagggcaggaaucugugggagucccugacagacucugcuggcucucagugucaucaccagcgcuggagcccaguaagaccagcagcagccugugaggacuggugguuugggaacguguguggcggcugcaguggggugggauuggccccugggucagagcuagaacaucaggcacagcugcccaccuccugugggucagggcagcucccuuuuuucuguugcuuuugagucuuacuguguagcuuugacuggccugguacuugcuauacagaccaggccuugaacucagagauccauccacauccugagugcagggauuaucaccugugccaccaugcccaaccagggcagcucacuccuaagggucgugguacagaucacaggucaugcagggcuguuucuugcacucugaggacuuguaccuggacacuguagagccgugguucucacccuuccuaaugcuacgaccuuuuaauacaguucuucauguuguggugaccccagccuuaaaauuauuucacugcuaccacauaacuguaauuuugcugcuguuaggaaucguuauguaaauauuugauaugcaggauagcugauuugcuacauuugugaaaggguuguucaacacacacccccaaggacucgugacacagauugagaaccgcugcucugaacaguggacagcagguggcaguguagaguuuggcuucccaggcccuucaucuuccccuuagccaucucugcccagaacuacucaaguccugaugcccagugccauaaaucugaagcaagacucucaaaccucaccgucuggggacuagaccauucucaguccucccucagugugcucccuaugcucacacacacaguccuccuucagugugugcugugcucacacacucaaguccucccucucagugugcucccugugcucacacacucaaguccucccucucagugugcucccugugcucacacugaguccucccucucaguguguucucuaugcucacacucauuccucccucuccaugugugcccugugcucauacacacaguccuccccuccucggugugcacccuguguucacacacucaguccucccccucagugugcucccuguguucacacacacaguccucccccucagugugcacccuguguucacacacucauuccucccccucagugugcucccugcacucacucaguccucccucucaaugugcgcugugcucacacaacuccucugacuuuucagcuuaugcugcaucgcuccuguccucgcagccaaagugaucaaagguguggaggucaccguaggccaugagcaagaggagggcggcaaguggccuuaugcuggaacugcggaagccaucaaagcccugggugccaagcacugugugaagggugugaccauauccuuucugguagcuggguggugcgguugguaucagauagcacauuaggcuugcccuucauuugguccucgaggguacggugacaggcagccaucccuacaagaguuacuucaagggaaccccugggcaggagaacagggccagccagugccauggggcguggcuagcucauaugccacaggcaggcuucucacuuggcugaggaggauccguguuccugcacccacugagaccugucagcccugaaucagccuggagcacacagcuggacaccugagccccacaggcuagagaaggacucuguagccuagaagacuaggagcugcuugcuggugaccauagaacggagcuagagcagugugggugggcagaucuccugguucuaguggccccucagcuaagguggcuggcuaagguguuuuacaccccuauguggggccagcaugcaagcugucauccaucgggcacuguuccacccccagaccaguuucuuccuccugaugaguaccugugagucagaagcuagcuccuccuaaagccagugccgacuuguuggcgugacaucaucgagcagcaggggacuggcaggaccaaggguggacgggcggguggggcucuucccgugcgaugcccaugggcccgccaagugcuagauuuucccuaacgucuacucacgaagcucauguagaccagaaaaacaagguggucaccaccccagccuucaugugugagaccgcacuccaccacauccacgacgggaucggggccaugguaaagaaugugcuggaacucacgggaaaguaaugccacccggaccacgcuuggccuccgugacuguggcauccccagccggcgugugcuccauggcuucagcccggacacaggagccgcuuagcuacuaggagcauagacacuuccugccugaaggaggagcuuagccucuguauguccagccugagcuucuaccagcaggaagcucagggacccucccugggcccugagcagcagcaggagcuucaugggguggggagggagggagcgggcuugccucacugcguguccccauggaagaucuaagcaccuuucccagagccugguugaaggacuuagguucuccgauccugggucugauaggucaggguacuaaagcuuuaaaagaagaaaccaguuuagguucuaagucgucugauaaccagaggugccuaguuuguggauaaagaaaagcucucugauccagaguaaagacagcuaacuaaagccacggggauucuguaguaggucccuguagccacagaauaaacucuuccgcacgauggaaacuccuuucagcuaugucucaggccuugugaaacuagugaacgguacccagugacaugaguugucagugagucucggcucugagucgucaggaaaagggagaaaucaccgauugugggucccuggaagggccugcuggcugggucugggaaguugccccaggcugugagauuguauaaccuggguaaagaaggaaaguagaagaca

SEQ ID NO: 5594 - RNA, 494 nt, Mus musculus
uggacgugaggcgacaagauggcggacaaagagaaaaagaagaaagaaagcaucuuggaccucuccaaguacaucgauaagaccauucgggugaaguuccaggguggccgggaagccagcgguauccugaagggcuuugacccacugcucaaccuggugcuggaugggaccauggaguacaugagagacccugaugaccaguacaagcugacggaggacacucggcagcuggggcuugucguaugucguggcaccucgguggugcucaucugcccacaggacggcauggaggccauccccaaccccuucgugcagcagcaggacacuuagcagcaaaggagagcgguccagccccagggaucuuccuucuauggggugaacuucugugugauguuuuggucuuuuguucuuguuuuguuuuguuuuguuuuuuaauaaaauugcccaugugagcaaaaaaaaaaaaaaaaaaaaaaaaaaaaaaaaaaaaagau

SEQ ID NO: 5595 - RNA, 12684 nt, Mus musculus
uccaaaaaugggagaagcagccaugugcuguaaggacccgcaguuuauuugugggcagccaaggguggaggggacagugaccacacaguuacuugguuuuguuuuccugacuaugguggagggaagcugagacagggauuuacucugcaacccaggcuggacucagucuccagaucuucuggccucucuggcuaggaucaggcacagccauagcauauguacaagugaaauguugaguguuuuucugagaugcaggucauggcucugaggcaggaucaugcuuaaaggcugggacuaaaccaagaguuucuuccguccuccuccugcuccuccccuauaggacggacgcucagaaccucggcauucagaggcugcaggagcaugcccagguauccugccccauuccaccaugugccagccugggcugugcaccucacucugcacucugugaugacuguauccucuucuuggguugcugggccccagcccccuuugcccuagccccgggcuuccuccucuucccaggaggacccccuuggccagccuucucauccguuuuccuguuccucuuccucuuccuuccugggccugggucugcacuugaggauucugccucacuccccgcuguggacaaaguaaggcuugugagcaaacuccugggacaauaugguguccuucagucacggcagugccagcacuggggacagcaccagcuauggcugcugaccagggugagcuucauccugggucccaggaugaucccagggagggcucaggaacugaucuccagaaagacuagccagaggacagggugaagggcccagacauggagcagggugugaagacagugcaggaagagagguagagauggcuaucugacaagagggccaggggccguacccccaggaccagcaaacauuaacucaaccugcugugucagagcugaaagacggugucugggcugaggcuggggccaugccaagggcaggcuggugagaagauacugcccagcugggaccaauauguaugggccucaguguggagauagcugggccagagacagggugaaugcagugaccuuuggcagggcagauggcagauccuagguuagcauaugaccagguuaaccccugaaaagacugucagcucaggcagggccaccaacaaugcacagcaagcccuggacagucuuuagcaagagugucacaggcuagcacauacacagcaggaaggcagggcuagaaaccugaaaccaacaguuacaugggaagaggcucaggaccacuaaggagacgaggcagacgaggcucugaucaaagauggcaagacagucaaagagagcacaggcaccaagggcugagggugguccccaggccaggugcacugugggggucugugcaugaagggaagccuuaagcauaggcaggacaggcaggggagacaagggaggugagccagcccauguguuaaucaucacccaggauccuaccuuccuuauucuggggcugagguuugggcaagcgcuucuuuuucuucuuccguucccgccucccuuccagcaucuucuuguaggcuuuuucagggacaucauccucugggaaagugccugagaaccaggguggcagucagggugcugaggggauaggucagcuccauucugugucacgguccccacagacccagcucagggccagggaaauauggaggccaccugaggcacaugugcuaugccacugucuauuccagccggacaguacaggcuaaugcugggagugcacgaagcuacacaugcgcaguggggccuccugggcgcugguaaaacccaucacaugcacaacacacaaacacagugugagcuucaccuccaaauaccagacaugaguucauggccucaggaagcaccccucagugaccucagaggaacagugagugcuguggagccuuugagccuaacccuucccccaccgagacacaggucgcugcagacauuucgcaugcucugcgcaugugcgcaaaugcacauguguauuggagggaccaccucagugcccaccagauccucaccuccagccagcucccgcagccugaaagagaagacagacaacaucagcacucagcuagucuaguccucacgggggaccagcuccugacuccccuugcucaggccaccucacaggacaacacacaugagaggcagugacugcugugaggaggcagcagggggaggcgagacaggccuccugacucacuuuuggaucacuuuguagaggcgcuuccuguucugagaaggggugcucugucuacuggcgagcuugaacagccuguuagcaagugccucguagucaaacuguuucaaaagaugugagaaauacaagauucaguucauguccacaugaccaaacacaaaaccccaccucccugggcugaggagacacauggccaucacaggcauucucugcuuggccacggaaacggacucaucucgcucagcaucugccagcaaagccugcagacagagacuacaacccagcaggcaccaccccugccugccccaaggaagcagcagacuucagaaggcagccugcucuccaacuucauuucuuuuugaggcagggacuuacuguguggcuggcauagagcucacuacuaaagugcagagauuaaagucccucugauuuuaacucccaacuagccagagcagacagguaggaagaaaccaaaugaaaagagaucaacacauccuauauaaccaaaauacucaaaccuacucaugugacaggcugucagcauugaagccuuacugacauccgcugaccgccccgauccaccugacccguccucugagcugacucagagcuaugacccaaaugcagaucacuaagucugugcuacccuguucgaggccagcaccccaacaauagaggcagaccuaggggugcaggcuaccugcuuaaagcaugaggaaugccacaggagggcagcaggagcccuacaucagucucucagcagugagcaggaguuacccauccuucccugaaagccagccuccaggaaggcugucugcucaucuccguugcucuccuucccccggcaguggggcuggaagguaaaggcuaaccguguggccuagacauggaugccuaccuggaggacagggccagcguucuccucgucaucccacgccuguuccuugucugccucagggccagcccuaugugcggugccuaaaaacaaauacggaaccugagcucaagguaccaugccuaguguaggggcaccccaauaccaacaccaagcacugaggacccucuuggucgugcacugacacaggcuggggaggggacaaggagcugggcucauggggaguguagagaugaggaaaggcaucccaggggaaggguguaggucagugggcaccuugggcagcaaaggcagacugcaguuaucccagcaguggguuaggccagggaccacuggagcaaugcuuggcuuagcuuggaacacugagcugagcugugugcucagaacugugccagcagugccuuccugguguggagcagaguuaaaacggggccuuguuauguuagcucuaguggucugguucucccuucacagcccaggauagcccugaacgugggcaauccuccugccucagccucccaagugcuacgguauaggugugugcccccacaggccacucagcauaguuguaagugaaggcuuguggacaacagugcugugggacacuuuggcaaggacaacggcugcaggaugguuugcugugcagaguggcugaugagccaugagcaggcaucaaggggucuccucugagaaacucuuaggaugucugggcuaccaagaaagagaaguuaagagaaagacaggcaagacacacaggaugccaggcagugugccugcugacccacaagaagggggccacuaaagcuggcaccaaagcugaaagaagacccucacugagacuccaugaccacagcaucaagacaaagaaagccaagcuaggcccacugcaaccagacaccuggcccaaacccagagccagugagaggccauuuacaaggagagcgugcagcacauucauuugcccuugcuacacugugggcagaugccgacugucuggcgggcaggggcauggcagggcagggcugaggggcacagaggaaaggugacugauggaaguggaggguccaggagaagggguagggaaaggcuugggugugacgcaagguuagagcaguuccuagugccuacggccagaguuccguccccaacaccaccaaaaccacaagcaaaccaggaugcaggcuccucugugaacagggaggucaggguaccacacaggacccagggagcacuagaaccuuagguaggagcauucuagggaccgagcuggaagcugggagccaggaaucaagugcugagaccgacuuaggagagcaaaccaaauguccuucaugcaugcaacacggugcucuccagagaacagcccagagacagcugcaacaauccagcaagagccuaggauaggacaggcuggggcccucaccugcaggcagcuucuuggguggugugucuugcagauccugcucacccucugaggacuuguuacugucaccuucaucauugucaccaccgucaccgucugacacgucaccaucaucaucgucugccccaucacuaucaucacugucugccacaucaccaucaccaccaucugacgcuucaccaucaucaucgucugaugcuucuccaucaucaccaucugaugcuucaccaucaucaccaucugaugcuucacccucuccacucuguguguccaguucauucaugaugucuucuauggccaagggagccugcuccacaaucgucugaaagaugcucugaaugaucuuaugcaaaaccugggaacugagggugaagcagaggccagagaccucauuaguaugggcucucagauaccacacuacccucacagcaugggagggaggccaguggccacugcagccugagaggaaggggaaccgcccaccacuuacuccuuagugcgggcugcuaucuggcagaaggggucgaugaacugcagauucuggucugcggugagcuguggggaaaccaagagaugggaaguguguuuaaaugccggacacaugcaccguacgccacagcccucacccgagcccaccucaccucugcagcgcccacuuuggccagcuccuccagaaagaucucuaggaaguggcucuucaccccacugggggccuggcugucgggguucaggaucucggugguuagcagcucuagcagcugcucaaucugucugaagagagagaaagaaagaagagugugagccgggcgugguggcgcacaccuuuaaucccagcacuccggaggcagaggcagguggauuucugaguucgaggccagccuggucuacaaagugaguuccaggacagccagagcuauacagagaaacccugucucgaaaaaccaaaaaaaaaaaaaaaaaaaaaaaaaaaacccaaaaaaacaaaaaaaaaaaaaaaaagaaagaagagugugguugccauggggucgcaggucugcggugccccacgaucuccacauggguucuggcaggcacacaacacacgugcaggcagguacggucaucuaggaacacaccugaccuuucccacccauaugcagagacccaggcagcucuggguuugaggagcacaagggaguccugcuggcucaggucugugugacaugugacacuggagugacacauguggcucuuggccacaaauauaccacugaauauacuagaauacucauaggccuuuuguaucuucaagacacauguggaaauauggccagugaggugcucugcugcccgacccucacuacuuagaaaagguaucagaucaggacagaccagaggcaaagaggaaguuauaccaacaagggcugggggccacaggcccccggccguaugcugauugguuggcagcaugaggaagcuaugcagcuguggcccucucaggcacacagguuacacugucucggagcccuggaccuaguagcagaggacaaggaacccucagcacucggugcacaugagacuccuaaucggaugacaguguagucuuagugccaccuggagcuguggcaugugcugccuaaggaacuccuggacggcuccagcaaacggucaccaaccccagaaaggaaacgcgauacuuuaccaggcucaggggggaaggaagcaaacagcaagaugaggcauaaaacccagcgagagaccagaguuaggugagcuccagaugacacuacugcguguggcaaacaccgggaacgccugagccaggcuguaccacaucagacaaacacaccgaauguuuugucuuccaaggccagggagggauaagggccccucagcacuguuaccacuaggaaguugcaacagaaaaucaaagaacacuaaccaaauuaaaaaugucaccauaaauucuguuaagucacuagcaaccuacaauggagcccugaaaugacuaagagagacgggucucaaaguccucaacagugauuaaaaaagaaguugcucaaaaccacaggcaagagagcccugaagcaggaaagcucagaccaccacagcccagcaugcguucauucucugaguggaggcagggguggcgugcgugugugugcgugugaugucugaucuugccuggugccccaaggccagcucucugucagcauugcugacaucuugcaaucacauguaaaguuuuugucuaggccuuuccccucuugcugccaucacccaagcaaaacaaaagaaaaagaaaaaaaaaaaucccuguguggugccauguagaugcaccauguagacacacacgccugcacugcucugcgggaucuccaaaucaaccaccguugggguuaaucuuacuccucugggcaaugggcguggugggccacaccuuuaaucccagcacucaggaggcagaagcagaccucuaugagcucaaggccagccuggucuacacaguaaguuacaggccaacuagggcuauggagagagacaccaucucaaaaaaacaaaagaaaacaaaaaacaaaaacaaaaaaaugcagugguugaugguaccuagaguuagaaacaaaguugaaacauuuauuacuucaaaaaauguuacaugaaaaccuucagaaacccacuuugugcuguaggacucuggcugccacaaggcuuggaaccugcugcccaagcuuagacaagugagcaggcagcaccuaggggguuagcucucuaccugggugucccagaggccaggaguagaagcagaaccccagggcaguggaagcugcagccacagaagucaaggugagauaggaacacagccaaccauugcuuggaggacaugggccagcccaccuaagcacuguggucaaaagcaaagggccagaugaacaauggccacauggcagcacaugguacaccauacaccuguuaaaauggaggccuuugaggggacuggagagauggcucagagguuaagagcacugacuguucuuucagagguccugaguucaauucccagcaacuacaugguggcucauaaccaucuguaaugggaucugaugcccucuucuggugugucugaagacagcuauaguguacucauauacauaauagauaaauaaauuauauaaauaaaaauaaaauaaauaaaaaauaauuauaaauaaauaaauacuaaauaaaaaguaggccuuuggcaguacacguguugggagcagagcacacgauucugcccgacuauagaaaacugggauagcacaguuggaggagacagcaucaucugaaccauuucacuucauaaacuuaucuuaauucagcaccacugugguaccaagugaugcacaggucaccugccuacaacaaggcaucacaagaggaccuugggauuccuggggugagccagaagauggaggucccagcccucagcugccugggagcugggagucugacucucagggcggaccuaccucucgucccauccccgggcuuucacagccuucagugacucacuuaggaccauccucaugagcuaggacacaaaagaaacgcacguuaguaagaagacagccaacccaucgagccucccugugucccagaagccuccugaagguaaggccucugucugucccacggggcgugauugaggccuuggagaucaaagcucuguacuuggcugagugagcagaaacuacagauuagagcugauuggaauggucagggcaggcgcugggcucuuccugaagaaggcagacuuacuacaaagccaagguugcagcugggccucacaauuuuugagaaaaaaaaauucucucaaaaaaggaaaugggccuuguaaagcaauucauuggccgagaggagcacgacacaggagaagaaagcaagcaggagacacaaugcagacagagggccaaggaccaaguccucagccagaagggaucuucacagaugggggugaucaaguccccuuucugccuugugcuaggcccagggcucacugguggucagaauggcuuuacuuccucugggagagcugaggcaaggcuccugcuuugaauucuuacuggcccuuaagaugggggcacuccaagcucuagcagcucugcagccaaguauauugcaaaccaggccuggcuuuguauauugacccagggcuuguggaucaccugcuuuggugccacacugucucaccauguagaacuuauccaggcgcagucugucaaugcccacccacucccggaucauggucugccagaaggccuucaggaacuggugcucuagggcagagagagaggacacacacaucaaucaacaccagagccauggggaaggggagggagggacagcacaaacccacagaacucccucauucauucacagggcucagaggugaggguuuccaggcuccacaggggguaaaaaaaacccacaaaacacacucaaucaagcugacucucuguucucugaacaaaacgcacaaagaaggagggaguacugggaaaggagugauuacuggggacacauccucccuaggccucuuugucccugccuuggcuuggaccaaagcccuccugacacccaagcuagaccuucagcagaacugcauuccugaagcagaacuguaggcagauaccuggcgcuugcccaacuagauccaugaacccugcagggaacagaugagucagauauaggaugcagagucuaacugugccgccaaaaccucauagagaagcucuaaacccucggcacuucacaauguaccaggggugaacggaggggccguguucaggguacuaaagcaggucgugaggguggacccaccuacucagagucaaccagagaaggcgccauccacaaggcaggaggaaccagcccugggaagccuugguacugggacaaaaggaaggcaaauccucuucucugcaaaauucuacgccagcaaagggcuguuuguauggcucaggccugguggccuggucaccagguuaccaaguggucacuucagcuuugacucagcaaagcugccgguccuuagagagcagggaguucagaucuacugccucuucuacacucaguucaagagagauccugaagccaugauacacauccgagaugccagggcccagggaaguaggaggaggaaguucccaaguucgagaccagccugagcgacacaguaagaaccugucuccaaaaagaggggugggaggagggagucuccugaacugaggcgugcacgcaucccucaacuugccagcuucagucgaauaaagcuaaagcccagcucgccgaggacaggagcaggcacaagcauccggcuucucugucaggacugcccucaaagccucagacaugcuaugccccagggcuaggcuggccugaggcagggucuggaucucaggauguuuaaaggcugccuaagugauuccaucagguagguuggaugagggauaggaaugggaaacacgggauuuagcaauuuagccucggcgauucucaaucugugagaccucccacuuuggagguccaaugccucuuccacaugggucaccuaggaccauuggaaaacacagauauuuacauuacaguucauaacaguagcaaaauuacaguuacaaaguagcaaugaaaagaacuuaacgguugggggcggggguggggugggggguguguguguauccugacaggaggaacuguuuuagaggguagcagcauuaggaggcuugaaaaccucuguacuuaagagaaagggugucacugucaucagcuaaacaccacggggaucaugacaccggcugucauaugccauaccacugccuuucacucuuuagccaugucuguuugguaaacugagggaggcugguugggcacugggcuguguuccacgccacgagcauccacacagccaccucccugcagccugcgugagguuugagagcacacuguugcauuggucccucuggaucucagcgacucuggugucggcaggguccggccgggccuggcuuccgccggguacucacgugccuccgucgugugaaaagcauggacaagcugggcaaugguccuuccuaguucuuccugugagggaaacaggaagcacacgcucaggccccgaagcacaguggcucugacggccaacacuaccaaugcccucucacuucaaaggaccagcugccaguuggccuugguuccuugcuugcaaaagaccuacuauggggcuggagagauggguuagugguuaagagcaccaauagcucuuccaaagguccugaguucaaaucccagcaaccacauggaaaaaaaaaaaagaccuacuaugcaggaaacaucacuuucucuauaaacagcaggagucagugcuggcuauguuaaggggugggguggaggauuaaacauaagccccucagucccccaccaacuccugugaggguucuucagcuaccuucccaggcacccaccugcuggaggggcuuguccugcauccacaugcaguaaaacaguccuuuccauacuuuuagcaguucaucuggagugaaaccaccugcaucacaagagcaacagugagacuuagugagcccuggaaccuaccuucccgagccaggaaggaaacaugacugccugaacuacucuuaacaauaauacgacugggggcuggcgagauggcucagcggguaagagcacugacugcucuuccaaagguccugaguucaaaucccagcaaccacacgguagguuacaaccauccuaaugagaucugaugcccucuucuagggugucugaaaacagcuacaguguacuuauuuauaauaauaaauaaaucuuugggccagacggaacagggacugagcgagcugggcugaccucagugaguggggccaacuggaacgagcagagguccuaaauucaauucccaacaaccacaugaaggcucacaaccaucuguacagcuagcuacaguguacucauauacauuaaauaaauaaauaaaccuuaaaaaaauaugauugggcagccagccccgcccucaaaacauucuccaacagaacugccauaacggugccuggaggagccccuccccccaacccuccaguaacuccaugcaccagcaagcagguaucagucccauagaguuaaagaaacccaacacuuucgggaccgggagauggcccauuguuaaugcagugauuaauuaagccagugucagaccaaggaacuguagcuauacuaugacauuucggagauuaaauggugaaaguuauucauuccggcuagcaaaggacaucaccaccauuuagcgaggcgcaucccccaaguuggggugcucugacuagagcgugaaaaacugcgcugagacacuucccaaagcauacagccaugaccucggccaaaccaccgcucagggaaucuauaauuugcauccgcggagggauauccaaaagcaaaggacaucgccaccauuuggcgaagcgcauuccccaagcugggguucucugacuagagcguggaaaacugccuugagacacuucccaaagcauacagccgugaccucggccaaaccacugcucagggaaucuauaauuugcaucugcggagggauauccaagagacgcggaggcugcugaaaggggucgcucacugaggaccagaagcacagaaaccgcucugcaaaaggacauccugggaacggggugucgagaacacaccuuuaagaacacgggacaccaguaaaggccggcggaagagcaccagcaagcuacagaaggaagaaaagcgggcagaccgaucgggucagccuaagccaguagaacagcagacgaaggccggauccugcggggcccacgcagcggagcucgccugcccucccgcccgcguaccugucgcccgcugcgaccuggccucgauguacuuccgcagcuuccgcaacgcgcggucccgcgucaccuguucauugcccgccaggcgcugcgccagcuggaucuccggcgggagcggcacuccgggaaccauggugaggagaacccugagaccacgcacucgacgcuuccgcuggggcgcucgagugacgacacgcgcucgucaccacugaacgucacacugag

SEQ ID NO: 5596 - RNA, 12684 nt, Mus musculus
cucagugugacguucaguggugacgagcgcgugucgucacucgagcgccccagcggaagcgucgagugcguggucucaggguucuccucaccaugguucccggagugccgcucccgccggagauccagcuggcgcagcgccuggcgggcaaugaacaggugacgcgggaccgcgcguugcggaagcugcggaaguacaucgaggccaggucgcagcgggcgacagguacgcgggcgggagggcaggcgagcuccgcugcgugggccccgcaggauccggccuucgucugcuguucuacuggcuuaggcugacccgaucggucugcccgcuuuucuuccuucuguagcuugcuggugcucuuccgccggccuuuacuggugucccguguucuuaaagguguguucucgacaccccguucccaggauguccuuuugcagagcgguuucugugcuucugguccucagugagcgaccccuuucagcagccuccgcgucucuuggauaucccuccgcagaugcaaauuauagauucccugagcagugguuuggccgaggucacggcuguaugcuuugggaagugucucaaggcaguuuuccacgcucuagucagagaaccccagcuuggggaaugcgcuucgccaaaugguggcgauguccuuugcuuuuggauaucccuccgcggaugcaaauuauagauucccugagcggugguuuggccgaggucauggcuguaugcuuugggaagugucucagcgcaguuuuucacgcucuagucagagcaccccaacuugggggaugcgccucgcuaaaugguggugauguccuuugcuagccggaaugaauaacuuucaccauuuaaucuccgaaaugucauaguauagcuacaguuccuuggucugacacuggcuuaauuaaucacugcauuaacaaugggccaucucccggucccgaaaguguuggguuucuuuaacucuaugggacugauaccugcuugcuggugcauggaguuacuggaggguuggggggaggggcuccuccaggcaccguuauggcaguucuguuggagaauguuuugagggcggggcuggcugcccaaucauauuuuuuuaagguuuauuuauuuauuuaauguauaugaguacacuguagcuagcuguacagaugguugugagccuucaugugguuguugggaauugaauuuaggaccucugcucguuccaguuggccccacucacugaggucagcccagcucgcucagucccuguuccgucuggcccaaagauuuauuuauuauuauaaauaaguacacuguagcuguuuucagacacccuagaagagggcaucagaucucauuaggaugguuguaaccuaccgugugguugcugggauuugaacucaggaccuuuggaagagcagucagugcucuuacccgcugagccaucucgccagcccccagucguauuauuguuaagaguaguucaggcagucauguuuccuuccuggcucgggaagguagguuccagggcucacuaagucucacuguugcucuugugaugcaggugguuucacuccagaugaacugcuaaaaguauggaaaggacuguuuuacugcauguggaugcaggacaagccccuccagcaggugggugccugggaagguagcugaagaacccucacaggaguuggugggggacugaggggcuuauguuuaauccuccaccccaccccuuaacauagccagcacugacuccugcuguuuauagagaaagugauguuuccugcauaguaggucuuuuuuuuuuuuccaugugguugcugggauuugaacucaggaccuuuggaagagcuauuggugcucuuaaccacuaacccaucucuccagccccauaguaggucuuuugcaagcaaggaaccaaggccaacuggcagcugguccuuugaagugagagggcauugguaguguuggccgucagagccacugugcuucggggccugagcgugugcuuccuguuucccucacaggaagaacuaggaaggaccauugcccagcuuguccaugcuuuucacacgacggaggcacgugaguacccggcggaagccaggcccggccggacccugccgacaccagagucgcugagauccagagggaccaaugcaacagugugcucucaaaccucacgcaggcugcagggagguggcuguguggaugcucguggcguggaacacagcccagugcccaaccagccucccucaguuuaccaaacagacauggcuaaagagugaaaggcagugguauggcauaugacagccggugucaugauccccgugguguuuagcugaugacagugacacccuuucucuuaaguacagagguuuucaagccuccuaaugcugcuacccucuaaaacaguuccuccugucaggauacacacacaccccccaccccacccccgcccccaaccguuaaguucuuuucauugcuacuuuguaacuguaauuuugcuacuguuaugaacuguaauguaaauaucuguguuuuccaaugguccuaggugacccauguggaagaggcauuggaccuccaaagugggaggucucacagauugagaaucgccgaggcuaaauugcuaaaucccguguuucccauuccuaucccucauccaaccuaccugauggaaucacuuaggcagccuuuaaacauccugagauccagacccugccucaggccagccuagcccuggggcauagcaugucugaggcuuugagggcaguccugacagagaagccggaugcuugugccugcuccuguccucggcgagcugggcuuuagcuuuauucgacugaagcuggcaaguugagggaugcgugcacgccucaguucaggagacucccuccucccaccccucuuuuuggagacagguucuuacugugucgcucaggcuggucucgaacuugggaacuuccuccuccuacuucccugggcccuggcaucucggauguguaucauggcuucaggaucucucuugaacugaguguagaagaggcaguagaucugaacucccugcucucuaaggaccggcagcuuugcugagucaaagcugaagugaccacuugguaaccuggugaccaggccaccaggccugagccauacaaacagcccuuugcuggcguagaauuuugcagagaagaggauuugccuuccuuuugucccaguaccaaggcuucccagggcugguuccuccugccuuguggauggcgccuucucugguugacucugaguagguggguccacccucacgaccugcuuuaguacccugaacacggccccuccguucaccccugguacauugugaagugccgaggguuuagagcuucucuaugagguuuuggcggcacaguuagacucugcauccuauaucugacucaucuguucccugcaggguucauggaucuaguugggcaagcgccagguaucugccuacaguucugcuucaggaaugcaguucugcugaaggucuagcuugggugucaggagggcuuugguccaagccaaggcagggacaaagaggccuagggaggauguguccccaguaaucacuccuuucccaguacucccuccuucuuugugcguuuuguucagagaacagagagucagcuugauugaguguguuuuguggguuuuuuuuacccccuguggagccuggaaacccucaccucugagcccugugaaugaaugagggaguucuguggguuugugcugucccucccuccccuuccccauggcucugguguugauugauguguguguccucucucucugcccuagagcaccaguuccugaaggccuucuggcagaccaugauccgggagugggugggcauugacagacugcgccuggauaaguucuacauggugagacaguguggcaccaaagcaggugauccacaagcccugggucaauauacaaagccaggccugguuugcaauauacuuggcugcagagcugcuagagcuuggagugcccccaucuuaagggccaguaagaauucaaagcaggagccuugccucagcucucccagaggaaguaaagccauucugaccaccagugagcccugggccuagcacaaggcagaaaggggacuugaucacccccaucugugaagaucccuucuggcugaggacuugguccuuggcccucugucugcauugugucuccugcuugcuuucuucuccugugucgugcuccucucggccaaugaauugcuuuacaaggcccauuuccuuuuuugagagaauuuuuuuuucucaaaaauugugaggcccagcugcaaccuuggcuuuguaguaagucugccuucuucaggaagagcccagcgccugcccugaccauuccaaucagcucuaaucuguaguuucugcucacucagccaaguacagagcuuugaucuccaaggccucaaucacgccccgugggacagacagaggccuuaccuucaggaggcuucugggacacagggaggcucgauggguuggcugucuucuuacuaacgugcguuucuuuuguguccuagcucaugaggaugguccuaagugagucacugaaggcugugaaagcccggggaugggacgagagguagguccgcccugagagucagacucccagcucccaggcagcugagggcugggaccuccaucuucuggcucaccccaggaaucccaagguccucuugugaugccuuguuguaggcaggugaccugugcaucacuugguaccacaguggugcugaauuaagauaaguuuaugaagugaaaugguucagaugaugcugucuccuccaacugugcuaucccaguuuucuauagucgggcagaaucgugugcucugcucccaacacguguacugccaaaggccuacuuuuuauuuaguauuuauuuauuuauaauuauuuuuuauuuauuuuauuuuuauuuauauaauuuauuuaucuauuauguauaugaguacacuauagcugucuucagacacaccagaagagggcaucagaucccauuacagaugguuaugagccaccauguaguugcugggaauugaacucaggaccucugaaagaacagucagugcucuuaaccucugagccaucucuccaguccccucaaaggccuccauuuuaacagguguaugguguaccaugugcugccauguggccauuguucaucuggcccuuugcuuuugaccacagugcuuaggugggcuggcccauguccuccaagcaaugguuggcuguguuccuaucucaccuugacuucuguggcugcagcuuccacugcccugggguucugcuucuacuccuggccucugggacacccagguagagagcuaacccccuaggugcugccugcucacuugucuaagcuugggcagcagguuccaagccuuguggcagccagaguccuacagcacaaaguggguuucugaagguuuucauguaacauuuuuugaaguaauaaauguuucaacuuuguuucuaacucuagguaccaucaaccacugcauuuuuuuguuuuuguuuuuuguuuucuuuuguuuuuuugagauggugucucucuccauagcccuaguuggccuguaacuuacuguguagaccaggcuggccuugagcucauagaggucugcuucugccuccugagugcugggauuaaagguguggcccaccacgcccauugcccagaggaguaagauuaaccccaacggugguugauuuggagaucccgcagagcagugcaggcgugugugucuacauggugcaucuacauggcaccacacagggauuuuuuuuuuucuuuuucuuuuguuuugcuugggugauggcagcaagaggggaaaggccuagacaaaaacuuuacaugugauugcaagaugucagcaaugcugacagagagcuggccuuggggcaccaggcaagaucagacaucacacgcacacacacgcacgccaccccugccuccacucagagaaugaacgcaugcugggcugugguggucugagcuuuccugcuucagggcucucuugccugugguuuugagcaacuucuuuuuuaaucacuguugaggacuuugagacccgucucucuuagucauuucagggcuccauuguagguugcuagugacuuaacagaauuuauggugacauuuuuaauuugguuaguguucuuugauuuucuguugcaacuuccuagugguaacagugcugaggggcccuuaucccucccuggccuuggaagacaaaacauucgguguguuugucugaugugguacagccuggcucaggcguucccgguguuugccacacgcaguagugucaucuggagcucaccuaacucuggucucucgcuggguuuuaugccucaucuugcuguuugcuuccuuccccccugagccugguaaaguaucgcguuuccuuucugggguuggugaccguuugcuggagccguccaggaguuccuuaggcagcacaugccacagcuccagguggcacuaagacuacacugucauccgauuaggagucucaugugcaccgagugcugaggguuccuuguccucugcuacuagguccagggcuccgagacaguguaaccugugugccugagagggccacagcugcauagcuuccucaugcugccaaccaaucagcauacggccgggggccuguggcccccagcccuuguugguauaacuuccucuuugccucuggucuguccugaucugauaccuuuucuaaguagugagggucgggcagcagagcaccucacuggccauauuuccacaugugucuugaagauacaaaaggccuaugaguauucuaguauauucagugguauauuuguggccaagagccacaugugucacuccagugucacaugucacacagaccugagccagcaggacucccuugugcuccucaaacccagagcugccugggucucugcauaugggugggaaaggucagguguguuccuagaugaccguaccugccugcacguguguugugugccugccagaacccauguggagaucguggggcaccgcagaccugcgaccccauggcaaccacacucuucuuucuuuuuuuuuuuuuuuuuguuuuuuuggguuuuuuuuuuuuuuuuuuuuuuuuuuuugguuuuucgagacaggguuucucuguauagcucuggcuguccuggaacucacuuuguagaccaggcuggccucgaacucagaaauccaccugccucugccuccggagugcugggauuaaaggugugcgccaccacgcccggcucacacucuucuuucuuucucucucuucagacagauugagcagcugcuagagcugcuaaccaccgagauccugaaccccgacagccaggcccccaguggggugaagagccacuuccuagagaucuuucuggaggagcuggccaaagugggcgcugcagaggugaggugggcucgggugagggcuguggcguacggugcauguguccggcauuuaaacacacuucccaucucuugguuuccccacagcucaccgcagaccagaaucugcaguucaucgaccccuucugccagauagcagcccgcacuaaggaguaaguggugggcgguuccccuuccucucaggcugcaguggccacuggccucccucccaugcugugaggguagugugguaucugagagcccauacuaaugaggucucuggccucugcuucacccucaguucccagguuuugcauaagaucauucagagcaucuuucagacgauuguggagcaggcucccuuggccauagaagacaucaugaaugaacuggacacacagaguggagagggugaagcaucagauggugaugauggugaagcaucagauggugaugauggagaagcaucagacgaugaugauggugaagcgucagaugguggugauggugauguggcagacagugaugauagugauggggcagacgaugaugauggugacgugucagacggugacgguggugacaaugaugaaggugacaguaacaaguccucagagggugagcaggaucugcaagacacaccacccaagaagcugccugcaggugagggccccagccuguccuauccuaggcucuugcuggauuguugcagcugucucugggcuguucucuggagagcaccguguugcaugcaugaaggacauuugguuugcucuccuaagucggucucagcacuugauuccuggcucccagcuuccagcucggucccuagaaugcuccuaccuaagguucuagugcucccuggguccugugugguacccugaccucccuguucacagaggagccugcauccugguuugcuugugguuuuggugguguuggggacggaacucuggccguaggcacuaggaacugcucuaaccuugcgucacacccaagccuuucccuaccccuucuccuggacccuccacuuccaucagucaccuuuccucugugccccucagcccugcccugccaugccccugcccgccagacagucggcaucugcccacaguguagcaagggcaaaugaaugugcugcacgcucuccuuguaaauggccucucacuggcucuggguuugggccaggugucugguugcagugggccuagcuuggcuuucuuugucuugaugcuguggucauggagucucagugagggucuucuuucagcuuuggugccagcuuuaguggcccccuucuugugggucagcaggcacacugccuggcauccugugugucuugccugucuuucucuuaacuucucuuucuugguagcccagacauccuaagaguuucucagaggagaccccuugaugccugcucauggcucaucagccacucugcacagcaaaccauccugcagccguuguccuugccaaagugucccacagcacuguuguccacaagccuucacuuacaacuaugcugaguggccugugggggcacacaccuauaccguagcacuugggaggcugaggcaggaggauugcccacguucagggcuauccugggcugugaagggagaaccagaccacuagagcuaacauaacaaggccccguuuuaacucugcuccacaccaggaaggcacugcuggcacaguucugagcacacagcucagcucaguguuccaagcuaagccaagcauugcuccaguggucccuggccuaacccacugcugggauaacugcagucugccuuugcugcccaaggugcccacugaccuacacccuuccccugggaugccuuuccucaucucuacacuccccaugagcccagcuccuuguccccuccccagccugugucagugcacgaccaagaggguccucagugcuugguguugguauuggggugccccuacacuaggcaugguaccuugagcucagguuccguauuuguuuuuaggcaccgcacauagggcuggcccugaggcagacaaggaacaggcgugggaugacgaggagaacgcuggcccuguccuccagguaggcauccaugucuaggccacacgguuagccuuuaccuuccagccccacugccgggggaaggagagcaacggagaugagcagacagccuuccuggaggcuggcuuucagggaaggauggguaacuccugcucacugcugagagacugauguagggcuccugcugcccuccuguggcauuccucaugcuuuaagcagguagccugcaccccuaggucugccucuauuguuggggugcuggccucgaacaggguagcacagacuuagugaucugcauuugggucauagcucugagucagcucagaggacgggucagguggaucggggcggucagcggaugucaguaaggcuucaaugcugacagccugucacaugaguagguuugaguauuuugguuauauaggauguguugaucucuuuucauuugguuucuuccuaccugucugcucuggcuaguugggaguuaaaaucagagggacuuuaaucucugcacuuuaguagugagcucuaugccagccacacaguaagucccugccucaaaaagaaaugaaguuggagagcaggcugccuucugaagucugcugcuuccuuggggcaggcagggguggugccugcuggguuguagucucugucugcaggcuuugcuggcagaugcugagcgagaugaguccguuuccguggccaagcagagaaugccugugauggccaugugucuccucagcccagggaggugggguuuuguguuuggucauguggacaugaacugaaucuuguauuucucacaucuuuugaaacaguuugacuacgaggcacuugcuaacaggcuguucaagcucgccaguagacagagcaccccuucucagaacaggaagcgccucuacaaagugauccaaaagugagucaggaggccugucucgccucccccugcugccuccucacagcagucacugccucucauguguguuguccugugagguggccugagcaaggggagucaggagcuggucccccgugaggacuagacuagcugagugcugauguugucugucuucucuuucaggcugcgggagcuggcuggaggugaggaucuggugggcacugagguggucccuccaauacacaugugcauuugcgcacaugcgcagagcaugcgaaaugucugcagcgaccugugucucggugggggaaggguuaggcucaaaggcuccacagcacucacuguuccucugaggucacugaggggugcuuccugaggccaugaacucaugucugguauuuggaggugaagcucacacuguguuuguguguugugcaugugauggguuuuaccagcgcccaggaggccccacugcgcauguguagcuucgugcacucccagcauuagccuguacuguccggcuggaauagacaguggcauagcacaugugccucagguggccuccauauuucccuggcccugagcugggucuguggggaccgugacacagaauggagcugaccuauccccucagcacccugacugccacccugguucucaggcacuuucccagaggaugaugucccugaaaaagccuacaagaagaugcuggaagggaggcgggaacggaagaagaaaaagaagcgcuugcccaaaccucagccccagaauaaggaagguaggauccugggugaugauuaacacaugggcuggcucaccucccuugucuccccugccuguccugccuaugcuuaaggcuucccuucaugcacagacccccacagugcaccuggccuggggaccacccucagcccuuggugccugugcucucuuugacugucuugccaucuuugaucagagccucgucugccucgucuccuuagugguccugagccucuucccauguaacuguugguuucagguuucuagcccugccuuccugcuguguaugugcuagccugugacacucuugcuaaagacuguccagggcuugcugugcauuguugguggcccugccugagcugacagucuuuucagggguuaaccuggucauaugcuaaccuaggaucugccaucugcccugccaaaggucacugcauucacccugucucuggcccagcuaucuccacacugaggcccauacauauuggucccagcugggcaguaucuucucaccagccugcccuuggcauggccccagccucagcccagacaccgucuuucagcucugacacagcagguugaguuaauguuugcugguccuggggguacggccccuggcccucuugucagauagccaucucuaccucucuuccugcacugucuucacacccugcuccaugucugggcccuucacccuguccucuggcuagucuuucuggagaucaguuccugagcccucccugggaucauccugggacccaggaugaagcucacccuggucagcagccauagcuggugcuguccccagugcuggcacugccgugacugaaggacaccauauugucccaggaguuugcucacaagccuuacuuuguccacagcggggagugaggcagaauccucaagugcagacccaggcccaggaaggaagaggaagaggaacaggaaaacggaugagaaggcuggccaaggggguccuccugggaagaggaggaagcccggggcuagggcaaagggggcuggggcccagcaacccaagaagaggauacagucaucacagagugcagagugaggugcacagcccaggcuggcacaugguggaauggggcaggauaccugggcaugcuccugcagccucugaaugccgagguucugagcguccguccuauaggggaggagcaggaggaggacggaagaaacucuugguuuagucccagccuuuaagcaugauccugccucagagccaugaccugcaucucagaaaaacacucaacauuucacuuguacauaugcuauggcugugccugauccuagccagagaggccagaagaucuggagacugaguccagccuggguugcagaguaaaucccugucucagcuucccuccaccauagucaggaaaacaaaaccaaguaacuguguggucacuguccccuccacccuuggcugcccacaaauaaacugcggguccuuacagcacauggcugcuucucccauuuuugga

SEQ ID NO: 5597 - RNA, 8774 nt, Mus musculus
ccuacugacuucugcugcccuguugcagggauaaggcuuuaaugccuguauuacagcaccugaacccaguauggguguuacagcagguggaggaaacucugccugacaaugcacuucuugugguugacggaggggacuuuguggccacugcugccuacuuaguccagcccagagggccucugcgcuggcucgauccugguaaggaaagucccacacuaggggcagccuguauucugugcacccuucacagcagugugcucuuaucuuucuaggggccuuugggacucugggaguuggcgcagguuuugcacuuggggccaagcugugucagccggaggcugaggugaggcauuggaugugggagacuaacugccuucugggcugcgaacuacccuaacugcccugggucgucucccccccucccuccgcuccucccagguuuggugccuguuuggggauggagccuuuggcuacagccucauugaguuugacacguucgucagacauaaggugacugggcugcccugagggaagauuaugaggguucugggauaugucauuuaggguggggcugggggggucgggguuuuuccucagugagccacaggcccuguuuuguugcuggucaaacuuuugaaggcugaaggcugccucuuggccuccuuuuuuuuuuuuuccccuaacagguaccagugauagccuugguaggaaacgaugcagguuggacccagauuucucgagagcaggugcccagguugggcagugauguagccuguagccuggcuuacacuggugaggugucaugguguuuugggcccagcugggcuucuguuaacucucugggugucucugcuauggccugacauauuuucuuuuagauuaucacaaggcagccaugggccugggggcccagggauugauacucucacgggacaauaaggaucaaguggucaagguacuucgugaaggccagcagcugugccaggauggucaugcaguuguggucaacauccugauugggaggacagacuuccgagauggcuccauuucuguauagggacuauccaggguuagugugcuugccucuuuggaccaggacuuugucuaccuggaguuuucauccuugccuguccugagcuugucucauaaggucuaacccucuaaguggggaauguggggguggggaaccaaagcucaaagaggcaccuuggcaacccuggguagcucuuuccaaaagguucagcuguacccucucucuuacaaaauuaauaaaucucuuggcuauaugagcccaaggacucagucacagaaucuguguauacugguuuauuuacuguucacaaagauggaagugguggaaagaagugggagacaggaaggggcccuaacucugucaccauuggaagauuuuggggugccaggcaauggaaaauccuaucccacucuauggucccugaaagaguuccacauauccauuccacacaggccagugcacacgaauccucacacacagacacacaugcauggaggcaauaaauauuuuccguaccaaagaucccccagccugauaccucagguggggucccuccaaaaggggaggaguuaagugcucaguuuuucaaggguggggaagggcugcuggggaaaggaaaggucugacucugucuccauuugcugguuggaaauucaucucggaguuuuugcuagaagagaggguuaggggaaaucaccuguuucucucuaagcuccaggccaccuuuucacagguagaggcagagucuggugcuguuucccuuaaguagaaucccaugauugccuuuagauacuucaagggagggagagagaguguagugcucaaugcuaauacugguuugguuggcagcagcaagaggguugacuagggauguuuuaacaccccagggugaugcucacaguaauugguguuccccugcaaaggggaggcaagagaggccagccuagcaagcagaacuguuucuggcagcaagagaagccccaaugcucgggagaggggccauggcaucagugcugaaaaugccaagagccugguuucugcagcuagggccccaaacaauggcacuaggaauugggaaugauuuuuuuagcauggaaggcuggccccuuggcaacucccuagcaaccaggugcucagucugagcaacucuggucagguccuuuuaggucaucagggccuuaguaacuuggaacccagucaccaguaaucagaaccugguccuuagcaaccaggaagcaauuccuuaguaaccagaguccauccccugcuuugagggcucagaggcacacauugaucugcuuggagaguucucucuccagauccaggaugagggcaucaaagucuuugagauucagguguggguugaagggugcaucaaacucaucuucgaagucgguagugccccucggcucuccagucucaucaucaucuuccucacugucgcugccugucacauggucauagucaggcccggacaggaagucccgcccacagggcaguaaaucgccuccgcacacacuccagucgccugcauagcgguugcuugggggacuuucggggccuccgcggccccgaggccgagucaccacuucugggcccgccagcggcaagugcagagguggcugucuuuugggccucaaauacggugcgacugcgccaucugggguaucugagggccgucugguaucugcgggguccaaaaggaggauaaguugugauacaagggaguggucccugauuggccuuuugagaggcaagcuuacaaauuuaacucacucaugacccuccuuagauuccaacccaugauuggucaguagggaagcauaaauguguaagggaggcugacugggaugggcgguguucaccuggccaagacuguaacagguaaugcaggacuucaauguggcgcuugaaguccacagcacuggugacuccugggccagagcuacggagccggggccgagaggguguuugucucgcugguagcaacacugguccgaagcacacugccaaguucugcggggucaugcgguuguggguguggaaggaagagacaaggcgcagaugguccagaagaagcgucaggguggccuguggagagaguugcuagggugggcacgaggcgggcaaaccugaacccuuguggcacuugcaggauagucagggguggcuuagaguggaggcacuucaguucaaguucucauagccagaggggagggguuaguauuaggaaugcauuuugccaaaguugagauuaagaccaaaagcaauuuagcuuuggaauggaaggguuugaacuccaacccaugccguguuuggcaauuucaaggacuuuucuaagaucucacagccaguauuuuugcuuguguuagguuggcagaucuguuugcucaguuugcuaggcagcccagucuggcuuggaaguggcuauguggcucaggcuggccuccaacuagaaauccucuugcuuuugacucuugagugcuaggaguagaggcguguaacaccgugccuggauagagccuguguuuggacagaucuggcuguuugaccucaggcaaaucaccaaacugagccuugauuuuuuuuuuuuuaacccaggaauugacagaugaauaucaaguacuuguuggcauugaugaucauguaugaugauuacaucuuaggcaugcuuaaagcacuacacugguauuagcugcucuaugagccaaaguuccuagcauggccgacucacccucuccacaucuggcaggcaucugaggagcccucuggugcccucaggacccagggaagcccugcuuggguguccuugggccauggcuuccagcaccaccugguagaggggcugggugaugaguggaguaggcaguucucgaagauaauccuugaggaugccuguggacagagggguucucucugguuaagguacccuggcuucugaagccagaggaggggucacuggggcugacagugguagugagaagagggcagguauaagaaaugaaaauaggaucagacaggagagaggaggguucacaggaggccuccagagcagccuggaggugacaacugaaagaagugagcaggcaguggagaaauggcugaccugugaugacauugauaucaggguacacaucuucagagaggcacacagccgcacuguccugcucaaaggcaucucgaagcucuuucuucacugcugcugagccacacagacgguacagccccacuaccuggggauaaagagaaagaacgucuuccuggagggccauaagacagcaaagccuggauauuuggacaagggugacuguggaugugauggccugggaggguagggccauucacaugcaucuucacuggcugccuucccauugcugucacaggggcccugagccaggccuaguacuucagcacucugaggccaaggcaggagggucacuuaggcuauaauauaguguguguucaagguaagccuagguaacuuggugaaacccugucucaaaaaauaaaaugaaggcugaggguguagcucaacaguaaagugcuugcugagcaaguaugagggccuauguucaauccccagcacuaggaauaaaacaaaaccagagacacauaaccuagcuuucuaaauuccccaagguuggaccacuugucuagagucucuuuccucugacuucacaguucacaucuuccaggaagccuucucacacuaacccaagcaagucaggaagugagggcccgcuuuaagcuguccuauacccuccccuccuuacugcuucuuuccuuuccuuuccuuuccuuuccuuuccuuuccuuuccuuuccuuuccuuuccuuuccuuuccuuuccuuuccuuuccuuuccuuuccuuuccuucucucucucucuccccuuccuuccuuccuuccuuccuuccuuccuuccuuccuuccuuccuuccuuucuuuuuuucgacaggugccaccacacuaggcuaccuccuuucuuucuuucuuucuuucuuucuuucuuucuuucuuucuuucuuucuuucuuucuuucuuucuuuuuuuagaggcuaagggcauuuuugccacuagcuggacaaccugaguuugauccuuaggacccacaugauggaaggagagaaccaacuauuuuaucuccauaucugcacuguggugugguacacacagaugcacacauauuccauaccaagcaaauaauauguuuuuaaaaacuaaagagaguuagugauaggcuaccuccuuucuuaacucccccuggcuaccuccuuucuuaacccccccugccagcuaguuugacauuuaugaaaguccaaucaucuuucucacuccaaagacugagcuccaugagggcuaagcucuuguaauaaaaaggacagaugauccguggguccugaugcuggggagggaguguuguuuaagggguuccaaggaguauguaugucuaaggcagcaggagugggggcagccagcucacccgcagcccucggcauucgaucugccccacacacuuucggaugaugagaggcaccuggccuggggacugcucacguucuaccagaagcugcagagggagcccgaaaacacggggcucugcuguggcaggggcuucuugcuguuccgacaauguuagcuuggcguaaagaagucccugggguucaagucgaacggccaguuguugcgcuuggcacccuaaagaugcaaggaggacugaggcaauuuuauccuaaaaguuucuguguccugacuccccucaucuagaacaccccucaaucaugaagcccagccaccaugggcaccaugggagaacaggaggcccuuaggugggucuuuguuucuugcucuuacuuccuggaagucccacgucuuaccucgaaagaugguuggcaauagcacagugcccugggcacagggccggugccgccucacaccagggucccaugcaaguaccaaggcccgcagcagacgagcagccuccagcucuagguggaaggugugguccagccucaggaagucugguccgcuucgaaguggcccugugcgggcccgagcuaccccauccacuuggagaaggcagcagagaucucguggaguagccccgggacuuggucgcagacccccuagcccauacaggugcaggcugagacgcccccagagggcagcuggaggaguccgggccgauggacccacuucauagggccggaaggcagugggugauggugguccuccaggacgcucaggcgaaucaccaucgcugagguacccaccccuugggcuccuagacccuccagccacugaugccugcccaggaguccccacacugcuguccaggugauagcggcugaugacagagccugcuggggcgguccucucucuaucccggccugugcgaguacuucuuaggcuuaggcggcgccggagcucuggcagcuuuuucaucuucauugagaggcgccuggcagggccuggggacuugguacgggagguuuugguaggggggcugguaggggcugcaccuguagggagagcaaacuucagaguccagggccugggauuggaguaugaaucuuaugguccuugcggggcugaggauaauaaggcuuaggaacaccuggaguauaggguuugaggcuugugcaugcuuguaggugaauauaacacuuugugcuuaccuuggauguuggggccuucuggcucagaggaagcuagcugugaucccaagggcucaggugcggguggucuggggucuucuucagggaugggguuguaccaaaucucaccagcaggcuccccacugcuagguguccuaggccccaaagagaucuccucuggugguuuagccccuccuagcacccaucggcggcuacugggcuccaggcuuugcagguaggccccccgaguggggcuucgaggugucucggggcugggugguaccucugcuccagccugagacccuucaaggacacgagguucugguucuggggguuugggcucugagcgcugggcuggguggccugguggagaaugaagaugguaagacccaacucucaaguucccagagguccagggaggcagucuagcuaauuggcuucagcccucacuucacauaaccaaucgacagcaaggaagcucuuugcuagccuggagccacugccuccuuuggaaccagcuguuuuguuugguccuagcagcuagcuaauacuuuugcaguccuagcuucaagguccccugcccuagccccuaguaaugcaaaagggacugugaaucagccucaagaguccaggucaaauguccuuggaaccucaggacauuucggcucugucaccccucucccagacauuccauuaauccuagaaucuuacgccugccccuucucauugaguggccuugagcaaggcauuuuuccugaugcuccaugucuuguuuaugaggagauucaguauuaucauauucucuucucgacccccuuccagcuuggagcucagugugagaagcaacuuuagacaauaggaucuguagcccugcucaaggcccuaguagcugcugcugggaaggcagggcagggaacgcugguuucuuuuucauucagcacccuuuucccauuucccaaauccugcccacaaguucucuuggaucuugccccucagcccaagccagauuucuacagucagugccccguuaccccgccccccuuaucuuggcucuacuuucucugacaucauggucgauuuccuguguguguuuaugugugggcacccggaucccuucucuggcccugggacccuugggaugcccugggaacggcccgggaggaagagucagguccuugguauaguggccucccuccuuuaacugcuuccuuccgaagcccccuacccauacagcuuucguuccuuuccauuucauucuugcugucuguggacccccagauuuaaggaucuucuauuuccacccuuuggcccucuguuucaggucucugucaucaguagcauaguccagaggauuguuuaaagucaguucacaggcccgggacaaaucacccaacaaccacgugccucaguuucucugucuuaauaaacaggacgguuucuuggggcuggccacaguaggugcggcugcagccucuggagcgaugguggcauggaauuggggaaaagacugcaauaauaaauauaaccccgcacgaccucucuuuaguacaggaguguguacccaggagaggugcccaccacccagccaugucgaugccacacagcuguccucaccucccgccccugccccgccacucucugggcgccccuucgaggccccauuuccugucaggggugaggccccccugcggggccuugcaaggaucccuggggcuggcaucucaggccagcugcacauaacgguccgugccccccgccccagccccccagccuuacaaagauccggugcauauuccucucuugcaucagggcucgcucccggcuuacccacuaggucccgcugcguacccuaccggggaccuggggaucugaggcugaguggggcucccuucucuuacuuuccgagaguccccgcacucaccgcgguccuuggcuucugacuuuuuucgaggaaguuucucacgaccccgcaggcgggagaaggucuuccugagcagcggcucggccaugcuugggccgcggccggccgagugcgcgccccggggcugcggccgcccgccccgcccgccuaccccccccccccca

SEQ ID NO: 5598 - RNA, 8774 nt, Mus musculus
uggggggggggggguaggcgggcggggcgggcggccgcagccccggggcgcgcacucggccggccgcggcccaagcauggccgagccgcugcucaggaagaccuucucccgccugcggggucgugagaaacuuccucgaaaaaagucagaagccaaggaccgcggugagugcggggacucucggaaaguaagagaagggagccccacucagccucagauccccagguccccgguaggguacgcagcgggaccuaguggguaagccgggagcgagcccugaugcaagagaggaauaugcaccggaucuuuguaaggcuggggggcuggggcggggggcacggaccguuaugugcagcuggccugagaugccagccccagggauccuugcaaggccccgcaggggggccucaccccugacaggaaauggggccucgaaggggcgcccagagaguggcggggcaggggcgggaggugaggacagcuguguggcaucgacauggcuggguggugggcaccucuccuggguacacacuccuguacuaaagagaggucgugcgggguuauauuuauuauugcagucuuuuccccaauuccaugccaccaucgcuccagaggcugcagccgcaccuacuguggccagccccaagaaaccguccuguuuauuaagacagagaaacugaggcacgugguuguugggugauuugucccgggccugugaacugacuuuaaacaauccucuggacuaugcuacugaugacagagaccugaaacagagggccaaaggguggaaauagaagauccuuaaaucuggggguccacagacagcaagaaugaaauggaaaggaacgaaagcuguauggguagggggcuucggaaggaagcaguuaaaggagggaggccacuauaccaaggaccugacucuuccucccgggccguucccagggcaucccaagggucccagggccagagaagggauccgggugcccacacauaaacacacacaggaaaucgaccaugaugucagagaaaguagagccaagauaaggggggcgggguaacggggcacugacuguagaaaucuggcuugggcugaggggcaagauccaagagaacuugugggcaggauuugggaaaugggaaaagggugcugaaugaaaaagaaaccagcguucccugcccugccuucccagcagcagcuacuagggccuugagcagggcuacagauccuauugucuaaaguugcuucucacacugagcuccaagcuggaagggggucgagaagagaauaugauaauacugaaucuccucauaaacaagacauggagcaucaggaaaaaugccuugcucaaggccacucaaugagaaggggcaggcguaagauucuaggauuaauggaaugucugggagaggggugacagagccgaaauguccugagguuccaaggacauuugaccuggacucuugaggcugauucacagucccuuuugcauuacuaggggcuagggcaggggaccuugaagcuaggacugcaaaaguauuagcuagcugcuaggaccaaacaaaacagcugguuccaaaggaggcaguggcuccaggcuagcaaagagcuuccuugcugucgauugguuaugugaagugagggcugaagccaauuagcuagacugccucccuggaccucugggaacuugagaguugggucuuaccaucuucauucuccaccaggccacccagcccagcgcucagagcccaaacccccagaaccagaaccucguguccuugaagggucucaggcuggagcagagguaccacccagccccgagacaccucgaagccccacucggggggccuaccugcaaagccuggagcccaguagccgccgaugggugcuaggaggggcuaaaccaccagaggagaucucuuuggggccuaggacaccuagcaguggggagccugcuggugagauuugguacaaccccaucccugaagaagaccccagaccacccgcaccugagcccuugggaucacagcuagcuuccucugagccagaaggccccaacauccaagguaagcacaaaguguuauauucaccuacaagcaugcacaagccucaaacccuauacuccagguguuccuaagccuuauuauccucagccccgcaaggaccauaagauucauacuccaaucccaggcccuggacucugaaguuugcucucccuacaggugcagccccuaccagccccccuaccaaaaccucccguaccaaguccccaggcccugccaggcgccucucaaugaagaugaaaaagcugccagagcuccggcgccgccuaagccuaagaaguacucgcacaggccgggauagagagaggaccgccccagcaggcucugucaucagccgcuaucaccuggacagcaguguggggacuccugggcaggcaucaguggcuggagggucuaggagcccaagggguggguaccucagcgauggugauucgccugagcguccuggaggaccaccaucacccacugccuuccggcccuaugaaguggguccaucggcccggacuccuccagcugcccucugggggcgucucagccugcaccuguaugggcuagggggucugcgaccaagucccggggcuacuccacgagaucucugcugccuucuccaaguggaugggguagcucgggcccgcacagggccacuucgaagcggaccagacuuccugaggcuggaccacaccuuccaccuagagcuggaggcugcucgucugcugcgggccuugguacuugcaugggacccuggugugaggcggcaccggcccugugcccagggcacugugcuauugccaaccaucuuucgagguaagacgugggacuuccaggaaguaagagcaagaaacaaagacccaccuaagggccuccuguucucccauggugcccaugguggcugggcuucaugauugagggguguucuagaugaggggagucaggacacagaaacuuuuaggauaaaauugccucaguccuccuugcaucuuuagggugccaagcgcaacaacuggccguucgacuugaaccccagggacuucuuuacgccaagcuaacauugucggaacagcaagaagccccugccacagcagagccccguguuuucgggcucccucugcagcuucugguagaacgugagcaguccccaggccaggugccucucaucauccgaaaguguguggggcagaucgaaugccgagggcugcgggugagcuggcugcccccacuccugcugccuuagacauacauacuccuuggaaccccuuaaacaacacucccuccccagcaucaggacccacggaucaucuguccuuuuuauuacaagagcuuagcccucauggagcucagucuuuggagugagaaagaugauuggacuuucauaaaugucaaacuagcuggcaggggggguuaagaaaggagguagccagggggaguuaagaaaggagguagccuaucacuaacucucuuuaguuuuuaaaaacauauuauuugcuugguauggaauaugugugcaucuguguguaccacaccacagugcagauauggagauaaaauaguugguucucuccuuccaucauguggguccuaaggaucaaacucagguuguccagcuaguggcaaaaaugcccuuagccucuaaaaaaagaaagaaagaaagaaagaaagaaagaaagaaagaaagaaagaaagaaagaaagaaagaaagaaaggagguagccuagugugguggcaccugucgaaaaaaagaaaggaaggaaggaaggaaggaaggaaggaaggaaggaaggaaggaaggaaggggagagagagagagaaggaaaggaaaggaaaggaaaggaaaggaaaggaaaggaaaggaaaggaaaggaaaggaaaggaaaggaaaggaaaggaaaggaaaggaaaggaaagaagcaguaaggaggggaggguauaggacagcuuaaagcgggcccucacuuccugacuugcuuggguuagugugagaaggcuuccuggaagaugugaacugugaagucagaggaaagagacucuagacaagugguccaaccuuggggaauuuagaaagcuagguuaugugucucugguuuuguuuuauuccuagugcuggggauugaacauaggcccucauacuugcucagcaagcacuuuacuguugagcuacacccucagccuucauuuuauuuuuugagacaggguuucaccaaguuaccuaggcuuaccuugaacacacacuauauuauagccuaagugacccuccugccuuggccucagagugcugaaguacuaggccuggcucagggccccugugacagcaaugggaaggcagccagugaagaugcaugugaauggcccuacccucccaggccaucacauccacagucacccuuguccaaauauccaggcuuugcugucuuauggcccuccaggaagacguucuuucucuuuauccccagguaguggggcuguaccgucuguguggcucagcagcagugaagaaagagcuucgagaugccuuugagcaggacagugcggcugugugccucucugaagauguguacccugauaucaaugucaucacaggucagccauuucuccacugccugcucacuucuuucaguugucaccuccaggcugcucuggaggccuccugugaacccuccucucuccugucugauccuauuuucauuucuuauaccugcccucuucucacuaccacugucagccccagugaccccuccucuggcuucagaagccaggguaccuuaaccagagagaaccccucuguccacaggcauccucaaggauuaucuucgagaacugccuacuccacucaucacccagccccucuaccagguggugcuggaagccauggcccaaggacacccaagcagggcuucccuggguccugagggcaccagagggcuccucagaugccugccagauguggagagggugagucggccaugcuaggaacuuuggcucauagagcagcuaauaccaguguagugcuuuaagcaugccuaagauguaaucaucauacaugaucaucaaugccaacaaguacuugauauucaucugucaauuccuggguuaaaaaaaaaaaaaucaaggcucaguuuggugauuugccugaggucaaacagccagaucuguccaaacacaggcucuauccaggcacgguguuacacgccucuacuccuagcacucaagagucaaaagcaagaggauuucuaguuggaggccagccugagccacauagccacuuccaagccagacugggcugccuagcaaacugagcaaacagaucugccaaccuaacacaagcaaaaauacuggcugugagaucuuagaaaaguccuugaaauugccaaacacggcauggguuggaguucaaacccuuccauuccaaagcuaaauugcuuuuggucuuaaucucaacuuuggcaaaaugcauuccuaauacuaaccccuccccucuggcuaugagaacuugaacugaagugccuccacucuaagccaccccugacuauccugcaagugccacaaggguucagguuugcccgccucgugcccacccuagcaacucucuccacaggccacccugacgcuucuucuggaccaucugcgccuugucucuuccuuccacacccacaaccgcaugaccccgcagaacuuggcagugugcuucggaccaguguugcuaccagcgagacaaacacccucucggccccggcuccguagcucuggcccaggagucaccagugcuguggacuucaagcgccacauugaaguccugcauuaccuguuacagucuuggccaggugaacaccgcccaucccagucagccucccuuacacauuuaugcuucccuacugaccaaucauggguuggaaucuaaggagggucaugagugaguuaaauuuguaagcuugccucucaaaaggccaaucagggaccacucccuuguaucacaacuuauccuccuuuuggaccccgcagauaccagacggcccucagauaccccagauggcgcagucgcaccguauuugaggcccaaaagacagccaccucugcacuugccgcuggcgggcccagaaguggugacucggccucggggccgcggaggccccgaaagucccccaagcaaccgcuaugcaggcgacuggagugugugcggaggcgauuuacugcccugugggcgggacuuccuguccgggccugacuaugaccaugugacaggcagcgacagugaggaagaugaugaugagacuggagagccgaggggcacuaccgacuucgaagaugaguuugaugcacccuucaacccacaccugaaucucaaagacuuugaugcccucauccuggaucuggagagagaacucuccaagcagaucaaugugugccucugagcccucaaagcaggggauggacucugguuacuaaggaauugcuuccugguugcuaaggaccagguucugauuacuggugacuggguuccaaguuacuaaggcccugaugaccuaaaaggaccugaccagaguugcucagacugagcaccugguugcuagggaguugccaaggggccagccuuccaugcuaaaaaaaucauucccaauuccuagugccauuguuuggggcccuagcugcagaaaccaggcucuuggcauuuucagcacugaugccauggccccucucccgagcauuggggcuucucuugcugccagaaacaguucugcuugcuaggcuggccucucuugccuccccuuugcaggggaacaccaauuacugugagcaucacccugggguguuaaaacaucccuagucaacccucuugcugcugccaaccaaaccaguauuagcauugagcacuacacucucucucccucccuugaaguaucuaaaggcaaucaugggauucuacuuaagggaaacagcaccagacucugccucuaccugugaaaagguggccuggagcuuagagagaaacaggugauuuccccuaacccucucuucuagcaaaaacuccgagaugaauuuccaaccagcaaauggagacagagucagaccuuuccuuuccccagcagcccuuccccacccuugaaaaacugagcacuuaacuccuccccuuuuggagggaccccaccugagguaucaggcugggggaucuuugguacggaaaauauuuauugccuccaugcaugugugucugugugugaggauucgugugcacuggccuguguggaauggauauguggaacucuuucagggaccauagagugggauaggauuuuccauugccuggcaccccaaaaucuuccaauggugacagaguuagggccccuuccugucucccacuucuuuccaccacuuccaucuuugugaacaguaaauaaaccaguauacacagauucugugacugaguccuugggcucauauagccaagagauuuauuaauuuuguaagagagaggguacagcugaaccuuuuggaaagagcuacccaggguugccaaggugccucuuugagcuuugguuccccacccccacauuccccacuuagaggguuagaccuuaugagacaagcucaggacaggcaaggaugaaaacuccagguagacaaaguccugguccaaagaggcaagcacacuaacccuggauagucccuauacagaaauggagccaucucggaagucuguccucccaaucaggauguugaccacaacugcaugaccauccuggcacagcugcuggccuucacgaaguaccuugaccacuugauccuuauugucccgugagaguaucaaucccugggcccccaggcccauggcugccuugugauaaucuaaaagaaaauaugucaggccauagcagagacacccagagaguuaacagaagcccagcugggcccaaaacaccaugacaccucaccaguguaagccaggcuacaggcuacaucacugcccaaccugggcaccugcucucgagaaaucuggguccaaccugcaucguuuccuaccaaggcuaucacugguaccuguuaggggaaaaaaaaaaaaaggaggccaagaggcagccuucagccuucaaaaguuugaccagcaacaaaacagggccuguggcucacugaggaaaaaccccgacccccccagccccacccuaaaugacauaucccagaacccucauaaucuucccucagggcagcccagucaccuuaugucugacgaacgugucaaacucaaugaggcuguagccaaaggcuccauccccaaacaggcaccaaaccugggaggagcggagggagggggggagacgacccagggcaguuaggguaguucgcagcccagaaggcaguuagucucccacauccaaugccucaccucagccuccggcugacacagcuuggccccaagugcaaaaccugcgccaacucccagagucccaaaggccccuagaaagauaagagcacacugcugugaagggugcacagaauacaggcugccccuagugugggacuuuccuuaccaggaucgagccagcgcagaggcccucugggcuggacuaaguaggcagcaguggccacaaaguccccuccgucaaccacaagaagugcauugucaggcagaguuuccuccaccugcuguaacacccauacuggguucaggugcuguaauacaggcauuaaagccuuaucccugcaacagggcagcagaagucaguagg

SEQ ID NO: 5599 - RNA, 1701 nt, Mus musculus
uaggucccgcugcguacccuaccggggaccuggggaucugaggcugaguggggcucccuucucuuacuuuccgagaguccccgcacucaccgcgguccuuggcuucugacuuuuuucgaggaaguuucucacgaccccgcaggcgggagaaggucuuccugagcagcggcucggccaugcuugggccgcggccggccgagugcgcgccccggggcugcggccgcccgccccgcccgccuacccccccccccccaccggcccgcuccagcaggaagcgcauuccgggaaugcuuggccuuaacuuuuuuuuuuuuuuuuucuuuuccuuucccgcggcccgagcaggcgaugcugggagauguagucgccuggggccgggaggggacaugauggggugcugggcugaucuaacucuucaacuaugaaugucauggcauaggcugggccccccauaaccauccuccuugugugauggcaugcagcacauucugucggcucccccaaaccgcauccaaggcacacaucagcucaugucuuuccuccuguccguccauccauccccacaucacccaguaccucgaccacgaucuuuccuugggaaccccaaaugcccccaacucaaguuacuauugcugcuuauugacccucaagcuuagugguuucagacagccgggaugcucacugucaggaacauggacgcgauauagacgaugcagucugcugaucucuacucagucgagaacacagcaaggauagguguaucucgaaaguaaguggugaaaucggagguuguauuauuauuuuuuauuuaguacugaaauaccggaggcuggacaacuuucuaaaguagacugaguucauguugauguccuagcagcacuccuuaagacaggaagagaaaaaaaaaucuuagguuugggcugauucuuacaacuuaaguuuacuuuuuauuaugaauaugugugugcuucuguguguauggcacauggaucggggugugugugugggugcccagaaacggcugggaaacaagcacuuuuaacugcuaauuuggucucacagaaccgucuucugaaggccaacucccgccgauaggcuccuuucaccaugacuagccuauuaacagggccacauagaggacuaaacuuucaacacaugaacuguggcacaacuaaaguucaggucucuuaacuggugccagacacaggcuggaccuccacugggauaguggacuaagcaccuauguggacaccucuguguccuuggcuuccucccaguucaguaguuuugugguaauugguggguaugcaggcgucuaaaaguuaagagugcagaugaguagaaggaagaccugcccagcuuugcuuauccaggcacaugugggaggagaaacuguggugcugcaauaguuugaaaagaucuaguacauucuaagagacuggaacuuuugcuagaccuuacagccagagauaauaccacaccuggaagucacccacgacugcuagccuccuauguacucauugaguaagagaacaauguagcaaucaacucuacuuguuuuggauuucccaugcaaucaacuucuuacaaccuauaauguaaugcauaccuggacucuuagauuagguacucuucccggccccucacucagauaaugcacacgaaagcaacacuugcagaagcagaagcaacuuucuacca

SEQ ID NO: 5600 - RNA, 14956 nt, Mus musculus
cccgggcuucaaaucaaguuuaauaaauaaaauagcauugggcaaaggcagucucacaucacaguguccucgguggggcgagggacggucgaguccagccgcacaggcucaaacagcaccgcucugccaacaccgggcggagcugccugcccagggaccccacuccaaauuguaaacaccaacauaaauaaaaugagggaggccgaggacuggaugggcccagccacccugcuaggagccuccaaagaaacgagacccacaggacagguggguggcuggguggugcuuccagagcugugccccaagacgccccaaggagaggggcaggaagggagcagaccgucugcccuucgagccugggaugcugaggccccaccacggcacaggguggggagugcaggcaggaggcaguugggguauaaagugcggcuuuuccugaagugaagacagccaagggccgagaaagggcggccacaggacgagguauauggcucugugccccaaagucccacacugagcaaaggcuggaggccacaaccccgcugugguggggaaagagcuggccuguggagggugccugggcagaggcugcuggugcgggaugaguccugcccaaggccccaggcagcaccgccuggccagcuucugcuggcugagggccgguggcuggcuccaugccgggacgaacccucuucgagcccagcugccaggcugacuccauggcaugguggcagccuggggcuguggcggugcuggacgcugaggucuggggucugucuguguggcccuggccacuucacugaaucccaccauguucugaagcagagaaggcaucacacaggccugcaugggaaggggggucaggaagacugacucgcaggccuggcaguguugccacguccaaucugagcacacguacccccagaugaccaggggucaacaggucaucacauugcaccuacgggaaaccauaaguaaaugucaguggccaaguaacccagggcucgcccguccugagccaccgccccccacccccccauacacacacacacacacacacacacacacacaacacugcucuggcuucugccugaaugccacuugcagcauuauggaccacgaacaaugaaaacuuauugccgaggacaaaacugaagcuguagaggagggauaaauaaggcugccgcagcccacaacacaaagcugcagcccugggcaccagccagucugcucacgcuccggccuguggaagcuaccaagaguggcacucacugugacaagggcuccgagugcaguguggagguugggcacgcuggguggccaguuaggaagggauucacauccccaaugccaaugaguccaaauucagugaccgacaaggccaccugugcuggagccaugggcucugcaguguccucgcucagagccacagggcuggacacaaggggcagcuccucggguagggcaagguccacaggcagccuggggcuagugcccggcucuggagcagcugcagccgccggugggaguucagcugaggcggccaggcuagugggcugcuggagcgagggcacagcaggggguucguccagcugcuggaauggacgcgguccuggcucugaggaagggaggucauccgagcccacgccaggcuggucaaguccaccagcuucaauguccacauucaggggcucugaagggacagcagugaggacagccugagcagaggcucagcuccucccacagccccacacacuccucucagaucucacuuaggcgaggccuccuuacaagaagccagacacaccaaugggcccagccagagacuaugaggucaggagcagccauguccacagcauuagaaacaggaaucagaggcccaggagauaaagcauuagagcucugauggcaauggugacacuggaugggucuucaaacccauaggcguaacacugggacagaaaugaugccuccaccaagaagcaggcuucacaggagcagcacgcguccguauucauguccccugugugaauguacuucugcccccuccuucccagccaacagagcaaacaggguuggcaucuggccaccgcucacugugggaacugccgaaagccuuggggucccuguccuuacccacagucccuucucgugucgacucacccacaggcaccccugccucagaaugcagccgggcauggccaucggggucaagcccaucuagguccuguucaguaucccuguggaaagagagcuaugaagagaaggaagccagggaaggaggaccucaccaggagaggccaccccacaccccaccacacccgcccuggccaggugacuagaaugagcacguacgugguuccagaggagacaaacuuccuccggcccagccgugucugcugggcaaaguagucguagcgcucagacuucuuccacagguaauaauacuccacacacucgcccacggaccgcgugcguaccugugugaaccacaggcaugcuuuaggccucacugcaggccacaaagcagcaggaaaggcucccuguggggccccaugagaccucaccuacugacucuaguccccaccggugcuccaucaacuaacacucaggccuucuuucccggacaccaugagcacaccuccugccuccugcaccucacacccauguacagggaaaucugugugcuucuccacacagacagagccuccagucagagagcagccuaaauccaggaugcuggcccauggaguccguugcuauugugaacaugaacuuggagccauccugaagacacagcugaggacaugcacugacuacaaugggacacuguacugucaacaacccagaggcacacgacagguaucuuuacauggguguguccaaggcacacaugaagaaagcccacacugcauaagagugggguccaggacgaauuacaaaggaaacaagaagccauccaagcacccauaucuaccuccucauugacugagagagaacuccgugugaccagcugccuauuccuaucauauuccuaucgccauuguaacuguauccccaaaucacaaccaguaacauguuuguggccagagguuuggucacaacagcaagugagugacagggaagugacagguaggacacaggugagugacagggaagaagugacagacaggauacaggugagugacagggaagugacaagcaggacacaggugagugacagggaagaagugacaggcagggcacaggugcagugacaaggaaguaacaggcaggacauagguacagugacagggaagugacagaacauaggugcagugacaggcaggacacaggugagugacagggaagugacuggcaggacagagauggaaaucaucccauagccaugagcuccuucacuaaggaugccucauacauccacaaucccagagcugugccaaucuaaaaccuggggcauuguuaacuucaauguccuccauagugucccuucaacaucuacaugggcucuccgacgagaugcccugacucacagagccacacuugcccaggacaaacacuuuguagagacccagucucugaacacccacccuucccagaggccaguccaccucugaagagcaggucacagagagaggucaggcucacaggccuucacaccucucacuccucauaaacaagugcacaguccgucuucagagccaaccaggcuguacagaggcccugaugugcacaugcaccccugcuuugacaguucauggcugagugcugcgucuggccagcugugggcacagucagaucaaguaacaucccggugacaccccagguccagaacucaccccugcacugccaaucacagaugacaccccaugacgaacggguccccagguucaaagcuagaagcagggcugggccugccaacucugacaaagccugauaaccagcaaggacgaggggaaggacagagagcugaggccagcauggaaugucagcccagagcaggacaaauucccacaggggacccaggucuaggaagggaagaaaggcucaggcagcccacuccaucguagagcacagagccagcaagcuccacugaggacucaaaggucacaggaccaaguguggggaagggaggggaggggaggggaggggccagcucaggcacaggagccugcacucucuguugaugguaaaggcaucugaugacuacagucaauaccagaggaagccaugcauggguagggcagguguggugggaagagagagugccucacccaccuuguuggccugaaucagaugaaaguucuucccaugaacacggaagccauguucaaaguuccugcacuccuccucgcuccaggcacagagcccaucugcaaacagagggggguugcuuaggcagcucaggggcaacagagauggaggggagcccagggcuguagcccaccucugaucacuuuuacguugaaccucagccugcgcagggccuccuccacguugaaauuacacuucacgagcucauacagcgccuagggcagagagaggcugaccuuucccaccagucuaccagggcuuacaccauggccccagggccacaggcugcacccacaguauggcucccacagcugcaaugguguuugcaccuuggccaugacagcugucaggaguaacugcacugucauaccaggagugacauggaacacugacaccacugucucucacaaguggguucaaugugagcuccaucccacuggccacacugucugaccaucaccuggcugcugcccagcgugugaccccuaccugcucacuguccuucaccaccucgcccucugggaucugggggccagccaucuccugccaccuccguuucacugcccuguacaggaacuccuccaccucccgcucugggaguacacuggggcuccacagcagcuggucuucauuuucauagacuguggagagaggcugagagucaggagcagcaguggccacccacagugggggaggcagggcaggcaccuuggcaccuccuaauggguagcaccaacuccggacauuugcaucacccauggaugcaagcuggcuaugggcacucagggaaaagucaagacacagugugcagacaacaaaguuggggugugaagccagagcaggucacaggggaugcuggaggggcuguacuuucucuguacucccucuuaggguguuauaaacacaaaggacacaucagagaugaugccacugaguguggccaucugcagacagagcaggaacaaggggcaaagcaacagaguugugcccagagagcaguggcacccaccuaugaugccagccagcacucaagggcacuagcuggaggaucagcucagggccagucucaacacagaauguucuaggccagccugaacuauaagagacccugugucaacagaggaaaaugaaacauacaaacaagacaacggaacacacagacugaagucuaugaauaaucaguugacucugucauuuaaaaauucacacaaauacaguauagugagcacaucuuuaaucccagcacucaggagggggaggcaggugaucucugggaguuugagggcagccuggucuacagagagaguuccaggagagccagggcuagaacagagaaaacuugugccaaaaaucaaagcaaguaaaacaaaaaggagccacaggcccacacggccucacugaaaaacucucagacacacuuugugaaacgcacucacagccgcugccccacucugaaaaaaagcaacuucaacacuuccacagacagcguggaaacccuggugugaacacaaaaacaacuguaggccucggcccugugagcacacacaugugcaagacggcauggaagagaaagacacucguguaaggacacuucuggagcaggcagagccugcacgcauggacgaugaucacccccugcugcccaccgcagaccuaggcucccuagacccucauuuacuuacacugcaauccauucguauguaugcuuccacuuagagccuggcuacgggugugccuagagcccauagcugcgcauguagcagggguucgauacguagggucucccucaagacacaggcugaugugucuuaggcugggucaccagcuaggcagcauuuauaggagccagaacccagaggaugccaccuuuugccacaccagccugauccggagcacacacuggacacccaacaacucauucucugcuaaguaacugaggucagcagcuggucagagcagcucuuccucugccgagggaggcaucagcccugagcacugucucugagcauggcguaagugagaagucuccauggucaccuggacuggccccacaaguacagugagacaagaaaaaagaaacgagacggcucagcagguaaaggagcccaacaaucuaagucuuagcccuggaacccccucgggagaacgaucccgcccgcacaugugaaugcaugcauacacaugcacacauacaaagcguagacgguguguggauaaaaaacgugaagaaagaagcuaaacugucuccagcaaaugacauaaaaauacauaacaaaccucaaagcaccagccaggcacugcacaaauggacagaagauagaagccaugcugacaucaggaaggcaggcaggcuacaagcuggggacuaccaggaauagaagugacccaggguugucacuccuacaaaccaggaagugcaugcacugcacagggauagggccacagagcagggugcuaacaaggugggcagaaaccgcaaugccuacacacugaagaacucgccaucgaacuagggacaaugugacaccaaccaagagaugaacgugcaacugaggaacacguaagcagcauacacucugugggcaguccacaaaugcacuguugcacaagcccaccagcucugggcucaaggacacaguaggugcuauguugugugccugucuccaugucccauccugggugucccugagccuguagcuaaggggucacacccuguacauccacauccaggcacucagccccuacaaugucccuggccccagcugcugagcacagcaggaagugaucuaugacaguccuggcccugcucagggcaaaaaguccuaacaggaagugaccuuccagaugaaggaacaauuugggaacacaagagcagcaaguauauggcuuccggggcaggcccacucaggaauggcacuguugguagugcaauagagacagagggcgguggggguagaaaccauggccugggcaaggcuguuacccgagagcugggcuaauggugaacuccgcccacagacagaaagcaggaccuuucaaaaugccagcuguuccuggggccccugggcaggaccccacuaggucuccugaaacacuuacucuugucacaaugucgguucaagugcaggauguugaggucagcuuggaauugaggcccuaccaugaucuccugcagagacaaaggcagacucagggucaggaagugaccagcagacucgaagcugggaccccaggggcaccaugggcuucaagcagagguugucacaaagagcugugggucugccugccaacgcccacuuccauacuguguggaugauacagaacacccugcugccuggcccugcacaccaaugcaggacacugggccacaucauaggcuuaguccauccccacagcagcagaaucacagcccagguccacacacacaguagggcccuccugucucugagauaggccucaaagcccauggaauccugccagcacgggugauggaauaaccacgcagccccacaggcacaggugaugaagaguaaccacacagccccacaggcacaggugaugaagaguaaccacacagccccacaggcacagguguugaagaguaaccacacagccauauaggcacaggugaugauggaguaaccacgcagccccacaggcacgggugauggaguaaccacacagcaccacaggcacaggugaugaagaguaaccacgcagccauauaggcacaggugauggaguaaccaugcagucccacaggcacgggugaugaagaguaaccaugcagccccauaccuucuugcacuuguuggcaggaagcgcguccucuucagugucagaggaggcugaggagccugggccauuaucaccagccaggaaccgggcugcaggcagagaggcagugaggggcacccaccaggguguggcuggcucuuccuagggcccuggauggcaacucaucuugcagccccaaucccgcaccaugagcacccagcugcuagagcuguccuggagagcaccugacagucugaagccaccaccccuaaacugccaggcagagacccauuccuaucucacucaauccaaacccacucugugacagcucacagaaccccaacaccacuaugagucaccauggcaugucccugcaaagcccccaagcccaguccaugugugugugccuaugugacacacagccaugacggaggaagggccagugacaccuacacccacucugguuauggaagagguccgaggccucaugggaggugacagacggggugaggucaucagcggaggacuguguuucuuccucuucuuccccagaaagcaaguccuuggcuaucugcuccuuugaacaggacaguaaacgaaguauggcaacuguuuuaccaacaccuaaaaccaacucaaagggccaggccugccggggugaaggggacagagacggucagcuuaagccaccaucuguguuggacugagguguggacuccgccggcccucuggggcuccagcucuguucccagacacaguuccccggauggcauccaucucccagaccggaacaggugucaggccaacccagaguaguucccccauccugggacugggucccugccacucaccuuguccaaggucauguccggcagggcuggagccgugucaccgccuucacucuccugcucagagauggggucugacgacucguacccauacagugcaagcagcucguccaggggcaugucacugcucugugaaggaggacagggcccaucagaagaugaagccuaggguucuacuaaccuccgaggccagguccucuccucacuccucagcaaguccccaugggacaguacaccaaagcucucaggaacagagcaggcucugaggcagggccacagcgcaaaccaugugccuggggcuggaccacauggagcccaaggagagcaacuggacacagucugguggguccccauaccuggucaaugaaguccuuguccagcuccuccuccggcuugucaggacacugcggggccucagcacacccuucuuggagguuguaguucugcgucaggagcucagcaagguugaacugauggucggcagagcccauggauaccacuguggaagaauucagcagguaggcagggugugggaucugaguggagauaggucuggagaggcaccagugaggucugccucacugcaucuggaaggguguguggacuagauguggguaggucuggagggcacagagacugggcaggaacagauggaucuagaaggacauuaagccuagaagaugaaaggcaucagucaggugacaguggacagccauggaggggucuggccccacagccacaaccuuggcucccaauauacacauggggcacacaggcaacaccaugcaugucacuguaggagcaccgaguucugcuaucuacugggccacggccacaugauguuuacgggggcagaggccuauaacacuucaccuucuugggcccacagcaggugaccagaagacuauuagacaccuuaaagccaccaggcaagcagccaccucaaggagggcccuccuucaugguuagcuaagcauuaucccauaguuccaaggauagggagugcccugaccaugugaaaaccgccaacugacugacagaggacacugggccuuccuggacccaugccugcucagucugggaccugcuaagaaagaguucugccugugaagaucugggacagagggggugguaccugccguggucugcaagcugggcucccgaggacacaggcuguguacaaggcaggaggccacacgaggacucugccucuccagagaggaggccugcaauggaagagaagcaaaucucacgcagcucccgaggcucgggugagagccagagccacuggguaaucuugaggacgccaggggaagcagccugaggaccguccaaucacagcuccaggguggagggaccuugaaaacacgaggcugggugacagauacagauguagaaggauacacuuguaacccucuuaacagaaaacgccagaacaaacaaagcauagaguggccacgaugaaagcagaggcugagcaguuccacuggacaccagggagcccaggguaaguggcagcacacugacugugggccuagacacuccccaacuccagcaacacuggccaaggcuccagugucacugcagcaggccuaaacgccaucuuguucccacacugcagcaguggacaagcccuagauuaaggaagagccccucucacagcaacuaggguguacacagcacaugcuccuaggaagacagccaugcugacagagagaauacugguaccagagaaaggagagccauguucccagccaaggucccuaccccagaaaauggagaaccucugaaguggccuagccaacaucaccugaauuguagaaacugacaagccaacuccaaaccguguacacggaaacucgaagagacccagaagagcgacaaccauccuggaacagggugcuccugcuuucagaaaugaccagagccacagacaucucagcacgguggugugggcccacagauaggcacaggccagagacacaaaacuggaaccucagagacaaacucccugauggccuggacacacaaguccaauacaugugaccaaaaaaaugcacgacagaacucagacuggugaggaaacaccagcaaagcacacaucuggaaagcagugguguguguagagaccgcucgcugagcggaagucaaagucaucgggccagcuugcaagcaucaggaguccugagcuucccucaggaugucuucccuugaagacaggcauauggugagaagauucggagacccuaucagaacagaacgcacgguccacaagugaaaaggugaggggcaucagagcccaaaugcuaagggucaaguauguggcaaagucacaugaccauucccucagucagaagugggacgacgacauccaccugcugaagacaggugaaccaaacaaagcuacaccacagaguuaccacucagccaagagugagugagugagugaucgggguucucacgugcaccaccuaaacaaggcgguaccuugcaagcacuacaaaccaauggcuacaaagaccagaaacaccccacauaagugaagcccagacguggaaguaggccuguccaggcugagugacugcccugacagcagggcuuccuucagagguaauggaaugcucacaaacugaguuuacacacuaaagggagacagcacgggguguaccucagcaaaaacaaaaaagagaaggaaggaaagaaggaagggagggagggaggggaggggggaaagggagggagagaggggagggggggaaagggagggagggggggaggggaggggaggggaggggaggggagggggaagcaaggaaggaagcaaggaagggaggaagggagaaaggaagaaaaaagugaaugaaugaauaugggcuagagaaauggcucaguggcuaagagcacugaguucaacucccagcacagaggcucacagacauguaacucuaguuccaggagauucugcacccucuucuggcaaacacucauaaacaaaaauaaagggguguguguguguguguguguguguguguuguguauuucaaaaguuaaaguuuaaaacuuagaacacaguaguacuggguccucagaggucagagaugagguacucauccaccccaaaagagaaacaagaagccuaaagcccagagaggucaaguucuuacucaagcaacaccaagaagaaccuccaaagacacgcagccaggucccugcacugagcacugcaccaugcagugagggagcggugggggacacagggccacacccuccugaagagguuccaggaaacccccaaagcucuaguucaacagugaccacaacccaacaggcuuuugagggugaccucccccuugggggcagagggcuaaacaagccgaugaugagggggcccaccugggacagccgcaggggcacucauucgcccaggugucggcugcguucaaaccuugggacauggacauggaccagccccacaggcuaacaucgugaagccacagggaggaagcccaggugcccucggaaucaugcccagcccucucuagcucccuauggguggcugugggcucugcccagggacuggcucucugucccagcugucaggaacccuaacuuagaggugagacaccacaggugcaugacaagcuagcaauagucccaaagucucacuaucucgacagaaugggaauagccuccugcuucauucaggucaggggucaggcauccucaguaggguggagccaagcaagggugaaagcagaaaggagcugagagccgacagugggagacacagccaaccuggggaccaugcagccugcuccuugccaacugggccaaguucaucuccaggugacccucaagguccccaagacugacuaaggcauagauaccaucagggucacuggacaaccaggcacaucacuuuaaugccgcuuuaaagggggguuuccaaggcccuauuuccccauguugggaaaacucaaagaccagcaaagucccugagaucucuaugucaggaggaagcagggaguccagccuaagaugauccaggugacaacaggacaaacacuuaaaggcugguccccaagcaagaggcaagaaggucccccagcaaggugucugagaauagaggauacaaaguaaguuagcauggauaccgccacccugccuucuuagcuaggagccuggacacagcacugguagcaccccccaggcaggucucccagggagacuccggcacccagaucuagccagacugagacuacagaaggaaagguacucgcucaggaagccgcaucccucgauuccaccuagcaucuuuuggagcacagacuccaagcugugaggaagcccaagccacacagagaccucacgaauaggguuguagcccacaccccaaaggggcagagguuucaacauuaacuccuacaaacugcaacccacaaaggaccccaagaauuaugagaggucagaacaagugaauacugaguugucagagagcauucucaagagaaaugacccacauccacaccuaggcaagggccccgugccccuggugucccagccucgccccuccaccguggcagcuaggacaucccgagagacggguucagccugucuccacccacauggagcuaggacaugggacaaacaagggagcuaaaccaagggacaggaaugaagaaaacgggugggagcugggcagcuggggucagagguggcguccuagagaccagaugaagugggacaacugacaggcaacucuguaggaauuccgacuacaagaaagaaacccaggggcuggauggucucaugaggacugcaaaggauaggcacagcgaagagguguggcuuagacuaagaacgggacaagccaccagcucaaagagauggcugagacacacacuaaccaaguagcugacacugaggacuucuauguaaccacugccacuuucaugaguucaaaacauggaugcagcaaaacacccucucaguuauagaaaggcaccaccagguucccacuuaagaugaggaaacugaggcagaacccuuccaaauccuagacuccaggagagcacguaagcacaggcuggggagucuccaccacccaugccacacagggcagagcagcccaagagcacccacuuggccgccaugccccaaaagggguaucgguugaucuaucuugucuucagaaggucugcuuccccaaaggcccccuaaagaaggaacuaaaccccuaagaacccucugagucaaccagccagaguuguccaacggggcccccagaucccgacccuguggcccacgcgcgggccuguugcugccccaagcugccccacucgcgcacugugcagaguuccaguaccggaguggcggauucgcagcgcgucgcugggggcuggucccggaguucagcggccgcaccccgaggugcaggucagcucugggcugugcgccgcagccccgcacccgcggggaggcccgcgcucucgcucccacagccagacgaacuccacgcgcgaaacuuuccgcucgcagagagccgccgacuccgcgcccugcucauccccaacgcgccggaaugcgguccccgcgccgccgucccagacgccagcgccgcacacccacccgguccgcggcgcccucccgccgcgcggccccgggucucggccccgcacccggccgcccgcgccucgcgccccucccccccgcccgcccgcgcaugcgcaccauagccgagauggggaaggggggucgucgggcgcccacggggcucaugcuccgcccgguaauaguggggaggcucgaggcgcucggacugggagagcacgggccggaccaggucgacccagggcagugugugggaggggccgcuacccagccgcucacucaccuccgccauggccgagcgugcgcgcgggaggcggcggccgcgcggguccccggaugcggugccgcgcgcuuauuggcggaggagcugggaggcggaguggggcggggccgcaggaggcgcguag

SEQ ID NO: 5601 - RNA, 7641 nt, Mus musculus
ugacacacacauggugggguaggucuuuauuuggggggguuccagcaggcccagcccccuccaacaguaagucagagcaugcacuggccuucccuccugaccaaggacaaggccccauucccccacuccacagggcuguagugacaacacuucagaagggaaggaaaaauaaaaacauaaaccccuaaggaauggauugucugcauagaaaccucauuuaguuuaaauuagaaacaggggcugcaaguggcuugcuucuuccagguggguuuucuguaagguaaggcucugucuucacuuggguugggauagguuggguuggguagguucaaaucgggacaggaugggauacuggaguggagguagacgcuggccuggggucaggcacccugggcaccuccccucccccgccugccccaccacucagguggcguuccucuggcguacauucuuguccuugucauucaugugaguuccacugcccuuccuggggauacaaaacagggcucauuacucuuaacaggcacagggcuggccucaaccccacugaaaucuggccauuauuucaacagcagccauccaccuucccugaacuuacugaggccuaugaaagauggacacacacauugagucccagagcaucccccauuucuauaggacacacagcuagcuccccagagcccacaguggcuggacuuacaguggggcggcgccagggucauccucugcagccaggagcagccacaugaaagagaaaggacaugugucagggcucgugugaacuuggccccacacugccacccucauggugcugcagaagugucguacaucagaugaucaacacauggugaggccaacacauccuaccccagcucgccaugcaguguacagcuagaggcacccacagccccaaguccucacagcgagcuccccagaggacagcagcuuguggccaagugauggaggaaggaggagggugagcuacaagcagaccccacucuccuccagguggacacacugagggcaucccacccacucacccagacccaggacugcucaccguccagggucuggucuggcuuccgccucuucucauagauaaagaugaugguaaccaacaccaggaccucagccacgaugccuaggaagggccagagggcugccaugcggcuccgcacacgcagugagaugguuucccgaguagugcccugggcguugguggcauuacacacguaggugccagggucaacauuuacgucaagguugcugauggucagcugugacuucucaggcguggauaccaccacauacuugccauuggcuucagugcuauuggugauugccuagggagaagggcuugucaugucaugcuagagucuguccuacacugucccagauccccacaccaaagcguccucuccuguguccccucugaugcucuuauccccacucccauuccuagcacccggugccccuucugccgccuccccuacccccauguccagaaccucaugcucccacugcagccugguccuuggcaccacucaagcuccauguccuuagccucacagcccuuaccucuucuuccccagugucagaggucuuaaaccagaaccaaucuguaauaggaggguaggaugcaucggacuugcagaccaguuucgcaagcucucccucacuggaaugcucugauuucuuuccgaccuugauccuggguggcccugugaggaugagaacccugaugcccaagcacguuguagacugcucucagccccaacaccagucccuggccuucacgccagccaccuccuggcccgcccccaccacucccacagauuaccuuccacauugaucucgcuucugcccacaggcucaggaaggaagaugcaggaauauuccccagagcggucaucugcguccacucugcaggggacagagccucggugagguaaggaacucccaaggcaugguggccaccuccccaccagggcucucugugcagaucauagggccuugggcucucucacgcuauacagguaaggccacccagccaauccagagcuguguggagccuggcacugcuacacgucaggauggaggcagguccccauggacagcaucaggacaggguccuuugagcacuguggacucacauguacuucguaugcaggucgggcagaguguccuccugcaguaccuugccaccucucauccagcgguggccaacgaugucaacgccacugcuguucaaagagcagguaagcuguguuuuggaguugacuuccuggacagagguuuggauggugcccgcugaagccacagggagaaagaguauaagcucagcauaguagucagccccacucugugaggucugcuguuggaaucacagcggcugacagucuacagccccagacggcuaaagcaagcugaugcugcacuacaaaccacuucaagauaagagacgcagcugcccaagccccgccugcugcucccacagccaugugguccccucacuguuaucugaccgucacucagaacuggacacuaaacccccagagggcucugcaaagucuggcuggaauuuucagguuugcaguagacagucagagcgaacacuugggcagcagaccccaccccugccagacaaucacaggggaggcaggggaggcaggagagcaggugcauggagcagagcaggacgggaggucagggcggugcacagcagaccaaaggccuggggugcgaaccgaggagccaccuggaagagggcagggccaaccugcacccagcaaggacacugaugaguguucagcucacccgugugcccaggggagucucaaugagugguagggcagagcagcaucugguucuacaaagugggagccaggguuggguggcacgagagguaaacagaaacaggugcccuggccacucacguucaaggaccaccacgcucgccugggcacggacccacuugacccuggguggccgaguaaggugguugcggucugggucacugcuggcccggcacucguaagugccuguguccucugcggugagcccaucaacagagagcgaacuggcugcaugcugacgguaggcggcauggaugugaacacgguccagccgggcaccaucccagagcugggagcagcugucguuuggagcauucccuucaaaccaccacuggaucucggggauggggcugcccacagccucacagugcaggaccacgcugccccccgcccaccgcuccugcgacaguggugccuugaggaaaccagcuaugggaaaggguuaguacccguuacuacaaggaaggacagccaccagggccugccacaggggccaacacaacacagcaaacuccauuucuuuucugcuugcggggagaaguaugaaguuagguagacaacaaaacacaaagggcuggguaaaagugguaaccaccaagccuaaagccgcaguccaaccccaagacccaugcggcgaaguaccugugugcaacuaauguacacacacacacacacacacacacacacacacacacacacacgaaauguaauuaaaaaacgaaaacagaguaaaagccagguguuguggcucgcuuauaaucccaccacuuaggaggaggucuauacaggaggauugcuaggaguuccaggccagcugggcuauguguuuaaaguugucuccaaaaaagaaaaaaacaaaaacaaacaaauacuucaagacagggccucucaguauuacauagggaccuggaacacucagaccuguaugccugccccaaacacauguccugugggaaggcaggucuuugcaugccuacacaaggugugguugcugucuggaaguacaaguauauggguuuaggcuuaggcuuuaggcccuguagugggggugggggggugggauggcagcaggauaagcuccaggaccaagagugacaccuagagccugggaggccucaaggccccugggguaugaacgacacagcagcuuugguagagguuuccugguaaccuacauuccagagcugcgaucugugggacugcccaaccugcaguugcaggcacguggguaggcugagucaggaggaggccacagcagugagugcccuuucccuuaguccccuucccuguuuacugcuccaggaugucuguaucaacuccacuccaucuaggacugucaggaaagacggaugcccugaagaccccagccccagcuagguuucugaagagacacuauacugugggugucaucagucugggacauggcuaccauguucccaaggaccaugcgccuaauggccacauuucagcccuuuuaggaccaacuaaaugacccauaaucuagucucaggaaugcagggugcccugugguacucccuugacaucuguccaaccuucccacacggagccuagcuagcauugcuuagggguaaccacuaacuaugaucccaaccccaggagccuccacagcuuggccaugugacuuguagcccacagcuugcagcauguccccacagucccuccuuccugccuacuggcagacaggugagagcagggccagccugaggcauuggguaaacaagccagcaccacagggugcagggagggaggggggcacuguucuagagggcagcccacaggcagucuccugcuauccagugcugacccaggcuguuggcuugucaccucucucaccaugucaucuagaagccugaggaauuauuaggguuaaauuagaucuggguaagcgcugggguaacacccugcagugagugucugaguuggccuagccagggaggccagccuagucacucacucagagcaagcaugcgaaaucagggugugaagugcuuggagcagccugaagagacccuaauaucaaauucagccucauaaucaggaaaccuuaaguguccaugccacaggguagcccucugagcagagccccucccccacugcauagugggaaacacaucacugguugaccugggcccugcccaggcuguaggcuaugggucuguucccaggaaagguuaggaccugcccguaagcuacacucugugcuuggcucccgggcauugcaaaggucuguuuaaccccaggcagaaagccacugggccugugcccagccaggcuuccuacccaggacagaauaaaucaacugccuccaucucaccaggggacagcuaucugcaccaagagccagccucauggaggcaccucaagauguuuugauggugaagaagagggccuggaaaaagugggucagaauuaacgccgggcacugcugccagggacagccccuccuguaccugcugaugggggcagcagucacauggcccacuucuccaguggagcucuggcucugcccuuugccugcugucuggagagggcaggagagcaguccccauguguucgaggccuaccacauguucaaccuugccaugacccugaaucccugccuuccuaccucagcugcccuuuugagccuucaucaggcaaggaucuaaggccagaaugggccagacuccagggugggagcaagcugagugugcagagcccuggccaccagaaaucccaccaggaaugauaauccagcaagugccugagccugggguccggagccauucgcaggcacuggcucccagggaacuccuagaccagccugaagcucugccucagcccagaggggcagggacagguggccauuacagggauacagccccuguggacuauggagaaccugcaagcucaccccaaggaggacagggacagcuggggacagcugauaaggacuccuccaaaccuaggggcgggaacugccucucaggaacuccucacccaacccucacaugugagggcgaguccacucauccccagcccuccaagccuacccaucccugggcaccucuuuaccccaagaacccacggggucaccucucacccccuuuccaauccacauccuccagagaccugaggacauuacuaauaggcaaugcuaucccccaccaacuucauccucuucuuucacauuccccaagcaaugcugugcuccuucacuaaguagaaacagcaaugcagcagcuuccuccacugagaccuuccaauccuuucuccaucccccucacaucaccaaacaucaaggaccucccccaaauuccuagucaccucacuuccacccauaugcccaaacuuguggaccucuccccaggcacuucuguaccccaaacccucugaaucaucucccugccuggucccccaaguauggacacccugaaaugguagcuccuccuacucuagucccccuagugaccccaaaccuuggagacagccuuuguaggaaagucuauuucgcauccuccccuugcccagaugguaacacuaaaguaacagaccucucuaacuccaugcccuccuaaauuagggacugugacccucacucuguucccugaguggggacaccaagacugcaguuccuucgacucccaggucuuccaaauuugggaucuccccaagguggcagcuucuuuaguccccagaucucuccaauccuggaggaagccaccugcaacacugcugucccucaccccaggucccacaaaccucucucagauguccugccagaugucccucuggcccaugguuacuuuccagcccugucucucagguguggaacccucaacgugcugacuucuuuuaucuucacucucccaggccccaacaccaggaggagguaaauuacuaggguuccguuccagcccugguacgcagguggagacaccaagaugguccagacagcucccuggccacggacgcccucacucacguuggagauguugccccagagccuuacugucuuccagcgucagggucaccucuucccacaccuucccuaacuccccaaaaccuaagccaauuauagucauuguuguauccccaaaccuucagggucacgucccagcccuauuccgggagcugggacaguuagggaagcggcuccuuccaucuccagcugaccaaaaucuggggucaucccauucacuucuguaauccaaauccauccaaauuaccuuccagcccauguccugguggggaccaccacaagguggcggcuccuuccaccuccgguucccacaaccuuaggacgucucccccagaguccuaaccuuugauuugucucuccagggccucaucucuaagaucacuccccuccaccucgaugcccagucgaggcuagguucaacucgagggucacccacagccacuguuacuccuccacaaucuccaagccucgagcccgaguagggaaccaccgaguccccgaaaucggaggcucaccuuaaguccgugaccccagcccggucccagcaccccgcucuuacccgccgcgcaggcgccuuggccgcucaagagcgugaaggccagcgccagcagcagcgccgccgccaugucgccucguccaggagcugccccacugcggcucuauaagaagggcggggcgcgcgcacgcaggcacgcacguacgcacgcacgcggcgucgcagggcggggcgccaggcacacagggaguaggcacguacccagcguccgccgcucccgcucgcgcuacaggagcggagcgggugga

SEQ ID NO: 5602 - RNA, 10461 nt, Mus musculus
ugcgcgugcgcacugcgggcagcaggcggcaugucggcgcuccgguggacccgaagcgcagccgggcuuggccggguucugcgcuccccugggccccaccgcccgccuucggaggaagguaaaggagugucggauccaggacuauaaucuucccuuccuuaggaucccggucaccuucaaccuuuguucuuugaccuauggaggaguuucuggggacccauuuagcugggcacuaguuggcaacgucucucuagguccgcagggcacuuugacuuuugauuguugcucgcuuuuccaugucucugacccacuguuggggacuuacggauauuggcauugaccuuuggcuacuuuuaguuaggaguacuucuugcuggauccugcaccccgauccuuauagcuuuggccuguucugcccuugaaguuggucuuuuucugggucuggauuuauuugugggcggggcguguuuuuuuuuuuuuuuuuuuuuuuuuuuugagccaugguguuuccaugugguucaugcuggaugcuuuauuugaacucagguccuacugcuucaaccuccugaguucugagaucccaugccuggcaguccuugucuuuugauccauuucuuucugggcaugacguaaguuugaggcaggaacucacacuagcuuaaccuagaacuuccuuuguagcccaggcuggaauccaauuggagacccucccaccucagccuccagagaccugggguaauaagugugcaugccacgguguccacuugauaggaugguuucuguguucuuauucuucaugucucuuucuagggacuuuugguggcuucugcagcucaagaaggagcuccgcugccaguccccgugagcaacauguccugagggaguggggccaugcugaacugcuggaagguaaguugguguccuaaguccuucuccacagugaagccuugagggagugugcucugcguuguaccugaccacuccaagggaguauguaaaaugggguccagaguccacugagcaguguugucuggcuggccugucugugguccuguggguccucuugugcugguucugggagcugcuguaauuccauucccugaguuccagauucccaccuggggcucucacuucuaggaagacaguggaggccccaaauacaccugaacaauaccggauuugcauuguuggaaugcugacauagaagucuccaguuuuaguccugcagagucgaggugcagcuggaauccagccugucugccaggccugccugucugucuuccuuccuuccuuccucuuucuuucuuucucuccucauuccucccuucucucuuucucucuuuuuucuuucuugguuuuucgagacaggguuucucuguguaggaaguccuggcugcuuuguagaccaggcuggccuugaacucaggucugccugccucugccccuggagugcugggauuaaaggugugcaugagccggguaugguggcgcacgccuuugaucccagcacucuggaggcagaggcaggcggauuucugaguucgaggccagccuggucuacaaaaugaguuccaggacagccagggcuacacagagaaacccugucuugaaaaaaagaaaaaaccaaaaaaaaaaaaaaaaaaaaaaaaaccaaacaaacaaaaauaaaacaaaauaaaggcaugcacgaccacugacuuuggaacccaauuuuaaguguuuuacuaccaagucuaguagacgggauguccagauuucccuccugauccuaugucaggucugcauggcagcugcagaagguggagacgcuuagaggguggguuaggagguaaagacaauggucuaacuguggcuccugucuacccuuagcagcaacugcuuccugacucacguuccaggguaugucaugcuggaaucugucauuugggcagagggaucugcagacuuaguguguggcgccugcucccucuuaugaggcuccuuucugucagggacagaaggcagugcuuugugggccauggagcuuacagcagcuauguaacucuucuacuccugacagaccaaccaguucugccccagggccuuuuugcacccuuuugucucuugggucccuucagaaagaagucgguguccccgucugccaccuguuugcuuugcagguggccucacacagauguguccucugccucugaugugcccugagugccacgagauguucacugaggcaggaucuccccagaacucugauccucucgcaugcacugcacuccucccaacuuucguuuuguacaccugugagccaggccccugccucacacugaccuugggccagggacuggaguaccgggaggggagacaagcagcuggucuuggcaaccagcgccugaguuguagccuuauggcucagccugccuuguuucugcgcucaccacuaaccauggcugucugcuugccaagacccuggccagucuuuggccuuuuuaugugcaaacuugguuacugcugaaagccauacagcaggggccuccuuguauggugccagugauugccuuuugguccuuagggcacugagucacggauguuugcgguuucuaccaagcuguaucaaguaugugccuguaucaaacugcaggcuacuauauauuggccagugaggucggagcccuuaaggcuggcggagugaaggagggagaagcagaagcaggugacagccggcaggaggugauaggagggguuggcaggcagagccgagggcauggugacagccaggagacuguguuugggaugauccugggguagacucagagcauccugagcugcaggagugguucauacccuucucugcucucugcagugcuggaggcucgggugcggcagcuccgggcagagggcacaccugagaugagggugaagaaggugcagguggaccggccuccacagggccacagcagccgcugggcgcaaaagcuagaggcugagaaaagggugaagcagaggcgccaaaaggaaguugaccagcagaagcaagcccucacacaggaguucuggacccuucacaaggagcccaagaucuggaacaagaagcuggcuggcuaccugcagccaagcaagaagggaacacccacgaacucagaggaaaagcagcuggcccaggcccuucaggcugcucuggggaggcucagcucccgugaggcagaggcccuggccaggaagaaagccaaggcgguggaggcgcagauccugguccuccagcagaaguuccuggcuuucuuugagugcugcgucugcacuggccaagugccccucgcucaccacgugcuggucacucaccauaacaacggagacagacagcaggugcucacacugcacauguacaacaccgugaugcuuggcugggcccgcaaggugagacccggcccaagggcugcuuccuucccaugggguaaauuccuuuagguuuuucagagagaaaacgcucuuuccuuaaaaacgaacaaacaggaaacaaaacaaaaaccgauuggaauauccaggcaugguggcgcaagccuuuagucccagcacuugggaggcagaggcagguggaucucugagaguuagagggcagccuggucaacacauuaaaauccugcuauccccuaaaaugaaggaggagauugggagggccugaguguaguucugugcaggacuucugagucuccugugcaggggcugccgcugcugucccaguggcugcuaagccuugugggacacauuccacgcuccaggaugggagcgcuugcuucucuuuauuuuuuuuuuauuuuuauuuuuuuuuuauuuuuauuuuuuuuuuugguuuuucaagacaggguuucucuguguagcccuggcuguccuggaacucacucuguagaccaggcuggccucgaacucagaaauccgccugcuucugccucccgagugcugggaucaaaggcgugcgcuaccacgcccggcgcuucucuuucugugugucgcuuuggugcuaugagagcuguguguccucaguuuguucccuaacaucuuagcaguguaggagagugucagucuaggaguucaaagacagaaaagcaaaauaaaaacaaggaaaggacagagcaguagacaggagacaggucugugaguucaaggccagucugaccuacuuagagaguuucaggccagccagggcuacacagugagacaaguucucaacaaacaaacaaagaaccacaacaaaaaccaagccagcuauaaaacacaaguccugaagcuguagcuuagugguagagcauaugccuggccugcaagaggcccgaguucaguccccaaugacgcagugucccucagaaagaugcccugugucucaccuacugccagauccccccucccaaauuacugaggauuuuagggaacagauuggucaggguccagguguuguucuugaccccaccuuguccccagggcuccuucagagagcuggucuauguguuccucaugcugaaggaugcuggccucuccccagaccugugcuccuaugcagcugcacuccagugcaugggacgcagggaccaggauguucgcaccauccagaggugggucaggaaugugcuggggcccugcuccccccaccccaugcucccaugcuaaguuugcacacccccacccccaccccuguauugccucaggugucugaagcagaugauggaagaaggcuuccagccccagcugcucuucacugaccugguccuggaagaggaggaccgggccgcgcuccugagagcaguggucaaggcugagccugccuuucguccaccgccacaggccccaagcccaguuaacacauccacgcugcucaaggacauauauagcaaggugagucccaggcaagaagucaugacagccuguuucauucccuccuugcaucaggcacauguugguccccucagaggagcacccccaaauccacuuccucuggauucuccuguucugggcguuugcuaucauagagcccuagucccuguggccuuuuguaucuggcucaucgauuacaguguccucaaggucccuucacgcugcggaauauguuggaagcucgcuccuacucauggcucaguuguauuccaguguguagauggggccuccuguguauccaucaucuguucggggcauugggcuguuuuuacugggagucaggugucugaacucuuaguacucuggguuuuuacuuugaguggacaugcguuuggcagggggcuucuugacaggguguagugcccacccucacugccuccugugcccagcaggagggcccuguguccuacccaaagcugcaccugccccuggacacccugcaggaccucuucuaccagcagcugcauguggagcugagcuccagugucuguguccagucgguggagaaggcuccaguaauguccaaggaggucauugaggcgguaagggucucauccugaggcuguacccaucauggccaguaggggucggagcuaugaccccaguuggggccuugggaggucuuggcagggggcuuuaagcucagcguguugacagcugcucuccuacagcggaagacccugcaggcccugcgggagcagugggaaguggagcuguugcgcgugcugcgggagacaaaggccacuaugggccgccaggccuaugaaggccagcccacccucuacccguuccugugccugcugagcgaaggggaguuugugagcauacugaugcaggugggcugggucuggagguuccugggcacagggcagauggcuguguucaggcagucacagcucgcgauccucuugcaccucagguucugaagguccugccugcgcagggugagccccuuauccaguuggcccauaaccugggccuucggguguuaaaccggcauuuggugaagcagaagcaggucacuaaccaugugcagaagcuggggcagcgguacucgcaguaccuccagcugcuggcgucugacacccagguaacgugggauggacuucuggugacccagguggcucccuuggagacauccccucccaguucacuucaccccacuugcuccagguuccacccaggucccuccccaccacacuccucaggcgccccuugccagcugcaucaguccgucugagccucgguucccucuggaaaacgugggcagccccacagcucaccugaccagcuguccuuacagguggcgcccugccuuccucgggaguacugggaaucgcugggcccacuggaggccccugcacaacagcccugguccgugccagugcugcuacagcugggcaagcaauuggcggagcugcuggugcaggcagugcagaugccgcgcagccuggcggcccggcagggugcucagcgcuccaucccagugcuuuaccauguguauuccuuccgaagcuaccgccaggugaggcucccagggccggccggcgccuggaugggacauagggcagcaggugucugccauccccuccgugugggauguguguacagagcaggagggguuacaucagucuagggcuuggaguuuucuguucucccugccugcgugguccguugcacagaggcacuggcacucggccucugaugcauaccauuugugucugcuuccucucccaggugggcauccuuaagccucacccugccuucacgcaccugcuagagacggcagcagagcccacacugaccuucgagaccacggaagugcccaugcugugcccaccacugcccuggacgucgcugcauucuggugccuacuugcugagcuccaccaaacuaaugcgugccacggaggguaccacacagcaccagcgucugcuggagcaaugcccuccugcccagcugcacggcccccuggaugcgcucacacaguuggggaacugcgccuggcguguaaacgggcaucugcuggacuuggugcugcagaucuuuagagacaagggcuguaugcccuugggcgugccucccccgcgcucagaagcaccgcggccggcccgguaucagcugccacccggcuccacaccagugcacaagucugagcugcggaaggagcuggcgcguugccucaagguggcucgagagaugcacagucugcgcagcgaggcccuguaucgccugucgcuggcacagcaccuacgccaccgugucuucugguugccgcacaacauggacuuccgcggccgcacuuaccccugcccgccacacuucaaccaccugggcagugaccuagcgcgugcgcuauuggaguuugcugagggccggccacugggaccacguggucuggacuggcuuaagauccaccugaucaaccugacuggccucaagaagggagacucgcugcgcaugcgccuagccuucgcagaugaggucauggaggagaucuuggacucugcagacaaccccuugacgguauggagucacgagcuccucucgcuggcagcccucaucucugccuccugucuuucucuggcucugccagccugucauccacucaggcuugggccaccucccucauaugcuuucaacccuucaccacagcuaucugcauccuuccuucccacgguguccccucuuagugccacuaguggcucccuagcccagcagcagcugccagcuaucacccgagcagccuuccucaucccccuacaucacacaugcuugccuagugucccuacgucccuguguuccacugagcugcccaggcuggcuugugcugacucgauucccauggauccuacccuccaaagggccggaagugguggauggaagcugaugagcccuggcagacccuggccugcugcauggagguggcacacgcaguccgguccccagacccugcugccuacauuucccaccugccaguucaccaggugggcacgcaaguggacugcccauggcugagcccgaggugccuuaggaacuggcauuugcaguugggucuuaccguaaacugggauugcccugugggacuagucucuugauuuaugagggagguugcucccgggucuccuugcaccaggugguggaauaaguuucuggggugaccugugugucccuauugggucauuuggccucagcucaugggcaccccuuguggucaggauggcuccugcaauggcuuacagcauuacgccgcacuaggccgagacagugugggugcugccucagucaaccuaacgccguccgaccugccccaagauguguacagggagguggcaacacaggugggugccaggaaaccccuccuguccccacucgggguagccuuucuacaagugaugggguccuuaguggggaggggaggucacguaauggcuucccugaccccuaaucccauccagguggaggaguuccgccagcaggacgccaaggagggucuacggguggcucaggugcuggagggcuucaucagccgcaagguggugaagcagacagugaugacggugguguauggggucacacgcuacggagggcgccugcagauagagaagcgccugcgcgaacucagcgacuucccucaggugugcagccugcccuguccucacccaagugugacucccuucagcacagggacucugagccgggcucuucugaaccguucuaguccuguaaagccgcgguucuggccccgcccaccugccauucauaucgcaauguccccacaggaguuugucugggaagccucacacuaccucgugcgccaggucuucaaaagucuacaggagauguucaccagcacgcgggccauucaggugcgucccugccagcccucucccaucugggggccccuccaccccacagcucacccacccaaccugguguacugucacacccacagcacuggcugacugagagugccaaccucaucucucacgccggauggccuguggagugggucacgccccugggcauccccaucauacagcccuaucaccgcgaguccaagguccagguacuugggaaaugcccuucuccuuuucccucaucuccccuccucccugccaagggcuggacucaccccuccuccaaccccggucugcagguaaaagguggccuccagagcaucacccucaccagcucgguagaugagagucagugaguccuguacugcggggaggggagaggauggagggaugggcaggaaaggcucugggcuaagaggguaccagccuacaauuucuguccacaggaagcccaacacucugaagcagaaaaauggcuucccgcccaacuucauccacucccuggacuccucccacaugaugcugaccgcccuacacugcuacaggugggucccaggacgaagugugaccaggacacagugugggcccagcagggcgggcaggcaggcaggcucuugcuucaggugagcgcugggucuagguuucagucugugguauuuagcugccuggggcaugccagccuuguucugcuuucuggggacauggacaugguagguacccccaugaugaggggcaggacaggauggaggcacugcuggaaaguugcgggaguccuuggugcagacaggggcuucccuuuacuccaagaccccgcagcuguuugagggaauguaagccaucuucuugaacaucuacuaccuagagcacuggggaaccaaagguguccagggaacccuggcagagugcccagugcuggggcagaugacaggauaucugucagacgagguucaggcaguagcuggccaagcaacuagcuaucucacucgggaucucccugcucaggaagggccugauuuucgucuccgugcacgacugcuucuggacacaugccgcugacauccccacgaugaacgaggugugucccguccgucccgucccgcccccccccccccccccgugaccccacaaguagaaaauggggccuugauccugggaauuuguaccauggcugacuccgagccugcaaccccucagguaugccgcgagcaauucgugcgccugcacagccagcccauccuggaagaccuggccaaguuccugaagaagcguuucugcuccguguccaggugagauacccccucuuguggccuggugcccugccugccaccugcugccgcacugaugucuacccuaaccuguuugcagcaucaagucccuaaaguccucggagcgcgcccuggucaccaagcugcaggagacacuacaguccuugccaaagacagguaaggauuuaaaggggacaugcacgcuggccuugaggaugaaucaguggcccgagccuaguucugcacucuuggcuuuacagguaccuucgaucuaggacaggugauaagauccaccuacuuuuucagcugacccacgccaugcggucccuaaaccugugcauaauguaaauaaaugaaaguuugugucuaccuaugccagccgccacuuucuggcggugcgcaaacccaccaaaguaaugaga

SEQ ID NO: 5603 - RNA, 4725 nt, Mus musculus
uuuuuuuuuuuugggggggacaggguuucucucuguagcccuggcuguccuggaacucaaucuguagacuaggcuggccucgaauucagaaaucugccugccucugccucccaagugcugggacuaaaggcguacgccaccauugccugcaaucagaaacucuuaacugaaaaccuaacacuagccacagcucuuuuaacuggacguucuuccccuuagcucugagccuaccuuuaccaugccugucuccagcuauggccucugacguacaccugaaccuccuucacuguggcccucccuggcuuuucucugaccuugcccuugcugaugugccugucugcaccuugagccgcagccauacagccaucuuacuuggauccucaaccuggacccagacugccccaacucuaagaaaccauaaucauggcugagccagacugccugugaccuugauuuuagucuagacccugacccuugcuugaaccauuaccccgacuccaaaccuaauuguauccuuggcccugcucucugccucccccuaacuccuccucucuccucuccagcaugacagcugcccggucugccguaagagccucacuggacagaacacagccaccaaucccccaggcuugaccgguguagguuucuccucguccucguccucauccuccuccagcucgcccagcaaugagaacgccacaagcaacuccugagucccaccuggccaucccccccgggguuuggucaucccacccaccccaggugccccagcaccgcccgccugcccgcccgccauggcuguggacuagaggugcugcccguggcggccggcaguaccuggcgggccccaggcugcgggcaggcuuggacuuggccauggccgcuccuguuuggaggugugcacgugggucccauguccccagcaggcaggcaccuucaguccgucuuaaccucacccuccaaauguucaacggcagaaggguuuuuaugauuuuaaauuauuacugcuuugaaauaaauggacguuugagccacgugcggccaugcauggucuguggagagucagcagaacugucgccaggcccagcccgccacacgcccugggaggccgggcccagcacccaaccagcgccggccucgggaccacaagggugaccagcagacccaggaacaaacugcuccagcagacaauuuuuuuuuuuuaagggaaauguguguuaucuggaaagcuauuuaaaauacaccuacucaaaaaagcagagcccauggcuuggcgucuuccuucagccaggguguccaugacugcaugguggggcagugcacaggguggguuggagcuucuggcaaaggccugauggaacccagcccucugcagugguugguaggaggcaagaccggaagacuucauccagagcugcuggggugggaagcugccuggugcagcccugcagcgggugaccaggcagugggccuguagucucaucccacacacuugucuuugguucaagugauggacuugcagcauguaugacggcaggccuacauacgccacgccaguauuaccauggcugagcaagucccuagcccuccuguucccaagcuucauggagaagacccagaacaccccuacggccuaaaguggucacugcuuucagcaaugcuaugaccugcccauccuguccucaaguuuaggacaugaagagccuagaggaucaucuuacuucagcccugugcugggaucgcugccuccuacccugucauagucugggguguaagucuuggcuuccgcaggucaguggugcuuaaaugacaaaggcugccagccacaucccacccugaaagucuguagcagaaaggaugcuacccacaggugcugugcagacugccguucccuggagaugcuggagugauagccuuggccuucccuggcaaggaccagagcauccauucugaaagcucuuagcacaggguguguguccugccuccaacaagcaaccaugcacacccaggcucaaaacauuuauuguugauggccaccugacacuagccuccucaggcugucccuuccagugacuccagggaacucaggcauugaacacauaguguucagaggccccacaucagccugguggugcacaucuuuaguccugauacuuagggagcagagacaggcagaucucuaaguuccaggccagcauagucuacuuagugaauuccaggacagcaggguuauguagagaccuugucucaagaaaaaacuuuuuuuuuuuuuuuuuuaaauguguauaggugcaggguaugugcacacgagugcaagugccugcagagaacagaaaagggagucagauccucuggggugggagauauggauaauuaagagcagccugaugugggagaacuaaacucaggccccuuggaagagcaagaagugcucuuaacuccagccccaagcuucggccacaugggcgaacaugucucuguccccacugacgcgggcccugcccuccgugacauguccacccuccccgguccucccugccugcuuuccucauccaccugguguguguucccaccuccaaaccucuccgugcugugcccagaguguucucaucuccaaacuagauggaugcaaacugccaguucuguguaucccccugagcgcuggcuucacuugcagggacccugccaugucuccaugcccggcagccagcgggcgcccggcuugugacauaaagacucguguuggcccagggucucuggccuggcccuugguuguucagcuccggaucuuccaggcccugugugccgcccaugccuccugaaccauuggcaggcccuucaagacgagaccaagacuggcaggaaguguguggacaguuggugccgucguguccgucugccuugccugggaaugccuuggcugucaagugccaggaacaugggucggccgcggugccuccaacgucgcgaggcguauguguuguagccguucuccucgaugcgcucccggaaccuacaguccacagaguagacccgcugcagggcgggugcgugagacuggcugucugcaccacugaccauugccacccaguagcugcccaccgccagucacucaccgacccauagaggcggccccugcgauucauggccacauagaagccugaguacacagcuuugaucaccacagugcccacacggacagaacggaucuccacuauaccugaguggagacaggaguagauggucaggcagcagccacaugugggcucuucaguucccaucaccacugggucuccaagcccagcuggcauggagccuggagacuaaggagcacaggcuggccagaaaagaccaggccaugcuuaagcaccggcuguaugcccucuguuucauggagcuuaagcaccggcuguaugcccucuguuucauggagccuacacaacccaggggacggggugccaacuguaccuacuuccagaagggaaacugaggccugggauuggaagagccagcuuuggacuucaucugucugcucaacccccugugaccaucucuggcaagcccuagcuggcugggagucugagcuuuccucuaggaaggggguucagggaaggcuugaaucccaccacaggccucugggcccagacugucuuuggaaacuugaggccucaugcuggggacaucagccacaccauucuuccaccaucccuuccugcucugaaagaaguacauuugcuucaccccaggggggaccgucugcaccugccaucuugguucacaaugcaugcucuuggccaguaccacacaggaacuaccaaguuaaggagggaagagccccauccccacagagccuuucaucugucacccccgucccuauccaggugggaucuaaauuucagacauaccgaagggccaggucacucagcugggccucuuccucagccuggggccaccccgccuggcugugcuaccauggauggaccugcccagccaguccccugucauagcccuuguccucuguggccuaaugagggccuuggaacccagaugaaagccacugggaugggcagugcccugucaccugcucagggcugagcucaaacccucccaguaacucugccagaguuuagcaccagagaagcuggcuguggccuccccaucacccccagcuuccuccucacaauggccucucuuuuugccacauacaugccacaggcacuuauggaaggccuucuguaugcaaagcagggcucacucccuuucuggucucuuagcaggaccuugagaucagggcaucccaucuuaccucauuugccaaauagugaugucugggaacagagggaaccccaauucaggcaggucacaaucccaggagaagcaaucucccuucaucaguuugcccuguaaguaggccacugaccccacccagcaacuccugcucugcuuaggagcccacgggaugcagugcccaucuccugcugccccagcacucacuguccuggccgugccgccaacgcguccccugcacccgaccaccaagguccacacgcaggaaaaagugaguggaggagaagaggcggcgccagcgcacgucgcccuccagaugcggguacccucccggagcgcccggugcccgcgccaacagcagccaggcuaggcccagccagaggcggcugcgcaucccgaccugugccggacagcgcgcgguguuccagcugcacgguc

SEQ ID NO: 5604 - RNA, 5359 nt, Mus musculus
cugaguccccgcugcugcccaacacucgccaugcguucuggggcacuguggccgcugcuuuggggagcccuggucuggacagugggauccgugggcgccgugaugggcuccgaggauucugugcccggugaguggggcugggcggaaggggcgggcgagcgggccacccacguggccugaggaaugcggcagggggaugucuggggugugcucuggcugggugggcgaaugcgggacuccacgccuccagccucaaaagaggacugacauuuauuuauugagcucuuacuguuuacaugcuuucccaugaguccacagaacagccgaaacuuguggguacuuuuuccuccccguuuucaggauagguaaacugaggcccagggucaugaaccuuuuaagugacgugguagguggcucuguaggcccuagagagacaucucuggguggcuggcccugcuaaugccacuuaggcagaggguuucaggagucucuggaugagaugccucagguagaaugguauaccugcaucuggccaggagagcuccagccucagucucccuuuuuguaaagccuuugcagaggugcuggggcccaguucauggaaggcguucggcagugucucuugagcaagaaugaguucugaugggggcggggggggggggggaggugugcggcugucuucacuuaagggugaagaaagccaaagguucuguguucuagccccuaccagcccugcaaggcugcugcccuccaagggagccaagcccccuccccuagggccgcgucccccgucccugucccaggggagugagcucacgcagagggaauguuccccaguuggagugaguaagaggcgggucaggcgagggggggcugcaagccgggggcucggcuguccugggcacugucuagacagagggcagaggcgggaagccagugcaggcccacagacccucacaugccgagcgccuggcauuugaaggggcugggcagggugccaguucucaggccuggaggccaggcgggaguuggugguggagcacucgggugcggcucagaggagaaggguucccuccacagaagagcucgagccacagcuguggcuuucugcccuuucuuccuguacagggcauuuaggauagcuauggacaucucugaauuggcugggggaauuagaucugagguguuggggguuaguugggaguuuguuccacaaagaucauguauagggauaauucuuagguagagauggggucuggagcuuccccauuccuccuccuccuuccaaauagguggcgugugcuggcuccagcagggcagagaggccaccugcagucuggugcugaagacucgugucagccgggaggagugcugugcuuccggcaacaucaacaccgccugguccaacuucacccacccaggcaauaaaaucagccugcuaggguuccugggccucguccacugccuccccugcaaaggugaagccguggggggcuccugauggcagacaagacccagagugaauggggaacuggggaggggacccuggggcccacgacuugcggaggcuuugagaagcccccugguuucaucauguaaagccccuaaccugcauccuaccucaccugguggggaggaacuuagccuuaaauccugaccaggcauucaggcuauguccguccguacugcuacccucaugggacccugagcaccacacauuuuacauagcuaauaugccuggaguaucugccugugcuuuauucugagcacgcccgccacccgcgucccugcugaggugaaugaauaacaguccaggugacagagggcaccccuggccucucugugcuuggggcugaaccaguagaaagugaugggaaggauuuggaggaagcaggcauaagaucuagggucggggugaugauuaggaguuuguugagugaagcccauauggaagagugcacugggucuaggguuagucucuagagguaggagcaacaucaggcagcucauccaggaggaagcugggcagggcugcagacccucagggauaggaggauagggaaggagccugcauuggccucagggguaggauuaaucucccaucagccuggcugugugguccagagcccauugccacacuccccuccuccucuagcuucugagaagaggagggauuucaagaaaagccuuuccggggcuugagggccugacuguccucccagccuccucugguccucgggacuggggauggaaauuugcccccucccuuuucuuucuuugauuuccuaaagcuggcuagagggucaguuccagauguauggugggugggcccucuggggggggguacccagguguaacccugaaauguaggucucuccagauccuggauaaucaagaguucaaggccagcccuggcuacaaagcaaguuugaguagccuaggcuacuugaggccaacucaaaaaaacagaguauguggcuagguguaaaugccaacacaagaaugucuaggcgaaccucaguuuccccaccugagacauaaagaugugcagagugaacgaaccucucccccaugccucuuuggggagguccuaguagaaaccaguaauggaugcauccaguaauugugcaucacggugcaccuggacuccagugacaugugggaaccgcacucgugugugcucuguguccucagauuccugcgacggaguggagugcggccccggcaaggcgugccgcaugcuggggggccguccacacugcgagugcgugcccaacugcgaggggcuucccgcgggcuuccaggucugcggcucugauggcgccaccuaccgggacgaaugcgaacugcgcaccgcgcgcugucgcggacacccagacuugcgcgucauguaccgcggccgcugucaaaguaagagcugugaccguggaggggcggggacgcggggcggggccaaggaaucaggcaggaccuggggguggggcuagggaggggaggacagggaggcaccucaggccugggaaaggcgaagccugggaaaagauagggcuggcugaggggcggagucuagagagggcggggccuggcaaacggcaagaccaagguaaggccggcugaggggcggggccuaggggaaggugugauuaugcaggggcggagccuauccgguuguugcccaaguccacaccuagcgagaagaaggggcagagccucgcugauugcacuuuacggaaaucacugguugcugaugcuaggggggcggggccugagggaggggcagagcuaugcaaaacugugggucgggucaagugcgaaccaaagaaggcaggcugcaaagaucgagcuccagccccuguguagcgccaacucucgggcguguccaggagcagggcugugagcugcagggugugcccugcgggccagcgugcccuuacaagugcugacgcgcggggaaggugagcagccacgggaagaggcuugugauggacuggggagggagaaaauguggguguggccaugaaggcaagcugauggguagagcuugguagacuggggcagggauugacaacugggugaggcugucauucugggggcgggauuucucugaggggcggggcuuaacaguugaaggggcuuguguucuggggcggggcuuaacagaggaguggcgcuugcaaucuaguagaucuugacagcaggguggggcuagugucccagggcagggcucgaagaguggcggugcguuuuuguccuaggagugggauuuucggguggaguccuugucugaggguagguggacucacagggaggagacaccauccugcaccugacccacccuuucucgggcuuucagagucuugcgcucagguagugugcccgcguccccagucgugccuuguggaucagaccggcagcgcacacugcguggugugucgcgcugcgcccugcccaguaccuuccaaccccggccaagaacucuguggcaacaacaacguuaccuacaucucgucgugucaccugcgccaggccacuugcuuccugggccgcuccauugggguucggcacccaggcaucugcacaggugagagaugugagugggucugggcaucugguccaccaaggggcagugcgccaugcuuacugucgccuccauacuuguagguggccccaaaguaccagcagaggaggaagagaacuucgugugagcugcagccacugggccuggcauuugacgccaucccgauuuuauuuauuguuauagaaaauauucuaauuuaugucacauggacauuucccaaaccuggccuggaaccacuuggggaucccccugggauccugagcacguaucacaaggacugaagggagauuuuuauaauaguugguaugugccaucacccagguacugggaucaaaguuagaacccaagaccccugcugcccagggauggcagcugcauggagaucccccugcuaugaucuccccaccugcuuucuaggcuggagcugucgcagggcacagccgaugaguugguguuugcauauggcuggccucagaccagagcgggcaacaucaggucagagaaacacugggcucauuccuguuugguccacucagggugaaaccugguagaaacauuggacccuggcugacucacaggcccaggacagccaguggacacuaggauucacugugcccagagcacccagagucacucuagcacccacugcccuguacccugcacacccacauuaguuuuuacgcaguuccccaccagccccacucguccccaagcccagcugcagguggugacaccagccagaugcuguuuggggccagacugaauuacugccuucacucugacagcugcugcugcaacuugcccacacccacaagugccuucaaggaagccaaaagggggagcugcaaugcauuuagguagagagugcuuuucuaguguucaccgagcccgggcuccauccccagcaccgcauaaacagacauguuggcucaggccccucaucccaguacuuagaaaguagaggcaagggcaucaggaguuuaaguucauccuuggccacauuaugaguucaaggccagccugggcuauauaagaucuuaucuuugaaaaaagaaaaaaaaaaaacuuaaaaggugucagaccacaacagaagacuaugggaaggugcccaacccuccaguuugggggcaaggaguucccagggucuuucucaccacccuccaguucucagcugugccuuucuuguaauauccccaaaaguguccuuagcaggggagcuaugguagccuccccuacccuggaguucugccucaccaaggaaauaaaagacaauagaaacca

SEQ ID NO: 5605 - RNA, 10342 nt, Mus musculus
ggaauuuuuuuuaagauuuaaugugaguacaccauagcuguacugauagaugguugugagccugccugugguuguugggaauggaauuuaggaccucugcucacucaggcacaaagacuuacuauacauaaguacacuguagcugaccucagacacaucagaagagggcaucagaucuuauuaugguuggcugugagccaccaugugguuuggacuugaacucaagaccuuuggaagagcagucgguacuacccucugagccaucucacccuugucauccuuugugcuccgugguaccaccccccccccccccccaccgcccaaugacaggcaggaguguaagacacagguguuuauugaauccaggcccagccuggccuacagcucagaaugaagggcucagggaagacagagguuauaaaacugcuuuaauggaaagcccccccccccuuccccaauacaccaucugggaugggguagauguggccagggcuggccccaggacaauacugagccuguagucguuaccaaaauauacaucugucaccauaaaaaacugcugcaccgccucagccccacagguauaaaaucauaaauauuuacacucuuccacgccuuccacagaaccagggugcagggaaccccucccacaggaacaggcuaggauagagguggcugugcaggaggacauuaaggccuagaggucagccccucaacugggcacagucagaggcgggcagaaagcuaaacuuugguccaaaauuuugaagguagaaacccacaagucucagagcuuuuucuccagcccuggccugggcccaccugcaaguuggucacuggaaggagcucaggggacauagaagcucagaauacacacauacaauuguaucauugcuauaaaaaguuacuuaaaacuauaucucuugcauauaaauggaaaagauucggguauuuggucaaguggaaauauugcuaggcacaggugucugugaccacacggaauagaauacaaaggucacaaugaggcucggcagcugaggauggccuggacccuccgggcuggccagggacaugggagaaucaugucacuugauuauaaggguguaggggaguggccccagcucuugcacagcauuggggagccuauguauaggccaccuggcucaccugcaggucuagagacaacugguggccuuagaggguggguguacggccaugaggcacgcugguuuguaaggcacagaaagcggcuauguuuggggcaccgcuguggccucacgccugagccccucaaggcauggugcugggauugacugggccucugugguccaagccauuuccugccacugcagagugggcuagauuuaauuuuuuuaaaaacagguaaacugaucucucuuuaaaaaaauaaaaucucuggucuguaaggucacuucagcugcuuuuuaaaguggcuuuucuggaaugguggaagcugaugcaggcccacaggcaccuagaugguggacuuggaaaaggacacucgcagguggugguucucgcccaggucaugguugugcaguucaaucagcgccugcacagccuccuccacagagcccaucuggaucagugccaucuugcgguccuuccugcagggguggagugggggguagucagcuaaaccugcagguuugggguaggguuaaggguggaggacgaaaggcagggcuuuacucacuggaagaacuugaagccuuugaccacaccaccguugcuggagaagaggcucuugaggucguccucugacacagagggccugcagagacagacgggagccaucggccugggcucacacggggauggggugggggagaucaggagcccuucguggcccacccacaaacaagaccucuggcugacuuacgggauguuggagaggugcaggguagcugaggguggaaagauguucuggaaguucuuggagccugguuucuugaagcggugcagcggggagcugccauaguccuuggucaggcccugguccuccugacccucccgaggcagcugcacacucugaugcuuggacaguguaaugcgcacugacuucccgugcagcuugugcccguucagguggcucauggcuggacaaaggguggaaaccaugagcagcaggacacucugcccacuggugcccuacccccaggugcaaccaaagcuucaagcacaagccugugcccuguggugguccuuacccagcugggccuggcugccgucugccaucugcacaagugcguucuccuucuuauugaacaggaucuucacccgcugcacaucaccguagacgccuuggaaacccaggguaagagucuuuaagcugucuggucuccuaaccucucccacccacucauuacccacccgucgaguccccagcucccagugggccaggucuguuuagugggcacugggagccugugucucacagcccaaggccugcuaacacacgcugcgcuccggcagucucagacuccagacagcugucagaacagccacgaucacaugcuacugacacgcuuagcucuggaagcaugcagggugguaaccaugcgugucuacucaguacaauccgcaaaccggaagcaaaccacggaccgaggcagaaggccaaacacaaacucaauaguacauagcaggguguaaaauaaccaauuaaaacgaaaccaagguaauaaaagggagaauaacauaccgaagagaauaaagaggcuuuggggugugacucucuuuagagacagcagaggaaggcagcaggggacagggagagggagaggucaagggggcgagugccaaucguccacgaggaagacaguccccgcaggcgagcagguucaugaugaugaaguugucaggauguuaauauucaagggcagguugguuuccggagagcggguuugagaggggaguuuuguuuuuauugauuuauguuuuguuuguuucaagcaacaacaggaagcagaagaaccgugcagucaguuggcaaagaaauuccggaucaggcaagaaaaaaaaugggaggggaggggaggaaagaaaaaaguagcaaaacacaggucaguaaauacguaggaaacgaggcaguguucugcacgcacgcacgcacguacccacacacucucacacacacacauucacacaugcaaggagaagcacugcacgcaggccggaggaccgugggucagcacugcggcugagacuaaggacugaggcaaggaguggugccuguuaguucccagguggcaggcugagcucgggacucaggcugagccagagagaacuggcuggaacagggccggcauggagcuccaccagagccaaagagcagccugaggcacugcgugcacagaccuguuccuggaaaggcaaugcugagccucaagggcuaccugggcucuacagagcaccagccagagacugccuggucagcacaagccugagccaccaccucccuuccgaccggcacucccaggccuccuugccaugccccaaauuaacagacugucuguacagcaagaaaaacaccgcggcucugagcacugagggccagggugcgaauggagcugagaggaaaacagaaaaccucagagcagcugggaaggagcggaggccagcaguggcagauagaggggcagcacgccuauacccacacggcgccugggacacccagaaacccugcuugccauccaguaugcucccccacccugacuuguggucagucagcaccccaccacuacuccauguauaagcagagcacagcaauacccacauaccucaggguucagauugcugaccaaaaggacagaauucccagcaccugccaacccugggauggcaaugcggcuggccgcagcagcagcagcagcagacgggauggccaggggggccaaggcuccauggacauuagggacagagaggccugcaaaggaagauaguauagaugugagccugggugucuacaccaagaugggacaggucucaaacacagccacgaggugucgccuggcuauggccugcacaagaggccacacugccugacuccacggccaguccuggugugaucagacugcaugcgcccaauagcacaaaagcucugguugacacuggcccucugcaagcagggccugccacagaucugcccggcugugcacgcaugcggcgcccauuccuccaugcaugcuccggcggcacgcggaggccagaggcccaugcuccucagcucuggaggccacuugcuuaccaggccauuaaauucaaucuacuagggacacugcguccucguccucgccagaggugcuugaagggaaccagaccaaagacugagugauuagaggcuuguugguaaugccagcacagggcaccuggcccagcccugccugagacuacccugcccuagcugccuguggaugcuucuggaggccccuuccccucuccccagaaggaagggggccuggggccuaacacuuggggccaguggcaucccggucuauggacaguuauggggcugugugggcaugcaggcgcuggggucaggaugagcgugaauaccugcggccugagggauggcaaaggugggagggaacccggcuccugcauacggagaggcugacauuaugccgggcgcaccuagaaacaaacagacacuaaucacugcaccucaccucacggcugggccaggcacgggcaggacugcugaguggcugggcugugcagugccagggugcccugacagcuagguggccugucccaccccuguucauuuggugugucucaguacagcaucuuaccaaaggcugcugccauggucuggucuagugaaggcuggcugucuccagagggcaggucaggucgaguguagucucugcucuuaucauuguuguacuugacauugagacuggugagcuuggagaagucgaugcgcagcgugcagcaggcguuguagauguucuggccauccagggacuguggggagccauaggugagugcgugggccagucauaggauugcccacccaagcaaguccuacucaccagcuuggcaugcugggcgcucacagggucagcauacugcagcagcgccuggaacugguuguucuuggugaacgugaugaucuucaggacggugccaaacuuagagaagaucugcaagagaggaugugugaacucuagcuggggccgaccaagugggaauccaggcaccaggugcagggcacgcacucaccuggugcagcacguccagggucacuggguagaaaagguuuuccacaaugauccugagcacugggcucugcccugccauugccauuccugcauccacggcagcagcggacgcugccaaggccagguuuccagacuggacggaguuuacagccugcagggcugccugggcacgcuguggaggaaccaccaugagcugugacccaggccugagggaggagcuuggccacccacccaccugcccagcagacauacugccugguugggcgagcugucggucuugagcucuuugugguuggagaacuggauguagaugggcuguccacgaagcacuggcgccaccgauguauaguaguuaaccauaguguuggcagccuccucuguguucaucucaaugaaggccugguucuuccccuucagcaugagaagguugguaaccuuuccaaagggcagcccuagggagaugaccucgcccucagugacaucgcugggcagcuuucugacauggaugacucuggaagggacuccugcgcuccuguugucaccuuugaacuucuugcuaucguuuccauuggcugaaaagggauaggugcacuugggaggcugcaugcgggccuccuuccugccucugccagguccuuucucccagcucgcccuguaccugucaaggcaggacucccuagggcacccaggcacucuuaccugcugaggcagagcugcucaugaugaaggggccguugcugacacacguggagaagagcucgucggauccccgcugagaagagagcauggaaucuuaguuccaggcugauuccuuuccugcauucccauuugcacggugggcgccccccccccagccuuuggcuuuagugcucacuaccagcuacugcugucacuucuagggcccugugccagcagccaugugggaggccccuuccuggcggguugucugucuagagugcacagcuguaggccucacgguacccucccggcagagcugcuuggcaguuuccccagaaacaaaguggggcccugcugcugccccagcccugguguccugucaucuuccagaaggaaaauggacuaugcuuauacccgugaguaccauccagggguauaagcagcucacucgggaccuccuaaacugaccccaugguaaggagacacccccuucuuagaagcaauuuauucauuauuuuagccgaaccaacccuggauaucacagaagagauuucaaccaggacagcaaaugaggcaggacauggcgccucagacagagguuucaugagacagagcucucuggcuguccacucccaggcagccaaacccugaagguaaacacucagggacucaggaccauauucauccaaggaccaccccccuuaccccaccgccccaucacugcccacccaacacugucuagggcacuggucuggauccuccaacaaugccagccuaugaaagaagcaggacacccauggugaacugacaggucuagagaccucacagccagcaccugccaugcccacuacucacccuagguggaaaggguaaacuaaacccaagcaucucacaaccugcaccauucugaagcauccuacccaguccuggccauacuaaggucucaggagcaaggacugcugauggggucuuggacuugccccgccuguagacaagaccaugacaugcaaacucagaaucucauguccauaucacuugagcugcaaaauccacuuccuucaggccaccauuuauuuacccaugaagucccuuaugcugaccuuaguggggguggcuucccucugggcagggcaacagaagcaguacuuacuuccugcagcucuguuccuggcaggcugccagagcccuaacagucuccccauagacgccagggagcccacuacagucagaggaaacuccagccacguaggccaacagccccacgcaucuaggcagacaaaagcauaugaugccacagcacaggagagccccuggucagcccagccuucccaaaugcuugccauagagauagauagucccaauccacucgcagucccagagcaagaagccuggcccacguauucaccuggagcucccugcuaacuugcccaguaugccaucugcggcuagcuagaauugagucccguguagacaaguggccauggggcaauccaggucagcagcagcuuugcccagacaguacucugucaccugcaggucuggaccuaaacuaaguggggcucccucccccacuguugaacacacacuuaucugagggaagaucaccaggcagauggagacagcguccacucacagaaaagucaaacuaguccagacagcagccugguagcaaaucagauggcagcagcugagauggccuuugacggagaaaccccaaacuacaggcaaaucuaaauagcccaccuaacacaguaagaccaauccugacacaaacacaucugccacaccauuucaagacagcauaccugcaacccuucuagcuccaggcuucagcccaaaguaccguugagacugaaauacacuuacugucugucuccccagacacucaagaagcugaggcaggagucacccgcuggagagcaggccugagaacugccuggacagcacaggaaaacaacaccaaaugggugguaacucagucucaccuuagaacaugccacagccuuucaaaccaaacccacagaggaaacaccaaauggaguguccacaggccugaacucacugcuuagaugaaggcagcagggcaggacaaggcaaagccagccagaaagaggccagcacaaagacagaaucaccagacccacaaaaggguccuaagcccucaaaacucuuggacggcaggucuacaugcauccaugcuaucuuccgccuccgagucuuuguagacccuggacuaaggcaggcuccucugcaauaagcaagccuuuacucugacuacaaugggguacaaugccaagcuagagacaccuaccuuuguaccgacugcuaugucugggacgaugcuguggagagaaaaguagacaucagcacuguguggccuguagggcccucugccaguccggcuuagaaaggcagggaagugagccauccauugagucucaacuugaaagagggccaucauuguccuugaagacccucccuucuuccacacaggacccagacccugccuuucaacacauuaaauccaguuuuaguacaggaaaaaaaaaaaaagaaaaggaaagaaaaaaagcccaguuuuuauaaagcauaccagugaccugggucaaaacucaacuccugagcauccuacaacgccagggagccugaaauauagguaaggagcagcccaagacagugcuuccugaugggggcugggagcuccuccagggccacacugcugauggcaggcaaaguggccuuguuaccauuuacaaaccaacagagcugccgggauacacccuagguuacugaucaaccccagccccucgugacugcacccugccgccucacaccuagccugcuuacaggcagcagcaagccuaccacagcuggcagguuaccaaauggcucucaggggucugccucgugaagggauuccaccagaagugguggcugggguauguguaacccucugcuugguuuacuguuuucaaagaaucuuuugcgacauuucucugcacucccuucuagaacucacuucgaucugccuaucucuggcaggauuaaaggugugcaccaccacaccccgcucaaagauccucgguaaguugcucaaaggaggcaacuggagacuccugucugucaucucagcacuuagaaggcugaggcaggaggacugccauagguacucagcuugaagcuaggccaaacuacuuuucagaaucguguuaaaaggaaagccgcuuacuaagccuggugacucaaagcacuagggagguuaagguggggaaaaucaggaauucaaggccaguccuuauccaaaagccaaacaaaaaguuucaacaaaaaagucggggccuggugacgcaggccuuuagucccaucacuacgcaagcagaggcaagcgcaagcagaucuuucagaccagccuacaaugagauccggucuccaaaacaaaccgaaaacuacaaaaaguugccaguggagggggcauccgggaagcaugugggagauacggaugccaggccggcgcccacaccggagaccgaacugaaccucacucuggcccacccgccccuccaauggggggcccuggaggccuccuccggacaccuccccccaggcgggaagggcgggcgcguucggcacagguccgcgcgcgugcccgcaccagggcgcgcgcccuacuacgcgcgcgcacccggggucgcaugcggcgugcgaagcgacauugcucggggcacagggcgagccggccggauuggagcacggcaggcgggaaggaucgcagcggccgagccgcuccgagugagcgcgucucaccggagggagcgcgcgugcacgcggagggcgggaggggggcgcuggguuccuccggaugaaccgcgcgggcaccggaagugcgcugggcgaggggcuuaaggggagccgaaagcugggugcggucgcccuaagccaaccggcuuccuuaagggccucagacgcccgggauuccgagcgcgccacgcggaacgaggccacacgcacgcgcccauugcagcgguuagagggaucggcgggggccaaaaguccacgcgcgcggcagcgauggcugggacggaguggugagcggagcggcgugcgaggggcgcggcaggacuuacccguccauggcacacggaagagacccgcggggaacggagcggaggcgcaggaauagcagaaaccgacccaacggcuccgaguuauagacucacaagauggcggagacgcccgcacacgucccccgcgcgcgauccucauugguucccgcugcggucugugggcguggucaaccccgccugcccccgccagggccuucuauuggucaaaagguuacuccaagggcgaaacgcauccagacagcagacagcuguugggcgggacggccgucagucaagacggaagacggaaac

SEQ ID NO: 5606 - RNA, 10226 nt, Mus musculus
ccuggaacccguaaagcaccaggcaaucaacagccuccucggcuuggugaagcuaccgcgcaugcguagacuuuccaguuuggccucuaggaggcgcuauggccguucuagucggccaggagccaucuuaacagucucucuaaggaugaugggauucaggggcgggacuggcagagcaagauggcggcgcccauggaaguggugguguguacugacgccgcggcacagcucuggagcugcguggugugggagcuucauucgggcgccaaccugcucaccuaccgaggcggccaagcggggccgcgaggccuggcgcuacucaauggcgaguaccugcuggcggcgcagcagggcaagaacuacaucugcgccugggagcugcagcguaagguguggggccucagcguccgcggggcagccgagaguccuggggcgccgccaggguuggggucccggcgacccugggguggcugcgugacagggcguacucggaggccgagggguuuucuccuagggagauggcgccaacgcacgcgugcucagaugaagaucgauggcgaauccgcuuuugcacgcuuguaguguuagggacgccaauuuugaugcagaagggaaaaugggguccguuagaggucaugcuuuuggacagcauggcagaucagagaucuugaggagccgcaggaagacagagaccgacggcccguccuuuuguuacccucguaaagagucgcagaucuucauagucaggacugacugaggccugggguuacugguucugauguuucuggaacacagagcuuccuucuuguccgcugggaucccuacugcugagcccugacccugcccuucacugggagguucuaggcagugguucuaacccugagccgcaccgacaaccccucacuugagcagucugucuccccaacccccuuacucuugcucucuguacuaaaaacuuuaaccuuccauugccuccguucugauacucacauaguuugucuuguauccugugucccuaggaucagcuccaacagaaaaucauguguccugggccugucaccugucugaccacagcaccuaauggcuuguauguccuggcaggaauugcagagagcaucuaccugugggaggugagaacagcuugucacacguaugugucacuugggaaugcuagagaguaaaacugguugguguccaguuuuaccugagguaggcagguggucuuggagaucuuacccaugacuucugaaaacaaaaauguggccaugucuauaggguccucauuugugacugagauacaggacaguguucaaccugcugguggcucuagugcugucgugagcaaccaggaaagaaacuuagaaaagggcagugaccagaauuaguacagaggaggaggaggcaggaaccagaagcagugcagaggaggaggaaagcauuuauuuacacuugugguuuauaugagggaagucagcgcaggaagcagaaagucaguuaacauccauagucagcagcaaagagaaaugcucccgugauugacuacacuuguugcucuugcagaggaccuggguucaauucccagcacccacagaauggcucacagccauccauaacuucaguucuagagaacuugacaccucuuuugaucucaguaggcaccagacugcccacugcaugcacauacaggcacgcaggcaaaauacucauaaaggaaauaaaccugaaaaaagaaagaaaaacugucuacugaaugagagagcuggcucagcaguuaagaacauuggcugcucuuucaggggauccagguuuaguucacagcacucacauggcagcucacaacugucuguagcuccagggaacuaagcaccuucaaaucuggccucugagaguaccccuagaccuacaaagaaauuuaaagccuggcagugguggcacacgccuuuaaucccaguccuugagaggcagaggcaggugaauuucuuaguucaaggccagccuggucuacaaagggaguuccaggacagccgggucuacacaaagaaacccugucucuaaaaccaaaaaaaaaaaauuuuuuuugccgggcgugccuggucugcaaagugaguuccaagcuauacagagaaacccugucuugaaaaaaccaaaaaaagaaaaaagaaaagaaaagaaaaaaaagaaauuuaaaauaaaacuauccgggguccugagaaaugauucagcaguuaagagcaccgacugcucuucaagaggucccaaguucaauucccagcaaccacaugguggcucacaaccaucuguaauccaaugcugucuucuaguaucuggagacagccacaguguacucaaauauauaaaaugaguaaguaaacuuaagaaaaaaaauaaaguaaaacuuaccauaagcccagugauagccagccccccuugucucacagucaggcacaaagguaccagcacccugcuucccacagagccagagguccuucugcuggccccagcugccugccucugggucaggacuaguuaauaacccuggagaacugaaggguccaggcuguccugaccuggccuuauguggagggaaggugccggcagcacagagcugagcucagccauguuucugcuccuccuggcuucaucuuccuccaaaccaugccaggaccuccauggcauucucagcccaugaugcugaagcuggcuugggcagagaggaaaaccaaagccaaggucuuacagccccacagcguggcuugugcugcuguguacugagggccccgugucugagacauccccuuuauucugugcauauguacaugcuuuguacgggaguguuugcauguaggcaacaggaaacaccuucagugguugguccuugcccuccaucuuguaugggacaggaucccacuguuucaaguuuccaagaauucucagaaugccguagacaaucacuguagacuggagaucggaagguggaucuucacauuuaaguggcaacuacauguccuuugauuuucguugucagucuuauguggccaggcugguguugaccucauuauguaacccuugacuuccagacccaccugguaccaccuccccagugcugggguggagcccagcaccgagccuguugggcagggacucaacacuugccgucucaaccuuuuaaagcacucuuuaaacccuuugguuuuuggucuuuuugagacaggguuucucuguuuaacccuggcugucccggaacuugaucaguagaccaggcuggccuugaacuaagggauccaccugccucugccuccaccucugcuucugccucugccucugccucugccucugccucugccucugccuccaccucugccuccaccucugcuucugccucugccuccaccucugccucugccuccaccuccggagucugcggcuaaagaugugugcuacugcugccccgccucucucagccuuuuaaagcagacuuuuuuuuuuuuuuuuguauaugaguauuugcuugcgugugugucuggugcccuuuggaagccagagguguaggcuucucugguggaugugacccuccuugugggugcugggaaucaaacccagguucucuggaagcacagccagugcucuaaccacugaacuaucucuccagccccagcuuacuuuuuuuuguuguuguuguuuugagacuggaacucacucuguagaccaggcuggccucgaacucagaaauucgccugccucugccucacaagugcuaggauuaaaggcgugcgccaccaccgccuggcucccagcuuacuuucuuaugcgacccaggacaaccuucccaggcugguaccauccauagguggagggcccaggucaaacauuuaauuaagauacuggcccacagggcagccugguggaagcaguuucucaguugagguuccuucuucccaggugacucuuguuugccucuccaagccuagcuuggugccuccucuugaugaagggcuggcuggcuuuugccccaccauggugucuuuaaagauuucugauggcccccagggguacugcccagcucauagguucuugggcuaaagcugauaugggaauugucccuuucucuggggugaggaccuguaagucucagcaucuuugugacacccaggggccucuggggccuaagguucugcugacaauuguggcccacacucucuuggagaugugagcguguagguagccauguugucuuucuccacccuuagucagcccagacacccgacagaaacucagccccccugggccuggaacccaaccuuuccccagugcaggccugggcucacacacugucccuucugcagccccuaggccucccccuguugcccguugagaugucuagacgccagccuuaacuaacucuuccgcagcaucgagcggcgucugugcugcccaagagugagaaccugcaguccucggccccugugcaggcugagggacccugagccaauuccagaaguuccgaacccccagaaugggguccugcagcuucucacagcccagugccccgccccuugauggcauggggugcacacagucaaacuuucuguauccugccucuacaaguggcccugacccuguggcaaacuggacaugggacaccauuuuaacccacauggccuuagccucccaaguaguggaaggacaccgcccccauugccccucugugugcugagcuggaggcucacacauuuugagccagcaggggccucuucuggggacaggguagaaucccauuauugucagacacugaggacacagccagagcuggccaagugcacagugaugagggccugcagccuuccugguuccauaugccaauggcccuggagcagguggacgggguucuuauggguuggcauauucuguguugccccugaccuucagugcccggccucucacaggucugcaccgggaaccuccuggucauccucagccggcacuaccaggacguguccugccugaaguuuacaggggauggcagucauuuugucucagcgggcaaggacugcuuggcgcuggccuggagccucugcagguagggcaugugccagagaucuacccagaaaggcuauggaggucucagggcaggcaauaggcuggugacuacugagguaucccauucuugggggcuuggggaggcaggccaggggcuuuccacguggccucacugcuguugugugcccagugugcuacaggcagacccauccaggauccuugccccaagacaugucuggucccagcacacgcucccaaucacagaccugcacugcggcuucggaggccccauggcccggguggccaccgcuucauuggaccagacugugaagguagcauccccagccucgacccaugaauuccuggcagccacuggaucucagcuaggagggagggagacuggcaucucccuugccuuggcuguuugggcuccagacagcccauaaucccuaugcccgaccaaggacacccagagauggacuguccagccugucugcuggaaauucccacucguccacgccucaguggccagaugcccuugaguguguaggguuguuuguuuguuauuggcacaguguuagagauggaacccaggcccugcaucugcuagaccagugcucuaccugagccucaccucagcccucuuuuaucuucuaguuuuaaacaguuuuuugcuuguuuuuugagacugucucauuguguggccacagcuugccuggaacuugguuuguacaccagauuggcuagggauucacagacccccuugccucucucugccuaggagcacagggauugagggcaggauuggagacauauucccuggcuggggugccugugauucuguggggguucagaggcugguagcaugggcaugauggugcgauggcccccaugccuccuggccccccgacuuggcugugugccuggauguccacagcuccaggcuucccauuccugcagcucugggccaucuccucgggggaccugcugcugucugucuuguuugacaugggcaucacaucugugaccauggaccuggccgagcaccacauauucuguggaggcagcgauggcuccaucuuccagguggaccugugcagcugggugaguggcccucugggacugagggagcccacaguccuuugcccuacaucccaggcacuuaacgaccugucucuacccccagcccggacugagggagcacagcuuccagccugagcagaacacagggaaggucuucaaaggacacagguagucaccucaggaggugggguuagcacagugcccacaccgugaagcaccuaacccccauccuccucucccaggaaccaagugacaugccugucagugucaacagacggcaguguucugcucucuggcucccacgaugaaucagugaggcugugggacgugaagagcaagcagugcuugcgcacagucacccucaaaggugugcccgaggcagcguggccacacagggacaaggcagggcccuguccugccagccaggccccugauguuguguuauuguguccuucaggcccagugaccaaugcagccaucauucuggccccacccagcaugcugaacccugaauucaggcccagccugccccugccccacuucaacaagcaccugcugggggcugagcauggagaugaagcccagggugggggccugcgccugcagcuagggcuccaccugcagguaggacccacagccacucuucuagaacauucuauacuccagaguuccuucugcugcugcuggugugccugucuggcaucaacagcuucugaacccuugcuacccaggucacuggcauccacugcugcucuugccauccguccccacaacauacgccugucugaaggcauacugugucagccuaacgggcucagcugacuugucacauugcucucagugaguggccagagagagagucagagcagccugaggucaggagacaccucaccaggaaggggcuucuacccaguguccucagugcugccccuggggcuuugaccuaggucugugccacucuacaguggcaggcccuuucacagaaggugacagacagggugagggccuaggguccaagaagcucagcagucaugccccaccccugcaguccuauugcuggaucugggcauuggcccaaccugccuuaugcucugcagucuucuuggccuggaucuuacagguucccacguggcccucagcccuggacucugguccugugguggaggcuggguccucugagggcagggaacagcgggggugaucaugcuacuuuacagggcaaagagccuagcuaccuggagcgucuggagcagcugcaggcaguguuguccagcuaccuggagaagguaagcagggcgaguccugguuuugggcagguccagggugggcggacaggaacagcccuacccacagccccucucuccacagaacaugcuaggcagccagaugcugccagcacguguguuugaucuggaggaugaggugcguagccugcgcaagaucaacagggaccuguucgacuucuccacgcgcaucaucacacggcccuccaagugagacgugcugggccacugccacacaaacacuugccacggggcugugaucuaguguuuuaacaaaggauggacuaaaggauggacaauucuuaaauugugcgccuugguuguucugucccuaucugggcuggggcuugguuggaaggccucgggccugggggauggggugcggugaguggggggccgacugcagaguccccauucaugagggccaaucaggcagcaaucaguccuucacagcuguccaaagcucaguguucacaucguguccuggggcuaccucaaauacccaaauaccaacagaaccuuccagaaagcugccugcaacugacagcccugcuuaacaauccagaagaucugugauuuaucagagcuguugccacugcagcucagaagagcugugcccucagguggcaagaugugaccauacccugggggaccacagccuccuaugacauggaccucuggguccucuucccuguacuuuccuuccuuuccacccuggccccuccccuaguccccuggcuccuuguagcuguugcucccucagggaaggucuggagagagacaagaagguaugcacucuaccagccauggguccccaggacccaaccaaaggccucuggaggucucuugagacuggguguucauuauacuccuaauuaugucucagauucuggcuagggacaguggcagauguuggguggagccauaacuugccacccaaauauuggguccccaccugcuguggcuggacugagagaccaucugccuguacuucccccauccaagccagaaccucacuagcccaggcuggcuuggaaggcagggucccccugcagaucugcuucaucugucccagccuccuuacuaagccuugcuguauucccucauuugucugccucagcuuccccgcacugacuggagaauucagccuuuguaaauacuaggcugggugaaugccaagcaagaucuaaguccccagucuccugagcaguggggcagccugcaccaagcccccauaaacuuccucgggcaacaggaguggggcaguguagaccaguacagccccauuccccaugggagggaaguggacgcugugugguccagccaucaaguacggaggaaccuugaggacaaaggccacugaaggguuccauggcaggaaaugucuggaacaguauucggggggauaauucacauuugugagaugugcuuucccacuccccaaaaaggccuugcaugaauuuccugucauucagcuggaguggaaggucccacuuggcccuucuguuaggagugauagugaauccugacaggccugcaguccagcugucucauguucagugaguggaauagagccggcacccaggacuguguggugaccuacugaaagagugccaggugacaguauagacaaaaaggagaugucagaggaaggggagcuaaggcuggcaacaucucagcuucaggaagagcacccugaggaucucugaagugguuggugacaauggcaacuaggacagacuagccccagacuggaacccuaaaggaccccaagccugauguccuuuggaucccuggccaggugccuagacagccugccaucuugagccaagccaucucauuaaaaaccagcucaaagugcagucaucuugcuggcuuuuuuauuugcuugauggauguuuuuuugguuugguuuuuugcuuugcagggagagugagguuuuggggggggagggggagcugaccaaguguagauucauucaucagggcugaguguucccugcaggcagcugcagugcaggauuuugggggaaugccacaucuuccagagcgucugugaggacagaccucagaauucccagcaggagccuccuggcuggggcagccucuguucccugauccuacaggccacguuugggauaacaagugaaccggguucugagucaguugaguugggggaccuggacaacugggagcuguagaagguuccagaacaauuauagagugccuauuguaaugcaaguccugagacccaggagggcagcgucugcccuugugcucccugaacugacaggggcaguggucacuaaaugaguccauaggaagucgagcacaugagagggaugugaugcacggucuggguggccgugguuuucagcaggacauuugauccuggguuuugaagggugaagaagaguucuggaaagcagaaagauuucuccaugguugguucagacugcuuuuguaaagaacucgauuugguuccuagcaccaacacugaguggcucauauccagcacuagggaauucugugaucucgagagcagugguuucacaggcauggaggcgcgcacccacgugcacgcacaaccccagcccuccagaugcagagaccgauggcucucucuaaagaguuaagggucagccuggucuaaauaaggaguucagacuagucagggcuauauaauaaaacccugucucagaagaaugcuguuguggguggguaggggauuggggggguggguaugggggaccuuugggauagcauugaaaauguaaacgaggaaaauaccuaauuaaaaauaaauaaacaaacaaaaagaaga

SEQ ID NO: 5607 - RNA, 7482 nt, Mus musculus
guaaccuuuguuuuuaaauuuaauuaauuugcuuauuaggguaggacacaugcaugcauggcauaucuguggaggucagaggaccauuuccuggagucuauucuugccuaccaugaugugggaccucaggcaaagaccaaguuuaggucggaagguuugcacaaggucuuuguauccugugccaucuccugccaccagccagaauuguaccacagccucugugagcucaucuccaaaguagagcuucaaggaccugcacauucauuuuagcaacauccucuggucuagacaauuucagaaucagguggcagcccaauauccuaagauuagaaucaauaguugccuggauuguaggcaagauucucagaugucuccuacucuggaaaaaaaaaacugguuuauuucacaaagcauagagggagauggguguagaucacccuggcaagcgugaguuagggggccuuagaaguugggguuuugcagaugcauaggaguucgaaggaagcuggugagggagacucagccucuuucuccacccuagccccgaucuaucucacaucauucauucaacugugucuguuucucgccuucucccuaacuuuugugcagggcuugcaccuugcuucuagacagcgcccccuccaucacggccaaacucaggaauguacuuuacucuuagaaacagagguuuuuauuguuuuuguuuuuguuuuguuuuuguuuuuuuuuuuguuuuuuugguccacacagggaauuucacauuuucuggcagugcaggggcccgugugggucauguguggccccuuccgaggcccagacucuagcacaccuaaucagggccugcacaggggcagggaagccuucaaacaccagaggagugagggagggcugcaggcguuggggucacaucuggcuugccucaguuuccccacggggcacaggagggugaagucugagagucgugggaaagcaaacuuagucccucagaaugccugcaguauuuuaaagccuaguguacuccaauacuuuugaggcaaaacccccacaaaaccccuuguuuucuuucauugaaacugccuguaauuuccccggguucacaaaccacaaacugaugugaaagagaugaagaaacaggaagcccauuggggccagccucucccacagcccacugggaaacgcacagccucacugucccaccaaggacacccauguccccugucuggugggucaauccugggaaggaagcgaggcauggugggugaggaaggagcauagauagcacagaucugucaucccagcccuuaggaagcugaggcaggaggauugcagugaguuccaggccagagagagauacaaagagaugaccaguuuccaaacacaaaacacaaugaaaaccccaaagcccacacagggcugcugaugcagugggggagcuggcaugcugggugcucaguagccagcuuccuccuggcaguaggccagguacucuggggccucgccuuggccgucacccgcaggagccccgucagcugcagagcccugugggcaauacuugggaucguagaucugccgccccaguccgaagaccugaccgcucugguuggcgcccugcguguagcccaucugcagggacauggaagaguugucgcacuugucggugcccagcuuggugucauagaugugccuccgggucccuggagcugucaugcccaccuggagacaggggagaagguaaguggggcucagaagaagagcagcuaauccccucaguguacucccuguaacucucuacagggcuuccaaagcuuagacuaaacccuuuuguuucuuuaaggcuugaucuuggacuagagagauggcuccgugguuaagagcacugacugcucuuccagagguccugaguucaauucccagcaaccacaugguggcugacaaccaucuguaaugggaucugaugcccucuucuggugugccuaaagacagcugcaguguacguauauaaauaaaaauaaauaaaucuuaaaaaaaaaaagacuuagucucauguagcacaggcuagccucaaacucauucugcaguugaggauggcucuggacuccugcuccucugcuacuuucugaggaugacaagcucaugcccaguuuaugccgugcugagucaggagagcugccaagagcuccaggcuacccuuggcuacauagucaggcccuggcucaaacccagccucugcacaaaaacaaaaggaaauacaacuuuuugucccaaagcaccaaccucccacuaucuccuucugagguccccaaaaccucagugacacacccauucaacuuaacaaaaagguuagaguaucaggugggguuaugcacagaguacggcugucacuucuguaagcaugcacagugaggaagaaccagaguugaggcugagguggggggucacagccggggugccagggugcaggggcacaggggcgccggggcaggacccaccuggcuggcacacuuguuggugcccaucuggaggcugauggugcagugguccaugggaggcaggauaugguucuuggggucauagagaugucuccugguaccauaggcugucaugccagacuggcuggcacacuuguuggugcccaucugcagggggcaguaggggauuagggugcugucggcaggcuccaaaccuuccuuggagcucaaggggucagggcccuguccaggcucugggacugaccugcagcccgaugacgcacuggccggccuucaugguggcgucgucaaaguuccucuccuguuucuccgaauacuuaacuccaauguccacaccacucugcagccccuuggucuuggccuggaugggagggggguggugaagggagcugucaguggauacaacccugccccucaggugucuggcccugcccucaaaccuccaaguccacuauagggacuucucaccaccucccaaacuccuuguugaaacgugguagacucuagacagcaaauuuuccuuacuccccacuucuggcaucaggugaagugacuuuuuguuuguuuauuuauucuauguauaugaguauacuauagcuguccucagacccaccagaagagggcaucagaucccauuacagaugguugugagcuaccaugugguugcugggaauugaacucaggaccccuggaagagcagacuugaaccgcugagccaucucuccagucuguucguucguucguuuguuuguuuguuuguuuguuuguuuguuuugacacagggucucacuauggagcccuggcuguccuggaacuugcucuguagaccaggcuggccucgaacugagagauucaccuccucugccuccccagugcugggacuaaaggugugggccaccuugccaggccagagugaccugugugggccugguuccuuacucacugacaccagccuucucacuguguggcacuaggcugcccacccggaccucaccuuuccagccagugcaagcagagacacuugcaccugugucauguucccgcucucgaacaggucauuggccucaaacagguccacaggguucaugccguagcugaccauggccuugaugaaguuggagagauuuucuagcugggagaaggcaagggaaagguggugaagcugggaucacaacuacacacgggcugggcaggccguguccccugcucucccagcugcucgucagcccccucaccuggugccaguucugcauagagcgguugauuuuagggacggagccuggcugcagcuuguucaugagucugggaagagaugacccaggaccuucuauugguuuccugaccucagcaagcuuaugccuuuccaggaaaccucaaugccuccacccagccucaguuucccuucacccaccacgcaaacaacacugcugcugcuagaugcuaggaauguaaucuuaagccguggaguuuugaggaaaucugagaacuuugaauauaauuuuuuucacaugcacaauuguggaauauccaaauaugugcauauuugcaagauggagaaauuuccagaagcauuaucuacugaagcaggaaaaagaaacguacaguaggaaugcuaagagcuaggguguucagagaaagcaaaaaaagcaaagaaacgucagaccgaacagagaugugacuggaaaccaagcaaaacagcaagaaaaggcacggaggggccggucagagggcucagggcuuaagggugcuagcuguuugcugcucaaggaccugggaucaguucccagcacccaugucagaacggccagcuccagaggacuggagcgcccucuuauggccucugaggaaagugcaaucaugugcacacagauggggugggguugggcaggaaaaacagacacaaauaaaaaugaaguagacccuaaauaauacaauuuaaaaagacaacacagugagcaaagagaaugaacaauaaaagagagaucaugcaauaagacaagaaaaaaaaaaaaaaccagaaacauacaacauacagcagccaugcauugaggagcgcucaggggcgaugcccuugugcgcugauaaacacucacgugcauaggauaaccccaucuuucagacccuucuggaagucagggccaauggagaggcccgugagucccucuauccagcuucggaguucugcuuccuuuugggggucauauuuggacaggagcuggaagagcaaagagcuaggacugaggugagaagcagacacgcccccgugggaguggccucguagaugaggccagagacagcggggcaagaagggugucugaaagcccaggccaccuccugccgccaccuccugccgccaccucccuagagcaggaugacacgugucaccuuggugugcuggggaugaaagcaacaggcuguguuaagucagcaccagcaccagcacucagcaccagcucagcuggugguccagcgccaguccauccucacagugucugagcacuuccuauaggcagagggcuuugcauccagaagguucacuacugacacuuguagaggccuguucuuuuucguggcugagcaguauuccagcuggccgaccuccgaggaggcccgaccuacauacucaacuucccaccgaugcgccgcgcugggagccgcaccacgcugggagccccccggcgggcgcucccucuacagauuucucucauguucucaaggcagcaggagagcugcccugugugggcagugaaaaaaaaacucaacucuccuggccucaguuuccccaucucuuucuuuccuuccuuucauuuuuucuuucuuucuuucuuucuuucuuucuuucuuuuuuuuuggggggggguucucugcucucacucucuauauagaccaggucagagauucacacaggauuaaaggagugcaguauucuuuuuuuuuuuuuuuuaaucuuuacuuuaugugucugugugagggugugagauuuuggagucacagugcugcuggguccuucaaaagggcaaucagugcucccauccaucucuccauccgccagucccccggcccccccccccccgguuuuucgagacaggguuucucuguguagcccuggcuguccuggagcucacuuuguagaccacuagccuacgacucagaaaacugccugccucugccucccgagugcugggauuaaaggcgugcgccaccaugcccggcaguuuccuauauggacugguuuguguaagaguucgcugucaggcgcucccucuccccuuccugucuuuuaaaauccuucgaagugggauuagcugggugcaggggcagucggggcagcuguucccacaggaaaaagcaaggacagcccagaggggaacaggggucggccagggacgccaagcaugccugguccagcugugccacgucccuagccacucugaggaccaaggaggagggcaggggcucagucccgcccgcugcggccaccucccuccccacugcccuucagcgcauuccugcccgcaggccacaaacuaccaggaaugcgguggccucccgggucuaaaucaagaccagcuguuccccaguggccaggcuccucaacuggaccgaacaaagucccacgggauaugggccagcuagggggguaaacugaggcacauaggucaggcagaaaagucuccggauccccccucccaguggacgaugcaacccuucugugaccccugcaggcuacugggggggggggguccacuucccagcuccacaguuggaggggaucugagagcucauccccugagcaagugcugaccugucccuggccccacccagcuccuaaaacucuauccuuagggcuguccugacucuuucuuucacuuucucuguuccagggagauguccagucuguccaggaagaauugggcagggucgucagaaugcugugugucucuggggagcuagagcaaccucucugagcccagggugggaagugaaauagcaacuugucucuagcaggcugaggauagcacauggguggcaugagguagguaugccucucgugucacuuguagggaccuggcaggugccagucggagguggguccgacugguagcuucagcgugccuaggcagguugcuuggcuuuagcugacugugaaacuugcauucccaggugccaggugugugcgugugguuggcggaucuaucuagaagguuucaggaugucaggccugagcccccuaagucugggaucagugucucccucaucagcucaggacaccuugcuguauggcuccccagaugucccuccgaaacuggugacuucaguguucuccugcauuugcgguuccucucagugagcccuuucccaggugugugugggaguccuggaacggaccacacccuguuaagaaggccaccggccccgcccccuucccuguccccaacuuaaguggcuuagaugaaacggaaguuucgacagguaaugaagauggggccucagggggcacucucagacgcccggaucgcucgugugcucgcuuucucucucccggaccuuaacuuucuuacauccugcaaggggcacagagugcaggaagcccggggcgccggggacugagagguccaggggcggggcuggaggugacauucaggaugcggauaaaauggguccccagccucccagacgccacagcuucccacagcaccccagacccuccggauaucaggguaaagcaaagcccagcugucccggcucaugcaucggucgcgcguucgaggcuggcgagccccgcucccauuggucgugcguucgaggcuggcaagccccgcaacccacucacccgguucuugaccucggccgagagcccguaggacgggcccuuguugaacugcguggagcucauggcgcgggaccccggagcgggacaggaggaccagcgggaccggcagagggucgggcugcgggcggacggcccgggacggggcugagcgccgccccc

SEQ ID NO: 5608 - RNA, 3858 nt, Mus musculus
ugcaccacaguaacuuaucaaaguauccuuuaauucucaggagaguccuucgagaauggagaacucugaacagaacagugacccuggaguaaggaguggggguguggcugcagcucuggagucacucauccugcgacaauggccaggacggaacccgucagucaaaaggcaauccaguuaugacccacaggcuguggcccacagcugucagggugcugugcagagcagugggcucuggguuucccugcaugcggugcagcuguggguuccucuucauuguuuuccuggagacacucacaccgagaaggaguccacagaugugcagcaauccuccugcuucagucucugagcacuagguuuccccuggcaagaguauggguuguuuuggguuuguuuguuugcuugcuuucugaggcuuacuauguagcccuggcuggucuggaacucacagacaucugccugccuuugccccugggcauuaggauucaagccuacccucccguuacauuuuauuuuugugggugcagcucugacccucuaccgggucaaggacaaguagcaggcucaucugggcagugcugggcucaccugcggcuacugcaccaggcgguaggugauguagcggccagccgucucacuggggcggaugaucuucacgaccugugggagcaggcaggcgagggaguggugguggcagggccuugggaccacuggccuauggcaaugguggucuuggccucagagacagggaggagauggaggaaccagggagauccaauaauucccaaagggccuaggaggggaacaaccacuguggcuucucaccugcccucgcuugaucccaaaguaccgugccacuggguccccggccuggauucuggguagcuggcucucacgaagcuugcuagaacagucaaggaagcagcuggcgggcagcgcuggggugagggggguguggggacagaguaaaggauacuaucgagccagcaguucagucaccuccuccuuugucaugaccacgugcucagggacuagcuguggagacagagacccacccacaggcacgcggccaucaggaacuucaacagaccaacagacuaauggguauugucauggggcugggacagaggacaaaaccaggcuauuaauaucaccaaguuggaugcucagggccaaaaccggggaagcaccccgccccggcccguguccuggaugcaggcagcacuacgccccaccccaccacacacaccucgugcucugugauauugaugagcagcuccugcuguagaaacuguuccagcacauacuucggggccauguccaccagggacugcuuggcggagggcgucaugcccugcugcaccacaaucagcgcccgugugauguuuuccuccugcaugcgcuggcaguauaccuugauggucuugaugcccaccuugggcuccucugcgggcacacaagcaccacccucacacucacuacuggagccuguggucuuaguuucucugcuugcaagggaagacuagaacaucaaggcagccaugauggggcugccagggggcucagcuaucacugcagaagcugcaggguaugcaggaacugcggccccccuggaacgggggugggggcucucagcagcucugggguuugggggauaugguacugucagcuuagacagccucaaggagaaacugacugaccaagagauggacccugugucuacaugaggcuagccuugucuccucaggcagagcgcaggagcagacccaggccaccuaguuugcaaauugcuggauaaacacagguauauuuacauuaugacucauaauaguagcaaaauuaguuaugaauuagcaaugaagauuuuaugguuggaggucacaaugugaaguguacuaaggggucccagcaucaggaaggcugagaaccaaugcccuccauaguugucccggaagucauuguauagaccaggcuggccucgacugccugccucugccucucaaacacugggcuuacaggcauaugcuaccaugcccauccccgcaccccccaauucucacacuaaaaaccaggucccggggccacaaagcauuagguauuaaaagaggcaagcugucuggggagacugaauguagcugcacagggagguccugggcuccccaauagccuucacucccacaagacaccugcgcugcuggcagaagcuguagaauacagcacacaggggguguggggguggcauagcuggcccugggacucccaggcagaagcuauagaauacagcauauaggagccaggggguggagggcugagagcugguucuggggcuuaugggaugaaaacgacaccagcaaaagggaggcuucccaggggagacagggacaaaagcaggcagcugccacaaucuuacaggcagcguuaggccagagugggacaugcauucacuggcaccugagccagggccuggaggagaccacuccugccagcccaagggccucaccugggaagaacacaaacaucuggucuguggggucaucguugugggccaccagcaccgugaggucugugcgccuuggccguccuucgcugggcuuguccccaaacugcgccuugaauuccucaagugucugguccaguucauccugggucaccagguagccacggucaugacacagcugcagagacaagaggcaaagaggcagucagccugagcacuuagcucgcagaccugacccugaauggccgaggcuggggacuaacacugaacugauccagcaguacccaaacucuguauaggcucagaccacagcggcccggccaagccucuccuccccccaaccucaguggagcaggcugggauuaauccccuggcaacuguaggcaaccuucugaauacaggcaccuuccuguccccagucuugaguguuccugaugagggagacuagagcaucauccaggaucagggcugaggaacaggcaugagguggcccugggcuccaccaacacagcauaagucaaaacuaugcauaccucuuuaucuaauaauggugucucauguguucaacucaaaacaaccaagaauuuuuucuuuuauucccuuuuucuuuuucaagacaggguuucucugcgugacuuugucuauucuggaaaucacuauguagaugaggcugacuucuaauuuaaagagauucgcuugcuucugccuccagagugcugggauuaaaggcguguaccaucauaccggcuuguucuguuuuuaaaaauacuguuuuuucauccuaugugugucuggaguccccagagaucaggacagggcgucagauccccuggaacugggguuacagaugguugauagcuuucgugugggcggcuaccuagcucgcauaaaaccaagugugaccacgcagcagcccccucucccgaaacggagcccacccaggccuuuuccccugaggcagaguuaggagguggaagcaguaggauuucuaagaguugaagccagcgugggugggcuccacacuuuaaacggggaugcauuccaauccaggaggauuggccccugcgggaggcgggccucggcggacaacccgcaguuaguccgcaacugaacgcucgcucgcauaaagcuccucacgcuugaucaccugcaugaucgucuugcggaucuuccacagccgguaggucuccuccucgucguccaugcugucgcgcuucccaaacaacugugcacgcgcgcucguggagcugccagcacggagccugcgccggacgcacaaaaugccccccgccccccggcagugcgccugcgccaagggcugggaaggcccccgcccagguucgugcugucuaaggugaacg

SEQ ID NO: 5609 - RNA, 3858 nt, Mus musculus
cguucaccuuagacagcacgaaccugggcgggggccuucccagcccuuggcgcaggcgcacugccggggggcggggggcauuuugugcguccggcgcaggcuccgugcuggcagcuccacgagcgcgcgugcacaguuguuugggaagcgcgacagcauggacgacgaggaggagaccuaccggcuguggaagauccgcaagacgaucaugcaggugaucaagcgugaggagcuuuaugcgagcgagcguucaguugcggacuaacugcggguuguccgccgaggcccgccucccgcaggggccaauccuccuggauuggaaugcauccccguuuaaaguguggagcccacccacgcuggcuucaacucuuagaaauccuacugcuuccaccuccuaacucugccucaggggaaaaggccugggugggcuccguuucgggagagggggcugcugcguggucacacuugguuuuaugcgagcuagguagccgcccacacgaaagcuaucaaccaucuguaaccccaguuccaggggaucugacgcccuguccugaucucuggggacuccagacacacauaggaugaaaaaacaguauuuuuaaaaacagaacaagccgguaugaugguacacgccuuuaaucccagcacucuggaggcagaagcaagcgaaucucuuuaaauuagaagucagccucaucuacauagugauuuccagaauagacaaagucacgcagagaaacccugucuugaaaaagaaaaagggaauaaaagaaaaaauucuugguuguuuugaguugaacacaugagacaccauuauuagauaaagagguaugcauaguuuugacuuaugcuguguugguggagcccagggccaccucaugccuguuccucagcccugauccuggaugaugcucuagucucccucaucaggaacacucaagacuggggacaggaaggugccuguauucagaagguugccuacaguugccaggggauuaaucccagccugcuccacugagguuggggggaggagaggcuuggccgggccgcuguggucugagccuauacagaguuuggguacugcuggaucaguucaguguuaguccccagccucggccauucagggucaggucugcgagcuaagugcucaggcugacugccucuuugccucuugucucugcagcugugucaugaccguggcuaccuggugacccaggaugaacuggaccagacacuugaggaauucaaggcgcaguuuggggacaagcccagcgaaggacggccaaggcgcacagaccucacggugcugguggcccacaacgaugaccccacagaccagauguuuguguucuucccaggugaggcccuugggcuggcaggaguggucuccuccaggcccuggcucaggugccagugaaugcaugucccacucuggccuaacgcugccuguaagauuguggcagcugccugcuuuugucccugucuccccugggaagccucccuuuugcuggugucguuuucaucccauaagccccagaaccagcucucagcccuccacccccuggcuccuauaugcuguauucuauagcuucugccugggagucccagggccagcuaugccacccccacacccccugugugcuguauucuacagcuucugccagcagcgcaggugucuugugggagugaaggcuauuggggagcccaggaccucccugugcagcuacauucagucuccccagacagcuugccucuuuuaauaccuaaugcuuuguggccccgggaccugguuuuuagugugagaauuggggggugcggggaugggcaugguagcauaugccuguaagcccaguguuugagaggcagaggcaggcagucgaggccagccuggucuauacaaugacuuccgggacaacuauggagggcauugguucucagccuuccugaugcugggaccccuuaguacacuucacauugugaccuccaaccauaaaaucuucauugcuaauucauaacuaauuuugcuacuauuaugagucauaauguaaauauaccuguguuuauccagcaauuugcaaacuagguggccugggucugcuccugcgcucugccugaggagacaaggcuagccucauguagacacaggguccaucucuuggucagucaguuucuccuugaggcugucuaagcugacaguaccauaucccccaaaccccagagcugcugagagcccccacccccguuccaggggggccgcaguuccugcauacccugcagcuucugcagugauagcugagcccccuggcagccccaucauggcugccuugauguucuagucuucccuugcaagcagagaaacuaagaccacaggcuccaguagugagugugaggguggugcuugugugcccgcagaggagcccaaggugggcaucaagaccaucaagguauacugccagcgcaugcaggaggaaaacaucacacgggcgcugauuguggugcagcagggcaugacgcccuccgccaagcagucccugguggacauggccccgaaguaugugcuggaacaguuucuacagcaggagcugcucaucaauaucacagagcacgagguguguguggugggguggggcguagugcugccugcauccaggacacgggccggggcggggugcuuccccgguuuuggcccugagcauccaacuuggugauauuaauagccugguuuuguccucugucccagccccaugacaauacccauuagucuguuggucuguugaaguuccugauggccgcgugccugugggugggucucugucuccacagcuagucccugagcacguggucaugacaaaggaggaggugacugaacugcuggcucgauaguauccuuuacucuguccccacaccccccucaccccagcgcugcccgccagcugcuuccuugacuguucuagcaagcuucgugagagccagcuacccagaauccaggccggggacccaguggcacgguacuuugggaucaagcgagggcaggugagaagccacagugguuguuccccuccuaggcccuuugggaauuauuggaucucccugguuccuccaucuccucccugucucugaggccaagaccaccauugccauaggccaguggucccaaggcccugccaccaccacucccucgccugccugcucccacaggucgugaagaucauccgccccagugagacggcuggccgcuacaucaccuaccgccuggugcaguagccgcaggugagcccagcacugcccagaugagccugcuacuuguccuugacccgguagagggucagagcugcacccacaaaaauaaaauguaacgggaggguaggcuugaauccuaaugcccaggggcaaaggcaggcagaugucugugaguuccagaccagccagggcuacauaguaagccucagaaagcaagcaaacaaacaaacccaaaacaacccauacucuugccaggggaaaccuagugcucagagacugaagcaggaggauugcugcacaucuguggacuccuucucggugugagugucuccaggaaaacaaugaagaggaacccacagcugcaccgcaugcagggaaacccagagcccacugcucugcacagcacccugacagcugugggccacagccugugggucauaacuggauugccuuuugacugacggguuccguccuggccauugucgcaggaugagugacuccagagcugcagccacacccccacuccuuacuccagggucacuguucuguucagaguucuccauucucgaaggacucuccugagaauuaaaggauacuuugauaaguuacuguggugca

SEQ ID NO: 5610 - RNA, 9277 nt, Mus musculus
agcacauuucuacauuuuauucccacaaggcagccagggugaagcucgagcccagggccacaggccucuggaccuuccuccggcagggaugcacgccagguccucaggacugccccaccagcaggcugguuuucaggcagaccuucaugagugccgggguggaaggcuccaggggucacagggcaggggggcucgguguaggggcacacacuuguagggcuagcuagagauagcacggcagguccuucucuaucaccuguagggagauaacucguucagacgugccccucagcaacugcacacagcccuggcucgggcugcuuuggcaaagguaauaauuaccuggggcuccuccaugggaccauagcgcuucaccacgcagccguucuuaucaaugagaaacuguaagacagaggaacauguguugacaguugagcaccagcguggaggagggaggggagcugggacacauucccacacuguaugccacuuaccuugguaaaguuccauuugauggcacugggaggggagggggaaggagaaaaaaagaauguuuacaagugguaccugccagggcauggugguacacaacuuuaaucccagcauuuagaaaacaggcaaguggauaugagaguucuaagccagccugguuggacauagucuguuccaggccagccagggaaacugaagcuguagcucccuuggugguuagaggaaugcacugcucuucuggggaaugggcuacacucccagcaccgaaagucuguuaacuccaauucccaggacucacaggcugucuuccggccuuggagggcuucaagcaugcaugcaugcaugacacagacuugcaugcacacaaaacgcauacacaaaaugaaaauaaucuggcgugguaggggcagacaggccaaagacugugagcacuggcuguccuuaaagagcacucaaacucagcccccaggccccacuugguggcuaccaacccaccaaccccagcuuuggcaaauuccaugcccucuucuagucucugcagacacuguaccuacgugguacacauaaauacacucagacaaaacacccauacacauaaaauacaacuaaagucaucuuugaggcucagccagguggugcacaccuuuaaucccagcacuuuagcagggcaggcagaucucugaguucugacccaaacuagagcuacacaaugaaacacacacacccccccccaaaaaaaacaaggaaaaaaaaaaaaccuaaaaauuuggcaccugcuccccacccagguccagagccaucuguccccucccucccccagggccacucacuuucccagcaugccccugcccuugggcuggacuuucauccauuuccacagugggugggcaucguccccauuuacacagaucuugcuguacaugucaaacuugacguuguagccggcugcaaacuccuugauuucuugauuacuuccuggcuccugcaggaagcaacauuuacuuggaagauacacuacacuguacacugagacacacacacacacugacacagccccccacccccaccccguaugaggggcauugccuggggaacagccacacaccugccucccaaacugguugcaggggaaggccaggauucguaaaccacacucagcauaucgggcaugcagaucgacuagcugaguguaguuuacgucaguuuugccucauugcgaggccacguuggugacgaugcacacgaaaccccugggagagagaaagagugggaaugaagccagucaggaaauccccauuuucagaccagccaugcacaccgcccauaugacuagaaacccaccuguacuuauccaggcagaccaugugcccgucgauguccuuggcugagaauucgugcauggagcgcgcacagcgccaaucaucgcgggaugcacacuguaaaacaggaaaacugaguguccuaacccagguccccuaggggagaagaauccggugccaaagaaagaaaguccuggggcacuagguggaggagucucaagguuccuuccauuaaguacgccccuuucaggucguccugauaagaucuguggacaccccuagaauaugcuaccagggaagaggacggcagggguaucccuggccgcacaccaagcccaggaacucggagcuguugcaguacuggggaggcucuugcagcagaggccccggguugaaagguucaggaaugggcuccauccggcgagggcgcgcccuccugcggcggcgcgcgcgcgcuuuccuucgccgagggcccgggcguuuccuaggacuuuggcguccagguccacggcgucgccggccucucggggauccgccgcgcugucugcagcguccccgcuugcgggcggccgcgcggcccaugcccgccggucugugcgucccaagcacagcgcggggacaaagagccgguagccaaggcgccgccgacugugacgcaccaggccgggcagggcgcgugaccaggucagagcccgcuauggugaccccgacaccgguucucaccgcccaaggaccucccgcgccgaggccuagccuuguucaaccccggagaugccuaucaggcuccgcuuucccaccugggugcccccuucucuagcuaaccgaucccacgaccccugaucuccacccuggauacggugacccgacuccgaaccccgcccccacccgcgauccuccaaguucccaguagcccaccauggugccugccagaccaggcgcagccagagccccgcacagcagugcuggcuuaaguaagcggcucagacggccccagcucaucucggcggccggagccagcggcuccuccccucacgcagccgaccaauggacgcgcgaggccgaguauggcuugcccgcccucgggcacgcccacugacgucucuuauuggucagaugcgccugcgcuaagacgcgaggccccugcagccaaugggaagccugaaugaagggacggcuugggcggggcugggcuuacgaguuuguuguuaucagcaacugcgcaugcccagugauagggacgcgggagaaacgggagccgcguucucgcggacgacgcguuggagggcuguggacaguuauccgcgagguugccugcagcggagcagggugccagggcgcuuuggggaaccucugggaauagaaagcgugucaaagucauccccuuaaagagccccuuugaaaguacaggagucuccuuuuucuacuggaaacagaaucucauguaacccaggcuagccuuggacuguuuauauagcagaggaugaccuugaaccccuggaccgccagccucagccuacugagugcugggaucucggugucggccaauccccacaucccuuccauuucuauuuucuuuaucagagguugccuccuguagcucaggcuaaccuaaacuauggaauggcaaaagugugcugccaugagguguagggauggaacccagaaccugcagcaugcaagugagggcucucaacccauugagucccgaaccccagauguagcuucuccccccccccucgacccccaauuuuacaguucagccggucuuagaacucagcaauccugccuuagacuccuagguacuagggugauagauaggucaaugacaccaggcccuaucuugucaccuguagauauugauuccugugaaguugauuugagggggugauaagagggcuuggugagaaagccauugccaugaaaacacaggacuaugucccaaucgaagcacccacgcaaucuggugcacaaggaugcucuuguaauuccagaaccugcgauuccgaggcuggagcaucccugcagcuaagucaggucacccaaguacucguggucagagagagaaccugccucaaaaccaagauggagaugggccuaguggucacacucuuagccccagcccuuggagccuagagggcagccuggucugguaagcaaguuccaggucagccaaggcuacagugaacccugugucaggaaagcaagguggcaagagacauauaaauaguuacuauuguccucagaggucccugccuacaucaaagaagccacaggucuuaggggccuaagugagaagcugaaggcccaacaguuccuccugcaacuucaccuauggccuuguccagcccccacagcucucagcccagcacugggcccuuugcccuccccgugucacaggagugacucaggacauuccucagcucagcugccuguccacgcccucgccuggacucuaaucccuucaauccucuuuuucugaacccuggaguaagccauccgcgagacaggagcccucccggggaucuggguccaagggagcucacgccccacgggcagacacccccccccccaagguuaagaugaucuggggugucagauacauucuugcccaauccuguccuguaaguucucaguugcccugagggccccccccccccccccgccucaggaagucagcuguuuccucccagcccccaagcuggggugacacugagagucacugaagaccucuaagggacuugcacuugagcuuuagcuuaaguuguaaauacacaacacacccucacagggcgucucaaaggcccguacuucuggacgaggggcuggggcugaagggcuggggcugaaggcggccacucaggaacccagccccaggcucugggagggaucugcauauggagugccuuccucucccaagugaccccaacuucacccuaauucagccaguugggaaaugaagaucugggcuucugcgaaaagcuacuuggcaguuccugagaagcuaccagcuucuggacagagccugacuuuuaccucauuguuauuuuggagacagggucucacguagcccaggcuggccugaaacucacuuuguagccaaggaugaccuugaacuccugaucccccuacuucacccuccugagugccugccgggaugacaaguuuguuuguuuaucgggugcuggguguggaccccagguuuuacacauaccaagugaggccuuaagccccagccuuuguuucuaauuuccuuuguuuucugagaccaggucuccaauuuccccaggcuccucggagcuucucgccucuugcuccccaagcacuggaaagacagagccauugccaccaacaggggacccugggaaugagaagccgcggucguggacaaccugcuagaaggacuuaagaaagauuaaguuaugcaaaguggaauuuaacuaagggagugcuccggguagagcagccaccuagggacaguaggccgggccgcuaaacggaggacagagaauagccuucagguuuguuauuaagauuagccaguuaaggggggggggauuaaaaaaaaaaaaaagaaaaagaaaaaaagauuagccaguuaagcuucauccccauaacaaaaggagacugacuccgggcucacagcuggccuguaaccggguccccccauaucaaagcccugggguucaaagguggcccaugaguccuguggcuaguccauccccucuuuccucaaggccacucgcaggaagggcgggauucugccaggcaacaggccccuagucugugaccaaaagacugaaauuauauuuaaacuguaaaucuccccccuucguccaaacagccuuggaguuucugccucugucgaacauguuuaacugcucgaaauaaguuggggccgugaaaccauacaagcggaggcaaccucggguggaggccccuuuggggacucuuucucggagguucuucccuaucaaaucaucugcacaguagauauuuacauuacaauucauaacagucacaaaauuacaguagcaaugggagguuuauggcuagggggucaccacaacaugacgaacuguauuuagggucacaacguuaggaagguugagaaccacuggguuaaguggcuuguuguuauuggcugcacccuuugugccuuggccagaaccggucaggugcucuugggaauuucccuucagcgaucuguguugagagauuucucacuguucgaguguugggagccaaaccagccccaggcucucucagaccccagugcaggacaaagggaacccuagucccuuugucuaggggcacacaaggcaagguccagccugggguuggggccuaagccucaaaguuaagguuuuguuccccacgaagccagauuucuccccugaauggcugugaugacaggcccuaaggcaagccgugucugagauguccccagugcgcuuugcaaacauugucugauuucacucucugcugucuuaggagaccauucccuaccugggaauaggaugccagauuuugaaaguaaguuuguuugagacaggguuuuccuguguagcccaggcuggccucaaacucacagagcuccuccaaccucugccuccagaaucaaaggcggugggcaugccaccacugcugggggaugcuguucucuuuaagaaacuugcuugguuuccuaggcccagcugcugcuguugccuuuacucuccaauccccacuccucccacacaccucacccugggguuugagaccuguauuccucugcgcuugggucaggaaggcauguuaauucccauuaacacacacccaggguaucuccuuucuuuuuaaacauuuauguaguugauuuucauuuauuuguuugcguaugaguguuuugucugcguauaugucuguauacugugugugugccuagugucuaaagaggucagaauaugacauaaauccucuggaacuggaguucugggugguuaugagcugccccuggguacugggaauuuaaccuagguccuaugcaagagcaaaaaguguucuaauuaaagaaacccaucuccggcccgcgugcaugcuugcuugucucucucucucucucucucucucucucuuucuuucuuucuuucgacagucucacuauacagaccagacugaccucuuuccuccagugcugaguguagagaaaauucuggaauuuuaguuucuuaaaacaaacaaacaaacaaacagaaaacagaaauauaagaauguguuuucauuuuaaucccaggugugggguguagggcugcuuuggacuguccacagcagcugacuaugauuugccuccugcucuagcagaggcacgguuuuaccagcugcagaaaguuucugaguuccugugaguguuuggaauguuuggaauucugggaaguuuucagaguguguacaaaugcuagggcccugagagguggguuuggugguugcugguuguucguggggcuugguugcaguuuguuauaguuuugcucaaagaagaaacaagaagaaagcguuccguucaggucucucucucucucucucucucucucucuccccuccccuucuuucucuccuaucuagugaaaccaaggagauaaguggugaaaccaaggagauaaguggugggaaaaaaaggaacccacaaaguaguuaagguccaaggccuugcugucaccaugccugucacaggauccuuuuaaaagaagugaggcugugaaguucaguggguagagcuuaccacccacccucaccccucacaugucaaauucccccaguuccuaccccagcagaggagggacggugugugcaucccagcaaagcuccaaagcugaaggcagggagaucauccugugcuacucaaaacccugcaucaaaacaaaacaaggacaaugaaagaccagacuggugucuccugagaccucacucugcgaugugggucacauggagguggcucuggcucucagacaguggcacaaaaggcuccuuugugcgcuagucaauggcgugggcaggaccagccuaagacgguccuugcuuaggagaaagccaaagccaaccuccauguguuccucagaugguguuggcaccaggaaucccagucagaccuggcugaggucaucaucaccucuguuuguaacacagaaaacaacuccgcagauggcuuuguuuguuugcauuuuucucucauacauuacaccccaacugcaguuuccccucccuccccuccccagauccgcccaucacugccuccccucagaaaagagcaggccucccaggcacuuaaaccaaacacugcauaacaagcuacaauaagcccaggcacaccaacacaucaaggcugggcgaggcagccuguaggaggaaaacugaccuacgaagcaaaaguuuucauguugugaaagucugggguuuugccugcauguuuguuucugagggugucagauccucuggaacuggaguuacaggcagaaugcucuacacaugggugcuggguccucugagcagccagugcucuaaccacugaaccaucucuccaaucuuuuuuuuaagggaguggggcagcacucuguagacuaagcugaacuugaacucacuggaauccuucugcagagcucccgcgauuaaagugugugccccccaccccccagcuuauuuuuagccuuuuuacuuucccaugcugaacaaguuuuuugugugccuguuuucucaggcugcuccuacaauggaaucauuagauacuacagucauuguugagugguccauuucucuguguguguauacaccauaaaaggcagugucaagucccuggcgcugaagcuacagguggcugugagccaccacaucggugcuggaaaccgagcucagguucccaccgcaucagcacaggcuccuaccacggaccgacucuccagccccuguucacagcacccugcugucuucacucccacuagccuuugucguuucuggccccugacugggcagugagucccugugcuaagaccccaggaucugaguugacgcucagggcccuggaacccacaggcuccagacaacacaugcuuuccuccagccgccgucccuaccagcagggacacugccccagcaaaccacgcagccaaccaugucagccugccacccauggcaggcccuuccgcuguucccauuccacucaccccucaccuggcccagggcccccuccucccugcugcuccccuccgcggaccugccugcucaccuccuccauccccacucaggccgcaggcccucagucaccacugguuuugcuccuaggucauggcaaccuuguccaacuuggcuuugcuggcucccucaccuccagacaccuucuucuccugguugccaagacaccuggcuccucuugcccuuuguuccaguucagaaacgcuguggcagcagcuuggucugggugggauugccugcugcag

SEQ ID NO: 5611 - RNA, 1216 nt, Mus musculus
cagagcccgcuauggugaccccgacaccgguucucaccgcccaaggaccucccgcgccgaggccuagccuuguucaaccccggagaugccuaucaggcuccgcuuucccaccugggugcccccuucucuagcuaaccgaucccacgaccccugaucuccacccuggauacggugacccgacuccgaaccccgcccccacccgcgauccuccaaguucccaguagcccaccauggugccugccagaccaggcgcagccagagccccgcacagcagugcuggcuuaaguaagcggcucagacggccccagcucaucucggcggccggagccagcggcuccuccccucacgcagccgaccaauggacgcgcgaggccgaguauggcuugcccgcccucgggcacgcccacugacgucucuuauuggucagaugcgccugcgcuaagacgcgaggccccugcagccaaugggaagccugaaugaagggacggcuugggcggggcugggcuuacgaguuuguuguuaucagcaacugcgcaugcccagugauagggacgcgggagaaacgggagccgcguucucgcggacgacgcguuggagggcuguggacaguuauccgcgagguugccugcagcggagcagggugccagggcgcuuuggggaaccucugggaauagaaagcgugucaaagucauccccuuaaagagccccuuugaaaguacaggagucuccuuuuucuacuggaaacagaaucucauguaacccaggcuagccuuggacuguuuauauagcagaggaugaccuugaaccccuggaccgccagccucagccuacugagugcugggaucucggugucggccaauccccacaucccuuccauuucuauuuucuuuaucagagguugccuccuguagcucaggcuaaccuaaacuauggaauggcaaaagugugcugccaugagguguagggauggaacccagaaccugcagcaugcaagugagggcucucaacccauugagucccgaaccccagauguagcuucuccccccccccucgacccccaauuuuacaguucagccggucuuagaacucagcaauccugccuuagacuccuagguacuagggugauagauaggucaaugacaccaggcccuaucuugucaccuguagauauugauuccugugaaguugauuugagggggugauaagagggcuuggu

SEQ ID NO: 5612 - RNA, 20602 nt, Mus musculus
cggcgcggcgcagggcgguaaacaagauggcggcggcgugucggucuaggaaaggggaggcggcucacggcguccgcgagugaggcgcgagucgccgagggcggcgccggcguggaguugucucucgcgggcagcaucuuucugccuggaguucgauuccccccucgccgcuccggccuccugccugucgcgcggcggcuaggcggcgagggggacgcgccgccuggggugguuuuuuuccccccucgguccccggaagauuuccuguccggauuucguguccgcgacuugcgggugucccggugucccgcguccggguggagucugcgccccgagaagucguagaacuaaggggccgcgcgcggcuucggcgcgggccggacauggacggcgcggaccggccucgacgcggccgccugggccccugagcgcggggcccaaguggcgaacaugaccuagcggcccgcgcgccgcgacggcggaccgucgccuccgucggaagcagcguccccggggacccgaauuggggggacgcgaggguugggggggcucauugcuuuuuuuuuuuucauucuuauuuucauuuuuuuucucccugagcaccuagaagaaaaggggaaaaucaaaagugaagaauuggcgcccaggaagcggacguggacccgguuguggggaccgggagaguuguggaggucguuccuguuuuuccccguuccuuuuuuccccuucuuggaacauuuggaagaagcgggugggggggggggaauucgaacuugaaaagaauuggcgcucccgaaggggacgaggacaaagagugggccaggauggacguggcggaccccgagccguugggccuuuucuccgagggcgagcugaugucggugggcauggacaccuucauccaccgcaucgacuccaccgagguaaucuaccagccgcgccgcaaacgcgccaagcucaucggcaaguaccugaugggggaccugcucggggagggcucguacggcaaggugaaggaggugcuggacuccgagaccuuaugccgcagggcggucaagauccucaagaagaaaaagcugcgcaggauccccaauggagaggccaacgucaagaaguaggugccaagggccuggggccgacgcgggcgcugccuugagcuccuugggcagcccuuccuccuacuuucuggcucuucucuuuccucuaaccguuuucucuucucauuuccuuccuccuuuuucaucucuuuccuuuuacugccuuaucuaccccaucuaucccugagcgucaccucguggggucuguauguuagggcagccugcaggacuguccuagcaggaggucgugcagccaacugcgccuccagccccccucuuugggccagguccuggcgcaagucgcgccuggcuucuuuggcgggcguugccaggcggguggcuaguuuguuuacgcagcuagagggaaccgguggggccaaaaauaauggugaagggggugggggggguagccggccagugcuugcgcaggucccugcggugucgugcgcguaguuggcgucguuggcccguggggacucuuuaucgccugcuaggcuuggcggaacuuggaaaacuucaccuaccggcuuccaagaaggggccuuaucuuugggaccagcacuggccacacucugccuaacugaccuugccucugguccugucccaggaaaggcuggcagcuucuuguuuuugccagcugggcacugcuuugagugguacguacaggaaaggaagguggacagauauccaggaucagauguguggacccagggguggagcagggcaggcugguggccuaggcuccucucaggaccuccuuggccuuuuuuguaggaguggucuuaggucagucuugcacuggggaaccugggcacccagcaucagguguuccuucagaggccugagcuuggaaauuccuggcuugaaaucauugucucaagguggaggugccagagguugcucaccuccagguggugucugcuggucuccaaggcaaguggcuuccuuuggcuucaggguaaugguucuuggaagcccaccaugucugggaggcugcccaggccugcauccuggcuugggucagcugcaguccuuguaacacauggcaagccugugugcucucucugccugugacagagggccccagagcucugucugcgacuuccuagcccucaccugcugcuuuaggcuuccugccaucucaacacccagguugggguguggcuugcagagccaggcagguucagcugagagagauuggucccuagauccugaaguaaacccccccccccaugaauuagugaugcuggacacagucaacacuggaggucaucaggacuggggagcuccuacacacuagggugauauaaggagccugcacgguuccucaagacaggaguuggucugggcaaguagacacaugccucucauugcagugcuggagagacugaggaaggaggauugcuucuguuucuagaccagcuaggagugcaugggaaaaccugguuuuauaagggaaacugguugguagggugaaggccccaggacccacaaggugaaagcagacucaguucucacaaguuugcucugacuuccauguguaugcuguggcacauguauauacacacacaagauaaaaaccaggaggagaaacugaggcaaaagcugcagacugacacacugcccugcaguaaggugcuugacuggcaggauacaaagccagguaucuccaugggagugcugguguuccccacuuccugaguggcuccugcagggcaaagccuagggcugcugcaccugcuugugugauccccacucagccacagccuggaaggggcagcuuggcgggcaacagcuggugcgggcagaaaggcuccuuugucugcaggggcuuaauagacugcacuccuguugucucucucacggugaagugucuggaaccuuccaggcaagccucugggguccuguccuccagucugcacacagagcuuucuccuuccaguaccauacuguggaugcaugccagggcgucagguaguguagugccuccguuccuggcaaggcugcagagaccugugcccuuggcuccugucauccccacugugagaagucgcaauaauuuuuuuuaauuuuuauuuuuuuuaacguacauugcuguuuugccugcaugugcaucugugucagauccccuggaacaggacuuagagauaguuaugagcuguuauguuaaauugaacccagguccucuggaagacuagccaaguacuuuuggcuacugauccaucucuguagccucaaguagcaugaucuuaguaccagcugauaggagaguugaggaaguugcuggugaccugcugcuagcucuauggcucuauggcuuugaagccccccaccccucaaguguacugugguuguccugcucugccuuaccuguggggcuuugugugguuaaaaccccauguaaacccccugggugcaugggccuuguugccacuugcuugugcauagauauacuuugagaugagacagguugauaaagccaacccagaauacgguggggaugaggcucuuccauuuccauguugucuguaugguguaguggaaggcauggaucucucuccagcugaugcccucaccaccaggagaaugccucuguaugcuugcuuuuuguugguguuuuguuuucuuguauuguguuucccccaucuagcccuggguguccuggaacucacuuuuagaccaaguuggccucgaacucagaaauccgccugccucugccucccgggugcugggauuaaaggcgugcacuaccacugccugguaacauucuuuuuuuuuuaagauuuacuuauuuacuuuauguauauguguacacuguagcuguacagaaaguugugagccaucaugugguugcugggaauugaauuuaggaccucugcuugcucugauugucccugcuugcucuggcccaaaguuuuguuuuguuuuguuguuuuuuguuuuuguuuuguuuuguuguuuuuuucgagacagacuuuuuguguagcccuggcuguccuggaauucacuuuguagaccaggcuguccucaaacucagaaaucugccugccucugcugggauuaaaggcauguaccaccacugccuggcucauuugguugcucuuugcuaguugcaggucaugaguggucagcugugccugugcucucugaguccacuaggugggggcuccugcuuguccuugcucuugacccucuuuccuaguuccccuugcuugcccuguaggcaagugguuagggcugaaggccgugcagccgaaagcuggguccuggcaguguggaccaugccuaguugaguugccuguccuuugcaacuugucuggccaccaucucuuuuggggauagggagcaccugccugggcagaguggcuugugcuggauggucacuggccacuuaaaagacagggcagacaguguguucagcuguugggugucaccacccuguccagaucugcaccugucugcguugcuggggccaugggaaaugcuggcagcucuccagggacaacuggaggccauaccauggugacuggcaggcugugugauguggauggugaauaguuaggacauuagcgagguguaggaaacacccuggacuuuguuggguuuucagcccucagaucacaaaacauccaaagcagccuugaugagcugcucuugcuaccucccugccugccugccugccugccugccugcuccugcugugaggccacccugugugcccacacccugagugcccacaccuaugcuauagccucauguggcuuacuuuguugugccuguggcaucuagagaucauccucaggugucaccucucagugcccagcacuuccuuucauacugauaggaaccuggaaccugugacuagaugaagugacagggcucaccgguauacaccaccacagucggauauuuauggguauugggagaucaaacucagauucucuggcuugcuugucaagauuuacugucuccccaguccacuguuagcugguuucuuuggcagggaauugaugcuuccacaagggaaccauguugguccacagacucaguacgggguagccagcgcacuggaaugacaggauggaguaucugcugugcgggcagaauucaggacucugcaucaggcaugggucacacuuuuacuuucccagugccagacccugucacugagcucugcuuccuaagaacugaguugggaguguccccucucuuaaguuuagagucugcuuaggaugugggaugucuguuuuauuuuauuuauaugaguacacuagcuaucuucagacacaccagaaaaaagagggcaucagaucccauuacagaugguugugagccaccaugugguugcugggaauuaaacucaggaccucuggaagagcagucagugcucuuaaccacugaaccaucucuccagccccucaccugcuuuucuuaguuaccuaaaagaaauccugaacacaggaggauggcaaaaagcccugaagccaggugguugggguccuuccugggucugaaccugcccgggcgcuuaggcucccugaugcccucaaguacuuuccugugggugagaguuggaugcuggaggcuucaguaaggugguuuuguuuguuuguuuuuaugaaaacuuuaugaguguuuugccuguauauuguacuccaaauguaccuggguaaccagaagagggcaucagaucuccugaaacuagaguucuggguaguugugagccauuguaugagugcugggaauugaaccagggucaucaucagcccagguuagccucaaacucauaaucccccugcuuuagccuccuggguuuuggguugcagauacauagcaccauguccagucaugaggaugcugugcuacugucucauccacuugucuucuugcugucaccuagcaccugacugaggccacugaggaaggaagcgauugcaggcagaguuccucccugugggggagguaccuaaugacgaacaugucacagcauaucugcaggcaggaggcagacuccuccucaauccuuuuuuugggguaggacuuuguccuugcucagucuaaucuggagacucccucagacuuggccagugucuauagaguugaucacuauuaaccaccacaacaucugcuguguaacuucuggggagaugcuacgcacugccuguucaccccagguagggagcccacggcugaccagaguauggauaccaccgaggucuaguguggugaaccagugagguuuauugggguuauuauuagaggagcagagauggcugaauccccaaggcccuccccagcaugggcgacggcucucaaaucugggaaccuagaccacugcagagccuguaggcaguguggcaggcuggagaguguccuucaggguggcucuguucuaauucucuuccaggaaggcugcugaugucagagcugucuaugcaguucagccccccagccuucguugcauuacucuaggggggaggaguguagugacauuuuuaagaauucuggaauuuugguuuccuuaaaaaaaacacagaaaugagccaggcagugguggcacacgccuuuaaucccagcgcucgggaggcagaggcaggcggauuucugaguucgaggccagccuguggucuacagagugaguuccaggacagccagggcuacacagagaaaccuugucucaaaaaaaaaaaaaaaaaacaaaaaaacaaaaaaaccaaacaaacaaaccacacagacauauaagaaugugcuuuuauuuuaaucccaggugugggaugcggggcugcuucgaacuguccccagcagcuaugauuugccucgugcucuagcagaggugugguuuugccagcugcaguucuuuucugagauugugugacauuuggaguucugggaauuuucaucggguacauaaaagugagccccaaccccuaggcaagguuggugauguaauuagggagguugguugcgguuugguugaagaagaaacagaaggaaagaaauuagauucuuggaguuuccugauuucucuccucuauucuuuuuaucuguuugguuuuucuagacaggguuucucuguauagcccuggcuguccuagaacucacuuuguagaacaggcuggccucgaacucagaaaucugccugccucugccuccugagugcuagaauuaaaggcgugugccaccacgcccggcuuucacuuuauuucuuuuuugacaugguuucucuauaugguccuugcuguccugggacucauuuuguagaccaggcuagcuugagcucaaagagaccugccugccucugccuucugaguggagauuaaagaugugugccaccauggcuggcuccagggcacagcugucagcugacucacuguucucucuaccuugauuuuuuucuuuauuggcaugaguauuggccucucugucauaggggugucaacuguguggcuacuaccucagcuccuaccucccuaguagacuucaagcccugccuuugacaguccuugcugugccgugggaugucaggauggcagccuuaguuuuuauaguaacugccuggaagucaguguggaaguggggggcugguagagucugggguuugggucaugcugcaucugagcacugguccaggcaucuuagaguugguuucccaagaaccccaagcccaagacacaucugaguguguaucuagcugugcuguuucccucccgugguguggcuccuggggacagaaagugaacuaggguugaacuggaaguucucuucccaacacuuugaggaaggauaauugugucugucccaaugcagaccgucuccauaagugcugugugucuaggcuggggggaacuguugaccuuggacccaggccugcuuccacagcccagaacauaggguggaugcccagugggcuaugcucagggagacuuguagaggaaaggggucuggaguggugaaggcaggccugggaggggcacuguccacccagcugggcuuuugggugagggugcagacuaaccuucaggguagaugauguugcccucacccauccuggcaugccaaccucacccauccuggcgugccagccagccuccuggagaagugcauagucaaucacccugugaagccccugugagcugcccaccacagccauaguccuaugccccagugaauccuccugucucuggagucacuuguucuggacaucugcuaucacggaggcccacauuguguggccuuuuugugucaggguuucucacugggccgagaugucccuugacaagugucagagccuuguuccuguucacaccugugugauacuuuccuuuguuauguaggugggucauguagugccugucagugucuguuagggucagugccugccccuuuggcugcugggugacuucugugauaaggcugugcaugucugggagcucuugauauuggggugcugggccauugccuggguaucagaccugagcuaagggaagcuucugggauaggccacuggccccaucaacuugucacacaguggcucucgugugggaccagcgccuuccucgaugguaucgugguggcuguugccagucucagggcugaccuucagcucaucggggcaguccaggguugugagguggggcagugcuugggagaagccccguggcccucuuagccuagcccgaggcacguuaggugcuggacuugugccgccucccauggggcuuugcuuguccuggugguccuucuccacuauggccugaaaccaccacagcccagaugacuguccacucccugggauugagccaggugucacaggcaaacaggaggcuccaccagagaugagcaugugugccaugacuagauguaggcuucucacagcaggcagggucagcuaagcaauguccucuguugcagggagauccagcugcugcggcggcugcggcaucggaaugugauccagcuuguggacgugcuguacaaugaggagaagcagaagauauauccuguggguggagugggcugggguggccccuguguuaggggcuggaagccuucugcaaggccucuggcagcaauagugcuacaugucauccuguggugccugucagcucaucaggcaggggagcaaggcauggggcuuccaccuggugccagccuguucugagcaguguggcugggacugggcauggccucacagggacuuggggccuauguacauugacagggccccggcugguucuagagguuuccaugcugccccuucccagagguagagguugcacagccuacguugcaucugggcaguccugggagcauucugagaacccagugcccugcagccccaacuccugguacccaucucucccuguggcuaguacaccagcugauuucaguccuguuguaaucuaugcugacuccaugugguccaagucacugugguggucuuguggacccugugaguacugauagggagcgcagaauggcgggagagcagaguggugguggucuguuggcccagcggggcccuccagaccacuguugcuaggagcagggcuccugggcuuggugugcugcuuuccuuagcgcccuacguauauggugauggaguacugcguauguggcaugcaggagaugcuggacagugugccggagaagcgcuucccugugugccaagcucaugggugagugcccugcugggugcaggaggagcagccauugucaggaaacccagguguuucugggcccccaguuuuuaacccagccaaugugcuuaggguuacccucuuguuaggcccuguggucccgcugcccugcagagccauagugggucugaguccuguucagugcucccagguucagcagaaucacauccccugguuagcagagaacaaagggaagggaagggaaggaagcaagccagaggggaaaccuggcucccugggccugggcagcagugacugccaguugcccuguguaauuuuaguggcccagccuucugacucucaggucuguuugccugagcccuaaacaucuaucaccuuguaggccaggucucaugagucucccaaacuucauaucagacuuauguagguaccaugguaugggcugagacacuguggggccugagccagucccacccauucagguacuuccgccagcugauugacggccuggaauaccuacacagccagggcauuguucacaaggacaucaagccgggcaaccugcuacucaccaccaauggcacacucaagaucuccgaccucgguguugccgagguaggcaccaugugcagggaucaugggccgcuucuccugagcugcccugacucucacugcccugcaggcccugcacccuuucgcuguggaugacaccugccggacaagccagggcuccccggccuuccagccuccugagauugccaauggacuggacaccuuuucagguuucaagguggacaucuggucagcuggggucacacuguaagugucuuguguguacccuguagcagauggggggcuguggguuuucccuaguguucuugggccuuuuugcccacaguguguggcuagcagguuggacauuccaggucugugggugugguuccucacccuaccccaccccacuccacaggguuuugcuugcacacagauguaggugccaugacugcacaucuaccaguuaacauguguccugucugggaguuggggcaccuguccucuggucuccaguguggccagcacugacacucuuuuccuaugugaaguuacaacaucaccacgggccuguacccauuugagggggacaauaucuacaagcucuuugagaacauugggagaggagacuucaccaucccuugugacugcggcccaccacucucugaccuacuccgaggugggcaucucuaaaucacccaaauguuaggacagcaagggacagagccccuggucuggagggguucugaccuuacugucaggacagccuuuguccgccaggaugggagguuucugagauugcuuccccccaucuggggccgggguggguggguggggucucagugcuauggggccuaggaaggccaaggggauggaugcuguaguggugcuguagcacaaagcaggcaccugcuacacucacuuaucucuucuguccuacagggauguuggaguaugagccggccaagagguucuccauccgacagauuaggcagcacaggugagcauggccggccugucucagccugcugggggucugagcugagaacauggucucagaggugcuaggucaucacaggaguaaggaucagugugcuguguguauugaugucugggaaggcugugugugaacuuggggugugacaggggugcccaaugcaggccucccuaccuuuaucauuuuguucaggagugcaggcguuauguggccugagaagcuguagauuucagggccuagaauuagagacggauccucccaugguggggagggaggaguagauggggaagugucacuuuggaucccagcuguuccuuggccaucuggacauggaaaugugucuagggaggccaacaggaagcgugaggcauggugucuuuccucaccugaggcuaagagccuucuggguaacaguggagccucuguccucccuuuguuuauuuaccagcuggucagagccuuuggguccaggcuucucuguccucuucucccuucaugcuagacugagacuggcucagcugggugucccccagugagggcuucuagccuauccguguucaaggcgggugggacuauaggugcagggaccugauugcccacccuaguccaaggcgcuguggcugucaucaguggguggugguuugugccagugcuauggguguuaggcuaccucaagccuguagccggagcacuaaggccucgucuuauguaaggacagccauggugugggcuuugguggguauuggccagccguggucacagugccuggcaccugaugucugugcugcacuuggccuucuuuagcugguuccggaagaaacacccucuggcugaggcgcucguaccuaucccaccaagcccagacacuaaggaccgcuggcgcaguaugacuguagugcccuaccuggaggaccugcauggccgugcggaggaggaggaggaggaagacuuguuugacauugaggacggcauuaucuacacccaggacuucacagugccugguaagcuggcuuggcgcagcuccuacuggagcuggugacuuugugcacucuggggcugguccccuucccaagucuccagccagcuaacaugagccaccaggacugccaaagccauccugguggcuguggcauuucacucugggcuagaugaagggcucccuggcugcaucuagcaggaggaggggaacccuggagggcaguggguaggggcccugagacagccaccugagggaggguccaguggcccucgguccuggccaugccugaccuuauaucgccuucuuccccaggugucgaggaggcggccgaggcagggcuuagcgaggaugcaugcgacacaugcauguggaagagccagggcgcaggccuuccuggagaggagcccgaggagggguuuggggcuuuaguguagcucccugucugcugccccacccauguccuccauaaagcuuuguccacugugucugcagguggaugcuugccgcgacuucccuccugucacuacccugacaggcuccccaccaggguuucagagaacaugccuggguccaaggccugagcuagguccucagugccaggguggccaccagccaggggcucuuggggccuuuguuccuguggccugcaugccagucccacuuagcuccuggccuuucaaauagcuuuggugggaggguaaggaccuugggcuacugugucuccuguagcaauugagaguucuaauagcagugcccgcugggugccagguggaauccacaaggacagguauacaccugauguccaguaugggccuuggccacagcccuuucuaagguuuaaagcaucccuaugugggaauagugucuucuacucugucacguggagcccuugucuagacugucccacaggcugggcuccuggcugagagcugguuucucugcuggggagaagauguacuuaggugcugguugcaugagggacccuuaaggcugcugugguuugaaggaaggcaagggucuggggacacugguuggccauggagcccauuugucaaaugggguaguguugcacagagugaagugaccgugcucugaggauagccugaucccucuguacuuggcaugagggucggacucugcagcaacaggacaggggcuuucuacucagugccuuguguggaggaggggacagaugcuuucucagaguccaccugaccucaagccucagucccaugcagagugagccagagugggugcugcuaguguggccaagucagaggguuugggagagaaauucuggauccaggagcgugggcagugggcugugugcuggguuccacagccgcauugccaagcacuggacuguggaguuacauguagacacugaccucuggagccugggaagcuucaggagaggccaucuuuugucccacugcgagggcaggccaacagagcaagcuggucugcagcccucagcuggaugaucuccuucccggugcucaucgcagcuaguagcucccaggccgaaugcuucaucuccuugugccuguacugagggucuagagccucucccuuggagagcucugugagcuggugcugggcugcccaggcuagacaggcaggugagcgugggcaugcugcaggagggccagggcauagcacugugaaggcagugggccugcuugccuuuggagcuacugagggguggguggcaccagaggcuagagcaccuccgaccagccucugucacaguuggggcuggcugggcccuggggcuuugagcuaccugccccuuggcucaagcuaugcuugccaucuucccguaggacagguccuggaagaggaagugggucagaauggacagagccacaguuugcccaaggcuguuugugugaauggcacagagccccagcucagcagcaaggugaagccagaaggccgaccuggcaccgccaacccugcgcgcaaggugugcuccagcaacaagauccgccggcucucggccugcaagcagcagugacugaggccuacaggugggcaugggccuggguccagccaucccugguguucacagugggugucugcugggcuccuagcuccuucccguagggcagugcugcaagggggaaggucuggugguugaggugguacuaagugaccacccauucuaccaacagugugucaucaggaucucugggcaggugucccugcaaggcuggguuuuccaggccugccuguccacucacuucgggacguuggagccgagggcggaccugcugccccagaagcacuuuaugucgagaccacuggccggccuugccugcaugccgcccugcgagccucgcugucuuuggguugguuucuuuuuuuuuaauaaaacagguggauuugagcuauggcuaugaggguguuuggaaauauggagcaggcggggcacaggguggccugcagagaaaacccagagcaaacaaauaugcagagacauuuaugauuaaccagacaacacgaccaaccacagagggcgcagggcagggagugggcaggcacucacagcgagucugcccuaucuuuuggcaauaaauaaagcuugggaaacuugaagcugccaccugggcuguucuguccguuguguccaaagcccaaggcucucggggaggaaugagacggggagccugugcacaugcagagagcaggcgcggucgguuauugcucagagaggaaagguagagcgcauaccauggacaggguaaaucaacucagaauauggggcggcgagcuccucucugauccucagugccccacagucacuucaccuccaguagguucgcucacacaguggcaggcaguguuacugccugccagugcucacgaguggagggucagcugauccuggagggaggcugcacaugcaccucagaaccugcuccaccagcaucuguggccagaggcugggugcuggggucaaccauauauggaccggagaguccagucucgucauccucccugcaguugagccuggguccuggagccucuugcuuccggaggccacugcgcuaagugcccaggggacacuauaugugcacacuugggauuugggggccguguacccaugcacggccaccucagguugcucccgcuguugccaccauucccacagcagccccaugugcugccggagaagcagcagagaggcagguccaguacagagcuuaggccgggcuguggucaggggauguaggggcagcagcagcgacaaucagcaccugggaugaggcaacuggcucagcaagacggggagagaagagucucucgucgaggcuggcugcuagcuugucuagcagggccccggcgggcucaacgcacaacccagagccugggcaaccaccgccuccaccgccaggcuccuccucgaugacaggaauggaugggucaucacccgugaugggcagcgcacggccuucaggaggacaaucaacgcuguccccacggcguaauggcgcacguguagggcgggccacuccagggggcguggcugcacgugcaccaccggggucgcugugcugccguccucucuguugccauugcuuccgcgcaugagugugaggaugugcacgugugcggugacgcggugcaucgucaaaaugagggucauggcgcaggaacucauggaaaagagcguccgucuucucgucgaugcuguaaucgcggcgcggccugcguggccaggcucgcgggcugcggggaggacugcgggcuggagcaggaaguucugaaacuucgucgccugcuccgcgccccucgaugcucgcauagccacuguccaucuguagcaggcggcgggcuucgccguccuuaggccucaaagcagguggagacuccggagggggugggaaggcgggugcugccccuccaccuccggaacccgagcccgagcuaucgccgcugcgcacugagucgcggucauugccgcugcugcugugguccgaugcaguggcugcauggagcucgagcgaagcacgaaggcuccacaggucacgguagcugcacugugcaugcucggcguccugcucuugcugcggguccugcugcugcgcaugcucgggccccaaacugaugccaugcuccggaggagucucagggcucgcuccucccgccgccucugcugccucuagccugcaaggccaggcccauguggucagagccugcaggcauugcccugcccugccggccacauguuugugcuuuagggacuauggacacggagggucucccauggggucugggccacuccuaaguaacucuugauuugcaaggguaccaagagaauggaccugaaacagacuccaaaucaucagccccuuguccuagguuacugcacccacuggucaagggcugauacagccaggugugaaucaaugaagcuaagggucagccccaaguuugcaaggccucagccugcaucccagugguuuuagcauuugggaguuuuguuuuugacuuggagggagggagguuauuucugauugcagcuguuagcaaggccgcuccuugauuggggucaggcauacaucaggagugcagguaggcagaagggaugcuggcaccacugaggagcccuucaggccucggagccugccacauaucggcaaggccacaggaggccccagcccacugcccugcucuggagggugucucaucuuggaaacccugggaccaucaacugcccaccuacccuuacccaagcucucccugcuucccuccuccuucuccggucugcguuggagagguggcccccacgagguggccagggugacucgaguucguguccacagggccaggagggcagucccugggccaccuaugggggacggggcagggcaggggcccacaggcccacccuuagcaccucuaucuacugaaaaauaccugccgagaguggggggcgggcugguggggcuggccagaaaggggcgggggggugggaaggccaccgagucgccugcgcuggcaauguacugaaugaagucggcaugggggacgucccccuccugcuccaugcucucacuggcugcccgcugccgcugaaaguggugccucuuaggggaaccugcaguugaagaucaggccagaaccagagauuaggcgugggcugaaagcccucacaggacggcaguccggaugacccuggcuggacccguguggccaugagaaaggaugcccagagccucgaauggcccagcucuugcugaagucauggccuaagcaagcugggguuguugggagccugcaugggagggagggaggaagaugccaccugcaggccgcaccaugcccugggaagcuuaggugaacugcaccacccgugcccccagcuccuggccagaagccaggaucuuaccccaaauagaacugccagagugggcaguccuccaugugggcugggagccauggggcugcaccagugguuauggcuaaucugcaccaggaauccugacuccagcucagagcccagauccuuaccaggcagucaagaggacugccccucccaccagagcaccgcagaaaggaagugaagugagcccucugccacccagguccucccugguacucccucacccugugucuuccaccuccucccccacaggaaaggucaguaccuacguggcacugucuuaagcaaggccagggcacccuacaauuaggcagcccuguauccuagggccagcaggcugcuaccuguuuguguaaacugcuuuaugggcacaggccacacucauuugcauauggaagucacuuccuaaagcaacagcugagaugggacacuguccucacaaacacccagauuguuacaguccagggccuuauugaaaguuuuggggauuagcugggcauggcguguccugcugcuaauccgagcacuucaagagggcugcaggaaguucaaggucuacuugggacacacagugagacaccucaaaauaaaaggcauucauaaauccuaaaauuaguccaaugcucccuuugucuuuuuuuggagauaggcucucauguagccaaggcuagccucaaaucuacauagcugaggcuggcaaugagcucuuguccuccaacugcugcccuuccauguacugggaaugugcaccaaaacacuggagagggagccucggcuucacgcaggcuggcgcgguccucuaucccaauggcuuguuucaacaacucaaagucauacaggcaaaaggaccagguggagguccagggagcuaggggaucggugugcugauggaugaaggggggaccacaccagcucugagcaccccgggggccuuggagcaccggugacaggauggucaugugccuaagagacaggguaccagcaacugacagcuuuccuagagacauucaggcccugggagucccuggccauuugagaggccuccaucaagauggccccuggaggucauagucacucuggaaugccuuaccucucguguccagacuggacgcucucuggcugggcuccagcuuccauuucuugaccuugaaguaggggcuggcuccauccaggcuggcaugucggcguagccgagugaagaauugcaaaacagugcccgacccggaggagccugugcccaucuccccaggcacuguuucaggcccagcagccuuggcaccccggguaccugcaucuaacuggagagguggggggaaguagggauaacugucaggcaggaacgggauccccuccccagcaggcccuggcccaaucccuggguccccaugaagugugccuuuggccacucccuucuggcaacccuucucaagccagcucugccauccugcccugaauccugccuuucacgggggaaggauccugccuacaaguucuguuccuugggcuuuaagugaagcuguccacucuucccaccagccuggcucuuacagggaauccuaaaguaccauggucugggagcagagugguucugagaaagaagucaccaagaucuugggauacuguagggacaccagagggaacccucaccgaaaugcccuccccagagucacuggagguugaggggcugaucucugagaaguccacggaguuguagggaccuccuggcagggcggagcuggggccgacugaguggccggugaggguuuucccagggggcugugaacagagagguuggugagggaggagggacagagaguacaaguaggugaggggcgaucccaccuucccaccccagccuuccaagaccugcugaagaccacaggcagcuguaaccuugaccucaccuggaaaauagccaagcuguccuuggaggugguagcugggugggguguggccgcugcacuggccucccccgaaucacacucauggauaguagcgauuuugaggggcgguagguggaggugggugaggcgggcauucuugaggugauggaaauccccuucugucaggguguaccuauguuggggaccccagcagucagcccuuggcagucccucgcauagcaccuacauuuaacaucuugacagacaggucucucccuguuuaagacuuugagcuuuuaauucucaugccuccaccuaucaaaugcuggggugacagguuuuuguuuaauuucugagacaaggucucucuauguagaccaggcugggcuuaaacucacuaaauacccaccugccucugcuggagacugccauuuguuuguuuguuuuuugagaccaggucucacucucuagccuggguuuggccuugaacuuugcagcaaucuuccuggcucugcccaccaugugcugguguucuuuuuaaagcaggucuuugaaauacacccauggcugaccuggaacucucucuguguauuuucuaugcagaccagucggggucugaaauuuguagcaauuggggcuggaaccauggcucaggaguuaagagcacuauggcucuugcagaggaccugaguuggguucccagcaccuauacugagcuacucagaaccaccuguaauucuagcuccagagagaucugacacccucuucuggccucugugggcacuugaaaccacauguacauacccccacacaaagacauauaaauagguaaaaauuuaaaaauaacucuaguaauucuccugccucagccuugcuuagaccucgauauugauacuuacucuacucuccacccugccagcccauaccaagagaccugagccaggauccccagcuuucaucaccaagcugcugugaccucccccugacuucucucaccggcggcccuuguccugagccuugcggcucuguucaaacagggcag

SEQ ID NO: 5613 - RNA, 10925 nt, Mus musculus
ccuggaagaggaagugggucagaauggacagagccacaguuugcccaaggcuguuugugugaauggcacagagccccagcucagcagcaaggugaagccagaaggccgaccuggcaccgccaacccugcgcgcaaggugugcuccagcaacaagauccgccggcucucggccugcaagcagcagugacugaggccuacaggugggcaugggccuggguccagccaucccugguguucacagugggugucugcugggcuccuagcuccuucccguagggcagugcugcaagggggaaggucuggugguugaggugguacuaagugaccacccauucuaccaacagugugucaucaggaucucugggcaggugucccugcaaggcuggguuuuccaggccugccuguccacucacuucgggacguuggagccgagggcggaccugcugccccagaagcacuuuaugucgagaccacuggccggccuugccugcaugccgcccugcgagccucgcugucuuuggguugguuucuuuuuuuuuaauaaaacagguggauuugagcuauggcuaugaggguguuuggaaauauggagcaggcggggcacaggguggccugcagagaaaacccagagcaaacaaauaugcagagacauuuaugauuaaccagacaacacgaccaaccacagagggcgcagggcagggagugggcaggcacucacagcgagucugcccuaucuuuuggcaauaaauaaagcuugggaaacuugaagcugccaccugggcuguucuguccguuguguccaaagcccaaggcucucggggaggaaugagacggggagccugugcacaugcagagagcaggcgcggucgguuauugcucagagaggaaagguagagcgcauaccauggacaggguaaaucaacucagaauauggggcggcgagcuccucucugauccucagugccccacagucacuucaccuccaguagguucgcucacacaguggcaggcaguguuacugccugccagugcucacgaguggagggucagcugauccuggagggaggcugcacaugcaccucagaaccugcuccaccagcaucuguggccagaggcugggugcuggggucaaccauauauggaccggagaguccagucucgucauccucccugcaguugagccuggguccuggagccucuugcuuccggaggccacugcgcuaagugcccaggggacacuauaugugcacacuugggauuugggggccguguacccaugcacggccaccucagguugcucccgcuguugccaccauucccacagcagccccaugugcugccggagaagcagcagagaggcagguccaguacagagcuuaggccgggcuguggucaggggauguaggggcagcagcagcgacaaucagcaccugggaugaggcaacuggcucagcaagacggggagagaagagucucucgucgaggcuggcugcuagcuugucuagcagggccccggcgggcucaacgcacaacccagagccugggcaaccaccgccuccaccgccaggcuccuccucgaugacaggaauggaugggucaucacccgugaugggcagcgcacggccuucaggaggacaaucaacgcuguccccacggcguaauggcgcacguguagggcgggccacuccagggggcguggcugcacgugcaccaccggggucgcugugcugccguccucucuguugccauugcuuccgcgcaugagugugaggaugugcacgugugcggugacgcggugcaucgucaaaaugagggucauggcgcaggaacucauggaaaagagcguccgucuucucgucgaugcuguaaucgcggcgcggccugcguggccaggcucgcgggcugcggggaggacugcgggcuggagcaggaaguucugaaacuucgucgccugcuccgcgccccucgaugcucgcauagccacuguccaucuguagcaggcggcgggcuucgccguccuuaggccucaaagcagguggagacuccggagggggugggaaggcgggugcugccccuccaccuccggaacccgagcccgagcuaucgccgcugcgcacugagucgcggucauugccgcugcugcugugguccgaugcaguggcugcauggagcucgagcgaagcacgaaggcuccacaggucacgguagcugcacugugcaugcucggcguccugcucuugcugcggguccugcugcugcgcaugcucgggccccaaacugaugccaugcuccggaggagucucagggcucgcuccucccgccgccucugcugccucuagccugcaaggccaggcccauguggucagagccugcaggcauugcccugcccugccggccacauguuugugcuuuagggacuauggacacggagggucucccauggggucugggccacuccuaaguaacucuugauuugcaaggguaccaagagaauggaccugaaacagacuccaaaucaucagccccuuguccuagguuacugcacccacuggucaagggcugauacagccaggugugaaucaaugaagcuaagggucagccccaaguuugcaaggccucagccugcaucccagugguuuuagcauuugggaguuuuguuuuugacuuggagggagggagguuauuucugauugcagcuguuagcaaggccgcuccuugauuggggucaggcauacaucaggagugcagguaggcagaagggaugcuggcaccacugaggagcccuucaggccucggagccugccacauaucggcaaggccacaggaggccccagcccacugcccugcucuggagggugucucaucuuggaaacccugggaccaucaacugcccaccuacccuuacccaagcucucccugcuucccuccuccuucuccggucugcguuggagagguggcccccacgagguggccagggugacucgaguucguguccacagggccaggagggcagucccugggccaccuaugggggacggggcagggcaggggcccacaggcccacccuuagcaccucuaucuacugaaaaauaccugccgagaguggggggcgggcugguggggcuggccagaaaggggcgggggggugggaaggccaccgagucgccugcgcuggcaauguacugaaugaagucggcaugggggacgucccccuccugcuccaugcucucacuggcugcccgcugccgcugaaaguggugccucuuaggggaaccugcaguugaagaucaggccagaaccagagauuaggcgugggcugaaagcccucacaggacggcaguccggaugacccuggcuggacccguguggccaugagaaaggaugcccagagccucgaauggcccagcucuugcugaagucauggccuaagcaagcugggguuguugggagccugcaugggagggagggaggaagaugccaccugcaggccgcaccaugcccugggaagcuuaggugaacugcaccacccgugcccccagcuccuggccagaagccaggaucuuaccccaaauagaacugccagagugggcaguccuccaugugggcugggagccauggggcugcaccagugguuauggcuaaucugcaccaggaauccugacuccagcucagagcccagauccuuaccaggcagucaagaggacugccccucccaccagagcaccgcagaaaggaagugaagugagcccucugccacccagguccucccugguacucccucacccugugucuuccaccuccucccccacaggaaaggucaguaccuacguggcacugucuuaagcaaggccagggcacccuacaauuaggcagcccuguauccuagggccagcaggcugcuaccuguuuguguaaacugcuuuaugggcacaggccacacucauuugcauauggaagucacuuccuaaagcaacagcugagaugggacacuguccucacaaacacccagauuguuacaguccagggccuuauugaaaguuuuggggauuagcugggcauggcguguccugcugcuaauccgagcacuucaagagggcugcaggaaguucaaggucuacuugggacacacagugagacaccucaaaauaaaaggcauucauaaauccuaaaauuaguccaaugcucccuuugucuuuuuuuggagauaggcucucauguagccaaggcuagccucaaaucuacauagcugaggcuggcaaugagcucuuguccuccaacugcugcccuuccauguacugggaaugugcaccaaaacacuggagagggagccucggcuucacgcaggcuggcgcgguccucuaucccaauggcuuguuucaacaacucaaagucauacaggcaaaaggaccagguggagguccagggagcuaggggaucggugugcugauggaugaaggggggaccacaccagcucugagcaccccgggggccuuggagcaccggugacaggauggucaugugccuaagagacaggguaccagcaacugacagcuuuccuagagacauucaggcccugggagucccuggccauuugagaggccuccaucaagauggccccuggaggucauagucacucuggaaugccuuaccucucguguccagacuggacgcucucuggcugggcuccagcuuccauuucuugaccuugaaguaggggcuggcuccauccaggcuggcaugucggcguagccgagugaagaauugcaaaacagugcccgacccggaggagccugugcccaucuccccaggcacuguuucaggcccagcagccuuggcaccccggguaccugcaucuaacuggagagguggggggaaguagggauaacugucaggcaggaacgggauccccuccccagcaggcccuggcccaaucccuggguccccaugaagugugccuuuggccacucccuucuggcaacccuucucaagccagcucugccauccugcccugaauccugccuuucacgggggaaggauccugccuacaaguucuguuccuugggcuuuaagugaagcuguccacucuucccaccagccuggcucuuacagggaauccuaaaguaccauggucugggagcagagugguucugagaaagaagucaccaagaucuugggauacuguagggacaccagagggaacccucaccgaaaugcccuccccagagucacuggagguugaggggcugaucucugagaaguccacggaguuguagggaccuccuggcagggcggagcuggggccgacugaguggccggugaggguuuucccagggggcugugaacagagagguuggugagggaggagggacagagaguacaaguaggugaggggcgaucccaccuucccaccccagccuuccaagaccugcugaagaccacaggcagcuguaaccuugaccucaccuggaaaauagccaagcuguccuuggaggugguagcugggugggguguggccgcugcacuggccucccccgaaucacacucauggauaguagcgauuuugaggggcgguagguggaggugggugaggcgggcauucuugaggugauggaaauccccuucugucaggguguaccuauguuggggaccccagcagucagcccuuggcagucccucgcauagcaccuacauuuaacaucuugacagacaggucucucccuguuuaagacuuugagcuuuuaauucucaugccuccaccuaucaaaugcuggggugacagguuuuuguuuaauuucugagacaaggucucucuauguagaccaggcugggcuuaaacucacuaaauacccaccugccucugcuggagacugccauuuguuuguuuguuuuuugagaccaggucucacucucuagccuggguuuggccuugaacuuugcagcaaucuuccuggcucugcccaccaugugcugguguucuuuuuaaagcaggucuuugaaauacacccauggcugaccuggaacucucucuguguauuuucuaugcagaccagucggggucugaaauuuguagcaauuggggcuggaaccauggcucaggaguuaagagcacuauggcucuugcagaggaccugaguuggguucccagcaccuauacugagcuacucagaaccaccuguaauucuagcuccagagagaucugacacccucuucuggccucugugggcacuugaaaccacauguacauacccccacacaaagacauauaaauagguaaaaauuuaaaaauaacucuaguaauucuccugccucagccuugcuuagaccucgauauugauacuuacucuacucuccacccugccagcccauaccaagagaccugagccaggauccccagcuuucaucaccaagcugcugugaccucccccugacuucucucaccggcggcccuuguccugagccuugcggcucuguucaaacagggcagccucguugaaggacacgcggcggccgguggagcugguggcuaggaagcgcucuguuucgguguccuggcccucggggucuuccccccugcagucggggucugugaggagagccaagagagggugggcccggggugggccgcgcgugucuggcugccaggcaggccgcugggcggggugggcugggaggggggcacgggccgagugagggcaggacggggcgggcugggcggggcggcgggcacucgcucauccgcucacacacucacucgcucucagcacgcgccugugcgcaccuacgccugggcguuaaggaaacagagaugagucggacucgaacugcgcccagucuggugggggagacagacagacagaccgucaggcggcccgagggggcgggcagggggccgagggguggggcgcggcgggaggcacagucaagugcagcuaggggugcugcaagccgcgcgggccccucaccuuguauagggugggugccguuguccagauaaguagugguggucuucucugcuuccuccauggcccugaggaagaaaggggaagaagagugagcaggaauggggcgucuccacucugaggcucugcaagcgcgccugggcaugugucaagugguucccaggacaagcaccuguugaagcgcuggugcaccucccagcagcguuugcagagcagaagaacgccagacagcaccaccagcgugccuccaacgaacagcgacaucaccaccaccagcagcacauaguuguccaagauggggucaggcuccgccugagucgggguugagugcacagggcggggcaugucagggcuccaccgcagagugggguuuccaucccaccucuacccccagucuccaggagucacccaacccaccguggggcggcugguggcauugucccacgaagucgucagggcaacaguggcgguaguggcggccgcuguggccaugguggccgugggcugcauuuugaggcuacaaguagggcauagagccagcucagguucagcucugccggccccuccccacaagagccccugcaagucagccccuacguccccgugcagcagcagcagccgccgucacuggggugacucauggacagguggggccgagucuuacaaugugagugcccccccaacuccccauccccgcaggggugccuggagccaaggcucccccccccccccacacacacacacgccaggaccucucuuucgccaucuuuaucacauaaaaggugucaucgcgcuugcgcagcacuguguguguguguguguguguguguguguguguguguguguguguguguguauguguguguguaaauguggcuuucccaaaugccaaccaccucccuggcuggcugggguggccagaccggcaagguagcgcagccaugcccaggaaagggaaagcacccuuggaggaacaaacacaugacgccuccacagcauacucaggcaacaucccagguguccuucuugucucagggucucauggugcagaaaaggaauugaagguagugcaccuaaggugugggcggggcuguacuaaugauucccccacccccagucacgacucgauagggaaagguccuuguuccccacacuggugggagugcaaaggacaaaagacgcucaucuguuccuggccugaaaauuuugguucccauggcgacggugcgcagggccgcgcaguggcgggggggggggggggggcuguugccaagcagagggaggcgggcgggggcgcgggggaggccgcccacaggggcgccccaaggcuuggccaagauggcugcucaccaggccucugccagaagcguggagaaacugaggcuagggcacaucauggggugggguggauucagaaggggcuuguuaaaacugcaccugacucaguccgggaaugaagaugauucuggaguaauaaaggccauuuuggccauccaucccuacuucccacaccagcgugagcaugcaaaccccuuucccauggaagaagagcccgcaggcuccaccgucaccaguguuuuucagacuggaugguggaggaguuguggggcgaaaccugaauaaacgauguacccccccccagaaggcuacguuuccucagcgcacccaggcagagagcagcgggcaucaauuuugguggguggcauggggcgcauacguaggucgggaaaugaauucaggcuggaggggguggggcauggugaggaugguaaugagaggugggggaggaagauggcuggagacccaaggcgaggaaggcggggucaugagagccagcgagaacgcaagccuagacauggaguccccacagaacguccaccaggccccccaaguaggauacggugcggaaaagcgcagagaacgcgacgccaggcucgugaggauccaggaggccaaggcgacaacgcucucgcccugucacuaggguaaacugaggccaagggcaggcaugggcuggcucccucucggggcugcgggcggugggcggggugcagggccgcucaggccguucccacgcuccgcucccuucccggagccgcgcgcgacaggaccagugggccagggcggacccuggaacuggucgccauccccuggccgcgcgcauucgcccgcccguccccgcccggccccgugcgccagggcccgccgcgccuaccucagcgccggggcgugcggcccaugggcggcgggagggcgggcggcagauacacggcucucccgguuggcucuggagcucgguggccgcggagccgacggagaauuuaugaauggggagagcagcgcacgggggaggcgcgcaggagagguggggccgcgcacgugaccgcguuggcggugcucccgcuccggccccuggcucugugcacccgguaaccgcccggucccgcagccugaccgcccccgccgcucucgccgccgcgucuggcucgcacugcgauggccaccgccuccccuucccuuccggcgggggcguggggcggagccugagcucccgcgcccccucccgcuguagcgcagucccgccccccucaccccugcacgacucagccuaccuggugcugcaaugucccagaacccggugcgggcggggcgcauuacgccccuaagcuaacgcggguaucucaggucucugggacccucaacuaucuaguuugucaccugccacuccagaugugcaauuccaguuugcauauccccuugguuuacaagccaugagauauagguacauccccauccccacuugcauguuuuucuuuuaugcugcucuuuggcagguuccuuuauggguccagcagauagccagugcuguaaaacaccuacugggaacuugcccucagaacugugauggucccgcacaccugcauuuguaaggugaaaucaaguggaucaggagcgcaaggucaaccucagcuacacagaauucuaggccagccugagcagcacaagaccccuucucaaacaagagaacuguagugaaagagcugagcaaacuaagguaccugcggccgagcccaagcagccauguuucaucccucagucccgaauaggaaaggaagagugccuccccucacaaguuguccuuugacacccaaagauuugcuauccccuugcccacuaacuaaaugaauguaauaacauuuaaacuugcauccauagaggucuguuauggaaugauccauaccuuauaacuccuuccacuugcagacaguucucuucccgguggugccuggguucgaacccagggucagucucauuauaagagccuaugcaccaggcgugguggggcacgccuuuaauccuagcacugcggaagcagaugcagguggaucucugaguucgaggccagccuggucuacagagugaguuccaggacagccagggcuacacagagaaacccugucucgaaaaaccaaaaaaaaaaaaaaagagccuaugcucccagaccauaccugcuuauucccugcuuggccacacagucaaauaagugucaucaugaaggugggucgcuuacacugacuuccaggacaccauccuccuuuucauuucagugaaggggauuaauccacagacccgaggcuggccugcacuaccaggauagacuuccgaacccaaccagguuggucucaagcucaugagugugucagaacacauggauuuuccaaauacuaaauauucugggggggggggucgugaauuuacaugccuuugaaggucagaggaggaugucagaucuucugaagcuacaggcaacuguuagcugucccccaugggcacugagaaugaagcacacgucucuuggaagaacagugcucguugcugaucucugaacuaucucuccagcacccuagguuuaguuuuuagaagacuugucugguaaggcacaguggccauggggguaggaagagg

SEQ ID NO: 5614 - RNA, 7199 nt, Mus musculus
ugaggaugguaaugagaggugggggaggaagauggcuggagacccaaggcgaggaaggcggggucaugagagccagcgagaacgcaagccuagacauggaguccccacagaacguccaccaggccccccaaguaggauacggugcggaaaagcgcagagaacgcgacgccaggcucgugaggauccaggaggccaaggcgacaacgcucucgcccugucacuaggguaaacugaggccaagggcaggcaugggcuggcucccucucggggcugcgggcggugggcggggugcagggccgcucaggccguucccacgcuccgcucccuucccggagccgcgcgcgacaggaccagugggccagggcggacccuggaacuggucgccauccccuggccgcgcgcauucgcccgcccguccccgcccggccccgugcgccagggcccgccgcgccuaccucagcgccggggcgugcggcccaugggcggcgggagggcgggcggcagauacacggcucucccgguuggcucuggagcucgguggccgcggagccgacggagaauuuaugaauggggagagcagcgcacgggggaggcgcgcaggagagguggggccgcgcacgugaccgcguuggcggugcucccgcuccggccccuggcucugugcacccgguaaccgcccggucccgcagccugaccgcccccgccgcucucgccgccgcgucuggcucgcacugcgauggccaccgccuccccuucccuuccggcgggggcguggggcggagccugagcucccgcgcccccucccgcuguagcgcagucccgccccccucaccccugcacgacucagccuaccuggugcugcaaugucccagaacccggugcgggcggggcgcauuacgccccuaagcuaacgcggguaucucaggucucugggacccucaacuaucuaguuugucaccugccacuccagaugugcaauuccaguuugcauauccccuugguuuacaagccaugagauauagguacauccccauccccacuugcauguuuuucuuuuaugcugcucuuuggcagguuccuuuauggguccagcagauagccagugcuguaaaacaccuacugggaacuugcccucagaacugugauggucccgcacaccugcauuuguaaggugaaaucaaguggaucaggagcgcaaggucaaccucagcuacacagaauucuaggccagccugagcagcacaagaccccuucucaaacaagagaacuguagugaaagagcugagcaaacuaagguaccugcggccgagcccaagcagccauguuucaucccucagucccgaauaggaaaggaagagugccuccccucacaaguuguccuuugacacccaaagauuugcuauccccuugcccacuaacuaaaugaauguaauaacauuuaaacuugcauccauagaggucuguuauggaaugauccauaccuuauaacuccuuccacuugcagacaguucucuucccgguggugccuggguucgaacccagggucagucucauuauaagagccuaugcaccaggcgugguggggcacgccuuuaauccuagcacugcggaagcagaugcagguggaucucugaguucgaggccagccuggucuacagagugaguuccaggacagccagggcuacacagagaaacccugucucgaaaaaccaaaaaaaaaaaaaaagagccuaugcucccagaccauaccugcuuauucccugcuuggccacacagucaaauaagugucaucaugaaggugggucgcuuacacugacuuccaggacaccauccuccuuuucauuucagugaaggggauuaauccacagacccgaggcuggccugcacuaccaggauagacuuccgaacccaaccagguuggucucaagcucaugagugugucagaacacauggauuuuccaaauacuaaauauucugggggggggggucgugaauuuacaugccuuugaaggucagaggaggaugucagaucuucugaagcuacaggcaacuguuagcugucccccaugggcacugagaaugaagcacacgucucuuggaagaacagugcucguugcugaucucugaacuaucucuccagcacccuagguuuaguuuuuagaagacuugucugguaaggcacaguggccauggggguaggaagaggacacucaccaccggacaagcaugaucuuucuagcguugaguucuuacuucauggagcauuugaguagauaugggauccugggacggguaugggugugugugugugugugugugugugugugugugugugugugugugugcgcgcgcgcguguguaucuguuuaagagcuggaguagggaagggaaugggguuucuagcugcccacugcccagggaaacuguccagauuauagagacugggaacuaggugucucucauagagauugauuaaggccaggacugcuggcuuuugagcaggucugcgugccagagucucuaguuaguagaauaaguuuguagucuagcuuguagucuugcaucugccaggcucugguucaagggugaccacgacccucuagcugccagcugcuccucuaagauccaacaaagcuaauggcuuuccuucuguuugccccaucaagccuaugccugcauuuucugugaaccuacgugguggggcauggggaccaagagcugagcggaggccggaaccugcgugagugcgggggcagggugaugacgucaugaccgagagcgaggcugcgcggacaagacuggcgucaguggggccccuuggccgccugcgcacgggcuccugcgucaguggcacgcaggggcggaggcccgcagggaggggacugcggagaagagcgaguacaucuccagguuucgcgcgcccucugccgccauccggugcacuucuuuccuggcacgaccucuccccagcacgcaccgcagcgggcaucaugaaauuuaauuauuuauuuagcagcuucucaugauguaguccugguuggucucaaacucauggagccccgcuugagucuuccuccggggaguugggauuaacugcgccuggcauaugcauauauauauauguguguguguguguguguguguguguguguguguguguguuucgagauaggauuuuucuguauaauccuggcuguuggcuguccuggaacucacucuguagaccaggcuggucucaaacucagaaagccgccugccucugccucccaagugcugggaauaaaggcacgcgccaccacugcccaucuauauuugaugcacuuuuggaaauagguuguuccgagugcggggauugcaagagugugucaccgcacucuacauuuuaauucuucuguuccaacacguuacagguuugcuucuucugggccucgaaugcuuggcaccugauaucaagcccauaucauuuccgcgcaaacauuccccuccugagggaauauguucguuugcagaaagaaccgcaucccaagaacccagagucguuugcuguuagaaggcgaagaaaacuacaauucccagaaugacccacccggcauaggaggaucccacuucuaggcaucacugcaagggguggggccaagggaaaguauaccucccagaaugcucagcgcguacugcaucgcgcagccuucggagaauccugugcgcgugcguucuugugggaacugcgccucccagaaggcaccgcgcgucguccuucucccucccugaaggccgccucgcuugcccagugugucggccgcccgcgaagcuagaguccacugacuuuuccgccaccauguugcccgccucacugcuucgucacccgggccugcgccgccugaugcuucaggcgcguacauacgccgaggccgccgcugcaccugcccccgccgccgggcccggacagauguccuucaccuuugccuccccgacgcagguacgaacucacaucccccagacucgucaagccccugaucugacccguggaagagguucucuuguauuaggucauuuguuucauccccauggggcccugugaaccuccccccaccccagaccucaccccuggauggggucaccuggacccagggcucgaccucaguguucacugaaacuucaugcuccaccccuaagggcgucaccuggacauaagacuccacccucugggagguggaucaccuauaucuggaacccagauuuugccuucacaaacccuucuguuuugggguguucuaggcucuacaccuuggugguggucacucaggcccuguccuuggguguuguacccgagauugauaugaaccccaggcucuacucaaggcuuagguggugucacuuggagcuaggaugaacaauggagcacagagcaaugccuuuggguuuuacauggcucacaguuucuacccgugggggauuccccaaguccccaagcuguugcccagauaggggucaccaguacccagaccuggagcucuuggaaauugccuggacccagauccugaaggagauuuggacucagaacagaagccuggccacuguuggggucaccugggauugaccgaagcuccucauccuguuggguuugccuggaccaaauauccuuuuuuuuuuuuuucuuuaaagauuuacuuauuuauuguauguaaguaaacuguuuguuuucagacaaaccagaagagggcaucaguucucauuaugggugguugugagccaccaugugguugcugagauuugaacucaggaccuucggaagugcucuuacccacugagccaucucuccagcccuggaccuaauauccuuaauuggauagaccuuagccaagguuuuaccaacuuacagccaugcuauuuguaagccuggguugguuuuacacuuuugacuaccucauagcaacuuccugagugguugugagacagccuuuggguuucucagaaaccccauaccaggggcuggaucagcacgcugcacuacacugcauugcccucuguuucagucaccucuucuagacacucuuuuagacauagacauuucacaggugagcaagcugagucuaaugucagcucuugguagugucugugucccaucagaauuccauccucucugugcccacuguacagcaggcaugggauaaugccuaccccaugguguacacucucugcagguguucuuugacagugccaacgucaagcaaguggacgugccuacgcugacuggagccuuuggcaucuuggcaucccauguccccacacuacagguccuacggccugggcugguagugguucacacagaagacggcaccacgacuaaguacuuuggugaguguggcccaggaugcauagacguucagguuugagaagggcagggagaaagcaaagggaagaagcuugcccagccugccaugacaaagauguggucaucuggggcacagaguaaagccagcagcugaccucgccauagcugggcaggaagacauggagaaaugacgguugaggagcuaagccuuuaggguaagauagccuugguguaggagggagccggucugaaggacccacguuuccggguuggacuuccaucuugccccuucuccagaugaaggggugugucuugucuucucucauaucucauuauuuaacaauacccacgauggaacccagggccuggagcuuucuaggcaggggauacagcccauggucaucgcugggggauuccagccgagggcuccgggcuccguccacgagucaggcccccacacacuguuguucuguaugguuauguuugggcaaguaccagagcaggcguggcggugaaggugggaaggaugugugcacacaugugacggaaggacauugguggcacccuccuucauaagcucuuucugucuuuguuccuuugagaugggcagaaccugaguuugccacauucuuagcgaggcaggcuggccagugagccacagacacucuccugcccuacuccucaccauuaggauuggcuucccgcaaacucugcuccuucucucugcacaguggguacucucucugcacuggcucuggggcccuucaguuuccuuuucgguuugcuuucugauuuuaaagcaguguuuccuuagccaugcugacuuugaauuucugauccuccaccuccugggugauaggggugacagguuuauguuggcauacccaguuucugccuugcugaggguugaacccaggaucuugcacaugccaggcaaacacaguacccaccgagccucaguccuggcuccucuuuuacacuuaguuugagggaagaccucucuguguugucuugaguggcuuugaacuggcaguccccuaccucagccuccccagggggcuaggcgacaggugugcaccgggccuggccauccuuugccaccauccacaugcuuggccugugccccagucuugcagggucacucugcaaguggccuagagugggcauuggccuggggaggcagagggcugguggcccugagcacacaugggcggugaggcugcccaaggaggcugcucagacccucuccuccacagugagcagcggcuccgucacugugaaugccgacuccucugugcaguuacuagcugaagaagcugugacacuggacaugcuggaccugggggugagcaguggaugggaaacuaaggcagggcagggcagggcaagugcugcucacaggagugugcuuuccugcuuccggcccugccugucccucacacuggcccacuccucugcaggcagcccgggccaaccuggagaaggcgcagucagaacugucaggugcggcggacgaggcagcacgggcugagauccagauccguauugaggccaaugaagcccuagugaaggcccuggaguaggugguaccuacugucugacacccacggggaaacugagccagguccaggccgaugagaaguucccagugggcugaaguggccaccaggggucagcagugcuccaguugcugggcuuaaagcuuccuggugccugucugccaggucauggaggauuccccaaucuggcauccccacgaugccucuggagagauggccuugauugccccucaaagccaccugaaccgucgucaacuuacccagccugucuccauuaaacaccaggaaccaacugaguguucuguuuc

SEQ ID NO: 5615 - RNA, 10099 nt, Mus musculus
gucaugucucauuuucguuuauuugaaauucggugcucguguaaguuuuuucucuuccccucaaauuuuauuucaguaaaaggagacuugggcgagguggauaccccacagccggauucuucccccccugccccccaggguggcuaaugcuaucuggggaagucgucauagggaagagaacuaugggugggcuccugccugaggccuccaaucucagcccaguggacauaucacaggcagcuuaaaaaaaaaacccuaaaaaaaacaccccaaaacacacauuuaaauagguauucaagacagcuuuaaaaaaugcacccacucacaccccccucccuuuucuuuuuggaaaaaaaaauaggaaaaaaaaaaaaaccaaaccgaauucucgcuuggccucuaccguucaggauccccuucccacccacccaccccaaaaaaccuuuacagcuagccaacacacguucacaucccaaaccauuaagguuuaaacacacagugggggaagagacaaggacggguucacagccuagaacaaaggaaccguggacagguggagucuagacaacauggacagaugucaggggugggcacacaucccauuuaucacaaaaucucaaaauguggaggaaaaaaacucccccacaagauucacuccugcuauaucagccccaacucaaggggagggcucccccauggagccaauguggaccagcagcgcgcccuccccagcguggaguuaaugcaggcacaguccagaaccccucuucccauccccaguggcaggcugggccuggagaagagguacaggggugucuuucugggccccccuccuacaaccuaccccaguuucuuuuuuuuuccuagaggauagcaaccaucacuggcucagugagaaaaaugaaaucuauaaauagucccccaagcuccauugggaaagaagguuaaggaaauaaguggguguguggagggaggaaagagacggcgaggccaguguccagagaggauggccgccucgcgaggaaaagaggcaucccccgccugaucagagaacagccacuugcuucagcuuuuuccauccaacgagcuuuuguggcaagagcaaggccagccaagcauaguggcaaaggcccgucauuguagcacuugggagacugaggcaggaggaaggcugugaguuaagugggcuucguggacaaagguauccucugugagucuaucagcuuuccggggugggaggggcaggggauccagcuggccuggaacaguggccaagucugcagacuggggugggggugggggugggacucauccugggguccccaacccucaucuguaaagugcuuggagaaucuacauugaguuaaaaaccugaauuggguuauggaaggggguggggagagcuaggcagagcggaagggcugggguggguggcuuccuccgucugggccauccgggaacagacugcuacauauuuggagcuggagaggugggagggaagggcccuguugcagaggccgugaccaugguaagggaauagagugggcaugugaccagggaugcgggguagacaaucggggagcuaaaaaagaaucagaaaggcugguaaguggcaucggaggugaccucgugccccccagagcugggccgcucagcguccagucuguggcguccuccugccccguguaugggauaggggauguacagacccaaggggacuggauccuuuaagccaccacaaacucggacuggauguccggguugacuucaggcuuccaaacggaguccucgaagucgaggcccaagccuguggccucgcuggggccaccuccacccccacugcugcugcugucgcuacggccagcuuugcggcuggggguccagugguaaggcccccgggcgucccgccgugccuuccugcgcaggcgcuucugcugcaacaggagcuggaggcguuccacuuugcaacguguggcacgguucucugucugucgaagacggucuccuacaaaaagagacagacaccuguuaaucuugaggcccauucugaaggggcuggagcaucaacugcugauagcaaggaccucgcaauguacaaggaagcacagggccccggucucucuccuccaguuacuggagcaugcugggagagcaggcaguucugugggcugaguaaguguugcacagggguugagucacagaagaaaagcaggaagucagaugggcuugguggugcacaccuuugaucccagcacacaaggaggagaagcugaggcugggagaccgaagugaguuccaggacagcuagaguuuccuaguaaaaccucggaccaaagagcaaaaggaaaaaaaauaugcaagcuuugguuggguacaccugucacaaguuaucuaggaagcagagaugaaaacucaaguucaggaaaaaccauuugaaaacagggcuguaggcuugauggagugagaggaagccuuggggagaauucccagggaagggcugggggugugugugggggucuugcuaaugacagaagccaaacaaaaaaaccuagaagaaucuuguuuccagaaaaaauugguacaaagcuugugucucaguuucccuuuugugacuagggcugaggcaggugaucuagguagggcagcguguagaccaccccacagccuggguuggggugggcuagaacugagucaaccauucagggaaagugccaaaggccaucuggagaggagccuggggugggggugggggugggaaggaaguggagagagcccuucaggggacacaaggggacacugugcagcaacaguugccuccuuuucuccuagcuagggcaggucugggggggggaagcagcugcuagcuccaggagguccccuggcaggucagcuguccccucaggagccagcaugcacagaggcagccuugaggaaagggaggcaagguggggggugggacucaccagggggcuugcacauucgaaucuggcucuggcccuggagcagggauguggaggagguggcugccagcuuuucacaggagguaguuuugggggugaggucaggggcuggugaggcaggugagcacugagcauggcagcggagcugggucagugaggguggcaugcccugguagugccucguggcacuuaggaggucauugaguaucugcagaauggugccgaugucacgccgaggccgcccacugcuguccuggcaguugggguguagugugccugcaggaagagagagagaaagagggucaugagcccaaguggucagagcucuagcagggugucagcaagagaaggcagacacaccugcgcacacugauaagaguaugcaggcguccagggcuagugcuaugcaccugucauccuagcuacucaagaggguacaaugagguuucaaacucuaagccagggcugggcagugguggcuuacaccuuuauaaucccaguacuugggagguaugggcauaggcagagacagacagaucucugcaaguucaaggccagccuggucuacagaguauguuccaggacagccagagcuacagcaaaacuccaucuugaaaaacacaaacaaaacaaaacaacaaaaacccuuccuauccaggugggagaacuaaggaugcuccuaccucaaaaaacaaaacaaaaccccaaaaccccaaggaggcuuggagcuugacgcaggguagagccucugcauagaaucccccacuggggaaggcgcugagggcguggcucagcagcaggguggccuaggcacuaucccagugucccagugcagcacacauaacuacagucacacaggugcauggcccagacuccagccagcacacaggaugucaaguuugagaugcuuauaccacuuguguacagugacaccuaccagagaaggucccugagaagaccccuggagcaugguucacgaagcucucaaugaccgcaccagguuugcgggaucgagggguggggcugcugccugggguggauguggagcugcugcuggcggguggagaacaguccaucugcuggugggagauuggcaaauggguauaguugugaugggccuguuccucggcucugacuuccccagccucuagggcagucggcaucagagauuguccagguuccagacucacuguaucagcucaacaagcauuugauacaaggcuauggcuggagcccucaaaauuuucccccguguaauaaguaucugcauccucaccucaggacagguuguggaggcugcgugggaucggaaggagccagcagugacaggugagggggauacaggugaggaagggcugcuggauacuggggguacacgggcggcacuggacaccggccuacagggugaagacacugggguggcuacacuggagucuccccgggcggcggcggcugcugcugcggcagcagcaagcacauggcggugcuggaguggggcaugcugggcugccaguugcaacugcacaaacaucaugugauccccgacucgcagggccagggucaaaggcgagcggccugacagaaagucacugaccugcagagacaagugggggcucucaucagccaucgugacucucgccuaugaugcccccggcccaacccugcccagcucuuccccgcaguaugugaccuggggccucucgccgccccucucugggcucuggggucccugucggugccacggacgcuuaaauaaaaucaaucuguauuuccggaagccuccuccggcagcccggccuggcccgggugucgcugggggcugugggggggacagaggugggucagaucggccucuggcucuucucagccaacuuggguccuuuaaaggggaaacugagaccagaagggguggggcccagcugauggucacugcccucccugaagugucacacaccugucccuuucccaccucagugcccagauccugucugccuaugaaucuagcagaggagaagccugucaagcuagccuucacagcuaagcuguaccagaggcaggcugaauccagaagggacuccuucguuaaccuuugcuuucccaagauaaauauuuaugugucucaggcugugagaagacaaggggaaaccuggagccuguccccaagggccuccacaugcucugcuaaacagcucucugaccugcucacacgcacccccacucugugggggcugaucugugggauuaccugacccuuggauacacugggcacccucccucccaccucuggggcccuggccaucagccuuguucuccccagaggccaggguggggggcggagguuucugagaagugacauagaggcuaugagucacagcagaccgccuggcagaacucccuccccuggcucugcuggcagggggcuggaggaaccuucuucacuuggggccccauggggaggggacaaagagcuggguggggagggaggcaacagacccugaacucccccccaucuugccagccacagagccucaauccuaccacccuuuccagggaaaggccugagcaccuggggucaccccucucccugggaggccaggugagaauuuccacugugggaaucucgaggcuccacccacaaacccccucugacuuccucauaccaggcacaucccccacaggccagcaggcaaaucugugcaaagcuggcccagaaaaaaagccccuucguccgguuucuaggaccuccuuguucuucccagaucccucccacagaggcaggaccacccagcgcccaagcccuugugcccccuauaccaggaggcaggacaacggagcaagcgacgggaaggguugcuguauguaggcccaggcaggggaguccagggaccuugcccagugccccucaucaaggcaagcaagcagcagucagugcacaccccgcuccccagggcaagcuaaggacgacugugucacuguacuggaaaagcuagaggcugcuaaagaggagggcccuguuguggccaagaauccgagaaaaggagggaggagggggaagcccucaacaaaacugggaguccuccugagagccaggcccagccucccuccuggcugcuuacuaaauauuuucuuaacauccugcggaggccucccuggcccagggcugggugccccugccugucccuccccguguuggggcagagaacaaagaccagagagaggaggagggaggggaggagggagacuccccccccccuugccccggcagaguaaguuuugccaucuuguucucacaaaggugagaaggcaucgagugacuuauccuaugggcugcguccuccacacugggagaguuuauggggccugugagcauggcccaaggucacccacagucagggcuggucgaaagauugccccccccccccccaccguggcagccaccgugagagagaaaaugucucaaggucagguggucaggugcugggggaggcagggaggaagaggaagcggggugaccaggccaagcuggcaccaaggcggggcuuuuauccccucccccacaggccaccagggaagcacaaacaaccagagacucucuaagggugucccgagaguugccaggucccuagguguggccacugccucuaguccccccuccccuuguuagggggagggugguggguccuuaccugggucucggucaaacuuuccaaggcuugcauaacggacuguuccggccucgaggccugggacuacaaagagagggacggaagaguaaccucagaguguguuuagagcagugagggggguggggguugaggggugagccuugcgugcuaggggcagugggagagcucuuugcaaggggaagauggugggugcauuuguggagugagguggccaggggauuauaaagccuccugggcacgcgccccucagucauuuaccaugaggccagcuuccaccgugggcacgagcgucaacuugcucccaucccccacgccgaauuccugcagcuuccccgaacugagccggcuggggguaggaaggaagagggugagacgggagacaacacagagacgcggaagcggaggcugaggaggaggaggaggagggcugugccugcccaaggagaggggaggacagaggagcguuuuccaccccucagcucuccaggcccaagugccuguggggaggccuacuggccugggagcccccuaagccuugacacuuaacuccaggugaaagcacuaagcacuaacccaucugcaaaagacaagagacuuugcuaucaccugaacccccgugggcucuuugccacccucccccgcgccucucuucaggccagcuccugccuacaacucuccaauucuugcccgggcucgucuuugugggcgccgcggggcuccggcccucuuugagaggccuucgggggcucugccgacccaggcucccccuccucccucgccagcgcaggcccgcugcucaaacaaaggagacccucccccuccgccccucccccacuggggccccuccgcuggggauggacauugcguguccccagaggcccgccaggggacgggggagcgggggguggcuccccggccuggaggcgauuuaaauaccaggugaggaggagguguggggaaccgagaacaaagggggguagagagacgcaagugauggggagacagccagacgcagagggggccgccaagcagaugcggaagcggcgagaccgccggcaugagaggggguggcugugcaccccuccccaggcacacagcgaacggaccccuccuugugccaucccgggggcccacaacuccccugucaucccuguauuucccgugcacccuggggccccgcagggugcuccugccuuugugcagaccccggcgggggaaggggcccaagcaaguaaggccaagcagagggcgcccgagagcgcgcggcgcgcccccgaucccccccccccccccccgucuggcugccccugcuuccccgcgcggcgcgcucuuuguucccgcccggggcccgggcccgagggggcggcccggugccagggggcgcgcaggcgggggcggcgcucuaccuacgugucuuugugaagcagcgccaggcguuccuuggguacuuugaggcguugggacaaccuuuugcgcagcccuuccacggucucgucguggggcaccgacaggucguagcggguccccguagugcuguggaucgccaggcucaugggugcggccgacuccguggccguguucagcucgcaggcgccgccgggggccccgcgccggcagcuccgggcaccgccgggcugcggcuccauccccggcgcgcgcuggagaacugggggccugcgggucgccuccaauccuagccgggacucccccgccgaaacaagguccuccuccgcuccgcgggcgcccagggacaggagcagugcgugcgccccuuggggaaggucccaacguuaggaauugagccggcaaucaagaauccgaguggugcuccggggucgugugggauccuuggguugcgccccgggguggggucugugauccguuuucaagggcggaugacagcgaccuggguacggcacggggaggguccuagagaaacggggcaagcuauccugguucgcacggugccuggaucccucucgggucgugcuaccccgcgcgucccuucccuuagcaacagccgcagccgccgcucgcaagaucugggggugaaaguacgaagaaaaaaaaaaguuaucauguaucaacguuccaaugggcgggaccaccgcccccucccauucacuacuuacuccgccggccuggcggcggccaaucaaaacacacagaccgcccaguccgucgcgcuaccgggccaaugagaaucgccgcggggcuaccccacguggcagcgagacccucccuuucucuccgccccgucccuucugcguccaauggagaugccaagaggguugggcugaggccgauccugaccagcccccgcgaccccccacccgcucccagagccauucauaaggcccaaagaccuuaacaaagggcgggcgggcccugaggguagcggacccgaguuuuaggacuuagcacccccccuccccgccccucugcgcgagccuaaccccuucaguccgcaacgggagcggucgggagaaaaggcuaggagccggccauuguucccgaauaaggaacaggaaaucguggcgccuccccgcugggucuguccgggaagcuacagccugcggaagcugucgcuugagcccugagccucauggucaagggucgcgagcuggccucucaaggacagggcugucuuccgcccccguggguggguggaugcaaugauauuggagaacuugggcggaacccacagcuugggcagggcccugcagcucggugacguggcuuugauuagauccgucccucccgaaccagugccacuucgcguccuaaccuaacucacccucaguuuuuuuuuuucugacuucccccccucccaaucccgggucggcccguuucccgaggugugcccgcccaagccgugacgugaugcggcguccccggcugcgcccgcgcgcgccccgcuucgggcagcggugagucagcagccccggcgcgcccucugcaguccccgcccgggagcgcugcccgagucccgggggaggagugccgugcgucuuggcuggggaaggggugcgccaagaauugggggucugcauguggggaggguccguugagaaccuuuauacuuagcaaugcagagaagacuuaagaccgcacauaaagggaaacugagucuacaaacaguucaaggucacuggcugagugcgggggggggggggggguuggggggcgugagcugcagucccgccagggcggugcccauagugcgcagccccucccaccccacaaguuggagggcuccggguccugaggcacacuaggugcggacgauucaaagaacaaagagugggacagccugagaaguuuacggcgggugggggccccucuccguuucgugcggucccgccccuacucaccggcuccguagguccugggucaccacugcuccagaugaccugcguauggguccuggcaagagguggccgugccggucug

SEQ ID NO: 5616 - RNA, 17070 nt, Mus musculus
gugcacuuccgccucagcuccggcauggcacuacgcaugcugcugcugcugcugcuccucugguguagcaacccugguuccgcugaaaacuccagccugccgggcccaccuuauaaccacacaaacgggaggcucccggacagggacacgggcuccgcggugcuccgcuuguucuacguaaucacugggcucugcggccugaucucgcuuuacuuccucauccgggcuuuuaggugcguuagcgcggccaaucagcaucuagugagucagggggaggaggaaaugggcgggagggcacgugauucaggcugccgacuggguuuuuuuguuuguuuguuuuuuuuuuuuuuuuugguuuuucgagacaggguuucucuguauagcccuggcuguccuggaacucacucuguagaguagaccaggcuggccucgaacucagaaauccgccugccucugccucccaagugcuaggauuaaaggcgugcgcuaccaccgcccggccgacugguucuuauucuugucucuuuaauugugauuuuaaggcugacgaggugggcagcgaccgcaguauggccauccuccuaacucagccucucuggugguguggugacaggggugggaaaaaacgugcuguacugcaaaaacugcagaaauucuuuccuuggcugaggcucauaaaaguuuugccuaacaccugcaaaaugcugugugcugauacaugucugucaucucaacacuuggaacuggaggcaggaugaucagaaguuaagggucagccuguguugcaauacacugaaucaaagaaaaaagaaaccagccuuucaucuuccauuuuuuucuuagcugcuaugacagugccuugugcuuuaauuaggaagcuguggcuggcaauccaacccaauaguauccaugccucuaccuccgugguuuucacuaugccaagaguugcucuuauaguuuggguuuuguuuuuuuguuuuuguuuuuugguuuuuuuuucgagacaggguuucucuguauagcccuggcuguccuggaacucacuuuguagaccaggcuggccuugaacucagaaauccgccugccucugccucccgagugcugggauuaaaggcgugcgccuccacgccuggagcacuuguaguucuuaugacaaaggauucacaucuggcaagugcuuuggggguggagggaagcauugcguggguacccuggacuuggugucacccgugcugaaguuguuucugaggguguuucuguccugcagacucaagaagucacagcgaaggagguaugggcuccugaccaacacggaggagcaugaagagauggccucucaggacagcgaggaagagacugucuuugaaaccaggaaucugagaugguaggaaggacuucaucacugagacaaacuagcaagggacaaugucucuaaaagggcucagggucuaucucagagcuagaaucccccagugaggggcugggagugugccaagaagguggagugucaauagggguuuuggaagcucuaauggaaacagauguuggaggaaagugccacacagggaaugugguaccacagaggguagagcagaacugcaaugagaacaaagguggcuuccucaggguucugagcagaguugaguguccuguccuggugauggcugcuauagagccaagaccacaauaggcacuagaucuggcuuuccaagggcccuggacaccaacuuuaucaucuucuguggucucuucucccuacccugguggaccugcaagggacaucaccuucuacaggcugggcugggcuggguuggaaggaggcccaaccagucccauccuucaauaccauaucuuguccuguuccuucccuugcagauguugagauggagaugacaggcugcaaggacaagagaaaacauguaguucugugagcucugaugucaaccuuccuggacagagccugcacaggcccuagggggcagcauagagaccucauugagacuagcccacagacuggagggccccaaggccaggcugaugugggcugcuccgucagccugccuccuguaagggacaagagcauccucugauaaggugugauggagcagggggccugaggaucucugugcgccuuccugcugcuuuggcaacaauaaaugaagaguggcuuuguagcuuaucugagaccucccccuugaugccacacucagguguccuggugaagugaaugagggugucaugccuggcugcccugccuaggacagggcucuccuguucaugucacugucccuagagacuauucuuuuucuuuuucuuuuuuuauaguauagaauagaguuuauucggggcauggggaggggaguuaagaggguagcagaggcagagaaaggcagagagaaggagagaguagagaaauggggccuggucauggccauguagagaggggggggaagggaauuaggaguaagggggcaagaggcaaaagagaggcaagaggguaagaggguaagagcgagagagacuauuccaaggcuccaguuaugacacucuggcucaguguauagucacuuacugcaguuucucaggauccuaugggcuacagcucagaauuagccagucaccugccucucuggugcuuaaauuuagggaagagggauagggaugcuaagucacuugcaguuugaggucuuaaccucaguuuuccucaguguugaguccacacugcuuggucauaacaacuaauugccaccagguggcagccacauaccaccuagccugccucccagcucccccacccccgcccccgcccccaguuacucugggaccaggucuccucuauugguccucuuucagaacccucauagucggaacuccuuguccagcuccugcccuauagguguccagacuucuuccacuuccauacccacugauacucccacuggucugagcugggucccugaggcuggcugagccuacuuacuaugaguguuggugucaggcugggugugauggagagccaagccauagcccacccuguaugucucuaucugcccccuucaguggcugggucucuccucagccuggggugcuccccgcaggaaaccucuguucugcuuucccaacuuguacccaggggaauccagagcuccugagucacaggucugggguuccugugcccuguuggucauuccccaucuuuguguuaugacugcugauaugggccugguucuagucccuggagcugugccccaggcuccucagcucagccauugcuggagcuucaaaagagagggugauuagucuaaugagaucaggagagaccccagcccccaccccugcuucugcucccagggaggguggccccaccaccauccgcagucacugaaccccagcauuagcagggguaauuggcaguuccaucaagguuaaugcacuauuagccagugcucuugcacagcugaaagcugggagaagggccugucaggcaagauggaaggccuugggcccuggccagccugugagugcccaaggagugagugugugccccuggggugaggagugugagugugugcaccugggguggcucucagcacacacacagcagggccaggggcuugaacucagaaugcuguugccaccuguacccauccugaaucugagccuuggacuggcagaaaggcucagcaggugaagccacaugcugccaagccggaguuugaucccuggacccacgugguugaaggagagaacaaacuccuguaaauugccuucagagugccacaccacaauacaggaaaaaaauaaacugucccccgaagcaucauccccccaauaugggcaaaccaagccucuuggugcuccccucgcccccaaagagcuagcugucagcugcuccauuggggacaugggggcaagugcaugucacagaccagucacaucuucuuuggaagucaagaguugacagcugcgacccuacauggauggaguuccacaaagggaaggcaggccaggguacucugagucccucuguagggcucaggcuagccucucccaacaggggccuggguaggcacagcagucugcugggacuuggacaguucuaguugugggaagauggguuugggaucaaagccugaccugugccuugagcuugaggggaggggaagaugauagacaggagagaaugagaagggaugggaggggggaugaauggugggaggguauagaaaagggaggagggagugcuugcauugagaagagaagaaggcaagagggagggaggauuuccucugagguucuguuugccaguaaugcaaagauuauuauuucuuugggcuccagugggugccuauugcuuggguugggcaaauaucuacccuguccuuacucugcagguggcaagcuagaaggggggcacuugugggauccauaacccacccccaacucccaacugcccagcccugucucagcucaggcgggcaauuugguacaauuuauucuguaaugagaaauuucucucggcauaauuuuagccuccugccuggcaauguggccuuugauggcuguagagucaccagacacugagaucaggagccugaggcuuugcccuguguaccagaguggcauggguggggcaugggugaccaaccaggguugaugagugaagccuggagacaggguuggcccagggccacugaagaccgucaguguggguuugaaucauagggugagcaauggccugagcacacagccccagcagaugguugaaggacccagauaucccauaacagaucucaccugauggaucugaagccaccuuugacccugguaacuccugaccuucauugaugcuugucuccaugguaggccccugaccucugacuaucuccaaggcagggucuuauuuccagugaccacuggccucauggucugaggcaggaugccugcggagggcaugggacuuccuaggcucccugucacuaugguggccaggcagggcucccuggaacaaaaggccuucugaggcccugcucuccccucaucuguguguccucaggagcgacaggcaggcuugggagguagagugggggacagccgccuuuguuccuguccucacucuggaucugaccuugagacaacagacaagaacagaaggcaaagcuuucugcucaaauccacuggcggcaggcagcucucaacucgguggccccagcaugcaaaugaggccuggugauguggccuccuugcuagguguccuugugacuggcccuggugauugagaaccuaacagauacagucuaguagaugagacuacccucuugguugcccuccccauugcaaagggggugcucaugucccagacagggcagcuccccaacauucaccuuuaugggcagaaugcuuagacauguggcccuguguccugugggugccaccagggcuugaccuggaaaucccagaauacccuugacagccaaguucagguccccaaguaaagccgggccuacaaagaggagagacauauuucaguggagaguggggacagagcacuuccaggucuggguaaagauuucacaucugugcccacccaguguguguguguguguguguguguguacacacaagcacaagugaacacauguuuauguguguggcauguggggaacuugucacagaaggccacauaucuaauuucuacagugccacccuggccuuuuuggucccagguaauaauaacacuggccagcuuuagcuuuucccaguccgcacacagaaggacauuuuagaauccaacugcucugugguccccaacaccaagcacaggacccagcaagugaaaaacaagccagcaaacccaucugguucacacagcucugaucuagguguuguagggaaagcccucccugagcgagcaagcgagcgaguguccuuucaccugccaggaauuggggugauucccagaguuccugaagugacucccagaggccucaaggauguacagucgaggaggauggaaagcuaggaaagggugacuuggaacuuuaguucuuuucugcugcgguuucauguagcccagguuggccuagaacccucuauguagccgaggaugaccuugaaugucugauccuucugccucagccucccgaaugcugggagggcaggugugcaccaccacaacuggccuacgacuucuuuguuuuaucagaucugaucugacacuguagccuaggauggccuggaacucgcgucaauccuccugccucagccuccuaaguacugagaugccaggcgcggcgcaaacaagcacuucgcuacaaccuacccaggguggggccacaaagcccccccacccccgcacaagcucagcgcucugggguccccuucccgaugcgggaggcuagggcgggacccuggggauccgcggcagagucugcgcgagucuggccggggcggggcccgggcagaggcuuggaggguccggggcgcggcgggagggggcgcccgcgacccuccaagacgcuccagcggggacaaaggcgaggggagcccccgcgcccggggaacccgggagagcgccuugcgcagugcaccgcucgggccucugccccgcgccgccgucgccgccgccgccgccgccgccgccgccgccugguuucucggcgcccgcggucuacggcgggggccgcgcgcagaggcggggcggcagaucuccaagcgcgcgcggcgcuccgcccgcucggcggcggaggcggaggcggagacggcggggccaggcggcggcuggagagcgagggagcgagcgcggcggcagcaccggggccauggcgcccgcgcagcgcccgcugcugccgcugcugcugcugcugcugccgcugcgugcgcgcaacgaggacccggcccgggccaacgcugaccgauacgcagucuacuggaaccguagcaaccccaggugagcuugauugggggaacccccggggaccccaagaggccccagcccuggggauugcagcgcacggaccuccuccugaacuucgggggugccuaguauucccccaagagcuccuggacuuugggggaagcccucugcacccucagacucaggaguuccuucucuguacuugcuugggggacacccuugaaccccuggccucuuggaggagggagcacccuggagggcugaggguuuggcaaauaucccuggggacuucccuuccacccaaggaauccccggacuuggcucuuuugagaagguucugagaguccugucuuugguucuccagaugaacuuggggaaguuacaaaauccccuuucuaccccuauguucacucguucacuccaaggggugcuccaaucccccagacacuuuagaggaacagaggggaccaggcaccaaagcgacggaggucaguuugaggggugcagccuaggcuuaucguuuuccaccuuuguagcugcggggggaaacugaggugcaggagccaggaggggcugccucaaggucaugcccagagaacuggugcuagggcuggagacccuggugguacccagccugccacacccagcaaggcaccggguccugccugucuguuugguggcaccccaugggucagacccugccaggcacuggguacagucaggggacacagcagaagccacuguuacaggcugaguaaaaaguuuacagccacugaccacauucuggaaagcauagaaccuuccgggucagaagggucucagaagugggggcaugcuggagggugucuugggagauaggcuuugggguuccaaggcuugggugcaguauagaucgagaguccccauguguccgaggcuggccagugaggaacuuaguugauggaucagccaagcugcccucuugauccaucaacagaaaguugcaaaaaaaagguggucuuugaggcaagcuguggcacaagggccaacagugucucucggugggagugggagcucucuguccccuaccaucaaggcagagcugugaggucagcuccuuugggcugagggcagggaccccagguccucucagcaaccuggcaggaccaucgcucagugggcccccuacccccacggcccgccagcuacacuggucacauguggguuugauuaacacucaguggccgugcagggagcagggugagacuuccuuggccuaaguuuucuaguuuuagcuuguggagucucuguccccaguauggccuguccuuugucuggaaaaagcacagaggauggagggaggggguauggagaagaaggaaaagggucauggcugccccuaauggccuuacuugccguggagacacggucauggggcugcaggcuggaacccugacucuggaaggauggagguguccccugccaccaccaggguccagcucaggcuugccaccuccuguugcuguguaucagggcaggcugccugagaggacagacagcuaggcagguagcagagccaaccccuaagguuguauguguguguguguguguguguguguguguguguguguguguguguguauguguguguguuuggagggcuccuagguccuugucucuuccuuggguuucuuucuguuguugacccugcugagcacccgacaguggggccugaggacagaugaccaccauaccccagcuuuacccaugacauugucauuggcacagcacaugguggggugugugugugugcuguggaaucuuaagauucaauggguguucgugggugggugauacagggaagauuccagguuggcaucuaagggggcccaguaucaggguacagucuggggagcugagguacagcaggauggggaugacauaaaauguaggggacgcugggaccccgagcuugaguaugggucacacacaaaagacacugugaacacaagugggggagggguggacuuguuccagagcacccacauccguguaggguacagugccuguccaacuaggacggguauauacacacaucggccauguucucugccaccgggccagccacagcugcccaaaggcuguugauuaugugugcauuucccaggggugauggcucugcagagaaggguggacauccacaaugggucacuccaucccccugcccaggcaccccugaaagccccuauccaggucugaccagcccagcaggcucgcuguccugaccuauguggaucucuagacuuauucccagaugcccccugcuuaccaggacugaccaggacaccccccggugcugaccgcucggcuguucuauggccuaacuguggcuaguguggcuucugccccagcucgggcaccuguguucauggagucugcaguggucugcggcugcauguucuccuccacaauucugggggaacccgggaugugugucagcauggagcuggcugccgcagacuuuaugugacacagcggcucaagcuggggugagugugugugugugugugugcgcgcgcacgcgcgugcgcaugguugugcaagaaagcgugugugcagagauuagaguagagcggugcacacacagaucugcaugugacacgcuugugcaaaucuaugucgugucaugagccacacccaugcguggucauggcuguaugguuugcgcaaaggagggcugcugguacggggacagcucugcccucccagggccacaaggacauccacagaaguggccucaccaggucccacucuucccuuuagacaggucaugaggauggaaagcugacaucacaugagaagcccagucccuccaggugccacuaaccucugagacauugcucagcuuggccaggcucugggcauagggcagccuggugguccugugccaggugaccucaugugggcaguaacagugucaccaccgagacaucugaauaggaagaugacgcccuucccagcaagaaagcgugugugccuagauuagaaugggagggguauacacgcagcucugcaugugacaugcaugugugaguguaugccaugucgugagcugcacccaaguguguaguuugugcggagggaccuggccacaugcucuucuuuguguuucacgggagauuguccuccaagauuaggggugcucggagcucugggcaagggcccgaggguuugggggucugaggacguuguggguaguggaccuuggggaagaggcuguguggacgaucaagguguuuagagugaaauggaagcuauaaccugggauaaggcaaagguuuuccgugacagaagagccagaaggagccaucugccaacuggaaggaggcugaggcaggaggauugcuguaaguuccaggucaggcugagugauaugaaauccugcccuagauggauaaguacauggguggguggggugggaaggucuagggcuggguucagugggaagagcacucacagugugaagcccuuggcucauuccaccccggugccacacaaagcaggcaguggcgaaggccuaucauacuaacaaucggcaaguggaggcaggaggaucaggaauuuugggucaucuucagcaauggugaguuagaggcuagccugggcuauguggggccuuugaucuccagucucucccaguucauaugcaagcugucugucacugcccuccagcaccccguccuuaaggaucugacaggcaccucauaggucccucugucaugucucucucucauaggaagagacauggcccauccugucauccgugagucagccaucauggucuauccuugugugguuauguccaaagugcgugcugcauggccgugauugcccugggcuucaggacucaugugccuuucaccaguccgucuggguccccaggagagauguugccaagaucaugggguagucagauugcuucaaggaguggacugcagggaccuaggccucucugugagaaagagaauccucaaggcagucacuaaccuuagugagaaguauuucaucugcaugcuucucuguuuuguucccgagggggguguuuuagaggugcacaguccccacucuggccucugagacacccuugcuggcaccacccggagcaagagucagugaugguacuggcuccugaaccacacacacgccuacccagaaccaggaucacuagcacugcaaggcuguugcaauuuuagagccaaagagagaaagaaaaagaaaauggcccauuuguuccuguacugucuauccgguggguaggugugcccccacagucguuccucaguuucccacccuagaacuguacccuaggaaucccuaaggccuccaacccuuggcuuuuauuaaauucucuuguucaaacauggguugagcaccacuguauacagggucuggguuggccucaguuacagaucaggacagaauaacuggauaaugguacaugccguguguguguguguguguguguguguguguguguguguguguaaguacuguccugggcacaugcaaagguucugagguguauguagacagugcuauggggcagagugaccacagugucccgaggaggagucccagccuggagaccaugggucauauggaguugccaagaaaaaugaacagugccaggccucugggucugggggucugguuuagauuuagaaaaccuggccauggguuugggggaggacuaugagccuggcaggccuuugcugugguccacugcaauucugucugugaucuagaaaggagugucgaugauuuuugaaaggccaggugucggggggcaguugagaggugaggaugugaguucaaguccugagcccacguaagaggugagccuagccgggcgugguggcgcacaccuuuaaucccagcgcuggggaggcagaggcaggcggauuucugaguucgaggccagccuggucuacagagugaguuccaggacagccagggcuacacagagaaacccugucucgaaaaaaaaaaaaaaaaagaaagaaagaaaaaagaggugagcauagcuccgcaccuguaacaccagugcugccugugaguggagcggagaaaaugaucuuuacaaacgugcacgugcagacugacagacagacagacacuugugcauacacagagcaggggugaggcagggagacaacucagugggugaagugcuugccuggaucccagcgucuaggcaaggcgucugggguggugugagccagcugaucagcagccacgggucagugagagacccccaccucugaaaauaacccuaccuaccugcguuggugaccaugcgcauugagaacaggcugacagaauauggcugagcugacagagcagggaccugccaccggcugugcugacccuuagagagucaggacuauggacacgccuguuguauuuuauaaaaauguaagaagggaaggaauauguuuggauaugcaguaaggugugggggaagggggugcuucugcaggcccgugcugagacaucccuuccaccugagggaccagccacaccacgguauaauaugguauaguauagaauagaguuuauucagggcauggagacuggaguugagaggggaauagagacagaaaaaggcagagaguagaggccgaccaugagcacguaagggcagagggaaauggggagagaggggauaaggggccagaagacagaacgggaacaagaaagcuagagagagagaggaggggcgagaagccccuuuuauagugagucaggcacaccuggcuguugccagguaacuguggggcggagcccagacgaaaugccaucaacgcccagcccgcccccucaauccuaaagauacccacacgugaggcacccaguccaguccgcacucagccauugcucgcaccucacaggcugcaugcauggaccagcaaacagcacgaacggcacuuacugcuguuguugacagggucucacgguugagggcuggccucaaacucgauguguagcugagaaugacauugaacccuauggcccucagucacugcugugccaugcagugaaccccacacagugcaccaggaagcucccguccccuuugcagggaaccaggccucaguuuccccagcuguuaugggagguaaaggaaaguggcagccucccacucccagcuacuaggcuuuuauaugcuaauaaacauucucccagguccccccucugccucccucggccugcguuuacaugacagggacccgggggacacuuggagagaucugacgguuccugcugccuuagccugaggcagagauggaaggggaacggcaggccaaccuggcaagccaaccucuguccucuaagaugaggcugggucaggcccgucacccccagaggacagcugggggacaacccagcaaccuccaggcugaggcugaaaucaggacuggggcgggggaggggggggugcaauggccaugagccagggaaccugcuagagagaaagauuguguggugucacucccaaaggcaggaaggaagacaguaguucaaggucauuccauccgcuuacagaguucagagcccgccuauguuucaagauauucugucacaaaaaaagggcacagagagggcaacaaacacaccagagucacacagcauggcagguuggcuugauccccagguaucuccaagaugaucuggcccugugggaggcuaagcgagagaagcaggguguccucugagcucugccuccucgcagggaaacccaggcagggaugaugccgauggggaggagcgcggugggguggggggcggguguuaggcaguguggauggguguggaccucagauccgucucccgcuaaccggcucucccuggcagguuucaggugagcgcugugggugauggcggcggcuauaccguggaggugagcaucaacgacuaccuggauaucuacugcccacacuacggggcgccgcugcccccggcugagcgcauggagcgguacauccuguacauggugaauggugagggccacgccuccugugaccaccggcagcgaggcuucaagcgcugggaaugcaaccggcccgcagcgcccgggggaccccucaaguucucagagaaguuccaacucuucacccccuuuucccugggcuuugaguuccggccuggccacgaauacuacuacaucugugaguagcccaggcuagcccccuuagcaaauggugaaaccgaggcagucuucucagcucuugucgaccccaugucccaugacccuggaagaagaagaguggaguagagggaucccauuucugagugucuccuaggaaggcucaguggggaagagggcaucagagccccugaagcugcagcagauccugcaucgccaacaggcucucaaaucaaaccucgaaaggccccacccauuucuuccuccuccccugccuccuccuuuuaauuccaguggguggggagggcaggagguguuuaaaaugaaauccuagaauacgaggggggaaaaugauauuuugcaagauggaaaucccagaaagauaauaauaauuccuuacauucuccaugacggauguuauuuuuauuuugugcauuuuaaucuucagucccggcaugaggagaugggugaggguggcuauaacaggccgugaggcgguaucccuguaccagggguuggucccugggcuccagaucucccauuccagcugccaaggagccacccucauguagcccagguugaccucaaacuccauauggagcccaggaccuuaaacucgccaugcucucccuuuuucucugugcaugugcacacccagauguuuugguuauuuuuguauuugcgcauauacacauuaaugugagugcccauguggacagagcccggaggcugggucugaguguccugucuuucucccucuccaccuuuguucucggaggcucucacugaacuaggagcagagcccguuugguccgugagccccagucaacccccugucucugccucuucggcucuguugguuaugagcggguaggccccacaggcacuuuucaugcaugcugggauccaaacucgggucccagggcucacuugcuugcuugcucgcuguacccaccaagccaccuccucggcuccuacuuugcucuauuuuuauuuugcuucaaacuucaccuuagguuaggcacaguggugcaggccuugaaucccaacacguggaagacagaggcaaggggaucucugacuuucaagcuaguuuggacuacauagagcguuccagaacagcgagggcugcauaaagagacccuguggcaaaucagccugaguaaauaaauagauaaauaaauaaaucuuacccuguccugccaggguuaggcugguuggucugagacauaacucagccuuuggagucagguuuggguggaggaaacaugaaagagacuucccaaaaaccauagggcauuguguuugggguuuuaacacaugguuaggaguucuguggguaaggucagcaguguggagaagggagcauacagccccagcaugugcccucuuuuccagcugccacaccucccaaccucguggaccgacccugccugcgacucaagguuuaugugcguccaaccaguaagugucaguagggguauggaagagacucagguccccuuacccucccuuugaccccaugacuaauccaaagagcugggggucggggacuaccaauccugggaccuuugagagugcauagccagaacuggcugacaaccuguccccuuuugugcucacagaugagacccuguaugaggcuccagagcccaucuucaccaguaacagcuccugcagcggccuggguggcugccaccucuuccucaccaccgucccugugcuguggucccuucugggcuccuagugucaggccggagaacaccagccccaccuggaccccgugaccuuugcccucugaccugccacggccaccuccgagacaaaauccuugcugcuucucuuucauggugcugucccgccggaggaggccauccauccgucccugggaugcaacauggggucccaaugccugaggagaagacccccccccaaggcugacucgcuuucaccagggccaccagggccauccaguguuguuuaauuacagucggaaagacuuaagguuuuucuuuuaauuuaauuuauucccugacauugcuggugacacugggaagggaacaagccacagggaugaggugaagccaucucuguccuuccuggaauaccggagauccaggggccuccagcugcuccuuucuucuguguccuguuauuugggucccagauggagcccaccgcggacuugccuugcauuccucaggccaggcaagccugagccagaaagggcgcacggugccagccccucucggggacucugggggugccaucccccacucuucuuccagccacucucgggccccacucccacaucaucucagaaacccuucagcccucgcaacucgccccuccgggcccccccaccaggcacaaccauccccggggccagccgggacguugucgguuuauuucuguaaauagaaaccagcaaguguauacugugauuuauuuuaauguauucuuaaggacagaauggaaauucuuuaaaaaaaauuuuuuuuccgaccuucaauucaaggggucauuuauuuugguggggggagugggguggacuuuuuaggauagaagcaacacuuugcaauaaacucauuuuuuuuuguuccguuggagcccucccccuugaucaugugaccuaguaauguuuauaacaaaaaaaauuaaaaaaaaaaaaagaagaaggaaaaaaaauacaggacuggaaaggaaggggagcuaccuaccaaaaauacagcaggcaaaggacugagugaagcuggccacaccacacguuuauacggauuucggauuucuacccacguuuccucacucuguuuucuauauauucuauauaaauauauauuguggauggccgccauggcgagugguggcuggggcuuuucuaggggcgggggacggguggcccggcccccucaucacaaucagcuuugaagucuguauuuuuuuauaauaaaauggacaaacuguuaag

SEQ ID NO: 5617 - RNA, 7678 nt, Mus musculus
aaccuuguaggguuauacuauaagcagcugacuaaugucgucucuguggcgcaaucgguuagcgcguucggcuguuaaccgaaagguuggugguucgagcccacccagggacgaccacagcgacuuuuucauucccuaauacugaauaaaguggaaguucuuuauuuugucgcuguuuccuguuugucacaggacgaccguggcgcacucugcgcggacgcgaccacagguauaaagcgggucagaaccacucggcuuguggugcggguuuccgcuggugucuauuugggcguuggacuagaaccggaacucuuuggaggacggaccgcagagguugucugaaggccgaggccaagauggcggcgcuggcgggugagugaagcccuugcggucgggagaguggcguaguccugggcuccgagcuggcgcugcggggaccuuggagcccaagccuaguguugagaggcguugggaccguagagaccuauaggucagaucccagcccucgguaaugucggugucuagcauuaggccgaagcauguuugaauucacguuacacaguucugcauggucuacauagcaaguugcaggccuccugcuaucgucccugauuauagucgggaacgcugaggccuguguaucuuccaaccucaggaagcugacugcagaaacccggcugauguccccgaagcacagagugggacaggggagaggcccaggacacuuaggccacccacccgguggcucuuuccaucucauccccaaccuggacagcuagcaagggccucuagagcagaugucuuaguuucccugccaaagcuuuggugucuuucucuuuauguacagggauuaaacaccugugcaguuugguagacgugagcgacaguugcuaaguggaaccucccaucgccuagcagguugcaguguuaacauaaggagugggagaacucaggaagucgggucuaacuccuucuguguuuuguuguugcuuugagacagugucugauggguccuagcucaaacucuauacugugggugaucuugaaggcuucauccgaaugccuucacugcuaaugcugggauggcaggugugcacagucaagcccauuuauacagcaccagggauggaacuaagagcuuggugcaugccaggcagggacucugccaacacaacuccagccccaaaugccugcuuuggagacaggaucucauguauaagaggcugacuuugaacuccugauccuccaggcucugaccccaaauacuaggaugacagacuuacuacuauacccaacauuauuuuuucuuuuaaagauagggucuuccuguguggccuagagucauaucaaacucauguuccugcuacagucucucauugcugggguuacagaccccaccacuguacccagcccagcugugauguagcccccuugaagaguggagggcuuggugauucgugguguugacugcuggcgccugaauucacucaggcucagcugugaucuugcuggugacaguuaauagaccuuacugugguccuauuugaaggagaaacuaacaccuuagagacaacaaggaggauguuugcuguaaggcauuguacuguacagcugugaucccaucccuugggacgcugaggcaggaugagccuagccugggcuauacuggaucccugcuucaaaagaagggcacuaagauuucugggaguuccaggccggccauggauacauaguaauaccauuuuaaaaggcaggaagaggaggaggccuggagaugugguccaguguuaaaacauucacugaauguguucagggccccacauuucauucccagcaugacagcacagaaaucuggucugagccagacuugugcuucaugcaguccuagcugcucagaaggcucuccugaggucagaguucagaagcagcuuaggcaacacaaagagacccuaugccaguuaaaacaaacaccugcugcuggcaccuccagccacuuaguagggcauuuacuuugcugaaaguuuauccaaagccuuaaguuuuuagauggggaagaucaggccuggugugugccacucagucagaaagucuagagucugcaguagucugucuuuggucuaagcagucgugaccuugggaagcaguagcccugagcaaggcugaagucagugaggagggcugaggcagaagaaggaguguggaaagccaccgucagcccagccccgagugugggaggcaggauaauccccaugucauggugggugucucucucccagucccaccuuucugucauggaggggcagucccagaugagacccccucccacuuucuuccuccaagacaggaucuugcuauguaauucuagcugacuggaacuugguauguagaccaggcuagcucgaacucacagagcucccuccaccuuccucugcauccugagugaugggauucaaggugugcacccccaagcuuggucccagaugacagaaauuuaucuuguauuccuugaacuuggaguccaagaucagagugucacagggcugggguuucgugagcucacagauaugacccccucuauccucaugaggcuauccuagucaucuuuauauccuacccgugguugguuuuguuuguuuuuguguuuuuaaaugcuguuugggauuuucuagagucuguucccauguaagccaggcuguucuaggacaugcagaccccugccucugucuccaaagugcuaggaugacaguuguacaucuucagaccugacccacacccgcccuuacaaagaauauccauccugcuaugucugggcacaucuuagugaccucauuguagcuuuuuuuuuugccucuggaaaggcuuaugcauacaaugacauuccguucugagaugcuggggcaacaugcucauacauacaguugcauuccaaggugcucagauaaagauuccaauacauaagcagugagggcauggcuccauccuggcucaaagcugccugccaugucucucuuccuuuuaaaaaguccccuugguugaguccugccaugugggaagggccugcuaugugcaaauguagaacaggcuguucagaagcagcugacuuggguccugggguagagaagugagacaugggagauagagggaaaggugacuuacaagggaaguuagguaagagggagaguguguuggagcccuccaggguaggauugggacuagaaccuggaccccuccuggggacuaaacuguuaggcucaggguucuguguuucucucucuagcuccuggccugcucucuguacggauccugggucugcggugagugugucgccugucugucacaaggcuagaucuagcugggugucagugaacagcaugaagcugcagggcuuggagcugggagggucccccagcaguggcuagugaagagaauguucgguuuagugggggguuagugguacguccagguguccucacaugguaugcagggauugucugggaaggcaguggccaaggcagaauaguauuguccacaagcuuggggcccucguaggaaaugcacugccugucccaacaagguguucugugagccugccagcuggaccuccacaggcuggcugccuugugacagggcugugaaggucaccagcccaggggagcuaccagcugucuccugggcuuaaagcacagcaucucaauaccaucuuugcuaggacauuugucaaccuuuugaccagucgguaguuuuuagaagcaaagaggcucuacuuaugucagaguugucaccaaggacaguagcagcauugucccuaugaaagggcagggcagccuggagaugagcagggggccaggggugggcagggaggccaccugugcuauguggggauggugguggugagaaggaacugcugacuguguccuggcggccucucagcaucgccccuguuugcaucuccagcacagcacagguccagcugcgcagaguucaucagaguguagccacugagggcccgagcccgagcccaagcccgagccugagcagguaauccaugcucugagaagggucugcaugcuaucuucuagggcuuugagucuuuuuuuuuaaucuuuguuuuguuuuguguuuuaaagauuuaucuauuuauuauauguaaguacgcuguaacugucuccagacacaccagaagagggagucagaucucauacagauggcugugagacaccaugugguugcugggauuugaacccaggaccuuuggaagagcagucugugcucuuaaccacugacuccucccauagggcuuugauucuugauuguugccugcacuccaccccaacauguggcccuggccccucaagucuuaccucccuaguguggcugcuucuccuuucucuguugaucaggccuaguguaggccuuguggaccucagggaugaugugguucuguccugggacccugucuaucccuccccaugggucccaggucagggacccuggggacaccuggcuaacuguccccugugcucaccugcucugcccuuagcacacagucugcuguguccaaggcuggagcuggagccgugguccccaagcucucucaucuuccccgaagccgggcugaguauguggugaccaagcuggaugaccucaucaacugggcacgccggguaaguccucgugucaaacccacccuucucagggcuuccucccacucaggguggccuggaugcuucagcaguccacauauuuguuuaguguauuguguguauguguauguguauguguguguguguguguguguguguguguguguguguguguguguauguauacacacacgcgcauacguaugcaugcuuaugcaacaucauguggacauggaagucaggggauaaccugcaggauucgaggauucggcucccucuuuccaacacauggguuccaggaucugacucaggucgucaggcuugguggcaagugccuuuacuccuugagccagcucaacaacugauaaaaagggccuuuuauuuacuuauuguuuugcauugaauuuguuugccuuggaacuuccuguguaaaucagaagauuuacagagcucugccugccugcugagcugagcugaaagcagccacucugccgucuuuaagcuccucucauggcagaggcuggugagcugcaagcccucugcaaagcacagggauggcauccucuccaugccuguccucaguugucccucucaaugcgugcucaugucuaggacacaguugcugggcagcugugccugguucccgugccuggaugugacaaccccugucugacaauuguccauugacaggcaugccccuggaccugccuuagucuccugggcagugccuaaggcucugguggguacccuacuggagccugaagcugcuaggacaaggugcccacugcggagaccagacauaggugcauccaugaggagcguaagcacccguggacagagaacauugagggaggcaagucagucccaggagauuccugagggacaguugagccaauccaaggacaucaagagggguuauucaugauggccagagcagcagcuaggccugggugcuaccuagaguccuaggccuagggcaaccucuggcaucaggugccugccaagcacucagugucacugugcccacgagguggagagacaaugccugcacagggcugacugucuguguucugccagagcucccuguggccuaugaccuucggccuggcgugcugugccguggagaugaugcacauggcugcgccgcgcuaugacauggaccgcuucggugugguguuccgugccaguccgcgccaggcugaugugaugauuguagcuggcacgcuuaccaacaagauggcccccgcgcuccgaaagguacaucugggccccuuggccccuucuacugccuugccaccugcaguuaucugaccugugugucuuguagguguacgaccagaugcccgaaccccgcuaugugguguccauggggaggugagugugugcucagacgccuaggggugcagggcccacccccagcuggcaccuuccucccagcucugcucuguagacaggaaaagcuccaggcagcccaaggcuccuccuccgugcucuccucucccucuccucagucuuucucuucagcugcaguaacuuguucauccuauaguaaaugcaugcauggagccugagucccuggguuccugugccugccaggcgaaugcgcacauccucgacccaacagcuugggucuuuucuugcaguggaggcuguaggggagaccccuuuaaauccugguacccacacaggggcccacaacugccugugacacuagcuccagacaauccaaucuuuaaaaaacaaaacaaaacuggguguggugaccaacucugaggccaaggcagucugaucucggaguucaaggucagcuugaacuaagccuggucucaaaaaggaagaaggaaaagagggcaaugguuguguuaucagaggcacaccuagcaagcuggguuccauccccagcuugguaacugguggugcacuccugucaccuucaggucuuuggggaggccaccuuagaucccacaguccacccgucugugggucaugagaaacucuuugguugaaugcacuuuuccaugaguugaucaguggcuccuugcauccagcacgucccaugaaaguucuggaaguccccuuuaccucagccuguggcagggugugggguguggcaugggcuggguggccaugcaucugaacugccucacaacccucuccccagcugugccaauggcgguggcuacuaccacuacuccuacucgguuguucguggcugugaccgcauugugccaguggacaucuaugugccaggugaggacagccauccugcccuaccacuccagacauugucuccaagcugcugagccagccuggggagggggaccuugaugucuccuguguccaugccuuguccuucaucccacccuccccaggagugcugggugugcuagcuuuccucuguagcccugggugggccucagcuuagcugagcugcagggucuuuuagcaguucccugucugucuucccuguguggucacuggccacugcccccugcagggcucucagucagcagacugcuggggagcagggccagaugaauagggagggcgggguuucuggcugcaguccaggggcuucuagcauccugagacauggacucucaagcugccucccugcccuuggcucaagcccaugucccugaccaaaugguucaguuuuugugacuauuccuaaggaccaagcuggucaccagagucacaaccuggcccuuuucccuguggagccauggacagcucagggauggaguggguguuaggaggcuuggcacagcaaggacccuugucccuuugaagccaaccccaggguacccuaagaguccuccaugugggcugguagaggcagaugguggggucucaaccguuuguguccccaggcugcccgcccacggccgaagcacuccuuuauggcaucuugcagcugcaacggaagaucaagcgugaacagaagcugaagaucugguaccgcagguagagcugccaggcugagcacgauaaucccagaaucccuugugaauaaacccauccugauccaguug

SEQ ID NO: 5618 - RNA, 7678 nt, Mus musculus
caacuggaucaggauggguuuauucacaagggauucugggauuaucgugcucagccuggcagcucuaccugcgguaccagaucuucagcuucuguucacgcuugaucuuccguugcagcugcaagaugccauaaaggagugcuucggccgugggcgggcagccuggggacacaaacgguugagaccccaccaucugccucuaccagcccacauggaggacucuuaggguacccugggguuggcuucaaagggacaaggguccuugcugugccaagccuccuaacacccacuccaucccugagcuguccauggcuccacagggaaaagggccagguugugacucuggugaccagcuugguccuuaggaauagucacaaaaacugaaccauuuggucagggacaugggcuugagccaagggcagggaggcagcuugagaguccaugucucaggaugcuagaagccccuggacugcagccagaaaccccgcccucccuauucaucuggcccugcuccccagcagucugcugacugagagcccugcagggggcaguggccagugaccacacagggaagacagacagggaacugcuaaaagacccugcagcucagcuaagcugaggcccacccagggcuacagaggaaagcuagcacacccagcacuccuggggagggugggaugaaggacaaggcauggacacaggagacaucaaggucccccuccccaggcuggcucagcagcuuggagacaaugucuggagugguagggcaggauggcuguccucaccuggcacauagauguccacuggcacaaugcggucacagccacgaacaaccgaguaggaguagugguaguagccaccgccauuggcacagcuggggagaggguugugaggcaguucagaugcauggccacccagcccaugccacaccccacacccugccacaggcugagguaaaggggacuuccagaacuuucaugggacgugcuggaugcaaggagccacugaucaacucauggaaaagugcauucaaccaaagaguuucucaugacccacagacggguggacugugggaucuaagguggccuccccaaagaccugaaggugacaggagugcaccaccaguuaccaagcuggggauggaacccagcuugcuaggugugccucugauaacacaaccauugcccucuuuuccuucuuccuuuuugagaccaggcuuaguucaagcugaccuugaacuccgagaucagacugccuuggccucagaguuggucaccacacccaguuuuguuuuguuuuuuaaagauuggauugucuggagcuagugucacaggcaguugugggccccuguguggguaccaggauuuaaaggggucuccccuacagccuccacugcaagaaaagacccaagcuguugggucgaggaugugcgcauucgccuggcaggcacaggaacccagggacucaggcuccaugcaugcauuuacuauaggaugaacaaguuacugcagcugaagagaaagacugaggagagggagaggagagcacggaggaggagccuugggcugccuggagcuuuuccugucuacagagcagagcugggaggaaggugccagcugggggugggcccugcaccccuaggcgucugagcacacacucaccuccccauggacaccacauagcgggguucgggcaucuggucguacaccuacaagacacacaggucagauaacugcagguggcaaggcaguagaaggggccaaggggcccagauguaccuuucggagcgcgggggccaucuuguugguaagcgugccagcuacaaucaucacaucagccuggcgcggacuggcacggaacaccacaccgaagcgguccaugucauagcgcggcgcagccaugugcaucaucuccacggcacagcacgccaggccgaaggucauaggccacagggagcucuggcagaacacagacagucagcccugugcaggcauugucucuccaccucgugggcacagugacacugagugcuuggcaggcaccugaugccagagguugcccuaggccuaggacucuagguagcacccaggccuagcugcugcucuggccaucaugaauaaccccucuugauguccuuggauuggcucaacugucccucaggaaucuccugggacugacuugccucccucaauguucucuguccacgggugcuuacgcuccucauggaugcaccuaugucuggucuccgcagugggcaccuuguccuagcagcuucaggcuccaguaggguacccaccagagccuuaggcacugcccaggagacuaaggcagguccaggggcaugccugucaauggacaauugucagacagggguugucacauccaggcacgggaaccaggcacagcugcccagcaacuguguccuagacaugagcacgcauugagagggacaacugaggacaggcauggagaggaugccaucccugugcuuugcagagggcuugcagcucaccagccucugccaugagaggagcuuaaagacggcagaguggcugcuuucagcucagcucagcaggcaggcagagcucuguaaaucuucugauuuacacaggaaguuccaaggcaaacaaauucaaugcaaaacaauaaguaaauaaaaggcccuuuuuaucaguuguugagcuggcucaaggaguaaaggcacuugccaccaagccugacgaccugagucagauccuggaacccauguguuggaaagagggagccgaauccucgaauccugcagguuauccccugacuuccauguccacaugauguugcauaagcaugcauacguaugcgcguguguguauacauacacacacacacacacacacacacacacacacacacacacacacauacacauacacauacacacaauacacuaaacaaauauguggacugcugaagcauccaggccacccugagugggaggaagcccugagaaggguggguuugacacgaggacuuacccggcgugcccaguugaugaggucauccagcuuggucaccacauacucagcccggcuucggggaagaugagagagcuuggggaccacggcuccagcuccagccuuggacacagcagacugugugcuaagggcagagcaggugagcacaggggacaguuagccagguguccccagggucccugaccugggacccauggggagggauagacagggucccaggacagaaccacaucaucccugagguccacaaggccuacacuaggccugaucaacagagaaaggagaagcagccacacuagggagguaagacuugaggggccagggccacauguugggguggagugcaggcaacaaucaagaaucaaagcccuaugggaggagucagugguuaagagcacagacugcucuuccaaagguccuggguucaaaucccagcaaccacauggugucucacagccaucuguaugagaucugacucccucuucuggugugucuggagacaguuacagcguacuuacauauaauaaauagauaaaucuuuaaaacacaaaacaaaacaaagauuaaaaaaaaagacucaaagcccuagaagauagcaugcagacccuucucagagcauggauuaccugcucaggcucgggcuugggcucgggcucgggcccucaguggcuacacucugaugaacucugcgcagcuggaccugugcugugcuggagaugcaaacaggggcgaugcugagaggccgccaggacacagucagcaguuccuucucaccaccaccauccccacauagcacagguggccucccugcccaccccuggcccccugcucaucuccaggcugcccugcccuuucauagggacaaugcugcuacuguccuuggugacaacucugacauaaguagagccucuuugcuucuaaaaacuaccgacuggucaaaagguugacaaauguccuagcaaagaugguauugagaugcugugcuuuaagcccaggagacagcugguagcuccccugggcuggugaccuucacagcccugucacaaggcagccagccuguggagguccagcuggcaggcucacagaacaccuuguugggacaggcagugcauuuccuacgagggccccaagcuuguggacaauacuauucugccuuggccacugccuucccagacaaucccugcauaccaugugaggacaccuggacguaccacuaaccccccacuaaaccgaacauucucuucacuagccacugcugggggacccucccagcuccaagcccugcagcuucaugcuguucacugacacccagcuagaucuagccuugugacagacaggcgacacacucaccgcagacccaggauccguacagagagcaggccaggagcuagagagagaaacacagaacccugagccuaacaguuuaguccccaggagggguccagguucuagucccaauccuacccuggagggcuccaacacacucucccucuuaccuaacuucccuuguaagucaccuuucccucuaucucccaugucucacuucucuaccccaggacccaagucagcugcuucugaacagccuguucuacauuugcacauagcaggcccuucccacauggcaggacucaaccaaggggacuuuuuaaaaggaagagagacauggcaggcagcuuugagccaggauggagccaugcccucacugcuuauguauuggaaucuuuaucugagcaccuuggaaugcaacuguauguaugagcauguugccccagcaucucagaacggaaugucauuguaugcauaagccuuuccagaggcaaaaaaaaaagcuacaaugaggucacuaagaugugcccagacauagcaggauggauauucuuuguaagggcgggugugggucaggucugaagauguacaacugucauccuagcacuuuggagacagaggcaggggucugcauguccuagaacagccuggcuuacaugggaacagacucuagaaaaucccaaacagcauuuaaaaacacaaaaacaaacaaaaccaaccacggguaggauauaaagaugacuaggauagccucaugaggauagagggggucauaucugugagcucacgaaaccccagcccugugacacucugaucuuggacuccaaguucaaggaauacaagauaaauuucugucaucugggaccaagcuugggggugcacaccuugaaucccaucacucaggaugcagaggaagguggagggagcucugugaguucgagcuagccuggucuacauaccaaguuccagucagcuagaauuacauagcaagauccugucuuggaggaagaaagugggagggggucucaucugggacugccccuccaugacagaaaggugggacugggagagagacacccaccaugacauggggauuauccugccucccacacucggggcugggcugacgguggcuuuccacacuccuucuucugccucagcccuccucacugacuucagccuugcucagggcuacugcuucccaaggucacgacugcuuagaccaaagacagacuacugcagacucuagacuuucugacugaguggcacacaccaggccugaucuuccccaucuaaaaacuuaaggcuuuggauaaacuuucagcaaaguaaaugcccuacuaaguggcuggaggugccagcagcagguguuuguuuuaacuggcauagggucucuuuguguugccuaagcugcuucugaacucugaccucaggagagccuucugagcagcuaggacugcaugaagcacaagucuggcucagaccagauuucugugcugucaugcugggaaugaaauguggggcccugaacacauucagugaauguuuuaacacuggaccacaucuccaggccuccuccucuuccugccuuuuaaaaugguauuacuauguauccauggccggccuggaacucccagaaaucuuagugcccuucuuuugaagcagggauccaguauagcccaggcuaggcucauccugccucagcgucccaagggaugggaucacagcuguacaguacaaugccuuacagcaaacauccuccuuguugucucuaagguguuaguuucuccuucaaauaggaccacaguaaggucuauuaacugucaccagcaagaucacagcugagccugagugaauucaggcgccagcagucaacaccacgaaucaccaagcccuccacucuucaagggggcuacaucacagcugggcuggguacagugguggggucuguaaccccagcaaugagagacuguagcaggaacaugaguuugauaugacucuaggccacacaggaagacccuaucuuuaaaagaaaaaauaauguuggguauaguaguaagucugucauccuaguauuuggggucagagccuggaggaucaggaguucaaagucagccucuuauacaugagauccugucuccaaagcaggcauuuggggcuggaguuguguuggcagagucccugccuggcaugcaccaagcucuuaguuccaucccuggugcuguauaaaugggcuugacugugcacaccugccaucccagcauuagcagugaaggcauucggaugaagccuucaagaucacccacaguauagaguuugagcuaggacccaucagacacugucucaaagcaacaacaaaacacagaaggaguuagacccgacuuccugaguucucccacuccuuauguuaacacugcaaccugcuaggcgaugggagguuccacuuagcaacugucgcucacgucuaccaaacugcacagguguuuaaucccuguacauaaagagaaagacaccaaagcuuuggcagggaaacuaagacaucugcucuagaggcccuugcuagcuguccagguuggggaugagauggaaagagccaccggguggguggccuaaguguccugggccucuccccugucccacucugugcuucggggacaucagccggguuucugcagucagcuuccugagguuggaagauacacaggccucagcguucccgacuauaaucagggacgauagcaggaggccugcaacuugcuauguagaccaugcagaacuguguaacgugaauucaaacaugcuucggccuaaugcuagacaccgacauuaccgagggcugggaucugaccuauaggucucuacggucccaacgccucucaacacuaggcuugggcuccaagguccccgcagcgccagcucggagcccaggacuacgccacucucccgaccgcaagggcuucacucacccgccagcgccgccaucuuggccucggccuucagacaaccucugcgguccguccuccaaagaguuccgguucuaguccaacgcccaaauagacaccagcggaaacccgcaccacaagccgagugguucugacccgcuuuauaccuguggucgcguccgcgcagagugcgccacggucguccugugacaaacaggaaacagcgacaaaauaaagaacuuccacuuuauucaguauuagggaaugaaaaagucgcuguggucgucccugggugggcucgaaccaccaaccuuucgguuaacagccgaacgcgcuaaccgauugcgccacagagacgacauuagucagcugcuuauaguauaacccuacaagguu

SEQ ID NO: 5619 - RNA, 2297 nt, Mus musculus
aucgaucuguagcuucaucuuuaucacuggcucuggggggggggggucguuccaagaccuucuucuacagcucuguucaaccccagaagguguuucugagcuccccacugacucgacagcgugucacauccccacaugcuggagccgagguugacugagguucagccaagcuguaccuggccaucagccacuggucauuugugguggaggugucaugguggagguggggaccaggaguccaagcugcacuggucagggcaaguuggaccccgugaccgccaggaauguggagugucaggaaugauguagccacaagcuaaggccacuucugacaaaacaguuccagccagcuugggacccaaggaggcaggugugguagcuagcgccugagcugccaagggguggcagggggcuuggguacccagugaucuagccuggcuuaagggagaacuguguucaggcaucaaacaucuuuaaucuuccagaacuaaaguccagccaccccaagaguggugggucuucugcaagaaggcaaacuaaaccccagauccagaaggggcaacauucaccacacacagggaccuggccuuugaguuccucuuggaccccugggcuccccagaauggaaacucccuugaugagucuccccggccccagggagaacugagaaggcaguguagcccuagagggccugagccaggcucuaugaagcgugcagcuagcccauucucucaaccaagaugccaguggcuggccugcuguggaugcuggggaugaagaccuucacugcccagggugacaugggacagaagagcacaccggucacuauggggcagacuggcuuugagccccgaccugcaaucaaguccuugaugcaauuuaggccaguguccccauaaugaggagguggccaugucccuaagucccaucaugaauuagaggccauuaaggauggaagagggaacaaagcugcuagcuggcaaggugggccacugggucuccccgggccaggguugggacagcaaauguugacccagagccucugguugcuaggugcccaggccuggaccaaggacaucagguguaacuucggcucuaggagguggcugaagucaccuggcugauauccuguuccagccgcugaccagcuugccgaaggccaucgaacuucugucucagagcuucccccgccugccgcagccucucauucauagccacguaggcccggcucuguugguagaucugcuccugcuggaucucagaguccucagcccuuggggaugggucuggggggucugaagagaagaaacagugucaccauccccaggccugacauccaccaacccagaggcaagaggaucagugguucaaggucauccuuggcuacauggugaguucgaggccagccugggcuauauaggccuauuaggcacuagaaaacaagacucaguuucagguuuuggugucauggagaggacaggacaccuccagccacccuggccugccguucuacccaggacugccuggauuccuggauccuaggccaggagucgcagauauggccccugcaaguacucuggccccccauuaauuuguaggagcagcuggccacgccccucugagacaaggucuugaacucacagcaauccucuugcccuagacccggguuggcagcacuuucaacuuuuuuuuguuuuuguuuuucgagacaagguuucucuguguagcccuggcuguccuggaacucagucuguagaccaggcuggccucgaacucaaaaauccgccugccucugccucccaagaguucggagcacuuucaauuuuauuucugaugaucuuucuuugcaggggaagagaagggcagggacaaaaaagauucgucccugcagucgguuugcuccccacucgggagucucacguucuccuaccuuccggggccagggcagugaaaacaggaucuugagcgggugccccucgcacguccuccaggaucugcuccaccgugggaggcgcggggcgagugggcaguaccacgcguuucuucgccuuggaguucaucuuguagguggagcgcgcgcuaacuggggguccacuuucggcucggcccgcccaccucgcgaacuccuacgcaccccuuacagaccugcgccgaggucccuaccccgucucgcuuucccuccucccggaaccucggaguuuggcucgaucuccgcgccaguuugcucuuggaacaccccgcugccuaucuucguuccaagaaccuaggcggccgccaccgcuuccgcuuccugcuug

SEQ ID NO: 5620 - RNA, 8218 nt, Mus musculus
cuucuguuuaacuuuuauuuggcaacuaugagguuagacauggggcuauggauggcuuggagacagggaaggggcagaugauugguggcuguggucugaccucuugcccacuguaccugcuccaaaaugaguaaggacacaucucuuccacugggagcagcugaggcugagcggugggcugucaccugacccaugcagcugcucugcccuggccuucuggggcaggcuucucuuccagccugagagcaggaccuugggguaccggccuucuguccugacagccaggcaucucuggcucuccagccuccagggaucugugcaugcaugguuuugggcacugggguaucuagccuggggcaggugggccuuccucaagccgaggggccucccaaaggcccuggccagcagagccagcaccauggcccaagacugguagcuggggggccaccagagguggcaagccuuggaggggcucuggagcucucccaacacaagggacaggggacaggcaguguagucgcugcucaggcugcugcagcagguguaacaggagggugacagcuggccuguccuucggucacuggcugcuguggguggcuguagagccaccaccacugcuggcuggagaugaggcagaguccugccaggauggagaggggacugugacuuucugcauagggacaacauggaaacagaaggagugaggcugcagcuggugggugcagccggugcccaccugcccauuccgggccgcugcgccuccucacccaacaagugaccaugcgcugcggccacucacccuggcacagccccucugugucccucugcacacaugcgcgcgcgcggcuggucaccuggggggccuggggccgugcugucauguccucggccgucccauacagcagcaggguguaguaguacagaguuccugggcgggggucgcagugggcaccaagggggacaccugucauuggccugccgggcucuguagccagccucacugucucccaagcagggccccguagcaacuguaccuacuaugugcuaguggccacaccaccucacaucucccagguagguggcaccugguuugcacuggucagaccauccccacaguugcuacacaucuacugugugccaguggccagacccacuucucuuaggugacugcaccuacugugugccacugugcucagagugccccgcuccuuuaaguuaccuuaaaccuaauuuacaaacccucacuuuccccacaggucagauucuccucacucccucacacuccccccauagcuguacaccuacuauugcccgucuacuguguacuagaaaggcaugguuucuccaagaaaaccccuaggauccucuauggcugagggucaaccaaggcaggguccccagcuccaaagcucgcagcccacagccacagccaauucucucaccuguguuaaaauaguagcccuuauucuccaggcccaggguccacaggcccugcggguccucaucccaguagugaguggacaugaagauccaguuguuguagccuuggccgcugauauccaacggucuguggccaguggguggcacaggagagacagggcucguggcgucucacacaagucuucugagucccacccagauagggucccaucugggaaggcuagggagggcaccgcuggcucucaggacccuuugagaugucucacaccugauggccacgagcguggagcgcgugcccauggggcuggugaggaagaucuccagguccccgcggcggcuguaggagagcgaaagcuggaccugcacgugcucgagcgagcggaugaggcggcggcgcgagccaucugagcacgcggucacguucuucggcaccagcauccgaggcaggauggggcugguggggugagggcgguccugugggucugcugcgggccagguagagcccagaggcggguuugggggggggcgggcagugucuaagggccugagggcacucuuuccucggauggguaaacugagguuucggggcauucugccuaccuuggacuaggauggggagguaguggagaagggggagcuacaacaaagcgcaagguggagaccuggacagaaucgcccgcguaggcguggagucuggaccgcggggccucccuccaguggaaggggcggggccucccuccagugggcgggggcucucucacgugggggugugcaccacccgaauggcacauuucuucugaggcuuagugggcagccacacgcgagccagguccaccagcaaccccgcguccagcagcccauagccauaaugguggcucacugcgcgggagggguagcggucacuggcccugagugcaccacacccgcuuccccugccuggccccaccgcaccuuggcgccccacgccguugauccuccaguccuccgccugcagcugcgccggccuggacgcgcggaccaccaggugcuguaggucccuccaggucaggagcgggcuggggggggcgagggcgggugagcggggagccgccccugggggcggggcggugggcggagccccacugucaccuacuuggccuccagggccagggcgaucaugccagcagccagcggggcagaugccgaggugcccgugugcuugucggugcacugguggugcagguccguggugaccugggacagacagcagagggaccuugagcucagugcgcagcccagauggagaaauuguauagaagguacuagggacuaaguuuucagagugaacaucagacuaagugaacauucagaaaagcugaagaaacacauggaggacugaguccaaaagguacugaaagggccuggugauacaggcauuuaauuccaggacucacuggggcagagguuggagaagcugugaccucuagccuagauuggucuacacugugagugucuggcucaaauaaagaauacuaaugaccggggcuggugagauggcucaguggguaagagcacccgacugcucuuccgaagguccagaguucaaaucccagcaaccacaugguggcucacaaccaucuguaaugagaucugacucccucuucuggaaugucugaagacagcuacaguguacuuacauauaauaaauaaauaaaucuuuaaaaaaaaaaaaaaagaauacuaaugaccaaguuuagcaaguacugaggacuaaguucaucaguuacuaagggucugcuaaggacuaagcuccaaaaccacugagcacugaguucaaaauguuacauagcccuacaucuaaaacgugccaagccucaaagguuggugaaguagggacgggggggggggguggggggggcagaggccacacagucaauggcccaaugauggggaaccucagagucagcccguacaaagggaauguucuucagagagccuccauguggcaggggcacaaauagaccaggcacuggcacagaucuugcccgagggggguggccgggcagaaggggcagggccuguguggccaggucuuguggagugggacuugcuuggggacugggaucuggagggauguggccacugccugggggugaagccuggggugguggggucuaggugaagacccccugcaggcggggccuguggugugggcuuggcuguaugcucacgaucugugggucggugaccacaccgcugcugaagguggugguaaacguggaggcacaggccucgcuguaccagggcacucgacccugccgcguggugcugcccacugacaguguguggaugcuguugguguagccgucacaauugcaguugucguaauggaggccaccguuucccgaggcccagaugaacaguguacccagcccuuggcggcccuggguggagugugacccgagagaacagagucaguccuccaaccccaggggacccucccccuccgcccagggugugguuccuggucaccuugguuacaccacgccugaaggccuccugugugaggaggccagguccguccaccgugcgaccaucauccuccgggccccagcuggcgcuauagauguguauguguugcggcugcaggcugagggacugagccuccacgaugucagugauggcuccauccaacaugcgcacgccugcgcgggugggcgugggccuugcgccagcaccaacucugguugcccuaccagaucaccuccuugccacccucagucuagggccuggcacugcucagccaucagggaugggaacggaggucccugcacuagccaagcuuaaccugacaccccacccccagccuucaccccugguaccuccaauucuagcauugaaggccacaccggcaccacagaaaccguuguuagcuguggcagacaccuccccagcacagcgcguuccaugucugauuccagagcaaggaggagaacagacauuugucccaucccaccuuggcauucauuuuugcaggccccaggaacacccggaacacagcaucuagcucaccgguucucaucguuggguguguagcgaggcugggggucugggucauagucguugaagucauagcuggccagaggguccugcagggcagguaggggaagaaagaugauagugaggugaggugaggccaucuguccaucgggggaccugcccugcugcucugaucccuagacaacucacauaauuagcccagagguccggguggucuuucucaaugccaucguccaagauggaaaucaccacuccccggccggucagucccugguuccaagccuuuaggauguugagaucuuguuguaucuccuuguucuaggagaggcagggagggaccuggggucagaggggcucaggaugguccccuuguccacuccacccagcccaagugcucaccauguaccacugcuuggaaaaccaggggucugugggcaccaccagggagcguuucacccggcgccucaaagucugcugcucaaaccagcgcaccugcagggugcacaggggcugaaccagcuaccgcagggguguggccccgcagccaggagggcugaagaccugcuuggacacacugcuaaacuaacaggcaugucggugggagcugcucuuugggucccccaugauccucaaagcugugggguuuuuguuuguuuguuugcuuuuuguuuuguuuuguuuuguuuuguuuuguuuuuucgagacaaggcuucucuguauagcccuggcuguccuggaacucacuuuguagaccaggcuggccucgaacucagaaaucugccugccucuaccucccaagugcugggauuaaaggcgugugccaccacggcuuaaagcuguguuuucagacacagccugaugauucaugauuggagcugcugggagcgaaugcagcucuccugccccacgcauuucuccucccgguuccuagguccuucucaccaaguccugcuggcaccaaguccugcuggcucccuccugcagugugauuauuauuauuuuuuuucuuuucuuuugagacaaggucucacuguguaguucuugcuggccuggggcucacuauggagaugaagcuggccuugaacucagagauucaccugccucuuccccuggagugcugggguccaaagugguacagcacuucaaaaaagccaccgcuucugaaacucuaggucaggacaccccuggcucaugucacacuacuuccacgaccuccuguagcuacucugucucucugucugucccccuccuguguccuuaauacaugcaccauggcauauauguggaggucaacucaugggccuacagagaugcuucagggcuuaagagcacugacugcucucacagcggacccagguucaguucccuguauccacaugguggcuugcugcaggcaccuggaacaaguuccaacuagaucccaugcccacuucugggcucccugggcaccugcauauaugugguacagacaagcaggcagagcgcugauccacauuaguaaaaacaaauauaaggaagaaaauucuaaaucuuuuaaaaaguaacaguggaacccggcaugguggcgcacgccuuuaaucccagcacucgggaggcagaggcaggcagauuucugaguucgaggccagacuggucuacagagugaguuccaggacagccagggcuauacagagaaacccuguuucaaaggagguggcagugacuucuuuaaucccagcacucaggaggcagaggcaggcugcucugaguucccaggacagccagggcuacacagcaaaaccuuagcucgaaaauuaaacaacaacaaaguaacugugggagucaguguucuccuucuacuuggaucuggggauugagcucagcuagguugggcagcuagcaccuuugcccucugagccaucucauugucuauuucucuguuuucagagaugaggucucauguaguccaggcuagccucaaacucuauguaacugaggauaacuuugaauuccugauccuccugccuccacuucuccaugugcaugacuggagugugcuaccaugccuggguggugcugggauggaacacagaacuuccgucccaccauccacucuacccacugaaccuuuuagcuccuauccccuccguuuucguccaacaucaccacaccuacugcccagcuggccuacagcagucagccugcuccucucaaagcuacaacuaggaaggcaggaaaaagucuugucuucuaccccagggccuuuccaugugcuguuuaucagcccaaagcaucuccugugcccuucuccuuacaccccaucuuagucucucucaggagccauguucuucugggugaccaucucuguccaucuauccacuucuauuuaucuucauucucuuccuucagaggcuuggcuucuaaagacacugagucccuguggugguuugaaugagaauggccccuaccuuuuauacuuggcuggguucccaguaggugaaccuguuuaagaaggucuaucgcuaucacugggagguggguggugggcuuggagguuucagaagcccauguccuuuccagcuagcucucccuuccccuugugaacuaucagcaccaccuugaccccuccugcuaugcucccugacauacuggccauggccucacccucugaguccaauaagcuccaauaaagucuuccuucuggaaguugcuuuggucaugguauuugucauagcaauagcuaagauaggucccagugcaggugauccccucucuaacguauccuguaacccucuauggcucauaccacaccuccaugccuguuuuuugacugccaucuaagaguuguucccaguggcagacuggccuaauguggacaggacaccuacagaagcaccaaaaacuugggcucugccccugguucugcacacucaccgacuccagcuccccugugugcugaaauggaccgguucccuucccuacauccuguggcuugcagggggggaaaggaccagugcaugagaccuuccauucaggacaacagggcaaggguuuaucugagucccccuggauauuaaguuguguuacauaugcgccuagcucacacauggcuuccccaacuaggccccacuucacacaggccacucauagcaggaacggugacagaaggcuacugguugggacacagcauccacgagcacucucaccuugggaucuuucuucagucguagacgauggccccaguguggagucagggacugcugggccacaccccggugccgcagauggaaauacuggucgucagggaagaucugggaaugcgacggacaacaggggcauagcugggacccugcuccuuugauaggaucuccacgacuuuauacaccucagccagggguccauaugacagccacagaaucccaaauugaacauggaggggcacacagauacauauuuggggaggucuuggggacacccucccauuuguccagaucugagguuguccagacccacaccccacgucccacccaccugucccagguugacgaagccaaauuuacgggccaggcgcucagcuuccugguaaccuuuggucacccgcacugcccagcugcugacauagaugggggccugggcugaggcccaccucacagccaggagggccaaagucaaagucagacccagccacagcucugucugggagggccgcauagcggggggcggggcgggggcggggcuucaggaagcacucccagccugg

SEQ ID NO: 5621 - RNA, 8218 nt, Mus musculus
ccaggcugggagugcuuccugaagccccgcccccgccccgccccccgcuaugcggcccucccagacagagcuguggcugggucugacuuugacuuuggcccuccuggcugugaggugggccucagcccaggcccccaucuaugucagcagcugggcagugcgggugaccaaagguuaccaggaagcugagcgccuggcccguaaauuuggcuucgucaaccugggacaggugggugggacguggggugugggucuggacaaccucagaucuggacaaaugggaggguguccccaagaccuccccaaauauguaucugugugccccuccauguucaauuugggauucuguggcugucauauggaccccuggcugagguguauaaagucguggagauccuaucaaaggagcagggucccagcuaugccccuguuguccgucgcauucccagaucuucccugacgaccaguauuuccaucugcggcaccgggguguggcccagcagucccugacuccacacuggggccaucgucuacgacugaagaaagaucccaaggugagagugcucguggaugcugugucccaaccaguagccuucugucaccguuccugcuaugaguggccugugugaaguggggccuaguuggggaagccaugugugagcuaggcgcauauguaacacaacuuaauauccagggggacucagauaaacccuugcccuguuguccugaauggaaggucucaugcacugguccuuucccccccugcaagccacaggauguagggaagggaaccgguccauuucagcacacaggggagcuggagucggugagugugcagaaccaggggcagagcccaaguuuuuggugcuucuguagguguccuguccacauuaggccagucugccacugggaacaacucuuagauggcagucaaaaaacaggcauggaggugugguaugagccauagaggguuacaggauacguuagagaggggaucaccugcacugggaccuaucuuagcuauugcuaugacaaauaccaugaccaaagcaacuuccagaaggaagacuuuauuggagcuuauuggacucagagggugaggccauggccaguaugucagggagcauagcaggaggggucaagguggugcugauaguucacaaggggaagggagagcuagcuggaaaggacaugggcuucugaaaccuccaagcccaccacccaccucccagugauagcgauagaccuucuuaaacagguucaccuacugggaacccagccaaguauaaaagguaggggccauucucauucaaaccaccacagggacucagugucuuuagaagccaagccucugaaggaagagaaugaagauaaauagaaguggauagauggacagagauggucacccagaagaacauggcuccugagagagacuaagaugggguguaaggagaagggcacaggagaugcuuugggcugauaaacagcacauggaaaggcccugggguagaagacaagacuuuuuccugccuuccuaguuguagcuuugagaggagcaggcugacugcuguaggccagcugggcaguagguguggugauguuggacgaaaacggaggggauaggagcuaaaagguucaguggguagaguggauggugggacggaaguucuguguuccaucccagcaccacccaggcaugguagcacacuccagucaugcacauggagaaguggaggcaggaggaucaggaauucaaaguuauccucaguuacauagaguuugaggcuagccuggacuacaugagaccucaucucugaaaacagagaaauagacaaugagauggcucagagggcaaaggugcuagcugcccaaccuagcugagcucaauccccagauccaaguagaaggagaacacugacucccacaguuacuuuguuguuguuuaauuuucgagcuaagguuuugcuguguagcccuggcuguccugggaacucagagcagccugccucugccuccugagugcugggauuaaagaagucacugccaccuccuuugaaacaggguuucucuguauagcccuggcuguccuggaacucacucuguagaccagucuggccucgaacucagaaaucugccugccucugccucccgagugcugggauuaaaggcgugcgccaccaugccggguuccacuguuacuuuuuaaaagauuuagaauuuucuuccuuauauuuguuuuuacuaauguggaucagcgcucugccugcuugucuguaccacauauaugcaggugcccagggagcccagaagugggcaugggaucuaguuggaacuuguuccaggugccugcagcaagccaccauguggauacagggaacugaaccuggguccgcugugagagcagucagugcucuuaagcccugaagcaucucuguaggcccaugaguugaccuccacauauaugccauggugcauguauuaaggacacaggagggggacagacagagagacagaguagcuacaggaggucguggaaguagugugacaugagccagggguguccugaccuagaguuucagaagcgguggcuuuuuugaagugcuguaccacuuuggaccccagcacuccaggggaagaggcaggugaaucucugaguucaaggccagcuucaucuccauagugagccccaggccagcaagaacuacacagugagaccuugucucaaaagaaaagaaaaaaaauaauaauaaucacacugcaggagggagccagcaggacuuggugccagcaggacuuggugagaaggaccuaggaaccgggaggagaaaugcguggggcaggagagcugcauucgcucccagcagcuccaaucaugaaucaucaggcugugucugaaaacacagcuuuaagccgugguggcacacgccuuuaaucccagcacuugggagguagaggcaggcagauuucugaguucgaggccagccuggucuacaaagugaguuccaggacagccagggcuauacagagaagccuugucucgaaaaaacaaaacaaaacaaaacaaaacaaaacaaaaagcaaacaaacaaacaaaaaccccacagcuuugaggaucaugggggacccaaagagcagcucccaccgacaugccuguuaguuuagcaguguguccaagcaggucuucagcccuccuggcugcggggccacaccccugcgguagcugguucagccccugugcacccugcaggugcgcugguuugagcagcagacuuugaggcgccgggugaaacgcucccugguggugcccacagaccccugguuuuccaagcagugguacauggugagcacuugggcuggguggaguggacaaggggaccauccugagccccucugaccccaggucccucccugccucuccuagaacaaggagauacaacaagaucucaacauccuaaaggcuuggaaccagggacugaccggccggggaguggugauuuccaucuuggacgauggcauugagaaagaccacccggaccucugggcuaauuaugugaguugucuagggaucagagcagcagggcaggucccccgauggacagauggccucaccucaccucacuaucaucuuucuuccccuaccugcccugcaggacccucuggccagcuaugacuucaacgacuaugacccagacccccagccucgcuacacacccaacgaugagaaccggugagcuagaugcuguguuccggguguuccuggggccugcaaaaaugaaugccaaggugggaugggacaaaugucuguucuccuccuugcucuggaaucagacauggaacgcgcugugcuggggaggugucugccacagcuaacaacgguuucuguggugccgguguggccuucaaugcuagaauuggagguaccaggggugaaggcuggggguggggugucagguuaagcuuggcuagugcagggaccuccguucccaucccugauggcugagcagugccaggcccuagacugaggguggcaaggaggugaucugguagggcaaccagaguuggugcuggcgcaaggcccacgcccacccgcgcaggcgugcgcauguuggauggagccaucacugacaucguggaggcucagucccucagccugcagccgcaacacauacacaucuauagcgccagcuggggcccggaggaugauggucgcacgguggacggaccuggccuccucacacaggaggccuucaggcgugguguaaccaaggugaccaggaaccacacccugggcggagggggaggguccccugggguuggaggacugacucuguucucucgggucacacuccacccagggccgccaagggcuggguacacuguucaucugggccucgggaaacgguggccuccauuacgacaacugcaauugugacggcuacaccaacagcauccacacacugucagugggcagcaccacgcggcagggucgagugcccugguacagcgaggccugugccuccacguuuaccaccaccuucagcagcgguguggucaccgacccacagaucgugagcauacagccaagcccacaccacaggccccgccugcagggggucuucaccuagaccccaccaccccaggcuucacccccaggcaguggccacaucccuccagaucccaguccccaagcaagucccacuccacaagaccuggccacacaggcccugccccuucugcccggccaccccccucgggcaagaucugugccagugccuggucuauuugugccccugccacauggaggcucucugaagaacauucccuuuguacgggcugacucugagguuccccaucauugggccauugacuguguggccucugccccccccaccccccccccccgucccuacuucaccaaccuuugaggcuuggcacguuuuagauguagggcuauguaacauuuugaacucagugcucagugguuuuggagcuuaguccuuagcagacccuuaguaacugaugaacuuaguccucaguacuugcuaaacuuggucauuaguauucuuuuuuuuuuuuuuuaaagauuuauuuauuuauuauauguaaguacacuguagcugucuucagacauuccagaagagggagucagaucucauuacagaugguugugagccaccaugugguugcugggauuugaacucuggaccuucggaagagcagucgggugcucuuacccacugagccaucucaccagccccggucauuaguauucuuuauuugagccagacacucacaguguagaccaaucuaggcuagaggucacagcuucuccaaccucugccccagugaguccuggaauuaaaugccuguaucaccaggcccuuucaguaccuuuuggacucaguccuccauguguuucuucagcuuuucugaauguucacuuagucugauguucacucugaaaacuuagucccuaguaccuucuauacaauuucuccaucugggcugcgcacugagcucaaggucccucugcugucugucccaggucaccacggaccugcaccaccagugcaccgacaagcacacgggcaccucggcaucugccccgcuggcugcuggcaugaucgcccuggcccuggaggccaaguaggugacaguggggcuccgcccaccgccccgcccccaggggcggcuccccgcucacccgcccucgccccccccagcccgcuccugaccuggagggaccuacagcaccuggugguccgcgcguccaggccggcgcagcugcaggcggaggacuggaggaucaacggcguggggcgccaaggugcgguggggccaggcaggggaagcggguguggugcacucagggccagugaccgcuaccccucccgcgcagugagccaccauuauggcuaugggcugcuggacgcgggguugcugguggaccuggcucgcguguggcugcccacuaagccucagaagaaaugugccauucggguggugcacacccccacgugagagagcccccgcccacuggagggaggccccgccccuuccacuggagggaggccccgcgguccagacuccacgccuacgcgggcgauucuguccaggucuccaccuugcgcuuuguuguagcucccccuucuccacuaccuccccauccuaguccaagguaggcagaaugccccgaaaccucaguuuacccauccgaggaaagagugcccucaggcccuuagacacugcccgcccccccccaaacccgccucugggcucuaccuggcccgcagcagacccacaggaccgcccucaccccaccagccccauccugccucggaugcuggugccgaagaacgugaccgcgugcucagauggcucgcgccgccgccucauccgcucgcucgagcacgugcagguccagcuuucgcucuccuacagccgccgcggggaccuggagaucuuccucaccagccccaugggcacgcgcuccacgcucguggccaucaggugugagacaucucaaaggguccugagagccagcggugcccucccuagccuucccagaugggacccuaucugggugggacucagaagacuugugugagacgccacgagcccugucucuccugugccacccacuggccacagaccguuggauaucagcggccaaggcuacaacaacuggaucuucauguccacucacuacugggaugaggacccgcagggccuguggacccugggccuggagaauaagggcuacuauuuuaacacaggugagagaauuggcuguggcugugggcugcgagcuuuggagcuggggacccugccuugguugacccucagccauagaggauccuagggguuuucuuggagaaaccaugccuuucuaguacacaguagacgggcaauaguagguguacagcuauggggggagugugagggagugaggagaaucugaccuguggggaaagugaggguuuguaaauuagguuuaagguaacuuaaaggagcggggcacucugagcacaguggcacacaguaggugcagucaccuaagagaagugggucuggccacuggcacacaguagauguguagcaacuguggggauggucugaccagugcaaaccaggugccaccuaccugggagaugugaggugguguggccacuagcacauaguagguacaguugcuacggggcccugcuugggagacagugaggcuggcuacagagcccggcaggccaaugacaggugucccccuuggugcccacugcgacccccgcccaggaacucuguacuacuacacccugcugcuguaugggacggccgaggacaugacagcacggccccaggccccccaggugaccagccgcgcgcgcgcaugugugcagagggacacagaggggcugugccagggugaguggccgcagcgcauggucacuuguugggugaggaggcgcagcggcccggaaugggcaggugggcaccggcugcacccaccagcugcagccucacuccuucuguuuccauguugucccuaugcagaaagucacaguccccucuccauccuggcaggacucugccucaucuccagccagcaguggugguggcucuacagccacccacagcagccagugaccgaaggacaggccagcugucacccuccuguuacaccugcugcagcagccugagcagcgacuacacugccuguccccugucccuuguguugggagagcuccagagccccuccaaggcuugccaccucugguggccccccagcuaccagucuugggccauggugcuggcucugcuggccagggccuuugggaggccccucggcuugaggaaggcccaccugccccaggcuagauaccccagugcccaaaaccaugcaugcacagaucccuggaggcuggagagccagagaugccuggcugucaggacagaaggccgguaccccaagguccugcucucaggcuggaagagaagccugccccagaaggccagggcagagcagcugcaugggucaggugacagcccaccgcucagccucagcugcucccaguggaagagauguguccuuacucauuuuggagcagguacagugggcaagaggucagaccacagccaccaaucaucugccccuucccugucuccaagccauccauagccccaugucuaaccucauaguugccaaauaaaaguuaaacagaag

SEQ ID NO: 5622 - RNA, 7479 nt, Mus musculus
ggcucacacauuaugugcaggcugccggaguggauggugggucccccaaauaugcaugggguauauaucccucaggaccuguuugccuuuccaugggucacagcucuuauaugaaauggaccguuauccucagggucucgcucccuccucccacaccacgcgaacgccagcgcuuacauauaggaaaacaacuuuauuaagaaggcuuucaaguccaaaaauaaaacucuggauacaauguuuuuaaacccuuaaaucaguucagcaaauauauaaucagugauuuagcugucaaagauuaaagguccguugcuuuauuuaaaauaaaauauauuuuaguucuuaaaauuuauuccguaaaguacauauaucuaauauaaauucccuacauauacacaggaaguaugaaguaaaaauaacaauaaaaaaaacuuuaaaaaccuuuuuaaaaaacaacaaaaaagaaccgcaacacugagucuuaauuuaaaaacaaaacaaaacaaccacaauaaaacaaguuauaaaucugucgaugggaccccccuuggauacccucccauuacccuccucuuguccaccccguggcugauguacaaaaugguauauguuugcccccaaaaaagggaguguguguuggggguggggggaagccaccugccuuuugaaguuucuacaagaauccacacuguuaaauccagugagaguuguaaauaucguguuauuuuuuguuuuaagaucaccccggaaacggggaggggcgucuuaauaaaaagugcaaacagagaauuuuccgguuuauugucaccggcucacucaauacugucacuugucaagaacggaggcgcugcugcugggccgcaagcugauggccucgacgccugcugcaggaguuaaagcuguuugcgacacgcgugggccccucaaccuccccacuuccccaccuuuccccccaaguccugcccggucccuccucucccaccccaaggccugaggcccuccugcuuggggaagccagggccaccccaucaaguagggguacacuaggaaaagauaugaauggcuuggguggcuggcgugcggcaggcgggacauucugguucacucuucccgcagaugcggacagcacaauccaugcagaagagguuguggccacaggggaccaacgcagccauggccucaccuucagaacacaccacacacucucgagccaaggcugccgagggugggccaggggcugcgguagacgcagaggaguucgcugcugugguagauggcuugugguugccuuccgaggggacagugucuaggguggaggacgccaggguuguacugggcagagaggggguuguggagaaggugguacugccagagaaaggcggcagcgcgcucugcgggggucgccaaggcacagcacccacuggaucugggacgcuucgacgcgccagcggcagcuccaggcucaguccucccggcuccggcagcgugggugaguggcgcggcgugguggcggccccgccgccgcuacugcgccgugugccuguguuggguugcgcgggugccccauuaacugcggggcagccgcugaaggcuggcaggggcgcggcucucucgaagggcgcccaaaugguagccguggcaggcacggucaggucuagcgccaggaagucaaaaccaaagucacaguccucugggguggcuguccccguuggggcacugggaccguccccaccaaaugugaagcccccauugccugagcccccauaggggcugcugggacuuggguccggcaguggcggcccuccacggcugcccacauagaagggcucaggggugcuggcugcccccagggcguuauccccucgaaggccgccgguggccgcggggggccuccguccuggguggggggccuuggcccagaggcuggcugcagcuccuaacaggucuagacacacgucgguaccauuggcauggaagucacugucgggacccgagucagugaaggccccugugcgcagcgugaugugagccucaaucucuucccgugcacggucaacguucucgggcaucccagucacagcgaacacugguuccuugucgcgcccgggagucacgauguacgugugcguccuuugcuggauccguuugaugguggcgcccuuaggccccaccaccagccccaccacucgguagggcacgcgcaccuggaugguggucuggccuggcagguuagggggaccuggaguggcccccgacagcccgcccgccuugcuacguguggcucggauuagagagaagugcucagcagccgacaggaucucccgcuuggccaucuccacauccuccuugcgcccagucacgaugaagaccggcuccucaccgcgcacuggggucuugauguagguauuggucuuggcacgcagggccuugaucuugcacccuaggaagaugggagggagacacaugacacccaaacuugauacccauaucucauggucuaugccuagacaguccaccaacucccugagugaacuaacucgcugggccucauuuccaucucuugaugcaaagaccuggccagaagagcaagcacccgggcagggagggcaagguaguucaccgguuaaagggacuuguugcccagccugaugacugaacucugagucaccaggaccaguguagugcaaggaaggacccagcucccacugaaucugcacucccccuaccccccccccccaugaaugaauaaguuaaacuuuucaaugaagggaaccuggccacaccccccagcaucagcugacagucauuccccaaucguagcugaaauguaauaaacaggacucaaaacaauccagguaugccagccgucugccacuguccacagggguuuacuggcccuuaaugguaguuaagcacacuucugcuguuccagaacuugggagggugacgcaggaagauuaccauaaagucaaggccagcuaggcagcucagcuacucucucaucuccagcacuggccacauggaggccagaggauagaaauuuaagguccggcucagcuacagcaaguuugaucaaggccagccugagcuacaugagacugccccugguucuagacccucuuagggcagugugugaaguggaggccugaggcccagaggguggcaacaccugccaugacaggcuuuuuguuuuuauuuuuuaccaaaggaauccucucaggcuacuaggcugcagucuccguuugaugggaacuccuagaccauaacucuggggcaccuggaaagucacagugaggcucugaagucuuugaucccacggggucccaggagugucccugagggagggccuccccugguggcggggagguggcccacagcaccagaaaagcugcuggaucagcagguuuaauggaguagacccuggagaguguacuccgugaugaccagagcaggggcucagcagugcccccuagggaaagucacaccucucuggccacuccaagcgugcccagacuuucuggucuccuggaccaguguuugagggauuacuuccucugcuuggcuacaugccuucuuccaggggaccccaacaacaagaggguauccaaagugucugcacuaacaccccaaaguguaccaggcuugcccaugaucugguugcccagaccucuacuccuauccacuggaagccaggaagggauuggguguggugguggagcccaguaccuaaggcagugugugccccacugcagaugcggcucaggagggggugugugggugugggaagguccuaaaugacagaggccuggucuacgaauguuucacauagggaccuaggauuuagcugggaagggggggggagggggagggaggggagggagggggcagugaaugaggucaaggaccccucccaguccagcaggcggccucucccuagcugugaccuagccuuagccccugaugguaguguugguggcuagggcccuaaggaccaagaggacacaaggagcaggcagggcauguggcaaacauggcuaucucugcacucaggagguuaagacagaaccauccuaagauggaggucagccugggcuacaaacaacagagcuggccuggggguguggcucggggguggagcuccugccuagaauccuccaguaaggugcuggaggugugguccccccagugaagggcaguggcauggcucaaaauacccuccagucuauuguacaucugaagaagacugaggcucacacaacaggaugguaccaggggauaggcaggccuuggcucccugcggcucaggucagguauggaagccagguaggguccauguguccauggacgugaccuggcuuuugauggguaaccaugagcucagggaaacacccuggaaaaaaugggggaacgaacccaggcacacacagucaagggaagaggucaaaggaccugacagaggugugucaacucgacacaaaccuagguacacuggggaagagggacucccaucuguguccauuaggcuggccugugggcaugacuauggggcauuuuagugauucaugauugguggguggugccaucccugggcaagguggcccuggguucucaaagaaagcaggcagguggaagagaccaugaggagcaguagguagcacccccaacagccucugcaucagcgcagccucagucaacggcuguagcugggagauuaaaauaaaccucauccucccgagcugcuuuugcuguuuuaucacggcaacaaauggccaacuaggcuagaugcgcuugggugggauaagcuggaaccacagaugucagaggcaagggcccugaggcugacgcccugucccuauauccagggugcccuccauguggcucugaguccauuuacugagcugagacuugcggaccacaccaauccagggcuuaugaacaucugcucaguguccaggggucaccccagcacagugggggacucaaggccaagcuugcuguuggccaccaauggcaccccacaucucaguaacacagcagacugggacugagcccgacgccccuggacuugauucuccaaagagugcuaagcuauacauuuacauggaacuguggugggcuccgccuccagaaagaggcagcaggcagcaggugacuuugagacaaaagaugauaauccuugacuucuucauuuggccacacagacucugaacaggucuggaaaacuggucccaguacaguuacaggggauggcauugggcgggaagccagcccaagguggcauugagccuacacaaagggacagcuggcucacagaugacuguccccacccucgagggccccuaggcccagcaccgcccauucucgguaggcauggaacggauaaaugacagaagagcaggggauacuccuggaacucgggaaguggccacggguggccuuugcuuguuggaggauggcagucaccuuugcaauucaaaccacucacauccuccuccauuccugaggguccagggaugccugagccccacccuaaaguucuuaggcugauccccgaucuuagcugggauaugaggagugggcugcuguggugaggagggaaggggaaaguugggggucaucacuauccaggcuugugggugugugaagggccgggcacugcccaccacaguccugcccgccccagcagcucaagggccaaugagcaacggcuggccugaugucacugugcgaaucucagccuggcuuucgaacaaagagaacaauggggcggccaacagagacacuccccagcuccacagugcugccgcagggacccccaugucuggguagauuagaucccuauacccugggaccgcugggggucagccugucaagaugggcggggugaaccccauggagagcuucuacagccaggagacccuccuauaaaugccagauucucaagcucaggguucgcugggggcuauagucauuuucucagaggacagcaccuaguccggaccuccaagcuagagagcuaagagaggcaccuucuaucuaaacuacuauacuucaauccugcccuccgggcacccucccugggcuagcaagucuaagcuggccccgccccaugccuaucuguggguggguggggggcagcccuagcugcuucuaaggggccuauguccuaaggugucccccagcuauggcacauggacugugguugucccuaggaacccagacaaaggccgcgguuguggccacagcuugggcagugcccaacuucugcagcagccggcagcuuugaacaaaggcgccaagaaauccaccgaggccuagauuccacacggggcgugucccuggggucuccuggucacauucacccugggcuagaacgggccacagcuugucccuuccucccaccaauacauacgugccccccucaauauuuauccaggagaauaagcgcgccccugcacuccucgacggcagccacucacccugacgacccacgaucuccgcgacaugcuccgagcugggcaccggcacacacucggucauguucacgcuuuucuugcgacucccgaucacguucaacugcucagccagcagcgucgagggacccagggcagccggguguggcgcgaagcuggcgaacacgucugggggugauggccgggggcucacgucgggguccaaaagaggcagcccgccgggggccaccgaagaagccacggccaucgugggugccagggucaccgagggugucagugccauugagggugccaccgucaccgagggugccacagccaugcagggugcacaagucaccgagggugccagggccaucgagggugcacuggucaccgagggugccagggccaucgagggugcacaagucaccgagggugccagggccaucgagggucccacgcccaucgagggcgcaccagucaccgggggcgccacggccaccucgagcucgucggggggcgcgggcucauccucuccgcauucugucgccccguccgcgcugcgugucgccaucccuucaucuccggggcgcgcgccccccagcccgagcgcggacagcugguccagcgccaggcgcagcgcagcggccgcgucgucgggcucggguggcggccggggcgcggcauccucggcucccgcgagugcagggugcggaugcccggggucgccggcgguggucccgguucccgcgccgcccgcgucgggcugcccgguggagcccggcauggcuuuagcgcucgggcccgcgccgccgccgccgcccgcgccgcccuccgcgucugcgagcucggccgccggccgccggcauccagcggcggggcggggacggcggcgcggggaugcugcggggacgcggggcugcggggcgguggcgcuguggcagggcuggcggcggcuccugggcggccgaggcggcggcggcggcggcggcggcggcggcgguggcacgggacgcucgugcccucc

SEQ ID NO: 5623 - RNA, 7479 nt, Mus musculus
ggagggcacgagcgucccgugccaccgccgccgccgccgccgccgccgccgccgccucggccgcccaggagccgccgccagcccugccacagcgccaccgccccgcagccccgcguccccgcagcauccccgcgccgccguccccgccccgccgcuggaugccggcggccggcggccgagcucgcagacgcggagggcggcgcgggcggcggcggcggcgcgggcccgagcgcuaaagccaugccgggcuccaccgggcagcccgacgcgggcggcgcgggaaccgggaccaccgccggcgaccccgggcauccgcacccugcacucgcgggagccgaggaugccgcgccccggccgccacccgagcccgacgacgcggccgcugcgcugcgccuggcgcuggaccagcuguccgcgcucgggcuggggggcgcgcgccccggagaugaagggauggcgacacgcagcgcggacggggcgacagaaugcggagaggaugagcccgcgccccccgacgagcucgagguggccguggcgcccccggugacuggugcgcccucgaugggcgugggacccucgauggcccuggcacccucggugacuugugcacccucgauggcccuggcacccucggugaccagugcacccucgauggcccuggcacccucggugacuugugcacccugcauggcuguggcacccucggugacgguggcacccucaauggcacugacacccucggugacccuggcacccacgauggccguggcuucuucgguggcccccggcgggcugccucuuuuggaccccgacgugagcccccggccaucacccccagacguguucgccagcuucgcgccacacccggcugcccugggucccucgacgcugcuggcugagcaguugaacgugaucgggagucgcaagaaaagcgugaacaugaccgagugugugccggugcccagcucggagcaugucgcggagaucgugggucgucagggugaguggcugccgucgaggagugcaggggcgcgcuuauucuccuggauaaauauugaggggggcacguauguauuggugggaggaagggacaagcuguggcccguucuagcccagggugaaugugaccaggagaccccagggacacgccccguguggaaucuaggccucgguggauuucuuggcgccuuuguucaaagcugccggcugcugcagaaguugggcacugcccaagcuguggccacaaccgcggccuuugucuggguuccuagggacaaccacaguccaugugccauagcugggggacaccuuaggacauaggccccuuagaagcagcuagggcugccccccacccacccacagauaggcauggggcggggccagcuuagacuugcuagcccagggagggugcccggagggcaggauugaaguauaguaguuuagauagaaggugccucucuuagcucucuagcuuggagguccggacuaggugcuguccucugagaaaaugacuauagcccccagcgaacccugagcuugagaaucuggcauuuauaggagggucuccuggcuguagaagcucuccaugggguucaccccgcccaucuugacaggcugacccccagcggucccaggguauagggaucuaaucuacccagacaugggggucccugcggcagcacuguggagcuggggagugucucuguuggccgccccauuguucucuuuguucgaaagccaggcugagauucgcacagugacaucaggccagccguugcucauuggcccuugagcugcuggggcgggcaggacuguggugggcagugcccggcccuucacacacccacaagccuggauagugaugacccccaacuuuccccuucccuccucaccacagcagcccacuccucauaucccagcuaagaucggggaucagccuaagaacuuuaggguggggcucaggcaucccuggacccucaggaauggaggaggaugugagugguuugaauugcaaaggugacugccauccuccaacaagcaaaggccacccguggccacuucccgaguuccaggaguauccccugcucuucugucauuuauccguuccaugccuaccgagaaugggcggugcugggccuaggggcccucgaggguggggacagucaucugugagccagcugucccuuuguguaggcucaaugccaccuugggcuggcuucccgcccaaugccauccccuguaacuguacugggaccaguuuuccagaccuguucagagucuguguggccaaaugaagaagucaaggauuaucaucuuuugucucaaagucaccugcugccugcugccucuuucuggaggcggagcccaccacaguuccauguaaauguauagcuuagcacucuuuggagaaucaaguccaggggcgucgggcucagucccagucugcuguguuacugagauguggggugccauugguggccaacagcaagcuuggccuugagucccccacugugcuggggugaccccuggacacugagcagauguucauaagcccuggauuggugugguccgcaagucucagcucaguaaauggacucagagccacauggagggcacccuggauauagggacagggcgucagccucagggcccuugccucugacaucugugguuccagcuuaucccacccaagcgcaucuagccuaguuggccauuuguugccgugauaaaacagcaaaagcagcucgggaggaugagguuuauuuuaaucucccagcuacagccguugacugaggcugcgcugaugcagaggcuguugggggugcuaccuacugcuccucauggucucuuccaccugccugcuuucuuugagaacccagggccaccuugcccagggauggcaccacccaccaaucaugaaucacuaaaaugccccauagucaugcccacaggccagccuaauggacacagaugggagucccucuuccccaguguaccuagguuugugucgaguugacacaccucugucagguccuuugaccucuucccuugacugugugugccuggguucguucccccauuuuuuccaggguguuucccugagcucaugguuacccaucaaaagccaggucacguccauggacacauggacccuaccuggcuuccauaccugaccugagccgcagggagccaaggccugccuauccccugguaccauccuguugugugagccucagucuucuucagauguacaauagacuggaggguauuuugagccaugccacugcccuucacuggggggaccacaccuccagcaccuuacuggaggauucuaggcaggagcuccacccccgagccacacccccaggccagcucuguuguuuguagcccaggcugaccuccaucuuaggaugguucugucuuaaccuccugagugcagagauagccauguuugccacaugcccugccugcuccuuguguccucuugguccuuagggcccuagccaccaacacuaccaucaggggcuaaggcuaggucacagcuagggagaggccgccugcuggacugggagggguccuugaccucauucacugcccccucccuccccucccucccccucccccccccuucccagcuaaauccuaggucccuaugugaaacauucguagaccaggccucugucauuuaggaccuucccacacccacacacccccuccugagccgcaucugcaguggggcacacacugccuuagguacugggcuccaccaccacacccaaucccuuccuggcuuccaguggauaggaguagaggucugggcaaccagaucaugggcaagccugguacacuuugggguguuagugcagacacuuuggauacccucuuguuguugggguccccuggaagaaggcauguagccaagcagaggaaguaaucccucaaacacugguccaggagaccagaaagucugggcacgcuuggaguggccagagaggugugacuuucccuagggggcacugcugagccccugcucuggucaucacggaguacacucuccagggucuacuccauuaaaccugcugauccagcagcuuuucuggugcugugggccaccuccccgccaccaggggaggcccucccucagggacacuccugggaccccgugggaucaaagacuucagagccucacugugacuuuccaggugccccagaguuauggucuaggaguucccaucaaacggagacugcagccuaguagccugagaggauuccuuugguaaaaaauaaaaacaaaaagccugucauggcagguguugccacccucugggccucaggccuccacuucacacacugcccuaagagggucuagaaccaggggcagucucauguagcucaggcuggccuugaucaaacuugcuguagcugagccggaccuuaaauuucuauccucuggccuccauguggccagugcuggagaugagagaguagcugagcugccuagcuggccuugacuuuaugguaaucuuccugcgucacccucccaaguucuggaacagcagaagugugcuuaacuaccauuaagggccaguaaaccccuguggacaguggcagacggcuggcauaccuggauuguuuugaguccuguuuauuacauuucagcuacgauuggggaaugacugucagcugaugcugggggguguggccagguucccuucauugaaaaguuuaacuuauucauucaugggggggggggguagggggagugcagauucagugggagcuggguccuuccuugcacuacacugguccuggugacucagaguucagucaucaggcugggcaacaagucccuuuaaccggugaacuaccuugcccucccugcccgggugcuugcucuucuggccaggucuuugcaucaagagauggaaaugaggcccagcgaguuaguucacucagggaguugguggacugucuaggcauagaccaugagauauggguaucaaguuugggugucaugugucucccucccaucuuccuagggugcaagaucaaggcccugcgugccaagaccaauaccuacaucaagaccccagugcgcggugaggagccggucuucaucgugacugggcgcaaggaggauguggagauggccaagcgggagauccugucggcugcugagcacuucucucuaauccgagccacacguagcaaggcgggcgggcugucgggggccacuccaggucccccuaaccugccaggccagaccaccauccaggugcgcgugcccuaccgagugguggggcuggugguggggccuaagggcgccaccaucaaacggauccagcaaaggacgcacacguacaucgugacucccgggcgcgacaaggaaccaguguucgcugugacugggaugcccgagaacguugaccgugcacgggaagagauugaggcucacaucacgcugcgcacaggggccuucacugacucgggucccgacagugacuuccaugccaaugguaccgacgugugucuagaccuguuaggagcugcagccagccucugggccaaggccccccacccaggacggaggccccccgcggccaccggcggccuucgaggggauaacgcccugggggcagccagcaccccugagcccuucuaugugggcagccguggagggccgccacugccggacccaagucccagcagccccuaugggggcucaggcaaugggggcuucacauuugguggggacggucccagugccccaacggggacagccaccccagaggacugugacuuugguuuugacuuccuggcgcuagaccugaccgugccugccacggcuaccauuugggcgcccuucgagagagccgcgccccugccagccuucagcggcugccccgcaguuaauggggcacccgcgcaacccaacacaggcacacggcgcaguagcggcggcggggccgccaccacgccgcgccacucacccacgcugccggagccgggaggacugagccuggagcugccgcuggcgcgucgaagcgucccagauccagugggugcugugccuuggcgacccccgcagagcgcgcugccgccuuucucuggcaguaccaccuucuccacaacccccucucugcccaguacaacccuggcguccuccacccuagacacuguccccucggaaggcaaccacaagccaucuaccacagcagcgaacuccucugcgucuaccgcagccccuggcccacccucggcagccuuggcucgagagugugugguguguucugaaggugaggccauggcugcguugguccccuguggccacaaccucuucugcauggauugugcuguccgcaucugcgggaagagugaaccagaaugucccgccugccgcacgccagccacccaagccauucauaucuuuuccuaguguaccccuacuugaugggguggcccuggcuuccccaagcaggagggccucaggccuuggggugggagaggagggaccgggcaggacuuggggggaaagguggggaaguggggagguugaggggcccacgcgugucgcaaacagcuuuaacuccugcagcaggcgucgaggccaucagcuugcggcccagcagcagcgccuccguucuugacaagugacaguauugagugagccggugacaauaaaccggaaaauucucuguuugcacuuuuuauuaagacgccccuccccguuuccggggugaucuuaaaacaaaaaauaacacgauauuuacaacucucacuggauuuaacaguguggauucuuguagaaacuucaaaaggcagguggcuuccccccacccccaacacacacucccuuuuuugggggcaaacauauaccauuuuguacaucagccacgggguggacaagaggaggguaaugggaggguauccaaggggggucccaucgacagauuuauaacuuguuuuauugugguuguuuuguuuuguuuuuaaauuaagacucaguguugcgguucuuuuuuguuguuuuuuaaaaagguuuuuaaaguuuuuuuuauuguuauuuuuacuucauacuuccuguguauauguagggaauuuauauuagauauauguacuuuacggaauaaauuuuaagaacuaaaauauauuuuauuuuaaauaaagcaacggaccuuuaaucuuugacagcuaaaucacugauuauauauuugcugaacugauuuaaggguuuaaaaacauuguauccagaguuuuauuuuuggacuugaaagccuucuuaauaaaguuguuuuccuauauguaagcgcuggcguucgcguggugugggaggagggagcgagacccugaggauaacgguccauuucauauaagagcugugacccauggaaaggcaaacagguccugagggauauauaccccaugcauauuugggggacccaccauccacuccggcagccugcacauaaugugugagcc

SEQ ID NO: 5624 - RNA, 1613 nt, Mus musculus
acucuuauaaggacaacauuuaauuggagcuggcuuacagguucagagguucaguccauuaucaucaaggucgaaugacagcauccaggcaguuguggugcccgagaaggagcuaagaguucuacaucuugaucagaagucagcuuggagaagacugauuuccaggcagcuagguggagggucucucaaagcccaccccuccagugacacucuccaacaaggccacacuuccuaauagugccacuccuugggccaaccauauucaaaccaccacaccaucauaccugagcgcaagcucugaccuauucacacaguaagauaaacucaggaaaguugucaagaucagaaacggcuagggauggagcuccuuuaggguguacaaggcucuugguccaucuccagcacuucauaacugucaccccagcuacauagcaagguucaggacauccugggccacuuaaaaccccuuauugguuuaagaauaaaaaagauggaaggagaaagacaguugaguaaccagcuuggcaaacacgcgugagagccugaacuuccuugcccggaggcugcaugucugagaccucccuuccugccagcccagauaaagcaguaagcuacaagcugagagacccagucuggggaaguuagaugguucuggaugguaagaggcacagauuuuuaaaauucaaaaauagagaauugagaaccccagugucaauuuucugcugccauucucacaugcaaaaaucugucagacaccaagccuggcuuaaucccagcaccugggaagcagggggcagaaggaucucggaguucaaggccagggaaagcuacaaagucagacucugacucaaaaauacaaaacacuaaucccagccuccaugucccccugaccuucuucacugugaucugaucucuccuccugaucuggggacccaaauccuagcucauaaaauacaguuccugagcuccaaaaauugcaggcaagacaaagaucuuuaaauguguugugauuucaccucaugaucccuuggcagcucuccuugucagggaggguccccuuucaaagagaggucuuccagguacuguauaauggaagccugggugagaagguaguuggccuucaggcauguucccuggguaagucuggcugggccugaguggcaaagcagccgacaguaccaagcaggaguaagugaccccccagcucccuguccucagggcugcgguagacaaggggcgauagugcgagugacuccauucacuaacuuagaaaccaguuuuugguuuuguucuuccuucugaugcuggaucuaguaaacuccaagcuggucuugaagugcuugauccuccuuccuccacuaucccagugcugagauggcaagcacgugccacuauuccuggccugauuuuaggguauugcuguguggcccaggcuggccaggaauguucuaaauagguucgugagccaucaaacucaggcuggggugcagccuaacggcagaaagucuaccacguguaagguucugcuuucuauuuucaguacugcugcaaagaacaaacuucuuaaauaguucuuggugaagccgggagugguggugcauuucuguccucgc

SEQ ID NO: 5625 - RNA, 1586 nt, Mus musculus
cgcuguaaucuuuggcuauauaaggccgucgugcgccccccggaggacgaggagagcuucacggccaggguuuuuguuugauuuaggauuuacuuucuaauucuauguaugugcaacaugaguguuucugauucucgcugaagucagaaaagggcuuuggauacccagaaauuggagcuacucaugguuaugaacggucaugugaguacugggaaccgaacccaagucuccaauugcuguaagugcucuucaccacugagccaacucucuagccagggucuuaauuggcugaggugccuauccugagaaaccuaccuaauugaugcucaaauagucaccuaaccacgagggguaucaguggggcauuucuuuuuucuuuuugccgugccuagauacauacacuagacaagggcacuccaacuaagcuacacucuggaaauauauuugauuuuuuuuuuuuuguuuuuuuguuuuuuuguuuuugcuuuguucugggguguuuggagggaggcgacacugugcacccgcaugcagagguuagaggagcauacagcuucccaccccuuuguuuagucuuccauuuucuuuccuuuaagacaggcuucuucacugaaguacuucagcugggcaggcuggcuagcaagcucccagcaucugcuugccuccaccccaaagccuaggguggcacucaccuggucauacccagcuuuaaaugggugcuggggauuagaacucagguccugagaccugugcacagcuuucuaacccacugagcccucuccccaaccgcuuuucuguuuugcuuuugauugagguaaggucucauguaacacagacuggauggacuugcccauuacacagugcuggagaugaaacgcaaagccuugugcuugcuagacaguuacuccagucacugagcaacauccccagaaccccucuuucuguuugucuggacagggucuggcacuguagccuagacugaucuuggacuucugacaguuuuccuaaaugcuaagauuacaggccugagucaccauggccgccugcuuuuuaaauuuuuaaucaauuuauuugguguuuauuuuaaaagauucuccuucugcacuccaggcucaucucauuuucaaaucuauaaaauccaucugccucagccucugggauccuaggauuacagacuugagccaacacaugcaauuuuggaaggguauucuaccagcauuuaacaauucucacagagagaagucaccuggauaagcacuggugcaugacgaacauaugacauaggcccuggguuauuacacagccucaaaagcaauucuggugguguacaccuauagucucaguccaguggaggucgaggugggagcacaccuguaaucucaguacaguggagacagaggugggaacacaccuauagucucaguacaguggagacagaggugggaacacaccuauagucucaguacaguggaaauagaggugagagauugacucagaucauucucaguuacacagagaacucagggccaaccuggguuaccuggaaacugguauuuuaaaauaaauaaaagcugguuuuguuuugu

SEQ ID NO: 5626 - RNA, 10243 nt, Mus musculus
cgggacugagcgcgggcggcggcggcgcgccggggccuccuccucccuucccuccuccgccucccgcacucuagcagccgcugccggccggacgggcguaggucccaccgccuccgcuucucucccgccgccgauuccgugucuccgcguccuugcccggcaugucggcggccguggcguguguggauuacuuugccgccgacgugcucauggccaucuccucgggagccguggugcaucgcggacgacccggccccgagggcgcgggccccgcugccggucuggaugugcgcgccacgcgccgcgaggccacgccgccggggaccccuggggcaccgccaccgccagcuacggcuccggggccgggaggcgccaccgcugcgccccaccugcuggccgccagcauccuggccgaucugagaggcgggccgguagucgccaccgcagccagcaccgcggggggcaccucuccggucuccuccuccucagccgcuucgucucccucuucgggccgcgcccccggcgccgccaaaagccaccgcugucccuuccauggcugcgccaaagccuauuacaagucuucgcaccucaagucacaccugcggacucacacagguaagccccucguauuuuacacaggugggaugcagggagugcauuagagaggucucggggaccccguucccccaucucacuuggaaccccgaaacugcguggcgcguggggggcggggaggggggcgcgcccaggcuucagcggcccgccggccgggagggcggggacgugguggguggggcgcgcgcggggaggcguggcggccacgcggucgggcggcgcgcggagggcggcccugguggccaaaucucccgcgauugcagguuguucgggaucuaccccggcaugguggguccaccacgcgcgaucacaguccucagcccccuacuccuucguuuucgcuugguauucuuguccuguuuuucugcgcuucauggucucgcccuugguggucagaacauccgguuccguaguucuuucucggcccucccccagccucaguuuccuuaucugugaagagggucgguagauccggguuacggccuucuggguagcagcgcggauucccuccgaagggcagcgaagacucucgcgcaggguuaggugguagcauagcaguggugagggguggcugcccggaacauuuuucuuuccauucuguguacuuuuaacaugguggagcgaggccacgacccggaccuggaguuggggcuugaaucuucaauccagugggauugaaauccucaccacaacucuucgccuacguuuuguguuggcccacuccacacaccugugaugggucaggucaagguccaagauggacaacgagauuuagccacaccaguguuucugggaugcccaauccccccggauuggauggggcaaaccuuuugcuagguacuggccgcuuccuguccaagggucuauccauguuagcugggauuugcacugggauuugacaaucuaccccuuuaacagcgguguagucaacagcuccaaggcaucccugggauagggcccccugcuuguuaucccucuauuuacuugcuuuugguucgccaucuccugucuauauaagagauagaggcugccuuacugauacaguugaugugggcagcaaggcacccaaagagggcuugaugggggugggggugggucuccuaacauggucacacugggagagagauuaggacagccuccauagguguguggguggccccaggcauguucagggcagguauggggguggaggagccaucuuuggauucuacugagccagagagagggcauagaugaugccuccucucacuguguuuugagcugcuggcuugagccccuguggucuaggggcuacccccguguuggugcccacauguaugggcagcuccauaucaccuguguauacacauuucucucuacagaacauuugagggggccacacauguagcaaggcuguguguguguguuggggguugguuugggggaagggagagagagaguggagaaagaugucucucuuugccacagacuggaauccaggguguccuggcucacaccaagugaauuuggccuugcagugaugggagccugcugagccagggacccugucuuucugauucagacugcaccacccacaccuuccaacccagcaggcuuccuaguucccagaacuugaggucgaucacagaggaauccaacgcccuccccaccuggagacaguucuguuacucaaaugucaaaggcugcaagccaccccuaagcugggaagggugaccugccuugcuagagaaauugaggccugagagcugaagucuggggucuagggaugacagcaggcagguccacgaggugggguauggaguuccacucuacacuggauccugaaucauccuugaccaccaggacacacacgggauaccguguccccaaacucccuuauuaacaccauucaugggaucaagagauucauauuggaucugggcaccuuuaugucauuuugggggugucuggggagcacugaauuuacauccugccuuuuaguuaauuuaaacgacuguagccagggcaauccugggacuugcucuguagacuaggauagccuugaacucacagauuggccugcuucugccuguccaguacugggauuaaaggugugugccaccaggccucaauuuuugagacauguucucacucuguagcccaaacuaacuuugaaacucaagguaaauccuccugcuucagucuucugccuagggcuaaagagccacagcuggcuuccccagucucuucucugugcaggggauuuggcuacuccacccucaagugaagguggcauacugcugacuuaggaagccuguguggucacguacaccucaggucaguaggacucaucucuaguauagggccugagguagaucugauccccuccagagccaugcccuaaggcuguggacuaggagaaagaauccugucuaccuacccacucaugccugacuacgaccuggauccguuuaguucucugauggaggcacagauagcaccggguagagggcaccuugcagccccgcuauguccacuucauuguacuugggggugcggaggagagcuggugguggggguuacaggacacucccagcaaaggcuguaagcagagcuugacacuccaguugccacagccccugcuuggguuggggaaggacuuuagagacugugggagauguugacgugguugcuauggauaccgagagagcuagccuuggggcgggggcgggaggagaggcuggcuccuguucugccugccaagcccccuccaucucuggcauccucuuucccugggccucagaggguggggggguccuugauauggucucgugagauagaacccagaccuaggagaggucuggacauucauccaggcagggucucaccccuuuaggaccaguucuucacaguaagauguucugggcccuucagcuuggccuccucagugcccaggaucuccuggaggcuucaggcucaucuccagauagccgaaaaacccgcuuacuuaagucugagaaacuugagucugggcaagggugaugauggcucaauuggguaagggugacggccaagaaagaugcaucucagagaccagcacagcagaaggagaguccccgcuugucaccggcagugacuucugcaugcaccuggugcguguuccuacacacacaaugaugcacacacaaaaauuagagguuugaagaaguguucauaucuguggucaccaggacacuguagggucuuugugggcauccugccccccaguaaccaugaagugggaagguggggagggcugauuugcugaggccuguguagcuggguggggccaggaacaguguggcuggagagggaacacugagcuggcucuagggcugggauuuugaaggcuacugaaguguugccuuuaaucucaagggcgggguugucucagaggccugcuuggcuucaucaggaaaucucuuuauggaggagggguuagggugggagagggguugagggugaggugaugucuggaggggggugggaugcagagaaggcuauggccaccccuaguguucugaccaggccaaaguaaugguucuaauucuuugaggauguuucugggaggaaagacagggaaacugaggcugggaugggaaggagccuggucacccacaggcagaggggcaagguuccucaguggggauuugggagcucuguagaaaagaggagccaggcaguaguggcacaggccuuuaagccuuuaaucccagcacuugggaggcagaggcaggcggauuucugaguucaaggccagccuggucuacagagugaauuccaggacagccaggacagagaaacccugucucgaaaaacuaaaaugagagagagagagagagagagagagagagagagagagagagagagagagagggucacacccuaugggguugagguggccuuugggaacugcuaccacccugucaauucagcucuuccuuacaauucacagcaacugggcuggcugcaugcucuccagcuggugagggcccccaacauugcuggaggugauaaccgcacccccaccuaggcuucugauaaaagcagccagaugggcuggcaguuggcaggcagauuauaccagccagaggacugguaacccuuuggagagguggguugguguccaucucagggagucccauggggguguuguccuuauugccuguuucaagagcuccugacagugaucaggcagcucggcccucugggaaggagagggguacugggucaugcucuaacucaugaacuuuugagacaguuugggaucuaaaauguagacuagguuggccucaagguuucucuuuguaguccuggcuauuuuggaacucucucuagaccaggcuggucucagagaucugcccaccucugccucccgagugcugggaucaaaggcgugcgccaccaccugacauaaaauauuuguauuuacugugugcuuguguguauggacacguguguaccauggugcauauguaaaggucguggguccugaggauccaccuccguuaggguagcaggaggucucuucccaguacauugccccucuauguaaagagagugcuaggagccccccuuggaguuucaggauucugagcacaucgaggaggcugccuuccugguucacgagccuucauccagacccacaggccaguguuaagcacccacuguaggccagacucaugcuaugaaguuucaggaaccaaauugggaacucaguaccuggucuccacucacaacuaggcauuagggagggaaaagugucacauugggugaccaccaccagagccagaggugaugcucacagggaaacgguagugggcagcuacagagccaagguuuggacuuuaucauugacugccagccaagguggaagucuggcaagcccuauacagcugcugggcuuaaguaccagaacaggccuccccuugaggaguuuagacccagauagagucaggcguggccagauggaaacugcaccuucaggucccccucugcuggccacuccccuccuggagcaaguuuacaggaugucacaaccugcaaguguuagagucugcaaaguaccuaaggcuccugaguuagagagaggcgucccuagcucacccuggcccuucccgagucagggucaaguccacagccacgcccacaggacccuucuagcguaguacccacccaccuauuccuccucccccacgguccgguugccaggccggggacuccugcagcuuggucuuucaaacacucccucgccagcagcacccccacuccucacgucacccuucuggguaaauugugauaccuuagcacauccaggccaggcuuuuggcaucugugcauccaguguugugggguggaguuuagugagcauggcguaccaccaucggggugcacacgugcgcuucccaacccccaaguguggggcgggaacuggcaggcuccuagcacugcuaggcgacccuggcccgggccucugucuccccuguggcgggagcuaggaccacgugagcaaggccaguugggcugcugaagucaccaccggucgccaucgcugaacuacgugcagcauuuguguucccagcaggcuggugcuggcagcagucgccuccacugcaaccugcuccugacaaaguagaacuagggggacauggggggggggcaccagccccacagggaggcuccgaaaggggaaguaagcugauugcaugcaaggggguguccccuuuccucuucccccgccccccauccucuguccgcaaaauggcgacaggauugcuugucccccuuguacggacaccauucugucaccuggugucuuguuccaaagcuaggaaccuagcccuauaaacaagcgccccaucccuccagauugagcccuuugugcucugugguggggagggguacuuucuggggcccgcuggcuggacccaguauuuuggaucauuuaggaggacacuuuggaaaugacaagggcagccuucuggguacacggucccucuucccuuucuuugcugucuaggauuguagccugugggcccucagguugccuggaugccaaauagaauuggcacauggguaucccaguggcaguuuccugcguucugcgccuccauggugaggggcccuugggugugguuugcagggggcccggauggagauaauuuucagcugccugcuuccugggcggugauggcugaugcccgccuaguuccagauccguccacuuucccucccguuccucaguucuucucuccugggauccccuaagcugucaccccagccuucgguguagaauaguaucuguuccacuuucuggucaccucuacacucccucuccucacuuccaugaguccugucuagagggccccuuggccauuuccugagggacaugagucuuugagaguaccuguucuccgguggauuagucuggagaccacacgagguagccucguacuagucccauuguagcuuccagagcuuagaccuuugggucacuaguggccugguucugccuccaaccuccucuggacucugucacaagcagaauuguacacgggcuuucugguccacacuguguccacacaccacccuaggcuuuuggauacacaccgugcauauggucccuccucuccagaucuggaaccuauagccauccaaaccaaguccugggugaaccagucagccucuucuugguccuuggaggcccaucugggaagauguuaaccacaagaugaggccugguguugugggggccuccugaggaccagagagcuugguugggcuggcggggaccggggcgaggccaauagggcggugggagugguuuguggaggaaguugccuaguaggcccgccccuguccagcaguaauugcugugugacuggcucuacucccugaggccacgccccuaggcgcucugcccucccccucaggaauugaauuuaagcuaaguuuggaauugcugccugaccuuuccuaccucuguagaguaugagaucgcgaagcugcaccccagcuucagauccacgggcugaaacuagcuugggccugaugauucaaaauugcagguggcccagggugucggggaaggaccuggagaaacguucuuucugugcgauuuggacacuguugggagcacaucugaggaccuguuaaguuggucagaagacgacagagugguguccaaagagacacaggcuagccaggggcaugguggcccaguguuugggaggcuagauugccuucaguucuaggcuagauggugcagcuaccaagaccccacccucccacagaccuauaggacugcggaauguagcucgaugggcagaauacucccccagcaggcccuggguucugaauaccagccagguucgguggcccaugccugucauucuaguggaggagauggaagcaaggugacaaggaguguugauuagggccacuuguauagcuggacccauccccugcccgcgcucacgugcucacugguuacucuuccuuguccaggugagcggcccuuugccugcgacuggccuggcugugacaagaaguucgcccguucugaugagcuggcccgccaccaccggacgcacaccggggagaagcgcuuccccugcccccuguguaccaagcgguucacccgaagcgaccaccugaccaagcacgcccggcgacaucccggcuuccgcccggaacuccugcgacgaccuggugcccgcagcgucucgcccagcgacucgcugcccugcagcuuggcuggaagccccacaccuagcccuguccccagcccagcuccugcuggcuuguagagcccugacguguccacccugaguggccuccuuacugggccucagcagggauuucuaucaagggacacaucuguccucuggagagccuguguccuggaguuccagcccaccucaagaaagcagcaaggggacugagaauggacuugggucaccuggggggccugggagguggccucagguucugucuguaaauagccaugguuaacuguccuguccccucugcagggaccccaaaugggcaguuggcaggcccccccaucccuuccugccacccucugcuuucccuccuggguggcguugggcaugaagccuaccccacuccuugucuucagcccccuagucaccccuccagguugggacacagguacacagagccauaggugacuggggcuucccaugggccccuaccuguccccacuccacugaaagccauuggcggaaguucagggaaauggggggggugcagccuggcugacccccuuccauggguacucaaaucucagguguccauagguucugcccucaauaagggccccccacucccagccccagggguacaggagacccacaguuuucagagaacuuagggcugugggguacagguggggcacguggaggugcaucccccacauccccgcucaccuuggguguggugcugggcagaugggaaagaaauuauuuauuguccucucugacugcuggugugggggggccuggcucccccuaucugggugugcauaugugugagagagacagugggugucuggugccuggggcuuagccuccuuacucccacuggguuagggucccugaguuuggccuuuguggcauugcgucucagacaaucuauaggaccccugcggccaucgggcuauggauacagggcucuggucugccgucaugugcuccacacucucgggugucugcagaggguggccuuggacuccaggauugggaacagggcguucagcuccuggaccuucugggguagcucggguuuuuuuuuuuuuugcacaggauagauuuauuuuuuucaggcucugaguuccauguuccaguggggguccccuuguguggccgucauccucaggggugaguggggaaggucucaggagagucuacaguaggauccucuacuacugcagacuggauuucuuuucuagaaaggcaauuagggauugccacacacacaccaagaaauuggggacacagagaaaguugagcugcccuguguuggcugugggggguuuacuggcauucccauuuguuccagaaucuuccaucaugaaaugagggaggcuuuggguaaugcuaccuuuaccugagccuacaugagggaggucacccuucuggagcugggcugagggcccugggccagcuccucuccuggguacuuccauuugccccuucucuuuggccacagaaaugagaugccuuaguuugcaggguggguggggggcuggggccaauucuuuuugucuuuuggauguaucuugcuucaucccagcuccugcuggucuccuguccuuccuguaaacagggggaaaggacugagguucuuaggaguuaacuccauaagcaaucagagcuuuuccgugauguccucccccagccccccaacuucagguucugauugauaacugggacuugggucuaaccauugaagggugaugaacgcagggcaggcaggacaaggguccuaagggauuuauuuguucuuucuguagggggcaccucuccuccauuccgccuggccucucacccauauauuuaaauuaaagaagcccuuuuuaaaaaccugc

SEQ ID NO: 5627 - RNA, 2923 nt, Mus musculus
caucucuggguccccaaugccauucuuggcuuggggacaaaauaucccggaggucgaacuugagagcguaggguacccacuacccugccuagcugaucgaguuuguagaguucgucuuugcgcaccgggacucgagaaucacuaggccuguggauaaccgguauggcaaaagugaacagggcugcaauaagaaggucuggcucggucaucuaugcgaagcuagggacacuggaguucugguuguuucgucccucccucacuggcccuuugagacugggacagggaaacugaggcugacuaauggagcgauuggaaacuuccauggauaaucgaccaaguugugaaaugaugguccccuaaaagccccaggcccuaggcgccgguugcgcggaaguaggagaccaggcucccgccccuuccuaacucccgccggguugcggaggccaugcaguggcccgcgcagccuccagggggcgaagcaccccaaccgacagcagucugucgguccgagcuccaucauguuuauuccccagcagaggcuaaccgguggcagagguccuugcucugggugucaucucuaccuuccccaccugcaccccaagcugacuuggucagguuccagugcucugccgucgaguuggccauguuucucuaggccccacuauacuuuguguugacaccgugucccucaacgacagagguugaauacucugggggaccucugcacaaaucuagcuggacagaaauggacagguuacacaaguccacguuguucagaaguacacaccuacccaucuuuccauugcuugcccuccaacaaccagaacccugcgauccugacccagcuucuguggcuuucugaagggaucuuuugcccucccucccgccaccugaagagaggagccaucaggaugaauugauucaugaugccccgccuaacagcagcuagagugguaaguaagguugguuguacaaccaccagguggugccacuuagcaugccccaagcacauuuguguccuaagggcuuaagccugugagagccggcugugagcuaauccugccauugcauguagcagccccccauuaccguucaugcauauuagccucauaccccaagccccagacacgagguggaucgguuguugaucugacccaggagagaccuaaaaacagucgcccuaccuuacagauggcacagucaaggcugaggacucugggaaaauauccagccugcucccacaagaacaggaguacugguaagucacucuuucugaugguaucccuagggcucaaacacuugguccuugcuagucccacgggggagcucugguuuguccuuuguuuuuauuuucauaaaggaucuacgggaguuauggggacaggucugacacccaacauuuggcuacacaaauuucaggucuuuuuuuugacacaacucuggcugaccuagaauuuauucuggucucaaacucagcgugccucugccuuccgcgugcuggaauuaaagaugugaccaccacaccagucccccaaaggugaacuauuaaggaccacguugagaacuuuggguuccuauaugaaggauggggcuaagaugcagggggccuaagagagccccuggcaggcacuugggucucagaaaagucagagaucccagagaccugucacuuccuggagacuuaaagugugccuguuuugaccuaugcccuggggacauccacagacuuggguccgguggaacagagacuacagacccauccaugucacuguugcucccaacucauguggcugaagccagccaggcauagugcuuuuuguuggggacagugacccuaagauuuagcuugaaccugggcagcauccaacacaagcaggaagcugaaccaggcuucauaggacuauguuuuguggggauuuuuuuguuuguuuguuuucuuuuuuucuuuuuuuuuuuugguuuuucgagacaggguuucucuauagcacugguuguccuggaacucacuuuguagaccagucuggccucgaacucagaaauccgccugccucugccucccgagugcugggauuaaaggugugugccaacaccgccgggcucuugguuuugguuuuuauuuuugauuaucugggcaugucauccacaccuuuaugccuagugcuccgagguggaggcaggaagaucgggagaucaagauuauucuuggcuauaaaguugcagagcagggcagugauggccaugccuuugaucccagcacuugggaggcagaggcagggggaucuguauaaguuugaggccagccuggucuacagagugaguuccaggacagccaaaccuacacagaaaccuugucuugaaaaagaaaaaaacagggcugaagagauggcucagcgguuaagagcaccgagacugcucuugcagagguccugaguucaauuaccagcaaccacaugguggcucacaaccaucuguaaugagaucuguaaugagaucugaugcccucuucuggggucugaagacagcuacaguguacuuacauauaauaaauaaauauuaaaaaaaaaaaaaaaagaaaagaaaaagagagcaaccucugagccagugagcaggucagccacuuuugcguguauguacaauaauauccaacaugggugccucagaaccaaagguggccagcaucccaacauguuuguccuggucccuauuauauauauauccaggauaagggagguagcugugucauagagaccuguguccaaggacacggugggcucuggggaagucugaaccuugggcaaccauuggucccuggccuuuguuacucucagcuggguccauugguccucaaagacaggaaaguccuaccagcuaucaacgacuauguccauguuugagacaucuguggcaggccugauccuguccc

SEQ ID NO: 5628 - RNA, 6695 nt, Mus musculus
acuuccgggggcgguguuaggucaagcucacuuccgcccgcggcggagcugcggugguggcggugcaggaggcugggucgggguccccgggggacagacagacggacgcacgggcgggcggccgggagccauggagugcggcccccgggccggcgggcgcgggcggcggugagugcaggcgggcgggcgcgcgcgggcugcggcgguuuaugguguggggccgaaucgagcgggggcccugcguccgagaccucccugcgcucuccggggauggcugugagaccagcgcacccaccgugucccuggcauccccaugucccagugcagcgauccuggagcagucgcuuaaccuccucaggacacggcuguguccccaagaaacgcccgggccagccgcagacccaggccacugucccacacccucucugucuacaucugucugcugacauucaccggccaccuuugccacucaccuggcgucuuccugccagcgggggcccacugcaggcuuccuuucugcagcccaggacuccuuuaugguuccucaucacccccacgaugaagcccucuugcugaagcacccucuugcugagggugcagcuugagcagacccugcuccccugggagcccuugcaguuuuucgaauccucuccugcugcccggguuuaccucugcgguccucugucacugagcuauuuccuuuuuuucacgugugugcgcccacgcagaggacagcuuccugaagucaguccucuccuaccaugcugguccccugauccaaaucggauuuucaaacuugguagcaagugccuuuaccugcugagccaccucccucaacccuacauucuuugaacucuucagcuccuagaggguugccucccuacuaugacuggcccggugaggcaugccagagcagacagucauauguaggucauccuagagcccuuacaguagcuugguugcuuguaacaccagggccugguuuuaugucugugaucacaaugcuugggcuuuguggcagugagugaauaaucccggcuuacaguacccaguggccccaucugugacaugaggucccacaugcugucuguccucuccauauaacacuggcaggucccagaggcuuaugucuuuaaugucuuucuuccacagcuuuauuuucucuggcugcccugcacaugguuguugaguggaagugggucuuccagguccugccccaugcaggauggagaacuaguuaacuguagaaguaucuggaaucaugacugagaguuccuccccauauggcagacucaggauacuggcauacguagggacagccacaggcaggaaacugaggccuccccuugcuugacuugucuagaaaacauacugcagguugagaccccagaaauuacacaccugauaagauguguggcuaggcaugaggucugugacuaggaggaggaaggacaacucuagaagggaggucacucaauaggugugugcugcagaaagugucaaaguagcgagggccaagccuuugacacggaaugauagcggcggcugagauggaccuucguaagguuagagugcaguuggggaaagguucagguggugguugauggaaccagcaggcuuaaagaugaugggagugacccggaggggagugugagggacagcacucccuuuccuggccuugguucacuuugucuccagcuuggucagguguucuuucucacuggaccacagguccuuccaagcccucugugucuaagggguguuaaaugaggaggccuugauuauaaagccagugucucuaaacauugaccuuguggauauuuggagcggggucauucacugauagccuguucugggcuauucagggucuuggacagagucucugguccccaccugcucuguaggugugcucccaguuacagauguggccugguguugucuugguucccaccugcucugugcuagaagugcucccaacuccauucuaggagugcuguagauuccagguguggccuggugucucuuggagacaccuggugucaucugcaucuuugagaauugcuaccugggagcuggggacuuguugguacuaucuuuguccuugcucuggcugucauagcuguccucucagugugucccugaauuguuagggacugggauaucccucucaccaguggucuuacaccucagauucucagggauccaaaaauguguguguguggacccacagcugccugagugucaugugucucccuuugccuguuauccaugucucucugucccuguggauuuauaugcugugaccuaaaacccagguguagguugauauccuguuaaaauugcaccaugagccaggugugcuggugcacgcuuuuaaucccagcacuugggaggcagaggcaggcggauuucugaguuccaggacagccagggcuauacaaaggaacccugucucaaaaaacaaaacaaaaacaaaacaaaauugcacuaugaagucuucugccuuccucucagguuaugagagaugguugugggcuuuucuggaaaugucucuguaucuauccauuggcagcucugcauacaguggcaguggcuuuggugucacuugaacacauuuuaggauguccugcagaaauggagcauuuggguuucuauuggagucaggccccccccccccccgccuucccauuucacuucccuucugcaguuugcugccucucugaggcaggccugggagguugggugacugaacccugagguugcagcugcuggaggccacagcugcccugacccugcgggagacccccccaccccuggccccaagcacggggacaaacuauugucccagucaguggggcccugugucuggcaugcauccuguccuuguucccggucuuugugucuguuuccuccuuuggacucugucucuguguuccaaggccccuuggcuuauccuccacauccuccugcgugggagccaaugagccuuuggaucccuuuggcuuaaaacuuggagcugccuuuguuaccuguucuggaggauaacuccuucaaggacugagggagaaacugguggggcagacagaagggucugggcauaggccuaggggugcuggaauggcagaagcugggggccauacauagaaugaguucugccacagaggccugggagagcuaggguugugggcaggccaagaggaucaagauagaccguggauguggggacacgccuuccucccugccuggcacaggcuggcaccugguucuacccuagauuccuggagggaaccuacauguugguguccccugcaggguaucccacuguauggcauggagaccuguggcugugaggcucccgggggcucgccuuggaccgcgauggggcccggcugcggccuccuaacgggacugaggugugcagcccgcgagcugccgcugcccgcaucucggagcacccccgccccuccccuggcccggcgcgggcccggugcccgccaugaacggccugucggugagcgagcucugcugccuguucugcugcccacccugcccgggccgcaucgcugccaagcucgccuuccugccucccgaucccaccuacucucugguaccugaaccugagccggggcccgguggggcuggcgcugcccccucggguccccugcggaccucagcggccacacccgggcgcuggaagauccaccugacggagcgugcugacuuccaguacggccagcgcgagcuggauaccaucgaggucuucgugaccaagagcgcgcgcgccaaccgcaucgccugcauguaugugcgcuguguaccgggugccaggugagcugcccccucccagggcucacagcaggggugccuggguucuguacuacccugucuuucagcccaccugaccccucuuguaaagcacaggagacuccacuuucauguucuugcuuucaagucuccaccaaagggugagguggagaggugacagcuuucccagguugagccuggagucuaaagggcaagccuuuacuuaggagucaggcaggugcuucaggaagacaccugugcagggccaggcagguguauggccuuaaccugacacaggccuuugucuuauuacaggucugucuggguuguccagaggucaacuggacaggaugggucucaaaagauuucugguggccagggguggggccuaguccuccuccuagcaauagagcauccacuggaaggaguaggcucuucuuaugcacaguucuguaucaugggggcaugagagggcucuuggccuccuggccugggcuugugucuauugaagauugaacucacagcgggucucucuguagauggggucuaaggccugcuggcugaccacaggcaggccuaaggcuauaggacuuaacagccuucaggucccauccccagcuagucccugccaugcugugggaggccagccguggagcuccaaguagaggagacagugggugcuguuggcucaguguggguggucagcugugcugugcccucucaccugcauacccagguacacgguucucuucucgcauggcaaugcaguggaccugggccagaugugcagcuucuauguuggccugggcacacgcaucggcugcaacaucuucucuuaugacuacucuggcuaugggaucagcucuggccggcccucggagaagaaccucuaugcugacauugaugcagccuggcaggcccugcguaccaggugagggcucugcuuuuagggcagcaguguuggggagugucaguggcagaugggaccuugguccuugccguccacaggaaaagggaaguucuaccucgucugacagugaacagaggacccugggucuaggagauagccaucgagaaacaugggagcaggcaguugguagcccaagugccagggacugugccauuagcugaacuugcucuggggcagguggcaggagagccaggaagcuguacuagagggugcccaagugacgguaggcagcaggucugugcccuugucagucugcuugccuggucaccccaucucaucccaccucaccagggcuccuuuuucuccuucauagagaaggguccaugcagggggcugagaccauccacccauacuucuggaggucccuacucuugauuagggccccagguggcucuggaacucugacagcccuggggaguugggggcccugguugcccuggagaugugccagguaucacugagcuggguccccaggcacuauuggugcuggcacuggggaccugucugagugccccucccccugugccaaggugccuguacccugccugggcugacucccuugugcacacugucuggagagccacugcagugugugcugagcucuguccauugucccacagcacugacugcaggaaacuccugagguaggggcgacucucuaaaggggccgcccccuauggugggaggaguuuaggcuugagcaggcagagcugaucagcacaggugcaguguggguugccccuaggugguccacuuccugccuggcaucaggggaggcucuuguggaggcuuguuucagacagcgguggggacuauggcaggggcagcacuaggcagcucagccaggguaagucgccgcacggaucugcuggucugggaacggcaggagaggcguuaggaaugagcuggcugcacugccacauugcaagcuucuaauugggcaggaaggacucuggggaccuuaaacugggccgaacauccggggacacaguuuccuaaauucccagagacccacacugguggggaggcagcacugggaagagacagcccucugcucgugggucagaagggaacaggaacuuuuggucuggaaucuuagguccaaagucuuccacagucaggcacugucacccugacccccacccugugggagggacugaggaaaaagccauggagcuacugcuuggcagggcuuugggaguugcucaucuccaggccugcugacccugcuccuguugucgcucagguauggcaucagcccagacaguaucauccuguauggccagagcauuggcacugugcccacaguggaucuggcgucacgcuacgagugugcugcagugguucugcacucgccucucaccucgggcaugcggguggccuucccugacaccaagaagaccuacugcuucgaugcuuucccuaagugagcaugggggcggagccugggaaagggcggggcaugagaaaggguggggcuccagccugugcaucuuuucccucagcaucgagaaggugucgaagaucacgucaccggugcucaucauccacggcacagaggacgaggugaucgacuucucucacgggcuggcacuguaugagcgcugcccaaaggcuguggagccgcuguggguggagggcgcugggcacaaugacauugagcuguacagucaauaccuggagcgccuacgccgcuucauuucccaggagcugcccagccaacgcgccuagccaagcugcagggaccucagcaguacaugggccuccugccgggacugcaugugacccggagcccaggacccugccuggcaccccaggggccaugagccauguucaggcgucagaggucccucuucucuccucauggaagcaaagagaaggaaagagggaaacuaauuaaaggauuaagauuuuaggguug

SEQ ID NO: 5629 - RNA, 3212 nt, Mus musculus
ucaguuacacucuccuggggagauccaguagagccagcccugggacagaaguccggauggcggugggguggguguggugacaggcuagaaagggguggagccauccgugggcgguaccaggccuguaggcggaaccaggccugggacaggagucuaaucggggccuggccagguaggggcggagccauccgugggcaggcgcugucuuuuuuuuuuuuuucgagacaggguuucucuguguaguccuggcuguccuggaacucacuuuguagaccagguuggccucgaacucagaaauucgccugccucugccucccaagugcugggauuaaaggcuugcgccaucaggcccggugggcgggacaugucuaagcggggcgggaccagaguuggaagcaugaucaggcccgggcaggggauggcgcggccaggguccacagcgcgagcuguugguuggugcggcguggcagggcguggcgcgggaggcaccguugguuggugcgcggcuggagggugcggcgcuggcggcgccgauguuugggcaaggcaggcugggccaggccauggcccugcuguuguuucugggcaugacagcggcgcuggcccggggcugccugcagugcgaccccaauuucgcggagaaguucuccuucuaucgucaccacgugaaccucaagucguggugggugggugacauuccugugucggggaugcugcucuccgauuggauccagaacacgaugaaggagcuccaucuggccauuccugcugagaucagugagcggcggaacccauuccagggucagaagagcagcagggaaccgggcagggccacucauuugcuugcuuuuuccuccugcccuuagcccggaagaagcuauaucaaguagcagaagccguguaccagaggauggaccagcuguaccaggggaagauguacuucccagguaaaaagagaaacagguggggccggugcgagcugcuacgcaccugaacuugaccguucugcugugacucucacaucaggguauuuccccaaugagcugcgggccaucuuccgggagcaagugcgccucauccagaacgccaucauagagagugagcagugggcuccacagaggggaagaugaucauggccgcuggcacuucagggcuaggggcacuggaaacagggcucagggaggagugacucugcaggaggcccuuuugcauaaauguuugcuagcaugcccaucacccccuuauuucugucaaacuagucuccugguggcaccuaggaacaauggaaccauccuucccuuagguuauccccaucuuucacugcaacugaccccuuccuacauccaugaaacucauguagcacaagcguguaaucccagcacucagaaaugagggaacgaggcaagaagauugccacaaaucacaaggcagccuaggcuaccuucucugugcuaggguauccugggcuacaaaaacaaguggggcugagguguugagcucugggccuugucagaaagcacuauccuguuauguccuccccuccccaggccgcauugacugucagcgucacugugguaagugaaccaugguccaggcuaagggccacaguggcaguggcccaggcuggggagggcccaggggagucuggggcugcuucucauauauugcagguaucuaccaguacgagaccaucuccugcagcaacugcacggacucccacgucauuugcuuuggcuacuacugcaaguauggcucaugcagcaaucccacugccccugggguccuaggcaaggaaggggaccagggccuuggggauaccccaccaccaagucuuguguuccccccccccaccccaggucaucggcacagugggagucagcuguacagggccuucugaaauacaugugagcuggggcuuauuggguaccaggacauggagagggagacaccaagggaggccacuugguccccugacuccaaaccuacugucauuguagaaacaccuggcacaaguaaguuccugcuggaauccaagguugugugugccuuaugaugagggguugaagcuugccaaggcucaggaggaccuugcccacacccuucaaaggucuccaaguucagcuggaggaagggggcaagccauccuggcugaagggucuucaugaaaccuauucuucccugaauuggugugguggcagaccuggagggucuaacuggagccccauucuauuucagacaggaugaaaagaugagguaagaccaggccuuccacuugagagggaggagugaggugaggagcgggguauggggaguggggagagggauggagugaggagguguguggguaagagugggaggggaugcugggcaggguggguaagagcgggaggggaugcugggcagggcugugugccugagggcacacuggccaucuguagucacaccugccuguguggucaacgcacugccugaaccaugcuguguuucuucccugcggccucaacuuggaugugcagaaccaccccagccuugugagugagcuggggaauaaggcuacaaagaagcaggugaccuguggaaaacagaauuccaaagucaaguggccucuuugccacagaccucucaugcccuaucgaggccugucauugugggugcuagggagggucccuaucccacuggcacacuuuaggauuuaagaacaggcagggacuagguguagcaaugcauuccuauaaucccagccuuccaggagccugaggcaggagaaucuuaggggcuagcuuggacuauauuaaugggcuaugggaggcagccuaggaagggaggcaggagggcaugugcagacaaugggcuuagagcaccuccuccucaucccccaaagccugucacaaaacauaaagugucuggaaccucagcaucuggucaaccugaccuuggaaaaagucucugagugucugacccagcacugacaguggcugccagcccccagccucggcagaggccaggacucaacugcacuguugccucuggagaagcuagcugcugccugccucaaguuaccccucccacucccauggaucccaggcugggccgggacaggggagggcagggagauggguuuguguaagauaguggggaaccccccagggcagggcccucugagauauuuugauuaaaaugcccugacauuucucaugaggaacaauucuuua

SEQ ID NO: 5630 - RNA, 35685 nt, Mus musculus
ggggcuuccgggaggcugaggcucuccgucagcugacccaccgccaucuuggccgccauuugcagcggcccuaagcugggaagggucuguggaagcuggggggggcgggcuuacuggcuaccccuucuccucagacugcucuccggcuacagccgucgcucuggccuccacggcguccccuccgcggcggccggaaacacagcggggcgguugccugaggugcggucgccggguccccgcaccuucuagggccgcggcagcggcguuucccucggaggccgcagcccacgggccgccgcgauggcccucaagauggucaagggcaguaucgaccgcauguucgauaagaaccugcaggaucugguccgcggcauccgcaaccacaaggaggacgaggugagccggcgcggagcggggcugccgggcuuuccccccauugccucuggcccgccguggagccgucuuccucgaccccaucgccuuucccguccugccuguuccagagcugcggcucugcacagccucuccuuccccuggccucaguuuacccccagcagcuugaaacaggcgcuguccaaaauggcucaggugucucgucuguuguaacuaggggccacucccugaaccuccaaauuguccacuuggagcaguccuugcccuaaaggccucagcguuuuaggucuugaaguuggaugccacugcuagagccugaguuuaccuucuugaagaagacuuacuuaggcaaagguucccccacuugagcuaguuucuggaucccauauggaggaaucggggacccucacagaaaaauccugucauaggucuacgugucucccauggagaaauccccuugucaggaaagcacaggcccggguggcugucuugggcuuccuugggaacccugccagguuuuccugccccagauccccugaacuauuagugugugcaggaccuaggggcaucuuggaauggggaagccugacuucaaaacuggaagcucaaagaaggcagaagucaggguguggaagcgauuuuuccagaaguuacacugagacuacaagcgcugcuuccuuuccuccccacagccugugaccuagauuaaggaagaagugauagagugacuacuuagugccuggcucaguggaaagacgcaggccuccuccugggcuggaaggccaugcugaaagagggugccugucccuagcugggacagucauuucucuguagcccucuucccuucuacccuaccuggugugguuuguacccucccugcucucccuggcuguuacuucaguugaaauagcugguuggccugcguuuugcuggguguggacugcccuaugugauauuuccuuuguacuguggcccucuuugcucucaagagggcuuccacauucccuucuugccuucccguacagagaauguucccugggcagcuguucuaggacccuggggacaggucacauucuaguuugaguaccugaaacagacucuagcuagggacauaaccugggcuggcucaugguacuccugccucagucuucuuaguguugggauuacugauuuuaagguaugugugcccagggccucaggccucuguuauguuuugcucuucacguccccuaccuucccaucccgcaaaucucaaaucuucauugggaauugguguacauagacugugagugucccacaggugucugugggguaaugguggaggugcuuuuuaaaaauugguguguauuacauuugauacugaguuucauuguacugucuugcauguagucugcagaaagcucuuucaguagugcagagcuaggcaggcacagaaaguccuccaagcccucagcuucuauguggcuccugcugcugacugcucagccauucuaagauuuugguugugagucuaccuuuaacugcugagccaucucucccaccauggcuggccagucuguacaagacacacugagaccgcuuggguccucugucccuccucagggacaccuucaaguuccugugcauuguugggcucuuaugaaggugcgguguagugcagagccuucugccaaccuuauagcacaaguugcagugaccauucucugcucuacacuccgguugacuuaggucucacugugugacacugggaguuguaauaauccuucugccuuacaaguacuuaaaaaaugcagggugugcacucuggaaguuuugugggguuuugguuuguuuuugagaugauccuuuuuuaaaaacugaaacaggguuucucuguguagcccuggcuguccuggaacucacucuguagaccaggcuggccuuuaacuaagagauuugccugccucugccuccagagugcuggcaucaaaggcauaugccaccacugcccagcuugagaugaucuuuuuuuuuuuaaaaaaaaauuuauugccaggugugguagcacauggcuguggauggugcagagccucaagacaguacagggaauuaaacccagguccucuagaagaucagcaagaccucuucuguuguaucucugcagccccuuugagcugauguuacucuguaucuuuggcaggccaacaacucacccuguagaucagucuggucuugaacucacaggcacucagcugucucugcuuccccagugcugagauuguggguguacaguaccaugcccaaugaaucuuugucuuuuuuuuuuuuuugguuuuuucgagacaggguuucucuguauagcccuggcuguccuggaacucacuuuguagcccaggcuggccucgaacuccgccugccucugccucccgagugcugggauuaaaggugugcgccaccacgccuggcugaaucuuuaucuuuuuaguaauaguguauccauuuauauauauuaauuuuaaaaaagacuuauuuauuuuauguaugugaguacuguugcucucuucaaacacaccagaagagagcaucccauuacagaugguugugagccaucaugugauugcugggaauugaacucaggaagagcagacagugcucuuaacugcugagccaugucuccagccuccauauauauauuuuaaagauuacuuuuucuuauguguagauuuguguaucuguguguccauuguguguguaggugccugcagaggcaggugaggucauuggaucuccuggagcuggaguuagagguaguugugagccgcugaacaugggugcugugaauccaacuuagguccucugaaagaacagcaagcucuguuaauugcugaaccaucucuucaucuccacccuuuaauuuuuaccacguuucacugucugacuucagagccuguagacauugguagcacucuguugcuaagcuacaacaucuuuuuuuuuuaagauuuauuuauuuauuuauuuauuuauuuuuaugcauaugaguacaccaccauugcucucuucagacauaccagaagagggcacuagaccccauuacagaugguugugagccaccauguaguugcuguguauugaacucaggaccccuggaagagcagacagugcucuuaaccucugaaccaucucuccagccccacauccuccaucuuuauuaugagauaggcuucacuauguagcuauggauggcuuccauccuacucauuucugccugccuccugagugcuggcauuaaaggcaugucagacuuauucuuucgcaguuuuuuuuuuuaaacacacaauugauguuauuaaauaaaaacaggaaguauccuuuccacucaccuucccccacuccuucaaauccgcagcuuccaugaguguuuacaagcagccaugagggcccccuacaucucuaugccagguacuuguagaaagcuaaaacacaagcugaauauccccggugcugcaggggacccccuauugccccuagaguauguuucucugcagucugccauaucugugcuuagcucagcaucuuugccugugccagcaccaaccccuaccuggugugaucagcacagccuaguuguuucugaaacucugcuguagcuaucuugugggcuuuagcuguuccccuuugguugguaacuccaagggucaguuggagaccugggaacucaacagcuguucuugaggcuugggcccugagaugaccuguaccucaggcugccuauguccuuugcuuugcaauggccauucuuugcucuguucauucugugaccagcacaaauggcucgugcucucuuauuuuuuauuuuaauuuuuugcuuuuagacaguugugcuguguuacccaaguuggccuuuuugugguacuggcuggucugcaccaauuuuaggcauauucuuuacccccugagccaccucauacccuuagccccucauuggggaguucuaggcaggggcugcacccccgagucccacuccaacccucucuuuacuuucauuuugagacaggguuaugcaaaauugcccaggcuggccuugaacucaagauccuccuaccucauccuguucucucugcuucuuuuucuaucagguguuagucuuccuaugcugcuuucugggccccaggcugggacuggcuccauuuagucucaagaauucuccuuacuuuccaggcuccccaggcauccacauugacuuaucugucuuguagcuucuccuucugccuucucuauuguagccauaggaaccacaguuccuggcucauucuugcacugacuuugggugauaugagaugacuuuuguccaccagagguaccauugugcuaauugugagaccuguguaccuguguccuucaguggcagagggacugcagacugggucaaacuggggacccugaguugggcaucauucuggaucaucuggacccauucucaccaucagguccucuagggaagcaggaagaggaaagagacagagccugagagacugcugccaggucuaggggaaagaaggagccaugaacuaaggaugugaggcuucuggauauuggggcaagcaggaugugggugcuuccuggaaccucaggacacuagccuugucacuauuagacugaagcccagagaagcucauacggcuccagaucugugaggauaugcacacaugggccaguuccuguguguugugucucuuuaccugccaccaaugugugccugucucccagaaugugagucgcacugcuugccagcccuccugccaugccugcucacgggcagaugcuggagguucucaggcacuugaguguauuuuuugugucuuauaacaacacccuugccagguuuaccuagggacccaggauuuuggcacucaacacggaaguaccagcugggcuguugguuacuauuuggcuucuccaggucuggcuguugccuucuuaucagccugagaaaacagccaucuuucacaaagccagcuggcauucgccucaagcccgucagaaggcccaggcagaauguuccacauuaaagccagcuuaaacuacacagugaggcauguuuggaaaggccaagggcucggggguagcacugugaugagcaggcacuggacugccaaaaggcucccuuggacuccugaaaauaaugugucugcccuggguugguuuguuguguuuuuccuuuuucuuccaccaccuucuuucaggggaucaaacacagggagucaggcuugguuuugauuuccuuuagaaacaggaacucacaugauagcuguggcuggccuugaacucggagacauccucugcuuuucccuuuuaaguacuggaaugaaaaggaugaaccuagagccacaggagagaccagcccugccuuccaagagagaauugcagcucuuugaggauggccuaagcuggaaugagcuuuuuuuuuuuuuuuuuuuuaaugucuuggggucuggaaagauggcuuagcaguuagcauuuuuuuucugcucuucuagaagaccuagguuugaguccuaggaccuagcuuauaaccaucuguaauuuuguaucugugucagugucuguguguacuuacagaggcgugugcgugcgugcgugcgugcauguguguguguguguguguguauguauauguaugcgcgugcguguguguguuugcgugcgugcacgugcacacauguagaaaucaaaaaucaaaggacagcuugcagaguugguuuucaggagcauaucuuuguuguugguaguguuuuguuuuguuuuguauuuugagauaggguaucacuauacagccuuggcuggccuguaacuugcuuugugaaccaagcugaccacagacuaacaaagcuccucuaccugcuucugagugcuuggguugaaagcaagugccaccacaccuagcuggaaccagcuucuuuaggcacaugcagggugagagacuuguguagaaggagcuugcagaggaauuggugucucguaacuguugugaugaagacugcauguguauguguaccauguguauguagugccugccugaggccagaguaggacauuggguccucuguaacuggaagaagucuuugugaaugggcaugugaguacugggaaucagacccuugccugaaccugagugucucagcuccuugcuguuucuugaauugugacuuucuuuuacuguuuugaaacauaguuucccucuugugcuuucuguucccuugagacucaggcugcacaagccucagccccuguggugaguuacuuucuuuuuauuuauuuauuuauuauauguagguacacuugucaaugucuucagacauaccagaagagggugucagauuucauuacagaugguugugagccaccaugugguugcugggauuugaacucaggaccucuggaagcguaguaagugcucuuaacagcugagccaucucuccagcccuggugaguuacuuucuaucagagcucucacaccugugugagcacuugggcaggugugugcuugugcagccugaaguggugugcaugugcaugucaacucuugucucagguagucccugcuguugcugaugugauaggcuaucuaguucauggcuccugaagccucucuuuccaccuucaucuugcuuuuagugcacugggauuacccagguccucaguuugcacuaauagcacuuuacccacugagcuaucuccccagccuaguucauuccuucauuccuucauucguucuuucuuuccuuucuucucuucucuucucuuuuuuuuuuuuuuuuuuuuggauuuauuuacuauaugugaguacacuguagcugucuucagacacuccagaagagggcaucagauuucguuacggaugguugugagccaccaugugguugcuaggauuugaacucaggaccuucagaagagcaguuggguguucuuacccgcugagccaucucaccagccccuccuuuuuucuucuuaauauggguuuuuuuaagucaaggacuuugcugaguaguccaugcuguccuagaacacagcacauaacacaggcuggccuugaacuugaggugauccucuuuccucagccaccugugcugugauuacaggugugccuaucagacuugguuguugagucacuuuggguuguguuuuggacagcaguguuucccuccugaaagccagggcgauauuauagggacuucagacauccagccccuggguccugcuugaccccugguggguucugggcaugugaguacugaaaaucagacccuugccugagcccuuaucugcugaaugucucagcuccuugcugaguacuugguucacuucuucaagcccuaccccccauggccagcugagaguccguccuuuccauaagucuggccugaaguucguuuucuuuucagucauuaacagccuggcaucuuugaagagagauaaagucauuccugaggaucccuggguggcauuuaguuacuugaggcagguuguggugacauuugacauuuguuccauuggacucagucuagaucguaaaauauucaggcaaguauucugauaagccaagcuugauggcccaugccugucauuccaugaggggggggacaggaguucaagggcagcccaauuaauugcaugguggucuagguuauaugagacccugucuuaagacaaaaacaaacaaacaaacuugucaacagggugcuuaacagcuguaguuucuuugacccaaugcuagagacuggccugggcagugaugaucccacaagcauccuuagguccacuucacagggacuugggaugaagccugauauccacacuugccugggagggcucugaggugugacaccuggaaugugucagcugugggucaucucuggauuacauuugaggaacagugacacuugcugucaaagucuggugauggcuacccguuucacugucaagacaagagagcuggagagauggcuuagcgguuacaagcacugacugcucuuccagaaguccugaguucaauucccagcaaccacaugguggcucacaaccaucuguaaugagauccgaugcccucuucuggugugucuguaaacagcuacaguguacucacauaaauauaaauaagucuuuuaagaaaaaaaaaaaagccaagauccagguuccucucucuucacgcagcaccuggcacaugggagcugaugugguggugguggggucauuccaugcccugguauaccucaacaccuucccccugcucaugcuauccuggggcuuggcuugacuccauuugugcuuguccagguaguaggguaggagacacucccuaggcccacaucuggucuucucuggacuuugugccuuaauucucuuggauggaccugucuggcccaagaaguuguuugguagauuugcugagcucucgcagggggaggccaagggugcaugcuaguggugagcggggcuaugcaaagcagccuaugggagggaaaggggauuuagugggcccugcagcauggguagaccauaggcaucaggccauacaguagaaugucaugugacuggcacuacugcuuagguccaaaauaguuuaccuucaacuagcuaaaggcugucauccagagcaguagcagucacuguggucccucagcuccacauguccacuucccaccucuaagagucuccuguuacagccguuuccuaucaguggaaaauaggugccuaguuaggcuuugagagacagcucaggagagcauguuugcuuggcaugcaccagcccuguuucagguucccaugcugcagagagaaggaagagaaagcugccaggucucuucauccaggauggcuggaacugucugucauccuccccaugagcaccugcugacaguuagcagccagaccacacugauucuugcacuucacacugcugucuccacucaggccaaguacaucucccagugcauugacgagaucaagcaggagcugaagcaggacaacaucgcugugaaggccaacgcugucugcaagcucaccuacgugagugccuuccuuuugccucaccugccugccugucuauccucuauccaucagacauugcugcugugcgcagcacaagguucaugcagaguccugccugauggcuucuauugcaaauacaggcugggcauguggugagcugcuggggauccuaguagggagccuuagacucugaaccauccuuuuuggcugcacguguaugugagugugauugccuucugccuccaucccuccuuagauugggaggcaacguaccaugcuggguucucaguacuggaguaugccauaggcgugggacaggauacuucacucucuuucaaagaaaaacuugccuuuuuuuuuuuuuuuuaaucuuguuuaucuuugggacaggguuucucugugugguccuggcuguccugaaacuuacucuguagaccagacugacuuuaaacucagagauucccaugccucugccucccaagggcuaugauuaauagauauguuucaccaugccagcucuuuuaauuuuuaauugcaugccagcucuuucuuucuuugcuguguaugcaaguauggcauggugcuuguuugaaggauaccucucagggccugguucuuuccauuacucaaguggcaggacucaguucauuagguuuggcaguagguaccuuuaccuagcccucuugcuuuuuaaacagugcuuggauugaauucagagccugguaccccugaggcuaguaagugcucuaccucuucacacuaacacuuuuuuguuuguuuguuuuuguuuuuucgagacaggguuucucuguauagcccuggcuguccuggaacucacuuuguagaccaggcuggccucgaacucagaaauccgccugccucugccucccaagugcugggauuacaggcgugcaccaccacgcccggccucuuuuucugguuuuugagacaagguuucucuguguagcccugauuauccuggaacucacuuuguagacugggcugaccuuaaauuaaacucaaagagauccuucugccucugccuugccaagugcugggauuaaaguugugcauuacuauaccuggcuauuuauuuauuuauuuauuuauuuuugguuuuucgagacaggguuucucuguguagccugggcuguccuggagcucacuuuguagaccaggcuggccucgaacucagaaauccaccugccucugccuccuaagugcugggauuaaaggcgugugccaccacgcccggcucuauuuaauuuuuuaaaaggucuguuuuauacauauugcuguuuugccugaguguauaucuauagcauguauaaccucaguuggcuugaaucuucaguccuccuaccuuaggucucugucauagacaagcucagaucacagacaacauagcugugugccgugauguugggacuuaagacaguagcaccauguuccucguugugaauguucaucaucuuuuaguguucugugaaccuguucccuuagacuuaguccauagucuuuuuccuugguauuuuuuuaaagugcuagauaggaaacccagucucucacacuugccaagcaggacucuccuacuaggccaugcacccagcaccucacugggggauacuagccaggguuccaccuugaccacgccccccaagcccccucacuaggggauucuaggcagggcuccaccccuaaggaacuuucucugaaccacauccaguuuugucagagccauuuguugaaaagaggauagaaaaguccccaaggguuugugauggaugaaguuucuguguccagacugaguguaucuuguucuuccauguguggugugaauguacugguguggcugcaaccuuugccccagugucucccgaguacuaaucaccuucaccaaucuucccuuaacaguuacagaugcuuggguacgacaucagcugggcugccuucaacaucauugaagucaugagugccuccaaguucacauucaaggugaggagcuaagaugcgcagcaggcagaugugcucuaugugagggaggagggauccucuggcgugggaggauccuugaggguguguccucuggccagaggcccugcuguugaggugugagaccugucucugcuaacuguguguugggauuaaaggcgugugccaccccacauggcuuaacagugguuuguuagggcagccuuuguuuucagucucccacacuguggauuggcuuugaauccccuguagcugagauugguccugaauugagugccagucuucugucucugccucuugagugcugcaguaacaggcugcaucacugugcccagaguggcaguguuugauuggagcaccuggcuaaggcugaucagcacugcugucccaagaguucugauaaccugguuguggggucauugucaugacuggucauuucccagccuuugguugacaaagaugggcacacuggucccuuuagacauuuucuccuguuaccuguccuauuccaugugugugccauauaacgcugaaagcaugcagccccuaagcaaguaccuugagggauggaaugguacauuaugagaacuagggugcugccuccccugugcauguguguacagcaaugaagcuagaaccaucugcaugugcugggaggggcaguaggggaggaggccucagaacccugugcccagugcucagcuggggauccaggugcccugcugcugucacccucaguguuucccgguguuuguugagugcuccugguggggcuuuagguagcucugguucugacacuguggcuguugacucugcagcguguuggcuaccuugcggccucccagugcuuccaugaagguaccgacgucaucaugcugaccaccaaccagauccgaaagguaggcccugaugcuuuccugccacucaagugagccacaaaagaucagcuagcugacagucccaccugccugggguagcuuuucaaagcuuucucacucauauccccugugucucagcagaugagagaucuggucucagcaagcaugggccuucacauucuagagggcuucaggcuggaguacaugccccuccucccuucccugcucaaugcacacugcuacagccugucccuguccacacugggcuccugccugccugcuggcucccaggccucuagauggucagugagggagugugugagggacugaacaugagggagugggugugagugugagggagggagugugugagaaagugugagggagggaguguaagggaggaaguguuggaguggaagugugagggagugaaugugagagagugaaggagugugaaggagggaguggaugaguccuccuugacaccauccugcuccugccuaccuugugcugaaaaccacagggugcuggcuguucuuuguuucagccccuuuauaauuccugccauaaagugcaccccucuguucucaaaugcuggaacaagggcaggacucccucagugugagguggcagguguguguuauaggcaacugucagguggaagaggaaugaauaugggagcuacaguagcauagcugggcucauggugcuggcugagggcaggggugaggugggaggugcagggcugugugguguuaugcugcaagccacaugggcagugucucuggguuauggggucaggcaggaggccugggugagccagagcuauuuggaggagcagauaaccugaguuggccaggccuuugagaagagcaagggucugagugauuagggcccucugaaggaggcuccugggugcuauuccugcaugcaugagccuuaugagaagaagcuggacuugaguggccaggcucugggaggacuggacaugugagcucuaggaggaaggggagugggauacagaggugagcaguuggguugaggcugaggcuggcucuagccacaacagcaucucacugucuguaugccugcagugugugaggcugugggucaggccuuccucucuaagacacaggagcucagcuucauaagagaagguguccuacuacugaggauagcaguaacuugcugauguccugguugggaccugguauaugugcagcugagaucucugcccacacagcagggcacaugucccaggccucugcagccgcugugucucuagaccagcaugggaucugggcaugggauucucaaggccaagcuccaggccaucugucaccucugugugucuuccugaugagcuuuccuaguagggggcagugcuuccauugauucuacugcuuuccuuucugucccuuugggagauggcacugcaaauuuuggacacugaggguaaagggcugaucauagcuucugaugcuguuuagcuuacccuaaagcucacaacauucuguuaauaaucaugagaccagcacucugagcaugccccauguacaacauaacugaaguacacccuccuagcaucaggcacacugccuuagaguggggagucagggcacugggaagaaguugccucagucuucugccuuaggcccuauacauuaaaaggaugaacuccuucuaaucggcccagagcaucucagaucagaacagccaaaggacuguuccugguauuaugagggaguugcugaauagaaaagguuccuauagcauugccaggaaccaggaaguuguccaggaguugugacuugcaaaggaaucucuguccccaaggagcccagagaccugguggcuuccacacagaguuuuuuguguucucugccucugaccuguguuccaauucuugaugacaguagaggagcugugagaggcucccucgugcuggguuacagacauacagauagucccaagggacugccacugacccuccuauuguccccuugcaggaccugagcagccccagccaguacgacacuggaguggcacugacuggucuguccuguuuugucaccccagaucuugccagagaccuggcaaaugacaucaugacccuggugaguuucugugugccuauaccacuguuuaccuucauccagugaugcccagaauccaguauugagcccuugcucugaggagacagaaaggcucucagaguggcugcuguguagcugggguaauugggaaagagcaaaagucagccuugcuuucuccuggguuuguccucuggauacugccugguggucuaaaaguugaauaccaugagagggcagagcccacugucaccauccagaucuagcagguaccuauuguaaacagagcuccacugggacucuccaugcgcauccaccccuuuguggugacugcagcuguugugacagauugcccagcccaccgaguagaugcauagcuugugaggcuucccagauaguugccagcccuguggacuagagagcucaucggaucugcauggagagcccccuggagccugaugggcuaaaggguaaccccaccaccacuagugccaggcagaagcuguccuggaggaggcuugagugaauagggccacacauuauaaccagaucagcuuucacagugacugcaucucccugugggccuagcaccucuuaaggcaggcagguacagagggcagggacugggccugcucuaggugguuuaagagggagcgagguguggaagagucauaggugcugaccaggugagugggucaccagcuacccuucugucuccacagaugucucacacgaagccguacaucaggaagaaggcagugcugaucauguacaaaguauuccucaaguacccagagucgcugcguccugccuuuccccggcuuaaggagaagcuggaggacccagacccagguuggugacaggaagcucugcccagccagcuccugggaggaugggggauggugggaacauggauaugggucccugucgcaaauccccucugaucugcgcuggugaugggcugaccgucacaagccauaaacacagaguuaguugagacuccccaaggcucacagguuccuugucugaguggauagucagauccaacacagccagcuuacuaugaagucaguagggccccaggggucccugggagcugugcagcuguggcaagugagcagucagucuugucaucucccaccucugcagaguugacugagcaggaggguacaguagaccuuacauccagccagcccagaagcccugagcauauguccuuugauuaaaguuguggucauagcuggacggugguggcucacgccuuuaaucccaguuggauuucugaguucgagggcagccuggucugcagaguuaguucuaggacagccagagcuacacagagaaauccugacuccaaaaacaaaaaaaaaaacaaaaacaaaaacaaaaaaaaguuguggucauuuaggauuugagcacaugagcaccucccucugugauacacacagguaaacugaugacugugucccucaugggcuugugcugccugguguucuggaagcaacauccugagacggacuguagcacaacuguguggucuguggucaaaacccacucucaggcugugugagucagagaacugggaggagaugaguggucaugguggccuguuguguccggccagcagaucacaacauggguucuagccuggaaaggcauuuuggaaaccuggaagagaagaggggcuagguggcgagauaaagaaaugcagcuaagacaggcauucugaucaaagcucaauuuuacuguucuacacgcaauuauaaagcaggggaacccgauucccgccaauuagucuugggguccaauagcagggugaccaugugcacggcuccaaacagcaaagcggcagguuccagcagugggcauggcagaacgauugagcgggaagcuccaccccugagcaagcagguuucaggcugggggaggggagacuacaguggccugagaaacagaaacacccaggccugcuaagaggagcacacuucccaguagagcagguccuguggccugggaccacauguuacagcagccauacaguccagcauaggcugggggcaaagcaugccaucagauccaugagacugggguacaagggaagcaccuugcauuuaauucauggggcacaugaguguuuguguaggugcuggguguguucaaaguaagaguccucguuucucagccugcuggcugccaccuggccgucuguggaaccaggucccuccuggccucuugaggaauacaugagguccagaguacauggcuuacagggagcacucccccucagugggcuagacaucuaguucaacuguuuccagccuggaaagugacagggcuccaguuguccugguggcucacucuaccucggguguuuggcacaauaaugcagaagaacuguuaggauggccugggcuaucgacugaaaggccuugccacagguaaaaaguagaaaagcagaggcugcgcucggugauagaaugcccaccuggcuucuaugagcaugugagugcugaaguaggguggauuagcccagggcuaagugaaccuuuccuugagaaaacaaaugucauccaugucuagucuguccccucccacacagggcagcagugacagaccaaagaaacaaucccagucaguagugaccaugcacagaaauacucuaagaaugguuuuguuuuaaucccaggugugggaugugaggcugcuucuggacuguucguagcagcugguuaugauuugccuccuacucuagcagaagcgugguuuuaccagcugcagauaguuucugugaugguuaauguuuggaauucuggggacuuuucagagguuauauaaaugcuagggcccugucuuaggguuuuacugcugugaacagacacuaugaccaaguuaagucuuacaaggucaacauuucauugaugcuggcuuacagguucacagguucaguccauuaucaucaagguaggaacauggcagcauccagguaggcaugguacaagagaugcugagaguccuacaucuucaucugacuggcuuccaggcagcuaggaugagggucuuaaagcccacacccacagugacacaccuauuccaaaagggucacaucuucuaauagugccacucccugggcuaagcauauacaucacagggcccgagaggagggguggguuguugguugguugguauuggccucuguuuguuauaaagaagaaauaagaugaaaaaaaauuagauauccugauggcgaauaucaaacuugucccaagaaacaccauguuucuaaucaggaggaaguaaacaaaaaauaauguccccuuucccucugucauuuuuuuuucuccuauuuaguguuagggguggaaagaggguggagaaggguagaagaaagaagaacccacagaguacaccacucaggucugccuuaggaggcugagaguucauuggaguugcuuguaugaacauggguaaccuaaggaugccuauaccauagagaagucucuuucccacauccguacccaggagaaguauagcuggagacagcucagugguuagagcacuggcugcuuuugcagaggaccuagguuaaguucucagcacccgcaugguggcucacagccauuuauaacuccagauccaggggaccugacacccuuuuucagucuccaggcucugcacauauguauacagcuguacauaucagcaaaugcucacaaaaaauaaaucuuauuuaaaguggcaggguauaaaaaaauaccaugucuaugcuaggcaggagcaguguuuccucagcucccucugcuccgagcaguccaggaacuguuuugugccacgugccugggguucuagcuagccaugugcauggugacaaucuccaguguguccuuaggcuuccacaguccuguagcacagauagggaagccuccuuugcugugauagacguguccugcucuguggguaucauuguuacugauggcgacagucccuguacacagggaugcccuuguugauggagacaccaccuugguaguagaauguuccacucuuugcugauguggaccccucucuugguccucagggguacagucugcggcuguuaaugucaucugcgagcuggcacgccgcaacccuaaaaacuaccugucucuggcgccacuguuuuucaagcucaugacauccuccaccaacaacuggguccucaucaagaucaucaagcugguaagugcugagggauggggugugcugggccuggguccauggccugcaggcauccuggugaccacagcaccccugucccuguaguucggugcccugacuccucuggagcccaggcugggcaagaagcugaucgagccucucaccaaccucauucacagguagcuauuccuuggcugccaccccugggcagggauauugaugccauucugacacgacccuugucucacugacugaggcugcucuguuucuuuuuuuuucuuucuuuucuuuuucuuuucuuuuucuuuuuuuuuuuuuuuuuggcacauuuugcuuuguagcccaggcuugccuagaauucacacaacuccccugggagcugggauuuuaagugugcaccacuauacucaguugagucagcuuugaccuggacucauacugagcccugcauucauguaguccuuuaccauccuggggcuccagagcugugccgugucccucugaacugagcugagcuguggaaggguggcaccagaggagcugcaggccaucauggcacacaaagggacaggguugggggugggagaagucaguguugaccugcauccccugccugagaggagccacaggaaucauggugucacugggcuuuagaaggguggaaaugguacuguucccauggagcccagcagugugaccugcuuguguaugacacuugggcugggucuacauuucuuccuuucucucagcaccucugccaugucccugcuguacgagugugugaacaccguaauugcuggugaguguacugacugcccugcuaggaggugggguggagucaacagugcuugcucucugauugcuacugagcugggagaggguucaguuccuccugcuggaaggagcggagaggccugagcagcaagacccagagcauccccugaaugaggcagcuaguguccccugcccaagccuucuucuacagaguggcauaaacucaggucucugcauuauucccgcccuuccucaggccacuuugcaaauuugagagguuaucucccgcuuggggucagagcccaagacccacagguuucugcuuugcaggccacauuccauuuuccaggccuccacgcuccuccagcagaacuaagcugagauagcuacgucaaccacagauccauaggagcagaccugagagguggcuguguggucacucugcaggcauagggaauugagugcacauacagcacaggucaggacugggcuuuguaacccuagcaccggaaagccagcaggcagaggcagaucccaggaaucuuagccagucagugaguuccagcaucagcaggagaaccuggcucaaaaaauccugguaggaaggauugccauggaggcaaugugcaacacaccuagagaguuagaacgugggcccagcacccuugggcuuaugauugaacauggccuucuuccccugaugucuugccuggguggagggaaaaggaauggaagaggggaagguaccuugaagauaagagcucugagauaaggucuuaaggucacagugaucacagaggaguccccaggucauauggcuauccuugcagcuauaccacagugacaggagccagcugucagccacaggcagagcagguaggguuucuggaccccucccugggagugaguucauucuaugucccagcuauagccuaugauguauggaguguugucaucugagggcucccuaaaaccaugagcauucaggguucuugaggggucuccagccuacucugcccagcacagaucugcaccccagaucccagagaggaauaggaacugugugauccugucuuagguaccaguacuuuaggucuaagagccacuccuauuaggaaggaugggagacccaggccagauccccuggcuucccaagguccaaccuguccaucugccuucugaacgugcagcgucaagccuccugugagccagucagccaggucccuguuggugggguggguuaguaggugucagugucugacccagggcuacuaaccuugaccuccaugugucccagugcucaucucacugucuucugggaugcccaaccacagcgccagcauccaggugcgucugucuccggaccugugcucaucagcacgaguggggcuccucagccagucuggaaaugauugcaguggucacuuccaaguucauuuuucuugaacagcuugaagcaugaagaaaguccuccagccucagcccucccacaggcaccuccuuucuccacuguacuucuaccugcccuguggggaccuagucagccugccugggcagcugcuguggacacucugugcccccagaacuugcucccacauguccucacuggugccugccaguccacuuagucaugcugagcaggguccccagagcaaaggcugcaguuaccugcccaaccuguccccagaugcaugcucuuggucagggcugguggugggcugcugggcauggugguggggugcagaccaguguggcuuuccuccucucagcuaugcguucagaaguugaggauacugauagaagacuccgaccagaacuguaagucacugcugccuucccuggcugucacaccugaaugccaugccugggauucagaaaucucacacuggggaccaaaugcuccugggcccucagcccucugcugugcucaugcugaucccgcuggagggcuuuguggauagagugguagcccucaccgcagucuggcuagccuugcccugagccccagggaagcaugaagcaaccuacuacugccuuccguaugucccuacacugcucucugcuuaaaccuguuccagaaugggggcugugucagugucaucugcugcuuaccagaccaaguggcaggcuguugucuacaguagagccaggccugauagacuugcucauagggcccagggguucucaguccuacuucacaccacaaucucucaggaaagcaucucugggccaucuguugaugugacuaccucaaaaccugucacaagugaggcuucaggugcacaggugucaucuguggcuccugcuucagccucuccauuuuucaugaggccugcacugggccagcagucacugucguuuggcuagcagugaccuuuagagcuugugggcaggguccucagacacagcaucauuggagugcuuuucuuucuuucuucuuuuccuuuuuuggcuguccuagaacucaaucuauagaccaggcuagccuaaacucacagagaucuauccaucugccucugccuccugagugcugggaugaaagauguacaacacuauucccagcaggguucuuuuuuuuuuuuuuccuuuuaauaacauguguuuuuuguuuguuuguuuguuguuguuguuuuagguuuuuguuuguuuguuuguuuuuucaagacaggguuucucuguguagcccuggcuguccuggaacucacucuguagaccaggcuggccucgaacucagaaauccgccugccucugccucccaagugcugggauuaaaggugugcgcuaccacgccuggcgaacaacauguauuuuuaaguuauuuguaaguuuuugucauucauaauuguguguccgugugugggucugugcuugggaaggccagugccuguggagaccggagcuuauaacacucuggagcuggguuuacaguccuguucuuccagucuccagagggcugugccuguagacaugcugugagaggcuggguacaagccuccaccguggcuuccugggugagguggggcucacgaaaguggccaucagcuaaaggcagcaccccugauaugccugugggucaugguauuucacuugcuguccccaagcuaauggcuacuuggucuucacaguaaaguaccuggggcugcuggccaugucuaaaauccugaagacacaccccaagucugugcagucccacaaggaccugauccugcagugccuggaugacaaggacgaguccauccgccugcgugcacuugaccugcucuauggaaugguaugugucccuguggccaggauggggggccugugaagcuucaguacuugucauuccuauccaggcugggagagcagccugaaccugcugcggucagccaauggcaccuguccaggauauaggggauggaacuggauaccaaauacgagagucucugucacucucccuugaucugauacaguuuugcacucuggggaggaagcuaucccucuugggcucaugaguuccaucuugguugucaguguucaugccuggccacagcugccuguuccccacagguguccaagaagaaccugauggagauugugaagaagcucaugacucacguggacaaggcugagggcaccaccuaucgcgaugaacugcucaccaagaucauugacaucuguagccaguccaacuaccagcacaucaccaacuucgagugguacaucagcauccuuguggagcugacaaggcuggagggcacccgccauggccaccucauugcugcacagaugcuggacguggcuauccgggucaaggccauucgcaaauuugcugugucgcagauguccucacugcuugacagugcucaccugguagccagcagcacccaacgcaaugguaucugugaggugcucuaugcugcugccuggaucugcggggaguucucagagugagucggggcagcccuuggaaguggccuaguguggggacauguacgcagacagauccuuugccugacaauggucacuucugggcagcucugcccaagugaucuccugucuccuuccauggaguggcguggacaauuugggucacacuggcuguggagaggagggugccuuguagacugugaggcagcucacgucugcuucaggugacucagcauacagugcugauagugagcuccucacgccaggcucccgggcugacuaggugguaggcugcgguggcuacagcaccuccauuacaccuuacaccugcucagaggacacaggacagcugugaccaagagagguguggauuuguuuucagucugucacagaacucuccuggggagcacauuucucuggaaaaaccacaaaauuugcccagcacuucccuugccccagagcucagcccacggaggcuguguauaaguuguccuuugaggauccagugggagccgccucuuugaaccccacagcacagcacauggaugccaggagaaguuauugaugaauguucaguuuuuguggugcuagaaaucaaacccagggucuuguuccuaucaagcaaaugcucauuaccaggaacaaaucaauggcaacaagucagccauacagauaacguagguccucugaccugugucuacuacuaguggcagucacaucuuugcuauuguuuccuuuuccuuuuuuuaauuuuacauacucaccauugcucucuucagacacaccagaagacgucagacuccauugcagaugguugugagccaccaugugguugcugggaacugaacucaggaccucugggagcauagucaguguucuuaaccgcugagccaucucuccagcccugcuauuguuucauaaacaaugucccuuuguggaacucaugguucuuaguuucccacuugugcauaguaagagcaggugccccaggguugugcuuuagcugagaaaccuagcucccacguugccuggccugacguacuugugauauggguguguggguaugcucaguagccucaugcagccccugucccccaggcaccuacaggggccccagcaaacccuggaggccaugcugcggcccaaggucaccacacugcccggccauauccaggcuguguaugugcagaacgugguaaagcuguacgcguccauccugcagcagaaggagcaggccgcugacacugaggcugcacaagaggucacccagcuacugguggagcgacugccacaguuugugcagagcgccgaccuggaggugcaggagcggguaaggcugcaaacuggagguucugcuccuagcugagacuaaccuuaaccuggaaguggcugugugugcucaugcccugugggcccccacaacccacacuccauauaccaccacagagguccuccagccaggcagccuccuacagguaccauagcucccugcauagcacauaaccccagugcuguuaccaggaacacucuggagacacccuuggcccccuuccaaguccuuggucccagcagagccaguagaugggacagauuuuucuccuuuuuccgaagugaguuguuugagucucuauccuagcucugcccaccuggggcuuggggucagugagcagggacuggguguggaugggccugagagucuggguaggagguggugugggugggcagggcucuacugcuauguggaagagcucuuuugggaccaucuuugucuguucuagaguaggagcuuguaugugucaggcauguguugugucacugagucacaacaugccaaagguccugggccguugugacucaauaccugaguauuggggcccaguggccaaagcugcuuuuggcaccccaugguaauauaggcugucacugagccaggugccauguggcuucugauagaucucaggggacccuccuuugaagagguuaggucugcuugugauucauccaugguugagcugucccagguugagcccagugggaagugugaacccacacugagccacaucuugauguuuguugggauugguugggcagcaugguagcaagggcugccuaguacagcugugucuguucagaauuagagccagcacaggacugaguggccauagguggcuccacaggaggugacauuacauguagucuucuccauuugaacugagcucccuccuguucugauccugauaaggcuugucuuuccuugucugagauacuuacagacauaaguaggucuauagcugauguacauggauagaggccagggaccaacacuccaugcucagauaucuggccgaguccucuccaguggcugaguggcucuggacagguacccacucuuggcugcugcucuccuaggcgucuugcauccugcagcuggucaagcauguccagaagcugcaagcaaaaggugugccgguggcugaggaagugagcgccuuguuugcuggugaacugaacccuguggcccccaaggcucagaaaaaggucccaguuccugaagggugaggauuggggauguggaagagagauggcuggagccacugaaauggucccugaucuaggaaauuagaaaaaggcuuucaucccccaugaccugccaucagccaaggugacaagaaguggccuugggacuagacagccugcccuugcucacucacuuaaagucacuccauccagggaccguugcaccuccuguucccugguccuccaggaguccccuugucagauuccaugguuccuguauuuuuccuauucuguuccucccaagcuucccaccuuuccaucucugugucuccugucaggaggcuguggcaccccugguuguuuaaucccugggguacugguguggaaagaugucucuuuugcaugguggcccucugccaaugauuaaugcuuaacaguggucaugguaggacaacacagaggagacaaggacacugugugauccccuuuguacuuccagccuagaccuggaugccuggaucaaugagccaccuucagacagugagucugaggaugagaaacccaaggccaucuuccaugaagaagagccgaggcacacucggcgccggcagccugaggaggaugaagaggagcuggcucgggugagcaugcuguuucaguagcacccagcacagggcagaagccugggcugggguauguucacaagaguagcugauugucaggcuuaggggcaccuggggcucagcugugcugccacacauagccugugacacagaggccagaugaccuuugacuucuaccuuguccucuugucuagggaagcccccaacccuccaugaacuccccuuucuguguuuguuugcuuguuuguuuguuuguuuguuuguuuguuuguuuguuuguuuguuuguuucaagacaggguuucucuguauagcccuggcuguccuggaacucacuuuguagaccaggcuggucucgaacucagaaauccgccugccucugccucccgagugcugggauuaaaggcgugcaccaccacgcccggcugaucuucccccuuucuggauguucagcaggaacacuagaguaggcuucugagccugcaggaguaggaaugguggucagaggcugaggcucagaaugggcagaccaggccauuucuccucccaggaggcaggaaccucaggcagucugcccacccgugagcucugccccuggaggucuugggaaccacacuucuacuguggcuccucccugcccaccuagggucuugggaacuggaugggcaugucucugagacacaugcucaugugcaguccuauucccacagcggcgagaggcccggaagcaggaacaagccaacaaccccuucuacaucaagagcuccccauccccgcagaaggcaagugguauccuugagcaucccuccccagcugccaagcugaagccuaagagaaugauguaaucauggcagugccuuguggggcggggguuugugccuggguagucucagcuguagcugagcagggcuaugcugcauccaggucuugauggagagcucugaaugguuuagaugaggccccaggggcagugaccacugccuugaggaaggcauucuacccagcuggcuuauuguacccacgggaagugcuggauccacguggacaggugccuggccuguuagauccucauguuccuaaggagguuucagcuucugugggcggacccuacagugguauuggguaaagcccuuguguagcauggaugaaccuugggucccauccacagcaccaccucaaccaaguguggucaucucagcagucaggagguagagauggaauucucuauuaccguugcccuuggcuacauaguuuuaagcgaaacuaugugcccccaaaaucccuguguccaaggaaggacagaaaagagaagagaagagaagagaaaaaaaaagaaaagagaaaagaccaucauggauagauuuggcuuuaacccuaacuguagcaagguuacaguuagcuccugcuuccucacaacuguaugacagggcccugcucuucucugugagccugcagcuuaccuuaugggcagugcucccaggcugcacugggagccuuacucucaggguccccucuuccuuccuccugagucccugagguucacugacacccuaugcucuucuuucagcgauaccaggaugcaccagguguggaacacauuccugugguacagaucgaccucucagugccucugaaaguuccaggcaagugucugcuggcucuaagcucauagucaggaccugaugggguucuuggucccugaguuguaaccauccacacuucccuacagguaugcccaugucagaccaguaugugaagcuggaggagcagcggcgacaccggcagcggcuggagaaggacaagaaaaggaagaagaaggagaagggcaagcggcgccacagcucucuccccacggagagcgaugaggacauugccccugcccagcguguggacauuaucacugaggagaugccagagguuagugccuucucagcucuuuuagccuugguuacaacgggcuugucugugugucccuaaaagggaaggcucccuacguguagauagccacacauugaccuguugcacaagcccuccaugaugggcaguauuuuacuccacucuuugagcuggcagccccagcugugugugccacugaaggcugugcucccaggcugagcuauagcccaggacacugggcaccuggcacauguaguauggauaugggugugacugggcaguuguuauuuggaggagaagggacaggagccuccagcagagcccgugguuguuaguugaacccugaccucuccauucccuuagaaugcuuugccuagugacgaggaugacaaagaccccaaugaccccuacagggcgcuggacauugaccuggauaaguaagugaggggugaggaacaaacugcugggugagcuugugccugggguggugagguuccuguucccagggcgcugagagucuuuagccuaagguggaaaguacaugggcuugggaucauuuuggggguggggaggugcugugugcugugguaguggcucagaauagcaccuacuaugugagcaugagcaccugaguuuauuucccagcacucauuaagaucaaacccuagcagcugaggcacugaaugaucccuggaguucauuggcugccagccuggccgaauuaggaagcuccagguucaguaagagauccuaucucaaaagauaaagcggagaggggcaggaaaaaacaccugacauccaccucugcccuccaugugaucauagacaugugugcagcaacuuguacacacccacaucccacaugagcauggacauacacugucacauacaaaagaauugagagggaacacuggggcacuugggaagggcacagggucuggcacgggcuccuggcaccguggcugucguggacacuugcuggagccucgggauccauagggccagcuguacaggggugggccacagcucagcccagugacaccacaucuccuccucucccaagaccccuggcugacagugagaagcugccuguccagaaacauagaaaugcggaggcggugaaguccccagagaaggagggugugcucgggguagagaagaagagcaagaagcccaagaagaaggagaagaagaccaaagagagagagagagagaagaaggacaagaaggugagcgagcaccagacaggauggcaacugacuggagaucagcccgugucccugguauuccuugccuuugccaaaaguccuuuucuuguggcuucagggugaggacuuagacuucuggcuguccaccaccccaccaccugcugcugcccccauuccugccccguccacgguaagugccugcuccguguguccucagggucucauuuguauccccaggagccagcgaauggcaggcauccccugcaaucagagccacacacaagugccaguaaaugacuggagucaagccuccugggcucgccuucuguacuuuguggucuaugucugcuauccugugagacucugugcuugccaggguucagugacgcagagggguagccagcaggacguuuguccccaaggcaucccuuggaggauguccccagcccucaaguggaacagcacugguuaugugggauucaaaguucucuuacugcuccuaaagcuggaacccaugaacagucuggaauaccacuacaccccuccccaaaagcugacucugacccuccugauaacaggaagaacuugcugcaagcacuaucaccuccccuaaggaugagugugagguucucaaaggggaagaggaggaccacguggaucaugaccaagaaagggugaggcacaagacgauccaccccaaggcuguggcaaggggccccuggcaggccugugccugaaccccaggacaguaggccugcucacaagggaucacaguagugguguccucaagagguagcugcaugcugggcgugguggcacacgccuuuaaucccagcacucgggaggcagaggcaggcggauuucugaguucgaggccacccuggucuacagagugaguuccaggacagccagggcuacacagagaaacccugucuugaaaaaccaaaaaaacacaaaaacaaaagagguagcugcaguccucaugcuuuagccucugaaagggauauaguaccuccagugcaguuucuaagcagugcaccacaacaccaucucauuccagaaccuuccaucacccaggucaucucacauuuacuugcugucucuagauguuccuguucuagacaguuccugacagggagucucacacucaguggucucuaacgucuggcucucagugagagccucucuugcucuuuauuuacuuacuuacuuacuuuuaaagauuuauuuauuuuauguacuugaguacacuguagcugucuucagacacaccugaagaggguauuggaucccauuacagaugguugugagccaccgugugguugcugggaauuaaacucaggaccucuggaagaguggcucuuaacugcugagccaucucuccagccccuuauuuugucuuuuuaaaguugacuuugguugugugugguguaggaucugagguccucgugauucaacagcaagcacucuuaaccacaaagccaucaaccuucgccccaagccccacguugaagucuccaugugugcuuuguuggagccuggcuccuacucguggccauguguuguugcuccagugugggacugggccucgugucugucagccagccagccauaaugcuaguccauuugccccuggaugauacaaauauaggcacacugcugaguguuucuuccucgugguguggccaauagggcuauccuuccugugcagugacagucuugcugaucugugcugugcaaucuucuucacucugcuccugccacucaucugucagccccaagguucuagugucugccagggcuggccuccuccagccguggagacuugugcaauuccugguuuuacuguccuaucugcuccccugaggaccucaccauguagugugaggggagacaaugauuaaagggugccucugugggagacauggggccucagcucagacucugcuucagaaaucaucccggcacaagaagaagaaacacagaaaggagaaggagaaggaggagaggccacgagacaagaagaaagcuaagaagaagcagguggcaccucuggagaauggugcggcagcagaggaggaggaggagccuaucccggugagcauucuugacaaccugccaacccaagggugucaccuggguucuguuuggagaggacccagggguccgugcaagcugcuuugugaccugugcuuggugagggauccaugacccgcaacaucugguggcucauguuuugggaacuggccauccccaagcaugguucuguagccuagucccugucgcccacaacugacgagccugucucuccuccccagcccauguccagcuacugccuucuggcugagagucccuacauuaaagugguaagugacacuuggguugcugcagggcgggccauuggcggagcagacccauccuuagaagccuuguggggcuggcggcaguagccgggcaccaagcucaagcaucaguauagggcacucucugcagcccagccacagcuggagagccaguaugaccaggccaccagaggacagcuuugcuagcaagacagagcgaccagcugggcagcauacaccuuacaccuugggaagaggcagggggauugcaagaucaaggccaaccagugcugcacuacaagacuuugucucaaggagucaaaaagacaggaacuggggugcagcuucaugaagagugcguuuugagggccuggggcccacaggcaguuuucacgggggugggguggggucacuguccuugaucuuggcagugaacucccuccccucagcuggucccuggcccuugacccugcccuugcucaugcagacauaugacauccaagccagcuuacagaaggacagccaagugacuguguccaucauccuggagaaccagagcagcagcuuccugaagaacauggagcucaacgugcuggacucucucaacaccaagaugaccaggccagagggcucaucgguacacgacggugugcccgugccuuuccaacugccucccggugagccuacccuucggcccuagccuucgucacgccaccuuggcucuucacaauggacuuaacuagagcucccagggacagcugaagcgaaaggccccaagcucuugaugacccucccgugucucggugcuacucuugggccacaugcuggcuuccaccugggccauugggcugagcugcagcagugcccauuguuucugucacucuagcaucccacccagcuaggacagacaccccagggucagugcuggcccacugagugccaugucucccagcaggcgucuccaaugaggcccaguuuguguucaccauucagagcaucgucauggcccagaagcucaaaggcacacuguccuucauugccaagguaugcacucuaugcugagguccaggucccucccgcuccccaggggaugucaggcaucccaggaaagaaagugccugauuggaaaguccacccuacagccuuucuccuugcaggaugaugaaggagccacccaugagaaguuggacuuccggcugcauuucagcuguagcucguaccugaucaccacacccugcuacaggugugucuccaccccaccacacagcucgugggaggaaaggagggguagaguuugcugaugugggcugugagguaggaguaacaugagagugcucagccuucaucacaggcgucgccuccaccugaggccaccucuucuggcaggugacacugcagaugguugccucucugucccggaggacuacccugugugccugucacuuucugaugcucacauguagguagcccaggcugccuuggaguuugaagcugcccucaugccgcgacauuccuaaugccaggugacugcugacacccaggcccugccaucacacacucucuguccucccacagcgaugccuuugcaaaguugcuagagucaggagaccugagcaugaacuccaucaaagucgauggcauuaguaugucuuuccagaaucuucuggcaaagaucugcuucuaccaccauuuuuccgguaagcaauguuacagugauaacacucuugguggcuuuguaccaaaaaugacagaagcuacuuucccaccccuaauuagacccuugcugcaucaggccugggccugcagccugagugccuucacagcaugggccccagccguguccuggcaguucuggcuggagagggccugccagggagcauggaccugaccccccugucuguugcaguuguggagcgaguagacuccugugccuccauguacagccgcucuauccagggccaccaugucugccugcuggugaagaaggugagcucacagcagugccugcugcucugcagccacccaggaugcucucaacaagaggcugaguuuccccugcacauaccucccuguccagggcuguccucuaagguccccaucccaagaguacaacccaucucccacaguuagacgagaccuccuagcugagcuguaccaacccucacaguucuaccaggcccuccagaugcaucugguuugggaacacaaggcaagaggaagggaagagugggcucagaacugucuccggcgcccugaagggcuguaugcuauuuaccugccaucuuagcacucaggagacagaggcaggguuacugcauuccaggcaaguuggggcuacauagcuucaaaaaaauaaagugaggucuaggcuccagggaggguaggagaggugacauuugcgccccccacacacacacacacacacaaacauaggcaauuugugcaugugccauccccuagggcgagagcuccgugucaguagaugggaagugcagcgaugccacguugcucagcagccugcuggaggaaaugaagaccacguuggcucagugcugaguugcaguccaggaugugcaacagaccacagaaagaugugaugcgucuuaccucuccuguuguguguacugucucacacccagcauuaauuuaacaccaccggccuccacugugugacccugagguccuauguugcaucaacuucuuuuauuauccuuuauuccgaccugcacuccuuuagcaaggaaggccauccugacccuagccagaaaggggcugcuccacuucccauucucaaaggcggcuguggacugcaggguuacagcaaacacacugauguggccccacuccugaccccaugcugccucuggaggaacccuuccagaugcugcuguccacaaauauuccaacugguagccucuauggagaggugauaaggccagcuguuaaugcuuuuccccacagccugcaaggucagauggaugaaguguccuuguggguggcuccgcagcucagcugcagacaacagggauggcccuuugauuuucuucuguucaacagaacuguggucugucuugggguucuguugugggggucaguggaagagugcaauguaugccucaguuugucacuacacaucaugggcuugucccugcagcuguggagggcuuagugccuugcaguggagagugugcauccugggagcagucagugcuuccccagcuguuccuggguaaggugaagagacaucuaacuggguagcugggcacaagcugagccuuccucagaggugacaguggucuacagacauucuggcuuccuuugaggacaacugucacuuuagcauguagaguacucuuaccgaccccaugugaccuuccagcucuaugauguuccaugauugauuugcuguugacauucccaugugaagagagauauaucacgcugcugacgaucggugucacaaugacccauuaaagagucaaaaaacauuuguguguuguguccccaugguaccccagggcaguccccagugugccauuuaggcuccugaagcucaggugguacagaccagugaguuucuccaaccuccaccaguaggugccuuguguguggggauuacaaguuuggugugagugcagaaccagaagacaguuguccuguaucauuaccuccaaucuccacuugccaugcuagaauucaaaauugugguaacacacaccuuuaaucccggcacuugggagccagaggcauggggaucucugaguuggaggccaaccuggucuacagagcaaguuccaggauagucaaggugacauagagaccuagcuugaaagggaa

SEQ ID NO: 5631 - RNA, 4036 nt, Mus musculus
uuggagggaaaacaaacacuaggacaaaacuggccugggcaggcuggagaaguggcucagcgguuaagagcacugacugcuccuccagagguccugaguucaaaucccagcaaugauguggugguucacaaacaucuguaauggaacccgaugcccucuucugguguguaucuaaagacagcuacaguguacucauuauaaauaaauaaaucuuagaaaagcaaaacaaaacuggggccugggugagcacacugcuugcucuguggauggggcaccaagcucugcaaacgcccaccaacaguucccaaccccaggaaacacagaaaacguagggcguggugguguacacuucucaucccauuucuuuauccaagguaggaagaugguuagguuaguguuagagaccaaaccgggcugugcagugagauccuaucucagauaaaagaaaaaaggguggcgguaggcuccagggacucugauaucccuuucuggacccuauggguaccccacucacacacaaagcuccacacagacacauuaaaacaaaaucuuuaaaaacgcggggaagggcauuuaucugcuugcugacuacugcugcaacacgaccaccacggcagaccgcaccuucauaccaucagccaaaauaaacccucgauuccuuaaaaccaaucaaaacagccaagugugguggcucaugcuguaagucccacuaugcgagagaaggcagaggcauggcaaugucugugaacuggaaaucggccaaguuuccacaccgaguugcaggucagccccaguuaagcagugagacccugucugaaauaaaugaaaaguugugccgaugacuggaggggcucacacgugaaacuugggacaggaggccaggacgcagggacgggagaugcgcaaccucacggacuaccguaagauuaccgaugaacgaucaauaaggacagagacgugguauauguuaagguaauggucugggaggaggccuggucccaggacaaaucccuuuuaugugcagauaccguuaucuuucaaucccagcaagggaccugcuccgguggacaggagcaguggucgccagggccccgauuaacgaagguggaaacggaaacaaccaaggaggucaaaauacacgccgagacgccacucggacaccccgaaccacccuggaggccacagaagcgccacccaagccagcaaucacgcggcgacccaacgggccucgcgagagcgcgcucucccggcgggcgcgcgccgauccugaggcaagagggcggccgcugccucuccccgucccgcccccgggcuuucgcucccaccuucaagccuccccgacggagcagccgccaccgacaaacugugcagcuccucaccaacgcuaaggccucgcuauccggguuuaaucuccgccaaggccgcgguuucgccgcgcgcgugcgcacgaccgacgaagcgaucccuuccgggagcaaaggcgucggcguuucgugugugcgcaggcccagcggauggacuuccgucuucgguaggcgggagagaaaggagcgucggggcgcagagugcgcgugcucacugcagcgaccgcacaguuucgcuccgcccuaagucuagcggcgccggcuaucgugacaagaggaaagcguuaggguucaccggcccaggaaggcgcuucgcucaucguggagugcucugagucuaacuuacaccucacgcuuaguaugucuggcgguuauuuaaggacgggccaucuccuucccgucugacucuguucaaccgcgcagacccauaaauuagggccgcgcaaccagcccaacaacgcgcaggcgcaguaaccggguugggacuuccgagaucgcucucugagacuuuuguggcgcuggcugcggcuucggggaggacggcggccgagaggcagggcgcguguugguucgcgcggauccgugcggcgggaugcgguacaacgagaaagaguugcaggcgcugucccgacagccggcagagauggcggccgagcugggcaugcggggccccaagaagggcagcggugagccagucggggcugcggcuggggcacuugggcgggccggcgcgguuccugggugggcgaaugagaacaguuccgcgcugacaccgcccugugccuacaguggccaagcggcgacuggugaagcugguggucaacuuccucuuuuacuuccgcccggacgaggccgagguaggggcguggggggcgcgggggacccgcgcggcccggaggccggcgcucauggccgugucucgcgcagccccucggagcccuguugcuggagcgcugcagaguggcccaggaagaaccgggcggcuucuccaucaguaaguuuccaucccggacucugcuccgcacacccgauccuuuuuacucccuuaggagccuacguuuguccuggaucccgcguccgcugguggcccaggacuggcccagcuaucacucagagugcccacugggucugguucucgcuuaguuucuucuccgaccccucugcccguucccaacugagagaggugcagucugcgaacgugggguguauagcaggaacagucucugccgcccucucugccacggguaggguacgggcaggcuuuaaggccugucucagccuucuucccuaacgagaacuuuacaguaucuuguagagauuugggcaucaugucuaccuauauuauccagugggguucuuuaucuguaccccucuuuucuccuucuugcacgagugcacacguguuuuggggugugaguaugccaguaaggccagagggaaacuugaguaguugguucucaucuuccacuauguaggucuccagcauaaaacgcuggucauugggcuuggcaguagggucccaccuggggcuuacuuuuaaguuauacugacuggccagcaagcccuacgaacccuucugucucuuucaugagucuuucuugaacacugacauuacagguguauucguucugcucuccgacacggaugcuggggcuucaucacccauguucuauugccauucaguuuagggucuaaccuaaugaccuucuauuagccacuuccauucccaauaacccaacuucccagugaguccccuauuuguggguucaggggucaggauucuggaggacaaagccagcaugagacaggcagaagaugacuugguguuagaauaagagguguaguuugaaauccuggugagaggaagcugggacuuguggccaacaggauguagaccaacuggacacugaccagagguggcucuuauccuuuaucccuuuccaggcuucgucgaagaccucagcaggaaauaucacuuugaaugcuguagccaagagcagugucaggacuggauggaagcucugcagcgggccagguggggcuuuagggacugaugggagcuggguggaaacaugggggaaugugaacagugagcccaauccuuuccuccagcuacgaauacaugcgacagagccucaucuucuacaggaaugagaucaggaagaugacuggcaagguauguggggcggucagggaugggacagcuuucccuggccuugcucacagccaccgugcccuccacaggacccccuggagcaguuuggcaucuccgaggaggccagguuccagcugaauagccugccuaaggaugggcggacuacuuguauuggcucccaguuaaauguguuggacugacccucucugggccccuggcuacccugggaaguuuuuuuuuuuuuaauauagguuuuaauacaucuguucaaaagguccagaggaggugggcagggucugugguccucguucuccaugccaucucccugccagcaccccuugaguguccacauccagggaccgagccuggcacagcuccccuauccauugccagaugaauguauaaugcuagaugaagcugugaacccccccccccccuccugcugauagagcagggcaugggugcuggccucagugcucagccugcucuuuaauaaagguaccucuuuucugagcca

SEQ ID NO: 5632 - RNA, 6895 nt, Mus musculus
aaccgcgccggcccgcccaagugccccagccgcagccccgacuggcucaccgcugcccuucuuggggccccgcaugcccagcucggccgccaucucugccggcugucgggacagcgccugcaacucuuucucguuguaccgcaucccgccgcacggauccgcgcgaaccaacacgcgcccugccucucggccgccguccuccccgaagccgcagccagcgccacaaaagucucagagagcgaucucggaagucccaacccgguuacugcgccugcgcguuguugggcugguugcgcggcccuaauuuaugggucugcgcgguugaacagagucagacgggaaggagauggcccguccuuaaauaaccgccagacauacuaagcgugagguguaaguuagacucagagcacuccacgaugagcgaagcgccuuccugggccggugaacccuaacgcuuuccucuugucacgauagccggcgccgcuagacuuagggcggagcgaaacugugcggucgcugcagugagcacgcgcacucugcgccccgacgcuccuuucucucccgccuaccgaagacggaaguccauccgcugggccugcgcacacacgaaacgccgacgccuuugcucccggaagggaucgcuucgucggucgugcgcacgcgcgcggcgaaaccgcggccuuggcggagauuaaacccggauagcgaggccuuagcguuggugaggagcugcacaguuugucgguggcggcugcuccgucggggaggcuugaaggugggagcgaaagcccgggggcgggacggggagaggcagcggccgcccucuugccucaggaucggcgcgcgcccgccgggagagcgcgcucucgcgaggcccguugggucgccgcgugauugcuggcuuggguggcgcuucuguggccuccagggugguucgggguguccgaguggcgucucggcguguauuuugaccuccuugguuguuuccguuuccaccuucguuaaucggggcccuggcgaccacugcuccuguccaccggagcaggucccuugcugggauugaaagauaacgguaucugcacauaaaagggauuuguccugggaccaggccuccucccagaccauuaccuuaacauauaccacgucucuguccuuauugaucguucaucgguaaucuuacgguaguccgugagguugcgcaucucccgucccugcguccuggccuccugucccaaguuucacgugugagccccuccagucaucggcacaacuuuucauuuauuucagacagggucucacugcuuaacuggggcugaccugcaacucgguguggaaacuuggccgauuuccaguucacagacauugccaugccucugccuucucucgcauagugggacuuacagcaugagccaccacacuuggcuguuuugauugguuuuaaggaaucgaggguuuauuuuggcugaugguaugaaggugcggucugccgugguggucguguugcagcaguagucagcaagcagauaaaugcccuuccccgcguuuuuaaagauuuuguuuuaaugugucuguguggagcuuugugugugagugggguacccauaggguccagaaagggauaucagagucccuggagccuaccgccacccuuuuuucuuuuaucugagauaggaucucacugcacagcccgguuuggucucuaacacuaaccuaaccaucuuccuaccuuggauaaagaaaugggaugagaaguguacaccaccacgcccuacguuuucuguguuuccugggguugggaacuguuggugggcguuugcagagcuuggugccccauccacagagcaagcagugugcucacccaggccccaguuuuguuuugcuuuucuaagauuuauuuauuuauaaugaguacacuguagcugucuuuagauacacaccagaagagggcaucggguuccauuacagauguuugugaaccaccacaucauugcugggauuugaacucaggaccucuggaggagcagucagugcucuuaaccgcugagccacuucuccagccugcccaggccaguuuuguccuaguguuuguuuucccuccaaagcucaugaacuaacugcauuuuugcaguggguacccauacacauucaaccucaaacauguaccccuaggggaccuuaugcaugauggacaaguguuccacccuugaggugcacccucacaucuguggcuggauacccaggcucccugcagaggccagguauagaguccuauguucuugaaaguugucuuugccagcgguugaagugguuuuccauccugcuguugcgggugcccucuugcucugagaagcccaugcugccacccuuagacucugcucuugcaucuggccaacuucaucucugggaaugugucucuuaguagcuuucaaagauguagacaaugcucuuuucaguccuuaaguggcugaguaugaaacauccgacaagcugguucugccccaccacuuccauauacaucuuucagccauucucucggcaucuagagcaucuuguauccuuugcauucuagccucuuucucuuugacagccagugguaucaguguccugucugucccagacacacucuguggugacacugagguaacuagguaccuggcccucaagguucuuaagucaaauuugcaggaggcuccagcaauauuaacaaggacugccuccacuuguuuccugaguacugucucugaauuuaccuauagguuuaaaccaagggcuggggcugacacugaguagucuaaaguguucugucaucagaugacacugccuauaggcuuugguugagccucaaagaugggacccuugguaccaagcacuccauaugccaugugucagguggaggagggcguguccuuuaaugccugcaaaggcaggcacacaggccagccugaucuauguagagaguaaccaugacuacauagagaauccucucuuaauaauaauaauaauaaugagaaaaauuaacaacaacaccggggagagguggcucaacuguggucacagcucuuaggaggaucaggaguucagcgaagggaaugaccugccugcugggcuaccucguccuagcaucauguacaguguucugagccuuagcuguccuuacucccccagguuucuuccuguccccugaagcacccaggccugcaucauggacuuucagcacagaccuggaggcaagacugggagugggggcguagccuccuccucugagagcaaccgggaucggagagagcgucugcgccaauuggcccuggaaaccauugacaucaacaaggucggggggagggggugccaguucccacauccacagagcucucacaugccucaguccuugguucaugcagucuaacgguacauuuauucacucccaggacccguauuuuaugaagaaccacuugggauccuaugagugcaaacucugccugacucugcauaacaaugagguaucugccccugcuuuuucuccacuguuauacucgagugaggugacauugguaggccuuggaccugccacccagagccagcccacucacucaguauuggucuggucucauugacuucuuuuuuuucucaauucuggggaucagagcucagccuagggcuuagcaugccagguaagcagugagcuuuaucuaggucagcccuugaggcagggucucacuguggagggcuggcuggccccguguacuccugaugcuccugccugugucccaggcuguccucuaacauaaccgcacagguuggcuggacaccagcuauccuuuauccuuuugcuuugacugugugcucugggaaugaccuuacaaauaguaauggauaccagccaucagcagagucacuucugcauuuuggggcuaaagggaggggguguggcuauugucccuuuuucuggaggggcaaggacacugggaguucccaccccuccuuucccaccccucuugcuggaggaccagacugaucaggcauggauggaacaggucuggccggguugacagugggguggugaugagcaguguucuagguuccaggccucuguuggaagcuccuccggacagcugccuauucccacugguggacucagcacuacagacuuuugcagugaaugcugcucuaaacugcagaggaauuucuggggagggaugggugcagaggcuagucacaggucucccaagugcagccacagccacugugaugcccuguaggcucccaugcuuggcugagccccaggccucagcuaagccgguacaguugcucugccaggugcccguccugcccucccuaccuucagcagcaugucuccuuucucuuugcaggggagcuaccuggcccauacccaagggaagaaacaucagacuaacuugugagucccuacagcccugguuccccgggaccacaacacuguuacucaguagggaaaucuggcuggaugaauggggaggggaggggagaggcuaccugcgucuacauucuugacccccuccccccauccccagcccauguuuagccuuacugucucaguacagagcagauggccaaggggcaaggacauugguggugccaggauucucaccuguucugcccugcuugguguaccccagggcagagccgccuaauccucucccucaacucuugagggcagggccucuggcuccuggugcuuggccuugguggcugguggagggcccaagcacuugugucuguuugcagggcccggcgagcugccaaggaggccaaagaagcccccgcccagccugcaccggagaaggucaagguggaggugaagaaguuugugaagauuggccgcccuggguacaaaggugugugugugugugugugugauggccucccuauggcugggggcuacggcaugaaugagcccuggcccuggcaccggacauacccuugucccuaggacacacagccgacuucucuguccucaaagcaucuuucccuuaguguugccaagagcccccaggugcugauaaguaccaucccuacuggcaaucuccagaagcaggagggggaggcuggcuguugcagucacugccccuggagccccucugcagaggccccugggugacguggccuagccagaagaccaaucacauggccagcaggagcccagggacccaaguugccaagaguccccuuuggcaggcaggguccguccuggggaggcugugacacagcaccucccuccucauacucuucuuggacuucaacagcugccccugcauagagugcuggguuggguugcccucccucacuuuagguccuagccaguggccuuaggcagagaagccaggccuuguguugaggaacccuguucuguugugcacacacagcacauaacagccccaucccuucuguugcagugaccaagcagagggacacagagaugggccagcagagccugcuguuccaggugaggugggaccagucagggguggaccagacacacggguggugaugccaauagugcugugcauguuuuacagauugacuacccugagaucgcagaggguaucaugccacgccaccguuucaugucugcuuaugagcagaggaucgagccuccagaccgccgcuggcaguaccugcucauggcugcugagcccuaugagaccauugcuuucaagguagcgacccuacaggacagagagagcagcuaaauucagcugucuguguauccuagccccuccuuggggugcugcagccucugacuuucucccuaggugccaagccgggagauugacaaggcugagggcaaguuuuggacccacuggaacagagaaaccaagcaggugagguuccacaggccuugcguggguacucucucagcgcuccucaguggcccugccccagucacugacccucucuccuacaguuuuuucuucaguuccacuuuaagauggagaagcccccagcaccucccagccucccagcaggacccccaggcgucaagcggcccccgcccccacucaugaauggacugccuccucgcccaccacucccugaugccuugcccccaccuccaccugguggccugccucucccuccuaugccccccacugggccugcucccucugggcccccuggaccuccccagaugcccccaccagcuccuggggugcaccccccggccccaguaguacacccaccaacaucuggaguccaucccccagcuccugggguacaccccccagcaccagugguccauccaccaacaucugggguccaucccccagccccuggagugcacccacccaccccuggagugcacccaccagccccaggagugcacccaccagcuccagguguccacccaccagcuccagggguacaccccccaacuccaggggugcacccaccagcuccaggggugcacccaccagcuccaggggugcacccaccagcuccagggguacacccuccuccaucagcuggaguucauccucaggcuccagggguacacccaccugcuccugcaguacacccucaagccccugggguacaccccccagccccugggauccacccucaggcaccagggguucacccucagccgccuccuggaguccacccugcugccccggggguccacccucagccuccagggguucaccccucaaauccuggggugcacccugcuccuaugccccccaugcugaggcccccacuccccucagauggcccugggaacaugccucccccucccccaggcaacugagcaguccccccaccagccucuguugucuguguggucuuuucccauugccaguccuuggaagguuuucuauuuguccugccuugagccuauuaaacagccucccccgugucu

SEQ ID NO: 5633 - RNA, 2403 nt, Mus musculus
caugcaggggccacaccucucuccacugguacugcugcuagcgacuaugggggcuguguuacagccugaggcgguugaaaaccuggccaccaauaccaggggccucaucuuccuugaagaugagcucuggccccccagcagccccccugaaccuuugugccuggugacagugagaggagaggggaacacaagcagagcuucccugagggugguggggggucugaacagcuaugaguaugccuuccuggaggcuguccaggagucucgcuggggaccccaagaccuggccaccuucggagucugcagcacugacucccaggcuacccugccugcccugcagcgccuuggggccuggcuaggggagacuggagaacagcaguugcuaguccuacaucuggcugaagguacgugauggacucugucucagcgcccaugaugccuugggacugagugaguuagggcagaagcugggggagggggguuugggggagggggccucgcuggauugcuaggcagaaccuuauacacccuuucaggaacuguagugggcaagauggcaggacacaccccaaugaucacaccuuccagacagaugacagcagagcugcuguguccuuacaagcaaggucuccacaccuuggaucagggucccucaggccuacauggccccagaagaucuccagugaagaguccagcugagggaauuucuguaggacagaucuugagggacugaagcuaauggccucagagacucagucaaccaauauuugcccacagugauaugggagcccgagcucuugcugaaguuccaagagccuccaccugggggagccagccgcugggagcaggcccuguuagugcuauacccuggaccaggcccccaggucacagucacagggacuggacugcggggcacacagguaccagagacuggcaugggcccauccccuaacagccuucugguugagguugugccaaauggaaggguuggugggguuaggaguacaccugggaggcuauucccaguauggcagggguggugccuguagccugaccaucuuccccaguccugcugacaagagucccuguguccacagaaccucugcccuacucgggacacccgcuauuuggugcuaaccguggacuucccagcgggggccuggagcggcucgggccucaucuuaacccuucaaccaagcagagaagguagguccuggcagaggggaggggacagaguggaaggaagcugcccuuaaccccagcccucagccagcacgugcccacccucuacaggugccacccugagcaucgaucagcugcaagccuuucuauuuggcucugauucccgcuguuucacgcggaugacucccacccugguggugcugccacccgccgagccgucaccgcagccagcacacggccagcuggacaccaugccuuucccgcagccugggugcgcacagggauggaggaggaacugggacguuggaggggguaguugguccaccauagccucuugugcucacagcuggcccacuucguucuauuccagacugucccuggagccugaggcccugccacacagcgccgaccccuuccuagagacccucacucgcuugguucgugcucugcggggaccucugacccaggcuucgaacacgcaacuggcccuggacccuggugcgcuggccagcuucccacagggccuggucaaccugucagaccccgcagcacugggacgccugcucgacugggaggaaccccuauuacugcugcugucacccgcugcggccacggagagggaaccuaugccgcugcacggccccgcuucugcucccugggcagcgggccugcaacgcaggguggcaguggagcugcaggcggcagccucagagcugcgggaccucccgggucugccacccacagcucccccgcugcuggcgcgccugcuagcgcugugucccaacgacucccgcagcuccggggacccgcugcgcgcgcugcugcugcuaaaggcgcugcagggcuuacgugccgaguggcaugggcgggaagggcgugggagaacggggcgcagcgcggggacagggacagacgggccuugcgcgcugcgcgagcugaguguagaucugcgcgcggagcguucagugcucaucccggagaccuaccaagccaacaacugccaaggcgccugcgcguggccgcagucugaccguaauccgcgcuacgggaaccacguggugcugcugcuaaaaaugcaggcucgcggggcugcccugggccgccugcccugcugcgugcccacugccuacgcgggcaagcugcucaucagccuguccgaggagcgcaucagcgcgcaccacgugcccaacaugguagccaccgagugcggcugccggugac

SEQ ID NO: 5634 - RNA, 2638 nt, Mus musculus
cagccaaugaacgagaucacuuuauuggauuugagccaggggaggugacacuauuuuuccagacuucaaaggagacugcuauagcauaggucaccugaccaucuuaaacagcaauaaaaaaguaaaauagaaaccuuuauuuagaauuaaagccaacacuugagugugacaaacacagcauucagcucgaagaagcaccccgcuaauggagugagcguuuauucugcacaaucacgacauguggacuaacccaggagagggcacagggacacugggcagggcuggcaccuaguccuccucacccggguccucucucuccagaguguagaccaugaagcaagcgucgggucucuuggggacaaggggaugcccgggucucacaaucucaaagccaagaaagcugaagguucggaguagggcggcugugggagaacauagggugagagguuggggugccagaacuccccuccccaggacccucccaagcaauaccaaccucuguccucacgguucuuggggaagcagaugaaaacguggucagccuggaguugcuccucugcgaacucuaggagagcugcaaaacugaaugaagcauggagucauuagccaccugugcccaggccccaaauccccuacagcccuaaggggaaguggccuaccuguccuuacugcccucaggcagagguccagcugggagcucgauguagaggccaccaccacuccacaccgcccuccaggugaccugcuuggccuccgugagcguggacuggaugcucaggacccuggucuugucguuagacgucggcuccucugucacauucagccgcucguccuaggggagcaggguugucagguuggccagcuuacuuugccagugccaggcacccccgggcucuccacagguacucacggaguacaggaugcuagcugaaagacugugaucccgcugacuguucccucgcccaccugggaucuucaggggugggugagggacaucaggagcaccaccgaggccccggacccagguuacuacagcaauuaagggcaacccuagaacugcaggaaacaaugcucagguggcagcagcggcaauaauuaagugcccgggcuucccacucaagagccauugacaacagucaacccgagucacugccccucaccugugugacucugccccuuuuguagcaagacaggccucacaggcagugucaucucagcacuguggcccaucccacuccaugcugccaauccucccuucacaccaggucacucgcuccuuccuacccucuggucagcagcuaccagugaccccaaaguucuaccucacuaacuacucaugcucuagagucagacaaccccaagucuccucucuucccuacugccacucuauaggugucugcacagccuauauccaaaguuccuaccaccuauaucgacgcccuucccaaaccaguccccauucugaacccuucaagugauacccuccaucccacccacugcagacuuuuaacugccaaguggaccagggauuaaggucaccucacaucauacucaccacaccacaccaccuccauguccuccaacauagcucugugagcccccaagccugaccacuuccaagguccuaauucugacccaaaucccuccaaaguauuagagcccucaacacgcaaucacuaaauccaaccuaaaccucaucccagcuuccccaccugugacuuccuaaaccgacacaagcuucuuucucaacaccccaaaucugaucccauacucucccaccaagaaaugaguccucaacauguacccaagaauauaauaggauuccuccccaacagcacccaaaaucccaguauucugcaaagaacuccaaacaccgggacgagccccaccucuacauagcauacgauuuauuacccaaacgcccuacagguaaccacaaacacuucgccaccugacauuagaacuagcucacauauccgagaggcagaccccaaauucgagucuccaaucucuucucagaucccuccccaaaucuuaggcucaacucacaacccccgaauccgauucgaacccaaaaucgaauccuacauuuucgcgaaauguucccgguccuccaaucaaaccaaacccuauuccucaaccugagacucccuaauuccacucgaaucccaaauccgaguccgcgacccgcuccacaggccccgccccgccccgccccgcccccugcgcgauuguggccgccacaaaggggcggaucucgcgcugccgagacuuaucuggcgccggaggccgaccccgcuccgggccugcgcguccugcgcugcccucuggggccuacgcggacgcuguuucuggaagguucgcggcggcgggggcagggcucucaccucucgcugcugcagccgccgcggcugugcugacuaagaagcggcauggugcggcuggcgugaagcguggcgcugcguuuguccccuuccuucucucuggcgaagcaguggcuguugaggauccgcugcagggaggauuucaccauccggccgcugggguccgaaaccagcaaaaaccuccgcugcacuucccgcgccgccgccgcugcucgccguucgcaaaauggcgccggcgccgacgcccacuuuua

SEQ ID NO: 5635 - RNA, 664 nt, Mus musculus
cagagcaucaucccagugagcugcguuacugaccgauguaaaaaaauaaauauucuuuaaaaaaauaccaugugucagugguggggaggugacaggugaaacuggcuggcuccuggcacuaaguugcagggaagcaaguuuccaggccuugccaucgagguggggcacagaggggccacacaguauucauacaggagaggccaggagcauagcuaguguggccacacucaugugagcagucacuggcugggaaccugcagccuuugcuccugaaggcacaacgcccacgguuugccuguccccuucagucuuaggaugggaggcgucgucccaugugugaacucgcuccuccuugguccuccgcuuuagaagggacuagaacaauucagaaucugggaccagagaagccugugaaugcccuggagcuggggacuguuauaaacccuucagauucagagcacaaagcugggccaucccugguuucaggugccaucaacuccaggagaggagggucugcccuguguccuaagagccaccacauccugacaggcuagugggccccacagcacucuuggauucugaauuugauuugauuugaaaggcuucaaagaaaacaacugaaucaccaguuucauacaaaguccacccugagcuagcagccauu

SEQ ID NO: 5636 - RNA, 664 nt, Mus musculus
aauggcugcuagcucaggguggacuuuguaugaaacuggugauucaguuguuuucuuugaagccuuucaaaucaaaucaaauucagaauccaagagugcuguggggcccacuagccugucaggaugugguggcucuuaggacacagggcagacccuccucuccuggaguugauggcaccugaaaccagggauggcccagcuuugugcucugaaucugaaggguuuauaacaguccccagcuccagggcauucacaggcuucucuggucccagauucugaauuguucuagucccuucuaaagcggaggaccaaggaggagcgaguucacacaugggacgacgccucccauccuaagacugaaggggacaggcaaaccgugggcguugugccuucaggagcaaaggcugcagguucccagccagugacugcucacaugaguguggccacacuagcuaugcuccuggccucuccuguaugaauacuguguggccccucugugccccaccucgauggcaaggccuggaaacuugcuucccugcaacuuagugccaggagccagccaguuucaccugucaccuccccaccacugacacaugguauuuuuuuaaagaauauuuauuuuuuuacaucggucaguaacgcagcucacugggaugaugcucug

SEQ ID NO: 5637 - RNA, 2135 nt, Mus musculus
gaaggcuuaacgaguuuauuggaaugucucuguaguagaaauuuuuaaaaauaugcaagcgaucugucuugcucagcacaauauuaaaaauagaugugcuguagcugcgaagucccgggcucgagucccgggucccgcggcgagggucgucgcccuccgcugacuuaugcacaguucacugucccgcagggugggggacgccucaccccaccccugcggcgguguccagaccgucugcggcugcgagcagaggcuggcugcaggacugccaggccuuggcucuaaagucucagucuccucuugccugaggugcccuccuuccgaccucggcgaccaccuguggugcugcuccuggcuccacagcccagagggcgggcgggcgcacgugccccucuccucaucucagucucggugacuccgccccucccagaagguaucacggguaggguagccuuugagggauuguucugggggaugagggggcugucaaauauguauuuuauuuacuuuuuuuaggggacagcaacucgacaguugcuuuagauguuuggagugggucucagcguuccucuagagagauauaggggacccauugguuauugccucugcucucuucacaguaacuggccaccuccaccaagccuuggcuuuuccaggaaucuguaugacaguucuguuggagggagaaaaagaaggguuuagugggaguucuaggaguuagguagggagccucuguucagcgccaggggcccuacuggggaaaaacaggcuggcucaaaauagcugccagggugacuaggcagcccacgggacaugccaagcauggcugggcacugagcuggugcuggaccagccagcccagcuauguugacaaacacgggacccaggugaccaggacggguggguggggcggggagagagagagacagagacguggggggggggagggcucaccgugaccaggaggcagugcaggucucgggcuucgguugugcccaaugucuccgccggcucccccaggagcugcgccagccucugcaugccugauacccggacgaugucaaugucauugucgcagcagaacgacuggaucagggugaagugaaucugcagagcgauaucauccuccucuucuucgucuauggccaggaggcacaagaccacgcugucggggucccugcaggagagaaggagugucagggggucgucagaccaggagcgggugucaccgugcacggggugggauagggggauaugagcuccaggaaccgcaggcgggaaggguggacaagacccaucgugcaucaggaguguauauaagaacagccccccagccgcaguacugcacgggugcugggguggccgacuaugcaaauacugauggcggugggggaggaagcacauaguccaaaguuacugggguugccuugucaaaacaaaaaacacaaaaccucaaacuugcgaagucaggguucugcagcgacucucuuuccuccuccccaaaaaaaauucucugagaaaugucgcccuccacuccccaaaaccgagagcgcugggaaagucccccaaagccccgagcccuauagggauguuggagcgcgcgugcaucagaggggcgcccccacccacgcccgagaaaggggggugcugacucacacauucaucaguuuggccgccucguacacccccacggugaggcgauccugacgcugcgcggccaccagcagcugcuccaccgcggcagucaccgccugcauccuaaaaggccaaauggggagauuagccgaugacagccccgcagaccucaggcggcgggcgagaagaccucagccucuguuguacucacuucugaaccgcguugucgcucgccaccagcucuuccagggucaugaugcagucacacuccacagcggacccccacggaagauccccaagagcaaaguacaaguccagauacgaacccaagaggcaaaaaaaccuucccgugcgaccagaagugucggaggccuuccggaggcggugggacuucccuucccaagaaaaaaguagggguaaaaagaagauugcaaaaucccccucgaaauuaauccaagaagacagagaugaacgcagacccaggguugcugcggagugag

SEQ ID NO: 5638 - RNA, 1759 nt, Mus musculus
aguccacagagcagcacagggcagggcccugggacccugaagccaccucaggugcaaaaauccaggauggccuuggcgggggagagucugggggcaggggcacugacuaauggggguggcugauuuaggggcugcaggcuagggguaugaugaugaacgggcaguuuuagggacucaagggaauggggcuuccugggagucagggucucagaggagggaaggagucuugagagaggggcuuggucacgagggugcagagcucuguggggggcagugaaggaccugggccucagcgggcaguucgcacaggguauguaugaggggaccagggcccagaaggucccaagugaugcucugcguggucagguagggguggggcgaccgggagcuguccauggugaccgcuggacucccggggacaagcaaagccuggugcgguggcccgggaggguggggccggaacaaagggaucauggugguuuggggaccccuccccacccucuguggccgcggcugccccgccgccuaccugggccgcugugguccccgccgcugcgcugcuguccgcgccgccgcagucccgauguccccgccccagcugcgcuccgccccgcccgccccgcccgccccgccugccaggacccgggcccgggcagcugcagccccaggucaccgccaagcccgcccuggguguccaucagcaaccgggggcaugcagagcucugggcaucgugacacccacacccacgcauaccacguggcuaccuguaccuuagggaacgcgggugggugacagggcccaucgugugagguccugaagacauggugaccaauagucaggggucgccccaacugcaaaaagggagaacuggaauuggggggggggggcagagugauccagcgacgggcagaaggaggugauggaagagggugugagcugaguauauaaaccuucauagauuaagaugucagccacacccgggagccggaggcaggagaauggcuaugaguuuaaagccauucugagauacagaguagagaccccuaugggagaaggaaggaaggguucgggaagaaggggagaaagagaggaauaaaagacaaaacacuaagaacccuauuauugguguuguagcuuggagggccaaucgauuccuuggcagcuaugggauccauccugagcguggcagaggcccagccugacaugucgacuucgcaucccaacacuggaggcagagcaggaggaccaggaggucaaggucagccucuacauaguuucuggaaaaugugagacccugccucaaacaaacaaaaagaggaaaagagaaaaagacccccgauguucaucugguauguggucuagggaagccaucuugccaagccugcugucgcccuggcuccacccacacacugcaaggaaaacagaacaaaaguuuacuuuguaucauuaaauauuggggccagugagagcgcucagaagguagaggugcuuucuuccaagccugacagccuggguggcucccugagacccacguggugaacagagagacccagcugagagacccagcucuaacuaauuguccucugauuuccacacacacagaaacugauaaagaaaaugucacuuaaauuuuguuuuaauuuuuagauuuauuuguauuuucuguguaugaaugcuuugccugcauaccugaugcccucagacauccaaagagggcaucggguccccuggagcuggagucacaaacaauugagagcc

SEQ ID NO: 5639 - RNA, 10193 nt, Mus musculus
agcgcaugcguagaugccgucucaggauuuguaccggagguucucgcgggggccucgcuggcaccgggcggggacucgauggcugaggacgguacgaaugggccggguccgggacguuguguugggacccaagggacacgcgacgagggcgggagcgaggggagggaacccgcgaggggcauggcuuucuccaaucucgagggguggaccucuaggaauagcaacacugcugcgcaugugucagguuuccggcgacaccccugaguuccggggugcuggugggcaugauugacaggugaggaagcuagguaggaauuucaagagccggacgcuauggaaguguuucgaguagagaaccccacgcugacuuggaacucuguuuaauccuccagccucagccucuugagugcuaggguaaagggcaccugacacuguauuguguuuuauaguuuuguacauauauauauauauauauauauauauauauauauauauacugcuugagagauguuguuccgcuucuuuuaguuauaucuaugcuuguuucugagaggggugucacagugcccgcagguaccugagguuccugaagagagcguuagaggucaucaggccugggaguuagagauacuagugagcacuggaaacugaacuuggagacugugcaaguacagcacccacucuuaccgucucagccaucucuccagucacuugagcuggucucauggaacucaggcuggcuuguaacucaccaaguauuugaguaugcucuugaacucguagccgugcagcccuccgcuccccaguguggggugucagguuugcucuaccaugaccaaauuguggguagaggcuguagaugaccaaagaaaaucuggggcaggggcauugugugucacauaugcuggggaagccucuugggagaagucggauccgugauaaacauuuccuguuuccucugucccuccagcuccuguguccccagaauccuucagaaggccagccgccauguccacauucaggcaagaggauguugaggaccauuaugagaugggagaggagcuuggcaggugaguggcgugggaggugggugcccuuccucuccucagugucuugaagcaguggccacagaguuuucuggugguaccacgccagacuucagguucccagaugacagggaaccugaguuccuuuucucucguguccucuguggagagagacacagagaccuguagcugcugccccugagccggggacagugccucggagcauugucugcuaugggauuguucucagcucgguuucuucuuuucccccaugagacagagucuuacuauguacuccuggcuggucuggaacuugcucaucacagagauccuccugccucugcuucccaagugcuggagcuaaaggauugcaccaccacccuggccuuggcugauuuugauuuugguuuuuuaaaggcaggcucucaugucccccagauuggccuugaacuucuuuuauguaauuacuauauuuugugugcauaugugucuuagucacagcacagcuuccuggagucugugcucuccucucccaugcgagccaguuccagggacugagcucagggaguccuuggcagcccugggugaugucccaccacacugcacaggcuguuuuacgacuugcugggucugccuuucuugaguucuguacauggaugcuuuuauacuggugucuccccagugccgggaugguucaggacaccguuuucuguuugguguuucuugagaaagccagauucucuuucuaggcuagcucucaugccuguccgugcuuuggagcccccucccucuucccccucccaccuccucaugccaggcccuuccucuuucuaaggggcuucagaccuuauuuggugaguucugggccagccuucugggggcaucaaggcccgcccuaugaugucauccccauggaauguaaauaaccuucccaguacuaggcaggcugaggaggaguuuuccugccuagggacccugaaccacuuccuucuggaguuccccaccccagcccccaccccugagaaccucccggcugccaucccaguagggcuucagcgauguuccugucaugugcuggucacaucuaugagccuacugcuagggaaguagggacaucucgugccagggaugugagacucagacugaaacauaagaugggacacuggagaggcggcucagugauuacagcaccagcugcucuugcagaaguccuagguucgauucccagcaaccacauggaggcucacaaccaccugugacuccagcuccaggagucugacacucccacuggucucugugagcaaaacuuguaaaaacacagaaagaaacacagaggccuucucacauaccacacaccaacucacccugacagguaaguauggacaauuuagcccuuacguagucaacacucugaggguggguccaggauccugagcuccucacaggcauugaugcucaucuagcaaaugaggauguauuugugcauaacccaugcauggcacccuguguaauuuacauaaaguguuuaugguguugggguagguggacccaggccccaggccugccacucuguacacuugcugccuggaucucuguuuuuauuuuuuuaauuucuauuuugacuuauuaugaauacaguguucugcugcauggaugcuugcgugccagaagagggcuccagcucucaauacagauggcugugaaccaacaagggcagucagugcuuguaaccacucagccaccucucccgccucugccucccaagugcugggaucaaaggcgugcgccaccacugccgggcuauuuguuuuuuuuuuuaagauuuauuuacuuauuauauauguaaguacacuguagcugucuucagacacaucagaagacagcauucgaucacaucgcaaaugguugugagcuaccaugugguugcugggauuugaacucaggaccuccagaagagcagucagugcuccuaagucaggagcaauuucuccagcccuuguuaauuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguagccgggcgugguggcgcaugccuuuaaucccagcacuugggaggcagaggcaggcggauuucugaguucgaggccagccuggucuacaaagugaguuccaggacagccagagcuacacagagaaacccugucucaaaaaaccaaaaaaaaaaaaaaaaaaaaaaaguuugcaaguccaaccuuguuaauuuuuaagagacauuuauuguauguguguguagcagccacagcauuuguguagaggucaaaggguggcuuacgggucccaggugcacaagcaggugaacucagggcucuguccuaugucugucauuccuuaacuucuguccagcuccagaguccuuguuuuuaauuggccaagugagcaggcauggugggcauggcugcugucccagcaacgaguagguagauacaggagaaccuggaauucagggccauccuuagcuacacagggagugaauucaaggccagccugggcuacaugaguuccugccagaaggacaaaucugaugauagcucaguguaaaauauucacucuacaaauggaaagccuuuagcuuuugucccagcaauagagaccaaaauacacccauggguccugccauggagagagaggccuuggagcuccagcauaguggaccagcgagcuaacagugugaaugacgacaagcagcugaggggcugcuuggaaccugccgugcauggcucuacccuucccuugcccucugcucugccagcuguacccacccuugaguagccuugaaugugcaccugggaccugcaggccacccucugaccuucacacaaguccugaggcugcugcgcacacauaugcaugcaucauuccuggcagaggugggcagacagacaggauggacacggucccagcacaagugugggcugacucagguuggcacccaucacugugcuggaagcugagaugcgcccuccccugggcucuugguggucgugugggcuuugagccgaguccuugagcugggugcaagugugcgacgcucaccccagcauuggaacaucauaggccagaaccagguacugggcacuuaggggcaccugccugccuauggugaagcuccagcucugugucccucacuccauguggcgggggccgaaugcugucccuggcugagguggggauggugguggcacuugccucacagggccauugcauagaugaagcucuugcgugcguuucugccagguuagcaccccuuggaggaggccaugucacucuggccucuccuccaugacccucaccuccccagugagcagcuggagucagucugcugucgggguggugacucugugggacuguugcuguaucuguugaggggaccugaugagugagccauuggguugcuugaguccugggacugucugguggcucucuucccccagcucccuccuggcaccuuugaugcuuauacaguggauagacacaggucccggugcaggacaggcucuacaggugcugcccaggccuuuuucccccacgugcccuuggucuacccacuguggguggcugcacaccaccaaauccucuccuaagauacacagguuugcaggaguagccacacggauucuuucaguugguugguauuauuauuuugauuuuuguuuuguuacuauuuuguuauuguuuguuacuauuuuguuuuuguuugguaauacugguuuuacuggaccuugauauguagagcaggcuggcuuuaaacucagagcgauccuccugucuguguaggccaggcgugcgugucugugcugcugcuuucauccacggagcggucucaccaucuccauguuguaguuucaaacucccuguguagccaaggaugaccuugaaauucugauccuccugccuccgccucucuaguacuaugaugauaggcaugcucuguucccaaaacauuuauggguuguuuauucaaagauucacuuauuauguauacaguauucugccuacauguaugccuacauccuagaagagggcaucagaucccaguuaggagccgugugguugcuggggauugaacucaggaccucuggaagagcagccagugcucuuaaccucggagccaucucuccagcccaaacaucuuuuuuuuuuuuuuuuuuuuuuuugguuuuucgagacaggguuucucuguguagcccuggcuguccugaaacucacucuguagaccaggcuggccucgaacucagaaauccgccugccucugccucccgagugcugggauuaaaggcgugggccaccacgcccggcuucagcccaaacauuuauguuuugagguucugggaaagcaugcugcugucccagcugcugugagaacgugggcucagaagcugaggccagccuggccagacucuuugucucauucuaaaaacaaaagaaccaacaggucaaagguaauuuguuacaaacuaacuugugugauuacagccaccaccuugccagcccucaggaggcugaggcuacuaaauucaacgcuaaccuggguuaugugguaagguuuggcuguugagacgagaagucuuguagcuuaaacugguggugugcagcucuauuccugggcuccacauagggagccaauaacagaccaaagcaagacaccaccaaaguccagugggaaauuuuaggaggagaaaugacucagacagccaaggcccaccccagcaugggugacagcucagaaaccuggaacccuggagcaaacugcacagucuaugggcaacuacaccaugguuaucuuccucuuggggugguucaguuccccugauccucucccaggcagccuggcugcucugagucaaucagaguccuuacugcuuauguguuuuuuuuuuccuuucuggggggguguauguuuuauauugggaggggcagugcaucuggucagcuucagggacuuccugaaacugcugagauguuugcuguuuucaggagcuuugcucuauaggguagguuucauuuuagacuacauggcccugggcuugaauugagauguuccugccucugcuccuguauuaaagacguggucaccacaccugacugagcgauaccuucuuuuuuuuuuagauuuauuuauuuuauguauaugaguacacuguagcuguuacagacaguugugagccaucaugugguugcugggauuugaacucaggaccuuuggaagagcagucagugcuuuacccacuaagccaucucuccagcccaagggauaccauuuuuaugucaccuuguuuuuuuuuuuuuuuuuuuuuuuuuugguuuuuugagacaggguuucucuguguagcccuggcuguccuggcacucguucuguagaccaggcuggccucgaacucagaaauccgacugccucugccucccgagugcugggauuaaaggcgugcgccaccacgcccggcucaccuuguuuuuuuuugcagacagggugucucacugaaccuggagcuugccaaggcugcuggacuccuuggucagggacuuccuucucucccccagcacuggaguuaaccauaccugacuuuccuuggguccccaucagcccucucuucccccaagccauccccaaagugucaaucauuuggcucuuugagcggaucugcuguuuugggaaaccugugguacaaacgcauagaggcuggguacagaguccuggcuuccuccgggucugcggugcuuagcugucuccuccccugcaguggccaauuugccaucgugcgcaagugccagcagaagggcacgggcauggaguaugcagccaaguucaucaagaagcggcgccugccauccagccggcgcggugugagccgggaggagaucgaacgcgaggugagcauccugcgcgagauccgccaccccaacaucauaacacugcaugacguguucgagaacaagacagauguggugcugauccuggagcugguguccgguggcgagcuuuucgacuuccuggccgagaaggagucauugacggaggaugaggccacgcaguuccucaaacaaauccuagacgguguccacuaccugcacuccaagcgcaucgcacacuuugaccugaagguggcgcacguuugugugcgugggcgcgcggggagggcggggcagggguaaccacgagucaacacccaaugcugucccgcagcccgagaacaucauguugcuggacaagcacgcagccagcccccgcauuaagcucaucgacuuuggcaucgcgcacaggaucgaggcuggcagcgaguucaagaacaucuuuggcacacccgaguuugucggugaggggcaggugugggcacugcccaggaggguagguccugcacagccacagccucaccugccccaacaauccugucucccacagcccccgagaucgugaacuaugagccacuuggcuuggaggcugacauguggugagugggcucagcgguggcccuggcccguucucuccauacuccccgugcuccccuauucuccccgugcuccuuuauucucuccuaacugcacccaaccugaaggccuuagacagcuggugagggugugggcacuagacagcagcauggaagggcugaggcccccugcucagaccccaaccuaucauagccugcauaggcucugcucagucacacgggacccaggagcucgcugccgccagacagaggguccugagguucuacuguccuggcuuuagcccagaugcucaggagacccugucacugacacugaccacacucuguagaguggggcccuauacccuggguguggagcugccacggccauucugaccggucuuuucugcccccuacaggagcauuggcgucaucaccuacauccugugagugccugagaggggccuaacuaagacuguaccugcuagaggccaggaucagggcugggaccgcuacuaaugcacugggagauagcuagggaaggaacacuggcucuaccucuggccacaccccuagcgcccccacuguggguucuagaccccacccccgaccacacccucacugagggauucuaggccauggcuuaaucucagcuccucaauaaggauuguugacccuguucuaggguuugcccacucccuucccuggagauauuucccuucucaagggagccaguguccuaaagagucaggaauauggggagauaucccaguaugccuucuauugugauaagaccaaacccaccuuggggaggaaaggauuuggucauuccuaccacagucacauuggaggaagucagggcagaagcgagagcagaggcaggaacuguggcgggacacugcuuccuggccugcucagccugccgguuuuuaugggcgggcuuguucucuccgcuggcaucgcucacaguggccacagcccacucacaucagucgucaguacccuacaggcccgucuaaagcaggcagacucucacuugaggucccuauucccagaaaaccagugggaggguauggggugucagcccccuucagugacucccucucuggcuugccaugcgcccugucucucugcagccugagcggagcguccccauuccugggcgagaccaagcaggagacgcugacgaacaucucagcagugaacuaugacuuugaugaggaauacuucagcagcaccagcgagcuggccaaggacuucauccgcaggcugcuggucaaagaccccaaguaggcggcccaugguggcagccucaguggcuggccacaccaguuuuauuuucggggucuuuuuuguuguauuuuugagacauggccaacugagccaggaccucugggcaaaagugacuacaaaucuuaaaacccuacacaaguaaccacagcucuuagaaccucaccagagugguagagcaagucuacucccauuccccaggcggggcggcaggggcuuuaggguugauagggcuacagcuuguguggcuucuccauacacugggauaggacacuuguggaagacuugggucauuguggggucaccugacaugguugccuugaugggggucaugcggggucccuuggguggagugaccagagggcugacccucccaucccgcaggaggaggaugaccaucgcacagagccuggagcauuccuggaucaaggugaggcuucuggaccccgggaucgagcuccggggagggagggcuguagacgugggccccugccgcagcucugcucuucacaggugcgcaggcgcgaggacggcgcccggaagccagagcgacggcggcugcgcgccgcgcgccugcgcgaguacagccucaagucccacucgagcaugccgcgcaacacgagcuacgccagcuucgagcgcuucucacgcgugcuggaggacguggcggcggcagagcaggggcugcgcgagcugcagcgaggcaggcgccagugccgggagcgcgugugugcgcugcgcgcggccgccgagcagcgggaggcgcgcugccgcgacgggagcgcagggcuagggcgcgaccugcgacgccugcgcacggagcuggggcgcaccgaggcucugcgcacgcgcgcgcaggaggaggcgcgggcggcgcuguugggugccgggggccugaagcgucgccugugucgccuggagaaccguuacgacgcgcuagccgcucagguggccgcugaggugcaauucgugcgcgaccuggugcgugcgcuggagcaggaacggcugcaggcugagugcggcgugcgcuaggcugcggcacccccagaccccgacccacccccagaauaaagcugcuuuccacguacugucgccugucucccacgccccgcagggagggugggagcgagcaaccccacgauaggugcucuccuacgccgccgaagagauuauggcucugccacaccacacaccaaggguggugucacccacaguucacauagagacgugcaaggcucaauugguaaagcugaaucucaguggggacccgcaguaucacacagcuc

SEQ ID NO: 5640 - RNA, 6647 nt, Mus musculus
ccacuccacacuccacaugguugagggcuuccugaaggaaugggugauggggcugggcuuuguaggauaugaaggaguuucaagucccaacccacauuuaaauacccggccuugcucaucccugugcccacccugccggguggggucagugcgggugggugaggucacacagcacacccagccaccaaggcccagcaccugccuccugucccccaggaccuacaagcacgaggcccugaggaagaaguucacaagagcccgggauguggaauccucugaugacgagggcuaugacuggggcccagccaccgaccugugaccuaugcagucaccagcgugccacaagcccucaagcuucugaccacuuaauaaaucuuuaaaaaaaauuuuuuauauuagaaaauaauacaagacugaggacucuuuggucccugccagugaaggagugacgguggcagggaugaaggcacacauggguggggcagucauagguauacugguuguuccugucccgugagcagucgguagguggcagcuggcauggucuugauguggaucuaggggucagagaugaagagucagguagacgggguugguuuggguaggacaggaucaggggugacggggucaggugacucccacgcacuucucuugucucugugagcagcuggaugaugcgcgcauggggcauagccaccacgcucugcccguugaccucaaugaugcgguguccaacgcggacuccaccacgcucagcagcgcccccacgcagcaggcuacaaaucugaggggggacaacucucaggaccugccccuaggcuauaggcuagccuccacucccuaggcuguaugcuagcccauuccccacacccggccuaggggggggggguucccagccucacgauuccauccuccacacagaagcccagcugcucgcgcacguggggccggcggaugacggccguggugaccggugggcaguggauaauacucagcgucacggaugaaagucgccgcaccuccuggggggacccaccaugcugcucaggccucugcgggcaucaguuuacccacccgucaaucucccaggcaacauggggaugcaaucagugguaccauacagucacuuaacuuaggagacccuguuaaugggcuccuaugcacccuacaaggccccugggaaccccgcccacagaacuuugacucacgcgcaccgcagccuggcaggcagccagcgacagccccaccaggcugguuccauugauggcagugacgcgguccccuaugcucagggccccgcagcgcucggcagggcccccauggagcagguuggcaaugaccgcagugggcaguagcgagccccagccugauucaacuagcgcgacgcccaggccuucaccuggccgcuucuggaugcaaaccugggagcagaaccaaguucagggggcagggugugggguggggucccaggaggggcaggaccacauucaggggcagugugggagaagcugcacuuagagauagagcaggcagagccaagccagguguagggagggcucaacuucggggaggggggcagggucccauucaggggaagugugggaucaggcccaaugcgggugugcucagggaggggguggggucucaaagggggcggggccguguccagggaguauggggccaggucucgguggggugggcucagcaggccaggggauagguccauggucccuuggguggcucugugugugcuguggcagagcaagcacucaccucccuacaguucuggcuguugcagaagugguccaggucgccguugugcggguggcuggcagcgguugagggcugcgugcccaccuggcuggggucgauccuguucuccuguaggaacuggcuguaggcgaugcugaaggccuggccgauggcuugugcuaugagcugggccugugggaggacaauauacuccuaauccaucccgcagaaucucagcuccaaugcacacaccuucaggacaccucaagguuucuaagucaaggguucuuagaugcucuggagggggcguagcucacggcugcucacauccucugaguggaagacauggcacagcaucuuguagagucgccgcuggcgguccuggggaguuguccuccuggccagccgccuccgggccaucaagaccaguacaggcccaaugucugcgauguaggagauggucugcagggcaugguccaucagggcauccuguggacaugcgcugggugggcugggggccucucaggaaccccaaguguccacgacagucaaggcccagcccucuggguaccugggagucagcagccaacacuuugacacgcuugguggagauaaagauguccacuuccaccaugggcugggucucgccuucaggggccugcaggguaggaaggggacacagaaguuagaggugguugggacauggaauccaacagcccaggaacuccacccuggcucaccuugacgcgguccauggccuccugcgccugccccaugcgugugcugggcgccgggcugcgcucugacagcagcuggguggagcccagguauuucgccccgaagaugacaccauccaugagcuccuccggcccacagggaccugggacugcagaugacagugaggggugcgaccucuacaggcucugagguccccaaucccugagcuguugcucaagaaacucaugguucuguccacggcuuagcaugcacaagauccuguacuagaagacuccagaggcucagugugcgguggccagcucuguaccugccacuuucagggauccuaagaagugucaccccuacuaugaggcacccucaggaggaauggacccaaaacagguugcagggcucaaagaccccucuuccagaaccuucugaccaagagucagagcucagggccucacgguggugucgugagucccuaacauucuggaaucaggcagggcagggccagcaauuuagcucaauggguaaaggcauuuucagccaaguaagauacccugaguuugaucccugggauaccacaaggugggcagagaacuaacucccacaagugauccucugccauauucgauaaaugcaaaaaaaaaagacagaagaucaaggccgggcgugguggcacacgccuuuaaucccagcacuugggaggcagaggcaggcggaucucugaguucaaggccagccuggucuacagagugaguuccaggacagccagggcuacacagagaaaccaaaaauaaccaaaagaaaaagaaauaagauaaaaauccaugaugaucuagaauucucuucagucagccuggagcgucucaaagucuggguccucgauagcccugaaacaaucccacccaugaauauuuauuuauuuauuuauuguuuuuuuucgagacaggguuucucuguauagcccuggcuguccuggaacucucucuguagaccaggcuggccucaaacuaagaaauccuccugccucugccucccaggugcugggauuaaaggcguguaccaccacugcuuggcuuuuuuuaaaaagauauauacauauauaugcauauauauauguauuauauauauaauaauaaguaaguacacuguagcugucuucagacacaccagaagagggauucagaucucauuacuggugguugugagccaccaugugguugcugggauuugaacucaggaccuuuggaagagcagucagugcucuuacccacugagccaucucgccagcccuguaaaugccaucuuuagcucucaaaacuccccagagcagccuggagcuauccucugucaaccagugugcuaaaccagcauggcuucuagaacauucuacagcuuaugucaccucuuuggccgucuaagaucugcucucauucaguccucucuagaccuugaucaucacuggcaaacuuugugucauuacuugagagcccauuuuugggcuguucuaggacauucugauuucuguguaaaaauggacacucacccucggugacggcagggcacgaggccagggucucccggcucuggaagauaagaggugcagggcugaguccccagucauggcugagggucagaagucagaggucagagaggcgagcacuauuaccuggguacccacaggugguuccugcugugucaccaggggugcugucuccagccagggcuccggggaacugcuggagcuccugcugucugcuggcucugcugaugccccuuccauccaucccggguccccaucaggguccucuggcggcugcagaaggcggggugcagucugugcaggaucuugggggacagauugggcaggcgaagaggccucaucccucagcagacccagaaggucguccccgccugccucggccgacaagagcccaccagcaucuggguucuccuggguggcaaguccuuggccgguagcaaugugcaggggacagggggcuccaucugggaaugggccacccaggucgcuggguagagcuucuagcugcugaaccagcuccugcacacuggauguguccagcuccaucucacucagggugacagggccuccaggcccuaaggccgacuggguguuagaggggugguucucagagggcaccucggggccuuugggcuccuccaaguccaugguugggggcccugggggaugcugggguccuggcaggaacuccaugucugagacccagguucaggccggcauugucaccaagcuggaagaugagggcucugaguguggaucucguaggcaagccaugguccuacaggugacagauuccauccccauggggccugcccaggaggaaaggaccccauuuuacacagaagccagcaaagaacucaggugccugccccagaucucaggcuccagaccucagaacucaagcaacagacacuagaacugaggcugcggcuauggaacucaggcauugccccugggaacucaagcacugcccccgggaacucaggcuucugucucuagaacucaggcucuggucucaaaaacccaggcuccggacccuagaacucaggcuccagccccaaaacucaggcuuuaggucguggaacucaggcuguugccccagaauucaggcacugguccugagaacucagccucuagccccuagaacucaggcucugacccuugaaacucaggcuccguccccagaacucagauuucagucucagaacucagacacugcccuugggucacccacgggagccuguccagucccgcacggcccgcaguaccugugucuccggcccgggcaggauuguccggacgguccgcccguccuuccagaagagucagcagcucucugggaucccagcuuuggaaccggaucaucggucacugcaccauccaggacuauugcgcauacacacucucaaacggccugcugggaaauguaguccucgaguccgcucucucuccuuccggggacucgccaguguugcaguauagauaguagagcucagguucgaaucccgagacuacaagaacggaggcgaggcucaaacuggcuuuucuuuucuaaaaucggguucugcaucacuucagaguguaacggcugagguaggacaugggcagaaaccagggaugguaaagagagccaugacuugaaaauuuggagugcaaaggaaaagugggaauggaaguuauugaggacggacuuccacuuuguaucccaguaaggaucuauaacgguacaaucuagacuugaguugacacuggaauuugcaucacgguccuacauauagauuagggacaaugauaauuccuaaacuuaacugugugaucuaaaaagaguucaccugguuagguuuguuagcaaugagucuagaagauucuaguacuagucuauuuauucuugagagucucauguagccuaggcuggcuucaaacuccugauccuccugccucagcuuccugugugcauccagccuccauuucugcuacgaagccccaaucaccaaaccccacuuuuuucuauuagugaauagaacacauacguaucacuauguagaguaggcuggccaggaacucacaggcaucuaccuaccucugccucccaaguguggggauuaagcugggguucaucacucccaucauucucagcuacccauauguuuaagccaagaucucauauagccaaggcugaccucaaacuugcuguguaggacagaucgacccaaacuccugauucucuugccuccaccuccacaucacaacugacuguccuaacuuuuaagcuuucaaaaauuccacaagggauauaagcaugauuuugcugugacauuuaaaguaaauaaagaucuaaauacuuguuguuguugucgucaucaucgucugaggcaggguuucuuuguguagccuugguuguccuggaacucaagcaguagccaagguuaaccuugaauucagagauccuccuaccuguaucuccagaguacugggauuaaaggugugccaucaccauuugaacugggggcaagaauuuaaugaaauauucuuugaacggucgauagcuacagaaguuaaaauuagucguuagucgggcaaauuuuuuuuuaaagacuacauuucccagaaggccgcggcgccuccaaca

SEQ ID NO: 5641 - RNA, 1219 nt, Mus musculus
auuuugauuuugggaucucgagcuauaauugguagacuguagggaucacuuguuuaagauauacacaccugugugaucuucagauuauacagccagguaaucuacauaguuccagaacaucacaucccucagagaaggccuucuguguuuaaggcauccaccaacgaacacaugcguuccccucuguguucucccacccugggugugaccugucauggauauuguauggcuuucuuguuuggguccccuguguugcuccagugugugggucaccgggacaaggaugcacugugcaguaugagagcagcagaccauucgcuuccuuuuugaggucuucgcacagccgccaugucucuguccguugcugcugcugcugcguaacaggcaccuccgauguggaagccccacaccacacucgugcaugcaccuacacagauccccaugcggugugugaugccucucuuggguggccagaagugggaucaugucccaggccucuuuucagagacagacaggucaccuguacaugcagcaugggagccaccaucagccacugggcccuucacaguugagcaguguggcugugcgggggaugugugagggucucgcucagcagugggcaaaccuugcaggagucuggcagaaggagcuacggagaacacagcugugccggggcaggauggaguagggcaggggccuuuguuggcuugaggaggcagagaggagggaaucagggaggcagcaggaaaggaagucucgguauaacccagucagcaggcuagcaugagcucauggauagcucccaccucugcuggccccaggccuugcucucugaggcagagugguggcagggucaagggccugugaucucccuggcuauaguuucuguuuccuguccauuccagccccuuuccuuuuuccugugcccagaccucucuguccccccauuccugucacucuaggaucaccuguaaggaaugucugcaggugaugggcauagccuguuuuacagauggagugaccuggguuguguccccaggcagugcgcaguugcagcccaugugacaggugcuugggaugauggggacacagcuuccgaccuccccaggagaaacccgcuauagagagauucagacucacccgaggucacccagacguguggcagcagacauuggccugaagcuugagggguauugucaccacuugccugggugcugcc

SEQ ID NO: 5642 - RNA, 5057 nt, Mus musculus
uguuuacgcgcgcgcaugcgcggcgcgggccgccaaaugggucgggacucucgcucgcgcucacggucugugggucgcaggggucggaagcagcggagucgaagccggggccggagccgcagccggagucggagucggagucggagucggagucggagccggagccggagccggagccaugggcggagcagccgaaggcgacgggaacacgagcggcggcgcgaacgcaagcggcgcagccgagggcgcaggugagcguccugggggcugcucgggccugggagccgagggacaggcggggcaguauccgagaugccgggcugcgccggggcaaaggagacuuccggggaccgcgggccaugagcauaggggaccgaaugacuccacucgccaccucugcauucauagacauugucuugucccgggcuggccuccugcgucagccucuggaaugcucgggauuacaagccauugccucacaguuaagguuuuuugcauuuccucauaguuaauucugcucaguugacagcccuucuucucaacuggcaguacuucuaacaaguugaccaaagccuaaucaggacaccguucauacagcacuggagauacaagcccgaacagccacaucuaucuuuuacuguggguacuggggauucgaacucauguccucaaaauacuaccuggugguauuccucuuucgugguuccugggcugucagagaguccaucuauugggccucucgucugucauuucucaucccuucuaccugucaucucagcaggacuugacggcacuguacacaccaguaaccccaacacuuaggagacagauaagaaccagccuggcuguagagggaguucccaccugauagcauuguagaugucauauuuaaaauaaaacaagcacucagaaagcagagacaggagggucucugaguuccaggacagccagggcuacacagagaagccagcccugucucgaaaaaaaucaaaaauuaaaagaaaauaaaaacuacauaaaaaagaacuacucccucacuuuuaaccuucauuucucuugcuguauugucuguuauggcccugggacuuguguagcucuacuaugaaggacagccuagcucauguggggagcaaugugauuuacaggccggugaggcuagaauucuaggcaaguaccucagcaccuaggauggugcccagcagcagccagcauugaacaggucuugauguguccuucccacaggucagauucggaaggagagcagcggcagaagucuaggaggcgaagccagagccuucgaccaccccgauggcacucacagaaccaguccucaugcucugacucgggugaggagcgggcucagggcuccugggcccguaagggucacaggcgcucgugguccccggggucaucagcgucuagcuuggacuccccaagacgcucccggagucccgggacagcuacccuggcccugagccagcagcagagccugcaggaacggcugcggcuucgugaggagcggaagcagcaagaagagcugcucaaggccuucgagacgccugaggagaagcgugcgcggcgacuggccaagaaggaagcuaaggaacgcaagaagcgggagaagaugggcuggggugaggaguacaugggcuacaccaacaccgacaaccccuuuggagacaacaaccugcucggcaccuucaucuggaacaaggccuuggagaagaagggcaucagccaccuggaggagaaggagcugaaggagcgcaacaagaggauccaggaagacaaccgucuggagcugcaaaagguaggccggccucgcacgcacgcacacuugcaugggagcucacauccucuucuggaggcuggaugugccuggacacacgccucucaccaugguggcucccuguguugcuguccaggucaaacagcugcggcuagagcgggaacgggagaaagccaugagggagcaggagcuggaguugcugcagcgggagaaggaggcagaacacuuuaagacgugggaggagcaagaggacagcuuccacuugcggcaggccaagcuucggugcgcuccucccuggccuucuauuggaaacuacaaucucaugccaaucucugccaggcguggcgugugaacucaugagacaaauccccggggagucccguuaagacagugauggggauaugggauccauuguccagaguaucuccgccucacugaaggaaccugagcacagaccuggucagauguauugaggaccccagcucaacccuauugucccaccuuggggagggccaggcucacagggccaucugacacuccuaucagucugaaccuguuuggcugguuggggcugagggucagcugugccagcggaacucuggcccugacccugccacccuauuuccuccugcagcuccaagauccgaauccgagaugggcgagcuaagcccaucgaccuccuggccaaguacaucagcgcagaggaugacgaccuggcgguggagaugcacgagcccuacaccuuccucaacggccucacuguggcggacauggaggaccuacuagaagacauccaggugcugcacauacuucggucuggguagcuguaccuggcucugcccugcccuacccugcccuauauugccucagcccuccuccccacaccccuccuucaggccccaccgcucacagcccugccccacagguguacauggaacuagagcagggcaagaauguggacuucuggcgggacaugacgaccaucacagaggaugagauugccaagcuccgcaagcuggaggccucuggcaagggcccagguaagcagugugggacaucuucccagcuccucugaggccucugcagggcauggcagcgccugaaugcuggacaauagaaugugucuccuaaggagccucagggaauggccgcagcccgagacagcugcuaucccugucugcagagccucagccuucaccagggcaagcagagucuaaauuggugugcugcccagcuacucccuaccaggcaggccuguuccugagccccggguggggagcugggaaccucaggccaugcucaacaaccugaccuacaggugagcgccgugagggagucaaugccucagucagcuccgaugugcagucgguguucaagggaaagacguacaaccagcugcaggucaucuuccagggcaucgagggcaagauccgggccgggggccccaaccuggacaugggcuauugggagagccugcugcagcaguugcgugcacacauggccagggccaggugaggcuuucacagggccuuggcaccuguguccucccugaccagugcuucuuuagugauugucaccucagcaccgggcugccuaucccgcugcuucacccaggccccuccuccucccuacccuuauacacauuucuuuuuccucccucuguccccucccaaucuggcaagagaauuguauauagauucugugcauguuuggcagugguggcugcuggauguccccaugccccauggauggcaacuguuggcuugccuugguuccucuggaugucccccauccaaguagaccaagcaccucagccaguuggggccacacugugugaaugugcccuaccaagggacugagauagugacacccuccuuuuuccaggcuccgugagcgccaccaagauguucuuagacagaagcuguucaagcugaagcaggagcaggguguggagagcgagccgcuguuccccauccucaagucggagcccucggccgcccacaggugagcagcgugacccggcagguggggcacccuuaggugggugaagaacugguacaagccuagcaggaugggccucaccucuuccuucaccacccguacagccccgaaccugaggagcgaccccccagccccgggacuucaguggacccaguggagccuguggaaccugaggaggccacagcaccaggagaagcagagggggaggcagaaggggaggcagugcugauggaggaagaccugauccagcagagccuggcggacuaugacgccggccgcuacagcccacggcugcucacggcacacgagcugccucuggacgcacacgugcuggagccucacgaggaccugcagcgccugcagcugucucgccagcagcuucaggcuacagguaggggcuggcccagacuggggaccuugucauggcgggggcagggaugggugugggcagccccaggugaccccucugcccucacaggugaugcgagugagagcgcugaggacaucuucuuccggcgugcgagggagggcauggggcaggaugaggcacaguucagcguggagaugccacugggcggccgggccuaucugugggccgacaaguaccggccgcgaaaaccucgcuucuucaaccgcgugcacacgggcuucgaguggaacaaauauaaccagacgcauuaugacuucgacaacccuccacccaagauugugcagggcuacaaauucaacaucuucuacccagaccucauccguaagcgcgccacaccugaguacuuccuggaggcuugugcagacaaccgggacuuugccauucugcgcuuccaugcgggaccgcccuacgaggacaucgccuucaagaucgucagucgugagugggaguauucgcaccgccauggcuuccgcugccaguucgccaauggaaucuuccagcucugguuccacuucaagcgcuaccgcuaccgucggugacaccugugggcugccugccccugucaggcuggccccuggacagcucccaggugggaaggccaagaggaccaggaggccuccuucagaagccguaggaaucuguggacuucagucaccagcacugugcuggccgcagccccucuggcagaucccugccuguccugaaaggauuuuuaacuguucuugggaagacugcuugggguggcagaaaggucuuguuuccauggacuuguucaaccggggaaccccgugugguuuugauacauuuaauagaaagcuuauucuaaacuggcuucug

SEQ ID NO: 5643 - RNA, 5507 nt, Mus musculus
cccacgcaccauggacagugcugcgccccgcgagcccggggccaccgagccccccgcccgcgcgcgcccgcgccuaguguuccgcacgcagcuggcgcacggcaguccgaccggcaggaucgagggcuucaccaauguccgcgagcuuuacgccaagaucgccgaggccuucggcaucgcuccuaccgaggugaggguggaccgcggacaccacccaggauccugucugcacuccacgcgaaagacaggaucagacccugggagugggguucccauagccgccgaggacccgacccaggugucaggagcccaugaauggcuaauggguggcaaucagcucaguggguagagcagucaccuaggguuuggaaagccaguuuccauccccgacacaggauaaagcagguguagugauguaaagucuguuauuccgauucugggaagguggaggcaggaggauugagaguuaagcuggucauccucagauacauaggaaacuagagggucagccugagcuacaugaggccuuauauaaaauaaaaucacuuuuaauuuuuuucaacucaauuauuucuacuauucccuuucaguuguuuguuuucuuucuuuuaauuuuguuuuucuaagacaggcagucucaucauguagcccuggccggucuggaacuagcucuguagaccagucugauuucaaauucacagaaaucuaccugcugcagccucuagagagcugggauuaaaggugugggccacccacuuaguguggguuugauuuauuauauguaggggcaccagagugggcaccacgguggagguugggcaacaguuugcaagggguuaguacucuccuuccacaugcagcccuugagaaucaaacagguucaggacuuggcagacuggccacaagccccucccacucccucccucccuccugacuccagccuucuuguccauuuucuuuucuuuucuuuuuuuaaagauuuaguuauuuauuauacguaaggacacuguguagcugucucagacacuuuagaagagggcaucagaucuuguuacagaugguugugagccaccaugugguugcugggauuugaacucaggaccuucagaaaagcagauggugcucuuaaccgcugagcucuagcccucuuguccguuuucauuccauugcuuguucgucuaauuaagauaauauuucgcuuuguagcucaggcuggccugaaauucauucuguaacccaagcuggcuucuaacuuccagcauuucccuugccuuggcuucccgacuucugggcuuacacucccgauucaggaugcuuggcuuuuuuauuuuuuauuuuugggaagccugagacucucagucauccuucugccucagcuuccuaaguuccugcuuaggaacagacagaccuaaagcacacccacagucuugccagcccacuuggucaccggugagcaguuagaggcugggggcagcugcuguuuccugcgggccacgggugcaucuggccuccagggggcgcccgcagaaggaugugcacagaaucgacuuuuguccauggcucaaucugggucccucucuuauccgaacagauccuauucugcacccucaacagucacaaaguggacaugcaaaaguugcuggggggacagauugggcuggaagacuucaucuuugcacaugugcguggagagaccaaagaaguggaggucaccaaaacggaggaugcucuaggacugaccaucacagacaacggagccggauacgccuucaucaaggugccugugggugugugugaacugggugaucaauggccuugucgaguccuaagaagacucuggggaccccagggaggguggccccgggcagacuagucacgagugauugucauuucccauagagaaucaaggaaggcagcauuaucaaccggauugaggcugugugcgugggggauagcauugaggccaucaaugaccacucuauugugggcugccggcacuacgagguggcuaaaaugcuccgggagcugcccaagucucagcccuucacccugcgucuagugcagccccggagagcuuuugguaaggauugaugggccccaggcuugccccagggcaaugagaagcaggaaaugguauucugacucauauuuucauagcccaagcugccaucaaacucaauauguacccaaagaugaccuugggccugcuuugcaaugacuucgagaaaggaggguugcuucuagaaaaguuauucaaacuuggcgaugugagcaccgcaccguuuuggggugcuuucuguguagugucccgggcucuucagggugcugagcaguguuccuuacucuuugucaggagcuccucaggggaggauagccagacauguccccagacaucacucagcagggucucuuagggaaagaauaauauaaaccuccaggacuccaacccugaccacaccccaagcccuucacuggaggauccuaagggaggggaggaccugaaccuccaccaccacgcccgcccgcagcuccuucacagaaguucuaggcggagcuccacccugaccacacccacaacccaucaauaggggacucuaggugggggcucuaugccugaccacgccccuaucuccucauuggaggauucuaggaggggcuccacccugaccacgccccaagucccucacugggggguuuuagaugggacuuuacccccugaccacacccguagccccauaguccuucaacagcccucaggagauuaaggcaugccaaccuugaguucaaggucagccugggucacagaagaagacccuauugacaaaagaaaauaaacaugaaaaacaguccacacaaaacaggacacaucugucaccgcuuugcccccucagauaugauuggccagaggagcaggagcagcaaguguccuguggaagcuaaagugagcagcgggagggaaacauuacgccugcgcucagggggggcugccacuguggaggaggcggugagugacuguugggauggcagcaauugacacccucuugucaagcccacagugcuaauggugauaaggcuggucaucccagcauucaggaggaugaggcaggaggauggucacaaguucaaggcuagccugaaccuaugaauagacccuguucucagagccgcaguuuuucagcuugugcaguggguaccgguuggagaauaggacaacaggaacagcuccgaucacagaguccaaugggugccaccuguuccuggcgaaggagcgggagggaccaucgugaccucuaacuuauuauuauugguuauuuuuuugcacuguguguaugcauacagaggucaaaggucaauaucugugucuuucuuacuccccaacuuuaauuuuuguuuuguuuuguuuuguuuuguuuuguuuuguuuuguuuuucaagacaggguuucucuguguagcccuggcuguccuggaacucacucuguagaccaggcuggccucgaacucagaaacccgccugccucugccucccaaaugcugggacuaaagguguguaccaccacugccggcuucaacuuuaauuuuuuuuaaagauuuauuuauuauuauauguaaguacacuguagcugucuucacacgcaccagaagagggcgucagaucucauuacgaauggcugugagccaccaccaugugguugcugggauuugaacucaggaccuucagaagagcagccagugcucuuaaccacugagccaucucuccagcccaacuuuaaaucuuuuuuuuuuuaauaagaauuauuuauuuauuuauuuauuuauuuauuuauuauguguaaguacacuguagcuguccucagacacuccagaagagggagucagaucucguuacggaugguugugagccaccaugugguugcugggauuugaacuccugaccuucggaagagcagucggguacucuuacccacugagccaucucaccagcccuaaaucuuuuuuuauuucuuuuauuuuauuauuuuaauuuauuaucauuuuuuuaauuuuuguuuuuucgagagaguguuucucuguguagcccuggcuguccuggaacucacuuuguagacuaggcuggccuugaacucagaaauccaccugccucugccucccaagugaugggauuaaaggugugcugugcaacuauguccagcuccaacuuuaaaucuuuuguuuuguuuuuugagacaggauuuuucuguuauagcgcuggcuguccuggaacucucucuguagaccaagcuggccuggaacucagaaauccgccugccucugccucccgagugcugggauuaaaggcgugcgccaccaugcccagcuuuuaaaucuuuaaauggcauuucuuuauuguuuuauuauauuuugcuuguguacuuugugugugcacguguuuggaaagugcguggacaggaggguggaggucagaggacauguggggagcaguucucacuuccaccuuuagagccuucuagagcucaaacccaguuccucaugccugugagacgagagucucacgaagcgcucggagcgccuugagagguggaauucuguguauuaacuggacuagguaaugugugucuugucugauucuucaaguguguucagguacauccaucacccaaucucucaucuccuuaccucuuccacccagaccucugucuccuccucucaccucuucauaaugacacaugguuugugucagggcacagaccauccacuacaccacugaagaaagugucuccuaucccuuuaguuaucacuccugggggcgagucacccaggcccuccccacuaucaaucgggaaggcgucaccuccagcaaccacaacucugucaauucucagaagcgggguuccgcacccccuaccccuaggaaccacuaauagucuaucaaucuuggggcgggcccuccagccugucacucauccacugggccauucaccuauccgcagcccagcgauguggaagcggcagcggcgcgcaggguggacgaccugcuggagagcuacaugggcauccgagaccccgagcuggguaagcggcgcggguaagcgcgggguccccggcgcgggagggugguagguggaagcaugcgccggagcucacagucagucugucuguccucccuguccuuccgucugcccuuccaucucuuuugcuugugcauccugucccucugucugucuggucccgcagcggccgcggugguggagacugcucggagcucggcgggagcccaggcuuucgcacgcggccuggacgccguucugggcgaguucgccuuuccagacgaguucgugguggaggugugggcagcuaucggcgaggcccacgacgcuuguggcuagcgugugugggagucuccaguccugggcccagccccuugccccaacgccacuccagaucccaggacagcccugagacaaggcccgccaccagaacccaacccaguucugagacccagguccac

SEQ ID NO: 5644 - RNA, 4437 nt, Mus musculus
cuugagugaaaacccauuuguuuuuauucaacacuuauuuaaaaguccagauugagugaugaaaggcgcaggggaaggggcugucggacugccccaccccuaccccggcucugccagguuagccagcgccugcgcagcagguccccuggcuguauggugagcgaccugggguccuccugcucagcaccaggggugggggugggguauccgaguccagcggccuuggcuccucuguuccugacccacuguagugugacccucccugugaggcaggcaggucucccggucucugcaaccugggaugggguucgaagcuaaagggaugcgguugagauuucauuugaggggggccuggagaccccaagguguagcuucuuucugggcggguggggaggggcaucuccugguccaagaggucugucacaggugcucgcuguaggacagagggggugaugaagaccucaagcagagccgcucucucccuucaccccacucuccccucccacaucccgcaccuggcuacccgcgccaggaucuccuugacgcgcgcgaucagucucucgugcugcgcggggucgcgcucgauggcuccaugaagccgcgccauguaaaaguccagcgucccgagggucggugucuccccggugccugcgggucaguggguuagagagaggccucccagguccguagcugggagggaccagggaauuggccuugcgagggggcggguccgaacucgggcgaggccuaauugaaaagugugggcgggaccggaggugugggcggggcugcgcaccgggcaccggcagggaggcgaagcuagccgugagcgccugccucacggccuguaguugcugcugcaaugccagugugcgccgcuccuccagcgccaacuccugcuccagacgcucacgcgcgcugcucaugcucugcguguggcgcugcagcaccgcauucugcuccucgaaggccacguucaucuuucucaggcgccgcagcucugccucgcgugcugcgggacaggagucagagcccugagcugccuccccgucauacuggucccggagugcuauagacccauuucaucucuggccucaacccgacccaucucccuccauuccugaccuuaccccugaucucaucucccuucagcccugauccuauccgcccucaauccuagaccccagcccgacccuuuucucccuccauuccuaaccgcaccguacccccaccgucuccagucuggccccaucuucccucuauugcccauuccaucccugaccccaucccuccuccaucacggcccccuggaacuucaguccugacuccagcccucauucucauuuccacucauccugcaaccaggacauaagcaccugcuaaaaucucaccuuuguuuugguccagaaacucuuccgugaagaugggcacaucaaagguggaaaagccaucgcaguccacacccugggacauggcaaugaguucgguggggacccacaucucuggagcuugggucgccuggagccccagacugcuuuuauuuccuuuguauugugugucucccaugugcaugcauuauccacagaggccagaggagguuagcagaugccccagaacuggaguuagaggugucugugcucacacccaagggggugcaggagcagugaguguucuuaacucugaguggcgcuggaguccccagcuuccugcaugccaggucagcacucuauacaugaggcccucucauggugggguggguggguggugguggggguagagcccuugguucugugcauucugggcaaugacuucaccacuaagcuaugccccaccacagagucacugugucuccacaguggucuugcuuuuaucuauggaacacacuagcuuuggggguagguaucuucucucuuaaguacuucuggacugagaggcccuuaccuugugcccauucaggaggguguucaugagcccagaacuggaguccucuaguggggagggaggaaggcaggucagccagcacccucccaguccagaggccccaccuggacggccccacauaaaccuuuaugcuuaugaggggaguuugggcccauucaccuuuccuuuuauuguuguuggguuuuuguuuguuuguuuguuuguuugguuuugguuuuaugagacaggguuucucuguguagcccuggcuguccuggaacucacucuguagaccaggcuggccucgaacucagaaauccgccugccucugccucccgagugcuaggauuaaaggcgugugccaccacgcccggcuuuuguuuguuuuugagacaggguuucucuggguagcccuggcuguccuggaacucacuuuacagaccagacuggucucaaaagcagagauccaccugccucugucucccaagugcuggaguaaaggugugcaccacuacugccuggcucacucaccuuuuuuaauuuuguuuucuugaaucuucucagugcagaccuuguaggccucugacugcugguaugcccacagcuccuucaaguacugcuguuucuccuucucugccucauccagguaccgcuaggaggggggcagcauccucaaacuagggccagcccaaacgaagguaggcacacagauguggccagagccaggcccccaacuccccucauacugauguauucguaaccccucccuugccucccuuccucccuccaacccacagagagagggucccuucuccaggacuacuggacguucuccaccuuguucuuugggccugggucucucaccgauggggcuugcccagggauccuccuguuucugccaccccuuucucuggucucuaccugcuucucugccggcugcagcuugcuccacucggcgcccaacaucuucgugaucuccgggaauggaagguccggguggcgggugcgaaucuguucccgccucucauucaggaagcgaacauagccagugacgggggccuugggcccauuugggagaaucuucuuucuuuuuuugccuuugggccagccucgcuucuucacuggcugcaggaggaggcuguguccuugggaggggcucugggaagugugggugggggucuggggcauaugggcggggccuagucuagugguaggucggcagaucaagggucagaacucuagagaaccuacggguccugcaccaagacagccuccuagggguggggcugaagccacugacaggcuaggcugggguguggccucuugcuaggcagugggaggaucuuauagucuggauuugugagguauguguugcugagccagcggccggccaggcuuuucagauggggacucaccuccuccuccuggggccccuucucuccagcucgggaacccucgcugcgcuccugcuugacagccacuacaaaggccccgugcuggcccggagucuugccucccgcaggucuuggggacaauggaaaccagcgucauccaucagugccaaaaucauucccccauaccuacccauccccuucuugucauuggagaucacagaaguaugugggagcacgcaugagccuggaaaaaggggguggggacccagaguuugaggauccaaggaucacaguaggccacuggcgggguggggacggaggacgaggugaguugguccuggggccugggaggaagaugagauagugaggaaggccauagggugucuuggcaguucuacagggaguacagaaauccccgaagggugacaggacauggucagaaguuccuguaguggggauaagguagguaggguauagggacaggacaggaucagggguucccaaaacagagguacacagagguaccugaggaugagacaggguauguccagagaucccagcguggacaugguguguuuagggguacccgaggguggauauagggaauguuuaagaguucccaaggaugcaggacaggacauguccaggaguacccgggguggagacagggcaugaccccugguacucgagauggacacaaggcauuuccagggguacccgacgauggggacagggcuuauccagggucgggacaggcugggggaggcgcacucacgcgguggcugcgccuggcugccggggaccgugggacauggccacuccgggcgggaucuggaacagaagccggcaaaggucaggggguccugccugccaccucgaugggaaccgcagggcgauccccggggggcccggaccggggaggcggaucccggggcggggagguccucgggcaggaggccccgcgauccuuuguugcgagaucgagucccggaggccgcgccccgcagcccccgccccgcgcaggcccggacuucccggcucuuuucaccucugaaaaaacuuucccgggaccugagacgcggcgacgguccaaccaagcgcccgcgcccgcuccgcccucaug

SEQ ID NO: 5645 - RNA, 9379 nt, Mus musculus
ggucuccuguguuuuguugccuugccccaaaacugcugauggcuggagaagccccugggacacagucacuaugggguuggcugccugcaggccugugggagucauagccuugugagcuaaguggguucugcacuuaacaggaguuuaagguucagggccaccugcugcuguugacaucuguacccaaaagcaaaaugccuuuagaugugcacuagugucacaggcccuugugaccuccuguugguggaaauccugcugggcguguuccauaugcagggguaggugcagccugccuucugauuccuggcugaccuucuuggugugugugguucagaaggcaccugcccuggacagagcagccagcugugacugugaaggccaugaaugggaagggcugguauacaggucagggugcaggugagucagagaguaaggaccaaagccuacagagccagaacugcaagcagggagggccuguggcuugggcucccaccccacagcaguguccuggguaaguuggccaggacccugacuggagcaagcuuagcauguuggugaccagagagggggaggugaugucuggugagaaaacaggaacccaaguggagcgccgccuauacagacuguaaaggguugacugagcuaugagauugguuguugcuguuuauugucaugagauacacaggaugcacuagcagaaugagcaggcccugggcucugcauguucagcgaugccaccagugaucccagagcauucuccccaacccaagacuuagguauccacuuccuucuguggaucucuagaucauggcccauacuuuguggccuuugucacugugcccuuacuuggaugugucuugaggacagagaugggguggagacccacgcucuagagggcaugaccucccgcuguggggcagggaggggggagggaacacuuugggucccagccccgcaccaggaaguaagcugaggucuuagacuguggcugcccgcuucccuguugcugggauaccuuugucccugucaacaauggccccagggccuuggugacuagagccucugggcaggcagggccagacauggaaaacgugaggcgggaggcuacucggcccucuguucccucaggcacccuugaacucuacuuccccgaccaucucuaccgguggguuccugcccuuggucccuuucuucacccagaccccagauccccuaccccuaccagcagcucagguggcugggauggagguaugcaaggguuguaaguuaggcauuugcacacacccacucccaagcagacaggugcugccacucauacucccaagcagaggggucuauugauucuccugucuacaggugcugcaguggcagccaugugccugaaugcccucccuuuuuagauucuuguguguaucccgagcuguucauaagcccacagagauccuccugccuuggcacacuuagugucgccacccacaccuagcagaaaagucccauuucauaggucugcucacacuugggccuuccauggugcugaugacaggccaccucacgugggucccuugcaagccccacuccugcagccugcauggccucccaugcaugcaccaucuguggggaguuacaggcuaggcacacccuuggucccuccuucccccaacagccauaaguggcucaaggcugaggcaggauugcugccaggucaacacugacaacugccucaaacagggccauucucggcuacaagauauagacugcaggugggaaagugcacagaggagauggguagaaggggaugacucucacccagcaccuuggcaaagaguugggacaggaaagcuggcugggaccagcaggacgcccuggcucaguccccacccucccucagcaaugacuacgugucccuggaggggccccguugggcgccggccaucaaacaagccgugcgcuggaaauucacgcccaugggacgggaugcggccggccaggugugguucaccggccugaccaacucagaaccuggugaugccugguacaagcugccccgugcucuugacacuccguaccgcgaggcccacacgcguuggcacggcugcuuucagagucgccagcguggccugccgcccggugaguaucccaccuccggucgugcacacccgugggucucaaacugacacccucccuuccgugccuccccgcagccuacacacagcacuugcgggagauggccuucugggaccccgcgauaaccgcgcaguaucucaacucaggcccgcgcugggggugcaugcaguggagggacaggcaaauccguggcaaggaguucggugagcugaggggaugcggacaggagggggccggggguaguacugcacgugggucacuccacucucggaggcagagauagggggauuuuuggucccggaggcagccugggcuagcuagugucaaaagaaaacaauauuaaaaaaaaaaaaaaacgaaaaaauaaggagggcuaggccagcaaugggcagaggugcgggagcgcaggaugggcguggccuggugggcucggucagcauaaggauuugggagccccccccccacccccggccccgcagcugcagagcucguccgguccuguccgcaguggucaccaggaaccaguucggggcaaagcugcccuggcgguccgacuaugugccgcuccugucgcugccacagcggccgcgcuucaccgcgcaggacuucagacagcggggccugcagcggcccugcccggccaucggccagccuccuccggcuuucacacccgcgcucugauaaagccgugcuaccgacccguguguccguguccccguaagccaggugaucucucccacgugcagcccgggcauguguccccuacagccucccgguaggcuggugcaucccugucaaaaguggggcgaggcacaacgggccccuagggcucacucagcaagcuuggccggguacacccacccgcaggccgugcccucugauccugagcagguuggggagggggcagggugucugccugguccuucauaacgucgcccuggggagccagaggucaaggccggucucgcggguccccuguaauaaggaguggaguggcguugggaagggcgggucccagguugcaccccgcccccacccaaguccuaguaauggagacccacgguugcgaaugcggaugggccagaugaggaggcugcagagagccagagccgcggccacacccacgccgccugucacugcugucaucacccagugguagaagcugaugcaggccccacagcacagcucagagcuagggaacagagggugaaugaaggacaggagagaaagguccagcugcuggucccuggggagugccgcagugucuccugaaacugccucugugguuuccauuucaaguuccaggggacccuagacacauacccccaaauaugcacauuugcaugcgcuugcucacaguccccugcagcccacagcccugcccuuggucucuuggcuccugcacggucuccucaguccugcccaaggaccuuugcuugggcccugcagcgacacagagguucuggcacacgggcuagguucucagggagccucccagccuucugucaaacuccuagaccccacgcucaaccccaccucugcuuagcaguuaccgacaggacugccauuguccugggccagcacagguggcuggguggcucaggaacaaauacugugagguuccgaguggcucugugugcccucaguguuugcugaauaaacgaacugcccaaaguaaggaaugcaugcucuccaagucugagggacaaaaacucacggacagggaugcaggcucugcacagccaugacugccaguccguuggccaccuuauccgaaaagcucauagcaccauacacgaaggcuccacugugcuggggggacacacgggguuagugcccagaccggagguccugaccacgccccaggcucuucccaccagcccuaccgugugugggccaaugaggucagcugucauggcuagggaggugacaaggaugguggcacagccugcaccuagcagcacugcagccccguacacggccacacccagauuaucugccagggccacccaagcugcgaaggccaggaucaccagcagcccggugaaguaggucaucuaggaaggaaggaggcaaagccugagucaggcccacgcugcugggcacccugcaccagagacgcacccucucugguccucagcccaguaaaaggcuccaugaaaacuuguccuauuccacacccaagacaggcauuacuacuggucucugcucagagcagacauuacuaaucuuuuguuccagagcuuggucagacauuacuaaucgauuucccauucugcaccaggguagguaagcagucugaacacuccagcccaccagguagcugaaaggaacagagcccugagaccagaggguucaagaagccuggacucugggcuucaggccacaguaugccuuggggggggggggguucccugcccaccuccccagcagcaccugucacucacauuccucccuaugcgccgguugacuggcuucaugaggaaggaagagaagaagccacucaaguacaucaccagggggaugguggcgaugaacuucuguggagggagaggcaauggugguccagaggggcaucucaaaaggggacccaucucccaccaccuccacacccucccacaacucaccuugggcaagcugagagaauaggucagguacauggcaauguaggucugagacagguucacaaugagccuuguggucauguacagcaugccuaccugugggcagaucagcagggggacaagccaagccagggaucaguaggagacccaaugcacucccucccaccaguuagagauuuagaaacaagcugagggcuuccauaguauugacucaggcuggggcacagggaggggaggggagcgaucugugauugguaaugucugcccuggcugaggaauagaaaguugauugguaaugucugucccaguuaggaaauggagaugaggauuuaugccugcaugggaaauggaagguugcuggcgaugucugccuugguggaggugggaagucaguaaugucuguccugagaggagugauuagugaugucuguccugggagugaagugacaucuacccugagcauggaauaacaaugcauagcccaguggagauuaaugucugcucugcaggucaagcagaaggcugauuaguaaugucugcucugggugugacugagacccacugguaacgucugucuuaggugguucugguuucuccggcccccucaaccccacaacacaccugauaaaaagcuggcucccgaagccaguguuuccacagcagcaguggcugggccgcuggggccaccaggggggugugcucauuggguucguucccccagugcugggaccuguggcccuccuugguacccaaguggaagagcagagagaagauggcucccacacccaccacaagcagggccagguucuggggaggagaacaagggucagcaacggcucucccaggcucaggagcucagggcucacaugcugcccagacuuacccggaacacgggcacauccuggacuccuagcuggucacccacacugauguccugcucgccgugugcagagcccugcaagugcagcagcagccaggcugcgccguacacggugauguuagccaccacagugaacgcauaccuagaggugagggccgggccuuagcacacguagaguccacagacugcgucuggcacacaacgugugcucaguaaauacugucagcacaccagaacaccauucccuaaaguuucaagcuaguagcuguaguagccacgcccucagcccacccugccaguguccuacgaggagagacaggcuacacacccacuacagaacagagggaucacaugacaacuuggucugcuggaguuccuuugaagagaggcugucccuggagggcccagcauaaucaggucauaggaagcuggcuuuaggguacaccagggaucacagcccacucugccagccucacagaagccugaaaugccuccgauccuauagccacauucuaggccaggcacaguggugcacaucuguuguccuggaugcucuggaggcugaggcuagaggccagccugggcaaauuauugcaaauauuuuuuuaaaauacugauucaaaacauuuucuaaaaaaugagcugguugguggugguacacaccuuuaaucccaacacucaggaggcagagacaggccaaucugaucuauagaaugaguuccaggacagcuagggcuacacagagaaacccuguccccaaaacaaaacaaaacccccaaaaaacaacagacaaaaaaaccaaaaaacaaagcagaaaggcuggagaccagagggugccuguuccucucugugagucaccuggcacucauuccuuacacagcuguagaugacggauacacaguuaccaggggauaccgggcuaggucccugugcccaacccuguuguaccugagggccgugagcuccaccuucucguggucacuggucaccagcucugggaugaggcucaggugggcaaucugcguggcagcccagccaaacuggaagacgacaaugaaggguccauaguacagcaaggcagcccauucaggcguggcuuccccgcagcccaggcacgggcugaagaugaacgggaaggagagcaggacacagacagugccugugagggcacaagcgcaacacggagccgugaggggcaacccaggcaggcaaacaccacagaggccagccuccacccucugugcagacggacaccgugaggaccuguagcuaggacuggcagaaaggacaagaacggggaucccucgauggcccugagcucggggucaucgccaucacaucuacuaccaguucuaugcacuccuuccccagcugggcaggguagaguuggagccuagguggcucagagucaaagcugcuccugcgccugggcacagagcagauccugccaccguccaggacauacuggguaccccaucuuccuccauggacucagaaaaaaaaaguagauauaaucaaugcaagcgccuccagcguccaucauacccugaccacccguccuguucacccccugccuggcacaggggccuccuccgauagcaggcucuguccugccuuugcgaccuccagccccagggucuuugcacagcuaccccagaugcauccucccauccugccaaucucucacccgaaggugucagcagccccugggcuccucacacccccuccucugagcuggacuugcccagcagacggcaggcuccaugggugggugcaguuacuccaaguucuuccuacauccuaagcaaccaggccaggacuggggacacugaguccccagguggguuuaucacaguggucucucugcagcuuaagggggauauuaucacucucuggagggaaggcgauggcaccacauagcccaggcuugcccuugaacuccugauccuccugccucagucuccugaguacaggauuugugggguaugggauggcagccagggcuccaacccuuucacacuuuuuuuuuuucccagccuggcucacaccaguuuuaagaggauuaacuugaggccccaugagacagagaacccugugaaaaggucucugagccccugccuagcacugggcuuccaacuucccuuuccugcccagaggugacuucaccacauaauaugccuuggauugagaaaugaaacaacccucacagggcagaucuucagggggcccaagcacuguggauucaaucucaugaccaaaccacacccacuguuucuaagccuaguuaaccauuggccuagucagggucaggcuggucaucuccagaugcuuggacuggucucucugggccucaguuaacccgagaguucugucuaguucuggguuuccuaugagacucaaaauggugcaagauguuaaucccagcacccagaaggccagggaucugacucggaggccagccugggaacaucuccugucugucccacugugaagggacccaggccugugcaaagucaggcuggccugguaucuccuggcaaacauaagcccuucugaguauuucuuuccauuuuuggagacucaaugaaacagucaucccccugcuucagcuuuugaauauggugacaggugugcaggcugugccuugaagcccggauucuuccuggauccugagaaacuagaaauuccagccccuaggcuggcagaugccacugggccacugcugucuugaaaaaaugucaucuaggggcggggcugguucugcaaccccuaccccaggcaaagggacggagccuuccaggaauuccccagggaggggcuacaaccccagggccaaccucuccaacugucuacaccaaaugagagagcugcuggggacuacaugcugggccaccccagacaggagccacaggcgaacagaaugaagugggugggcagcaggaggaacacaggacacaggaugauagucagggaaggggacugggggggggggggcagagcuguaagacuaaagacaggguacagaauccugaaaagguagagggaacaggacuggcccacggauggcagucagcggagaggauaggauauagcgggagagagaggacagacagacacaagagugacaaaaacggggagaugagacacuggggagcagaggguaagagggacacaggaugacagucagaggggaggacuuccacagggcgacaaccacaggagaggacggacacagggcggcauucagaggggaggaaugacacaggaugacaaccacaggggaagacggacacaggacgacgguuagaggggaagacggacacaggacgacagucagggcagggaaaggcucacccgcuaggugccaggccuugcggggcccacagcgcacgcaggaggcgcgguccgccucguagcccacgagcggcgugcagagcccgucggccacuuggcccagcagcagcagcagccccgcgccccgcgagcuguacccgcgcacggagugcaggaauaguagcagguaggugaaccacaugccggcgcacaggucguugaggaaguggccgaccgcgaagcucagccgcgcggcgagggacagcguccgcggcggccccgggccugcgucguccgacggaggcgacaucgcggccgcaaaccccaccgccccacacugccgccccgcgcuacccgcgcggcuacgcugccgccgcucccgggagccgccucaacagggcggagccucggagcaacg

SEQ ID NO: 5646 - RNA, 12297 nt, Mus musculus
ucauagcucagucaacccuuuacagucuguauaggcggcgcuccacuuggguuccuguuuucucaccagacaucaccucccccucucuggucaccaacaugcuaagcuugcuccagucaggguccuggccaacuuacccaggacacugcuguggggugggagcccaagccacaggcccucccugcuugcaguucuggcucuguaggcuuugguccuuacucucugacucaccugcacccugaccuguauaccagcccuucccauucauggccuucacagucacagcuggcugcucuguccagggcaggugccuucugaaccacacacaccaagaaggucagccaggaaucagaaggcaggcugcaccuaccccugcauauggaacacgcccagcaggauuuccaccaacaggaggucacaagggccugugacacuagugcacaucuaaaggcauuuugcuuuuggguacagaugucaacagcagcagguggcccugaaccuuaaacuccuguuaagugcagaacccacuuagcucacaaggcuaugacucccacaggccugcaggcagccaaccccauagugacugugucccaggggcuucuccagccaucagcaguuuuggggcaaggcaacaaaacacaggagaccgaccccaaggugucacaaauacauauauacacacgugcacacaccauaggccacagccaccacacugggaauccccaggcaaggggcaguggagaugggguaugaagacagggaggcccaggaagcuuagaggcagccaggaagaggcagacaaggcagcuggcuagggacagggugagcugacacccacggggagggguuacagaaggcgcacacacagacaaaggguggcaaugcaaucagagucaacgcaguuaagagugucacagggugagaggcccaggucccugccagugccucccagggucuucugguuuggaguggcagcagagaggggcacaacggcucagguccccaggugacacuggguuuggggauuucaugggaucucagccuccugcucagcuguguccaauauggcuugggcagugguaacagguggcaaguguccaucuggcugaggguccccauguccccgucccagacacuggcuccacagcucacaaugaggcauuuaaugagacucuggggucuccggcucccgcccgccagaugcuucuggggaaggcgggcacagcaaggccuaugcaugcuggcugcuccaucucugccugugggcuucacaucccgccugcggggucuaucggauccgggugaagagguugagcacagacacagauuccugggaacaggggaugcaggugacugugugccagggcugugagagcccagggacacaacagcaggcuugcccaccacccugccauguuaccuuuguagagcguguuuugcugaagacauuccagaaccucagggucucaucuccagcuccggugacuauggccuccccaucaggggacauggccuauagaaggggcagaaggaccuggcuauuucccagcugcaacagguagcuucugggacccagacaaaagccaggggacauggauucugggcuagggcgcacaaggccugcggugcuugggcugaucccucuguucccacacuuggcaggucauauccaaguguaccagcagccaggggacacugaaacuuguauggagagccuaugcccugugagugaggucugguagacaggacucgccccacuucccaaauccuagguuggugacacacugguggugacacaccaguuuguuagugcaggaaggcugaggugaugaacacccucccagcaagccacaggcaagccugccacauggagccccaggaugcugacagcgacaguggccaacacucaccagguagaggacacgauaugaguggccagugagcuuggccaccugcguaagggacggguacuuccacacgaggaucugguucugugaguagccaugugugcucaccugguggagagacuaggcaucagagcugcagagggccuggggauugccugugggcuucccucauuggcauccugggagucuggaggccccuggugccucagagaugggacugaccaggaugcaugcacugccuauucuauucccccagcccaggcuggcuucauacaguaguacacacagguggcaggcagggucucagcccccauguucccacagacucccaggggcucagugcugcucugggcugggcuguuucuucaucuuccccaugcucacugugcacuuaccagcucauuggcgugcuuggaccaggccagguugcacacuugugagccugugucaaugcacugcaguggcugaccugucagaguguuccagaaucggaugcagcggucagccgugccaccaccagaugccagcaguccaugcugguguggggaccaggcaauagccuucacggcugccaggugcuccguauacugcugcacagggcuuagacuagagugguuccacacgagcagcugcgggacaagacagggcugugacagagcccugcccagggaccagggacccaaggcaggcacaaaccaggaacauguacacaccuccaggccagcucuagggacaagguccucaagaugaccccaaggauaggaguuucuaauaccugggccaugaccuguaugcacccucuaaaaccaccccuucccaucaggucacacauccuugucucagguucuaggggucauccagcuuaggugacccacagggacaggcagcuggccaccuaaggcagcaugcuggccucuugggggaguguggggugacgcaaccauaccuuguugucauugccccccgaggcaagcagcugguggucuguggaccacuuuaggccacacacuuccugccgguggcccugcagccgccgcucugacugcagggguggugugcggauaucccgcuguaggaucaugcggucacggcuaccagaugacaacuggucagcauuccaggccagcgccccuacagaguggcagcagguuaggacuggccugguccaaggcugugacccaugaacgcggcugggcaggcggguccucacccacucgugcuguguggcccuccagcauggacagcuucuucccagcagcagcgucccagaucugcacgaagcccuuguguguaccuacugcgaccaaguuccccuagggugacaguguagccaaguggccaucagguaggcccagugugagcaguuuguccaucuccuccugcacacacacucacggcuaucucugcaagcucauuuugcuguugggcuuuuuaaaacaaggcucacucuauauuccaggcuagccacacacucaaaauauuguccaggcugaccucaaauccuccagccucagccucuggaaugcugggcuauaggcugcuucuacaaacugcuuugcuuaaaacccacgucaguguuuuccagcaguggagaccccugggccacaaaagugacauuguguuaccacuuggccaccacugcuucacggggcacacuuccaucccaguagccaagcugcaguaggagcagcagucuccaaaaaaaaaggcugaggcauggcuagauggugugcaccugagcgacacuagacaaagcaagcagccauacuuagucaucugggcucugucuuccuccuccuguggggaauggagcuggccccagggccaaacccucugcacucacccgcucagaccagccaacggaagucacugaguccccuucuacagagaggucacagagccgggucaccuguuggcaggagguuagagugaggggcagauggccuggguccuccuuagcccucuguacuccucccuucuggguauaacccugaaaagcucggcccuguggugcacuggcugugaucagucagacuucccauggaggaacaugggugcuugggugcccaccuggcuggugcaugcacuccacagguacacgcaggugcccagccccacgcugagcacguugagggaggaccaguccaccaaguugagguagaagucguccugaagcucuggcgcguccagcaccuugaagggaaucuuagagaucuugcgugugggcuuccguggugaccgcagcagcuucugacuguaaugacagcaggccacugcuuagaccccuauguccccaccaccacucugagggcacuuggggacccagcccuggcuuaccuuuuguugcuaacgggggacagagaguauggggacacgucauugccaucaucuggacucgagcgcuugcugcugagggaauacugggggcagggcacuagguugaggggcuucugcagccucaugacuuagggagccaugagcaccccaaaguugacacagacccgguggaagccgcagaaggggcagaacaggucccacagcgccccagccuugcugcccccuggcucaccguaaagagccccuugugcucugguguggacggcugcagccgccgguccuccgucuguggguccugaaccuucucgaugccggcacccagcagcucauucuucagcagugcggaguaggccaggccgucugcaagggugggagggugggcgugucuguguaggcagggccucaggugagugggcucugcagaggcagggcauaggggaggcccagccagcugccaggggugcguggcgagggaugggcugacccucaccuuugccauuguccgagguggcguccuuggcuuugcgguucuggcugggggacuucucauuuuccuaugugagaggacaucacaugaggcuaugcccuccucaggguaacagaccacagggcgcccugcucgguacucacauugauccuguggaaguucacgcuccaguuggccccggcccgcgaggggaugaagcggucaccaugcuugcugggugaagacacuggggaguuggcuggugucaggguucuccgcaucucugaaaccugggagggguuugggauuuaguggcgugcaggucccccagcccgugcacagugccccuguggacagggccaggaucugcaggugauuuucugggggacguaacaggacagcccgcccacucacacagggcacuguguucucauucuggaugaugaucugccgcaggagccuucgcucauaguccugguccauggcgagugggcaggcgggcaaggcccgcagccgaggguagccugcaggugggcagaagcacaugacaguccaggccucugggacacaacaaugagaaagggcaggcugggcuuuuuuguaaaucuuuuguuguuuugagacaggguuucucuguguagcccuggcuguccugaaauuuccucuguggaccaggcuggccuugaacgcagaaauccgcuugccucugccuccugagugcaugaccuauaaaucuuauuucugggacaaggucucaugcagcucaggcuggucuccagcccucuguguagccaaggauaaccuugaaaucuugcuuagguagaugucaccaauuccaggggugacaucccaggagccaaguacucagcaccccuuagccugggaagggggucaugugcccugggaaguggagauguggcuggguggguaguggguuccauccugguucugacauuucaucagagucccagccagcccaucaugcuguauguuugcuuggugaggcucagucccuaaagggagguggggccagugcccagucaugacugaagggggaauuggggacuccuuuagcuuccaucagcaacagaaacaaccgugacccaugaucucuggugcucaugcagacagcuuacacuugagaugggaagggcaaggucagccacagcagagcccauagccagugcuuugcugggcucagcaggcugcaggccacuauuugauugcacagucuuaggagagcacacaguucagggcuccagcuucuucccacccuucuaccugccccauacacuaccguaugagugcaugugugcgacacacauuccauuaccaccauagaccccuucuaacaugagccaugagccuccccaaacccaaggcugaacacacugcccccaagguugaacugauggguuccagcaacccugucuagaccauccacuuucccuucccacacgaagcucuguacucacucaacaccaguuggccagccaccucgagcccgcccggcaccuuccccaaccccagucccuucaacagucaaagauuugugugacccaagaauugcauuccuauggccaccugagauggacggcuccacacagaagucuauacagcugcaggcucagaggaggaggaggaggacaggaacagauagacacacagcauccauccacguacacuagugugaccucgagaacaucgcacucagugagggaucgagacacagaacugucacacaaacaguaugggcucgggacaggggccaugcccaccacucuuccuauccacuguccccgagauggcucucacuauguaucucaggcugcucuggagcgugugauccuccugccucacguacacuagcugagaaccagauugcucacauccacgagacaaaaagcuaggacagugaaaggccagggagcuguucagaugugucaccugccgcuguagguugagaagccgacucugggaggacagagcuuucaggaacgcugaguccuacaccuuccugcuggguaugucagucuccuccaggcccuuacccagaugugucacaggaugcugaggcaucuaacagugcucaguacacagccaggcccaagcacacucgggagugaaggcacagaucugaugagcgggucugugccugcuccagauugugcuagcgggagccaaggcucagccacccaucucuguugugcaccuguccucuugcuuggcacuggacacaggaaggcccucuggcuucugccaccaggaagcuccccaaggaugcaaguucagcucaucuggccuucaaccacugguuacacccuccaggggccacagaucuugaaaaacugguccccaaagcuugugugucaaggaaacaagggagagcccccaccugcagccagguguggggcucagugugcuacacuguggccuuggggccaugucgcuuucuguggcguuuagugggcccuguagggugcugagcuguacuccuguccucuacccacuccaugucaguagcugaguuccaacaggcaugcauguucccagaaucagaaacacucccagugagggcaacagagguugcucaaggcacaccagugauaguggccggcugcccgacacccuggugccaccccuacccaggcacacagcaaagcaucaggccucuucaccccacucuucccugucauagcuggcaacagccaccuuccagccaugggagacuagcacagggucguggucugggcuguggagcugggucagccugccacacacacagggacagggugccugaagagcugagccauguugagaggcccaagggcagagcuacguggacucugcagucaguuccuuguagcacugcccauuugggguaccuggacacagggucucucccaugugugaccuuagagcagauguuccacagaauuuauuguugacaaaggccugugucauugggaagucccuuccuuugacaacggaggguaucuggggauacccaaguuagccuucuauucccucgaagccaccuuccggccauggagacucgcagaaggagauccugacaguuucuaucagccagggacuccaaagguccugcagcugcccaggugucugcagucaccaagucaccccacucagccagggagcacuccuccaucccugcacuccuccauccaggggucucacccuaucccagccaggcagcuuccaggcaaccuucacaucuuucagagcuggccaguggugcucuggugccccacccugcggggaaaaaccccagucacuggucucuaugugacagugcaucauucacgugugccaccugugugugaaagccucgcauacuacauccccagguuccuuaugggaggcacaagggcucuguccccugugcggcggggcacugcacugcccaucuggagcacaagggcugugguguccuggguccugccacugcacugugcuagggaugagaugggaaagaacagcucaggaagagcaacaacauguguuaucuugguuuucuguugccaccuugggaauggcagcacuggaaagggggagggaaggggcuuggauccagcucagggcagagcagaugaucacacccugcauccaucaccagcuuccagggaugcagagcaugggcaccauggcaagaggcuucuauguugggucagaagcucuggaggcuggggugaugcucagcagagugaacuagaacuauauaccagugaucaccacaccaucccgugaacacauaaagaccucaauugucaauuuuaauaaaguguagggugugagaauauuaccugcaucaagcagauaaaaaucuuuuaaaaaaauuaauaaaaaucaacuugacggugcuggagagauggcucagagauaaaagcacugacugcucuuccagaggcccugaguucaauuccuagcaacuacauaguggcucacaacuaucuguaacgggaucccauguccucuucuggugugucugaaaacagcuacaguguacuaacauaaaauaaauaaaucuuaaaaaaaaaaaauugggcuggagagauggcucagcgguuaagaacacugacugcucuucugaaggucaugaguucaauucccagcaaccauaugguggcucacaaccauccguaacaagaucaccauccguaacaagaucuggcgccuucuucuggagugucugaggacagcuacaguguacuuacauauaauaaauaaaucuuaaaaaaaaaaaaaaucaccuuuacuaaaggaaaggcuggugaagacagauaguccuagauggcucauccuccaaggccuuugugaggccaggcacaccugccaccuggcaugugggaggcugaggcaagaggauuguugaauguuucaggcugccugagccaaagugagacugugguuagaaauaaaacccagaaaaacuggugcugagaggguucaggaggcaaccccagccaagccuacaggccugcccugcagcccagggacucaugagguggauggaagaguucaccccaaaggcucccugugaggcagggacacaugcgcgcgugcgcacacagacacagacagagugcugagucaacacgugcugcuguaguggaggaccaccucuaagaccagcuccggagcauccaacguccucucuggucucaagcuccuacacacagagagacacagacacacacacacgaaauaaaaaagaauguugcacugacugcccuuccgaagguccugcguucaaaacccagcaaccacaugguggcucacaaccacccauaaugagaucugccacccucuucugaugcaucagaagccaacuauaguguacuuauguauaauaauaaauaauuuaaaaaacaaauaaauaaauguggcuggagagggggcucagccguguaaagaccacaggcaacgagcccaaguuuggccuccagcacccauauuaagugauucggaaccacccauaauuccaggugugggacacagcaccccuuuggccuucugugggcaaugccugucuuuggcaaacauacagacaagcagauacacacacauauacauaaaaauacacacagcuaggcuggagagaugguucagugguuaagagcacuaacugcucuuccagagguccugaguucaauuccuagcaacaacaugguggcuuacaaccaucuguaaugggaucggaugccccuuucuggugugucugaagacagcuacaguguacucauguacauaaaauaaauaaauccuuuuaaaaaaauaguagaauaaacacaguugggcgggagacaugguuuagcucuuccagaggaccgcaguucaauucccagcaccuacacagcagcucacaacuguaacuucaguuucaggggaucugacacccuuuuccagucucuaccagcaacaggcacaaauguaauaccuagauauaaacacaggaaaaauacccauacacauaaaaauaucaaaaaagccacacauacacuuuuuucuuuuguuuuuuucaagacaguuucucuguguagcccuggcucuccuggaacuacucuguugaccaggcuggccuugaacagagagauuggccugcuuuugccucuacaugaacuauuacugcccagcacccacauacaucuuuuaaaaauaauguuaaagguaaagaaggcuaugggcguggucagggguggagccccugucuagaaucucccagugaggggcuggggguguggucaggguggagccccugccuagaauuucccaguaaggggcuggagccuggcucauuggugaccucucucuucuaagcaugugcaaaggccuuagguuucaugcccagaaccaggaaauaaaccacaccaagacuccuccagugcacacuuagcuccugacccucuauccgaaggaagcaaagagacccuugaaccacaaaacaugggcuaaacuccucaaguaccaaauccacacuugagaacuccauuaaucuuuacaacacaugccaucccagccccaugagagcuagagccaccaacucccuuucuuucuaagcccugaucccgagagccagagguggugucuguucugggugaaucuucacuggggaaucacccucauucaaacagcaggaaggagcuaggacugggacucagcagccagaggaaugaggucaucucucagacaggacggguagggggcgugcuucccaccagguguucucaacaaggagugcaucccaccaggugcucucaauuagcagagaauuuaggggagcgggguaggaagguaaugccuauacagagguuggugucaggcuuacagcuggagacaagugaaguugguggggugauuuaagggcuuuguaggggacaauggcuuuggaucagggauagaggauggaaggaccuggacuugcauuugaagacacagaguggagguucagaucugagaggguacgugguggauuuggggacacagaaugucugugguuucuggccaugucuccccugagaugagacaccugguuguuggcugaaccacuggguguuuacggcaaauuuaguucacaauccuucccaccuggggaaugccagauuugagacuccuggacucuggagguugacucagaucccaguuuggauguagggagcaucugaggcagggggauuuacauuuggaagucaacagggugcagaugaaugguuugcaguugagucuugagugaucagcaugagacagaaugcucuaaauuuaagggaacauagcucaaaagaauacagaguguuggugacagggcgaggucauuggggacagaccgucugagaucugacucaggaccucaccugaauugggugguuuugguggaaguaguaaagggugaccugaauuugggggcgcaaggagccugaccuaggguucugagcugcaacauguggaaugccuggauuuggacauuagccgugcucugaacaaggcucugggcgaugauugcugugauggacagagcgaggucaaggcgagguugccgggugaggggacucaggguuggggugacucagggccucaucugggaagcugguuugcauucugggguucgggggaacaagacggguggugcccuggauucgaggggagcaacuaucagagcagagcucuggggauggaggacucugacagacucagagagcuggcggggucggggccgguacuggaggucgcugggaugugggguucaggaucaggccgcacuggagccccagagaaggaaggggucggcugggggggcggguccccgagucacccguguccucaccugccucgcuccggucgccagccggcacccgccgguucccgccggucccaggaacacgccgcgccuguucgaggccccgccguugcgacaggccccgccgccgcugcucacgggaaucccccggccuccgcgguagcuaauauggcggaacucaguggcaacccgacucccucccccaaucugucccgcaggccgcgcgcgcgcccgcgaccggccccgccgcccagcgcaucaccgcgccuaggcca

SEQ ID NO: 5647 - RNA, 528 nt, Mus musculus
ccauggugcggcacgagugcgcagaggcccugggugccaucgccagaccugccugccuggcugcauugcgagagcacauugaggacccugagcagguggugcgggagagcugcgagguggcccuggacauguaugaguaugagagcagccaggauuuccaguaugcagacgggcuggagcgccugcggccaccacccuaaccuagcgccuggcugccugcccuggggcugccuccucugcugcugcccuggccccggccaugugugcugugccucacauccagauuuagggagcagagcagcugaggggcccugugucccacucgccucaccuccuugcugggugcugucugcucugugguucugugucucccaugcccuccaccagcagagguggcagugcagacgcuugcaggguugggaaaguugugggggcaagggugugugggguacaccucccaucugggucaagcagggaguacaagccagccccagcgugcugcaugaauaaaauaaguuauuuuucaca

SEQ ID NO: 5648 - RNA, 2450 nt, Mus musculus
cacaccugcagcugaacgucggcccauauccagugugcuggccauggacaccuugggcaggcugcugcugcuggcuacacuguuccugacacccgcugaggcccagcaggguaggacuaggguguggagcccgcgcuggguggguguuaggaacuggggcaggggcucuucagcaucucauuucccauuaggagaaacuaaggcaaggcaggaagaggaagugaagagggcacugguggggacgagugcucuccaaugacuccuucugcccugucucugaucuaacauccuucuccccucucaacgcuguaagcuaaggccacugcccuuuuccagcugguccucucagcuccuucaaggccucucugagcuaucccccccccucgccgcccccacuucccccgccuccucaacuacuuuaucuaaaagccucaccccuuagaagcccagcuucuccgggaggcgcggaccuccuuuacaaccucugcccccuaagccccuggcagcuccuagucuuggacguucuuccugauucccaccucuuuacgccuuuucuaagccccgcccuccaagacccgccucuuuccguuaacgucuuccccucucucccgcagaccccucugcucccaacagacccuucuuuuucccucucgcagaacccacuuccccugcaggcuccccuucccccugcagacccuucguuuuuugugucugacuugucuuguccuuugcagccucagagcgccgccugaagccuuggcuaguaggccuggcugcaguagugggcuuccuguuuauagucuucauccucaugcuggccaaucgugucuggugcgccaaaggcaggugaggaccugccccugucccacgcagggccuccuugaccuccccgcccuucugugcucccucccagggucagccuggaggucaucuugcuuugcugcccuguugaucccuucugauucuuggcguucaugaccucaguuggggauacugaggcagagaacagcucuuguaucaauguuucuauuugugcagagcagaggaugaggaggcuacauucagaauggagcacauuaugaacgagaacucacagccaagguacccugugggugauuccccccagacaguccugagaggcccagcuggggggaggggacaguguccagcagguggacucugggugggacucucuagugcagauucugggucugggagaggaauagaagugggggagaguuggcaugggcagcuggaaauacagcugagcccugugaaccugagaggguccugaggaaggaagggagggcuagaaggagaggcuggggcuaccuguacccagaacugcagagaacacagcuaccuacccugugacgacgcaugguuuccuguacaccaugaccgucacucuaucguaagugacccacucauuaaccuauccacccacccauccauccacccacccaucuacccacccguccaccuauccauccaccuauccacacauccauccaucgacccacccaccuauccauccacacauccacccaucuacccaccuauccucccauccaccaauucauccuuuucuuuccauggagugaacauuuucuuuucuguggggucauccugagaucaccgcagcccggaguccguccucaccuagccugauaagguggcuugguaagcagugacccucucucacugcggcacuguaacccuacaguaaagcagacaagaagcagaagaagaagguggacaggaagggcggacagagcaacgaggccuuggaacuagaggaaaaggaguccucagaugaggagagaggcaagaaaacagcuuuguaaagcaucuugucaccugggggugcuucauccacacaccucaaguugcagccaccaccugaagccggacuggugucaucugggucugaaaacuguccucauaugaggaggucagcucugccuauggccuccauacucacccccaccuuccccugacacucaccacuggccugguguccacuccuauucaucugucccccuucugcauccucucucacauccaaucugcccccuccaggcaugcuccuggugucaccugacuguccccuaugucucugagccccagugcuguacccgggaggcuucuacccucuguuuuggaggagagacacccuaugguccaagcucucugccccauggucaccggguucuuuucugaggaccucauccaagggucucccguucuugaguucuccagggcaagcaguuccagcaauggccacgaggaggcggugucaccucucagcaccuuccuuuaauaaaggucccuaaugcuguagucccuuuguguaggcuuaggccagagccuggaucagggguccuuggccacugagagcucugccugggcucaggcuguccacagaggugucugguugguucucauga

SEQ ID NO: 5649 - RNA, 2450 nt, Mus musculus
ucaugagaaccaaccagacaccucuguggacagccugagcccaggcagagcucucaguggccaaggaccccugauccaggcucuggccuaagccuacacaaagggacuacagcauuagggaccuuuauuaaaggaaggugcugagaggugacaccgccuccucguggccauugcuggaacugcuugcccuggagaacucaagaacgggagacccuuggaugagguccucagaaaagaacccggugaccauggggcagagagcuuggaccauagggugucucuccuccaaaacagaggguagaagccucccggguacagcacuggggcucagagacauaggggacagucaggugacaccaggagcaugccuggagggggcagauuggaugugagagaggaugcagaagggggacagaugaauaggaguggacaccaggccaguggugagugucaggggaaggugggggugaguauggaggccauaggcagagcugaccuccucauaugaggacaguuuucagacccagaugacaccaguccggcuucaggugguggcugcaacuugagguguguggaugaagcacccccaggugacaagaugcuuuacaaagcuguuuucuugccucucuccucaucugaggacuccuuuuccucuaguuccaaggccucguugcucuguccgcccuuccuguccaccuucuucuucugcuucuugucugcuuuacuguaggguuacagugccgcagugagagagggucacugcuuaccaagccaccuuaucaggcuaggugaggacggacuccgggcugcggugaucucaggaugaccccacagaaaagaaaauguucacuccauggaaagaaaaggaugaauugguggaugggaggauagguggguagauggguggauguguggauggauaggugggugggucgauggauggauguguggauagguggauggauagguggacggguggguagauggguggguggauggauggguggguggauagguuaaugagugggucacuuacgauagagugacggucaugguguacaggaaaccaugcgucgucacaggguagguagcuguguucucugcaguucuggguacagguagccccagccucuccuucuagcccucccuuccuuccucaggacccucucagguucacagggcucagcuguauuuccagcugcccaugccaacucucccccacuucuauuccucucccagacccagaaucugcacuagagagucccacccagaguccaccugcuggacacuguccccuccccccagcugggccucucaggacugucuggggggaaucacccacaggguaccuuggcugugaguucucguucauaaugugcuccauucugaauguagccuccucauccucugcucugcacaaauagaaacauugauacaagagcuguucucugccucaguauccccaacugaggucaugaacgccaagaaucagaagggaucaacagggcagcaaagcaagaugaccuccaggcugacccugggagggagcacagaagggcggggaggucaaggaggcccugcgugggacaggggcagguccucaccugccuuuggcgcaccagacacgauuggccagcaugaggaugaagacuauaaacaggaagcccacuacugcagccaggccuacuagccaaggcuucaggcggcgcucugaggcugcaaaggacaagacaagucagacacaaaaaacgaagggucugcagggggaaggggagccugcaggggaaguggguucugcgagagggaaaaagaagggucuguugggagcagaggggucugcgggagagaggggaagacguuaacggaaagaggcgggucuuggagggcggggcuuagaaaaggcguaaagaggugggaaucaggaagaacguccaagacuaggagcugccaggggcuuagggggcagagguuguaaaggagguccgcgccucccggagaagcugggcuucuaaggggugaggcuuuuagauaaaguaguugaggaggcgggggaagugggggcggcgagggggggggauagcucagagaggccuugaaggagcugagaggaccagcuggaaaagggcaguggccuuagcuuacagcguugagaggggagaaggauguuagaucagagacagggcagaaggagucauuggagagcacucguccccaccagugcccucuucacuuccucuuccugccuugccuuaguuucuccuaaugggaaaugagaugcugaagagccccugccccaguuccuaacacccacccagcgcgggcuccacacccuaguccuacccugcugggccucagcgggugucaggaacaguguagccagcagcagcagccugcccaagguguccauggccagcacacuggauaugggccgacguucagcugcaggugug

SEQ ID NO: 5650 - RNA, 1816 nt, Mus musculus
cucccgagcccagagcagaugguccgcaggacacuggguuaaaacuggaacuauggcagccauccggggguuucuaccugauucguggguuuccuaaucgaagccaaaauagauaaagcccaaaagacccagauaauggacaaaaaacacugaaggauuaaagacugucgaucucuaccaggcccugggcugggcggugaaagaaaaagaaaaagaaagaaaaaaagaaaaaaaaaaaaaacacuaaaaauaaaguauuccugggugcucuguaggcugcugcugcuggguagccgagcugucaccuccaugaagucauugugcaguugguuccaccuuuuaaaaucaguucagucccaaagaaaaugcugagacuauugaaggggaaauuggcuuuugggguuuuuugcuuguuuguucggguauuuggcuuuguguuguuuugugagagugcaagcgacacucuggguuuguuaacccacugggcaugaaauuagaagacaggacucucaggguccacgggagcuggcugguggggacagaggugggggaccacaaggcuaugauguguccccauuuccucugcuucaguccugggccaagcuuaacuggacauuccaaguucaacuguaggacacagauccuuucucuggauuagggcuucuuggcuugcagcuucacaggaugggauagaagccccgcccaucacauccugcaccccagaccacaagccccaaaccagaaguucacuguagugaaccucuauucauuuuucaaaacuuucccugggaaggaaguccccuggguggaaccuccuagcuuucucucccgguuuccccacccuaaucccacccucucugccacccaagccacaagguaaugggggaggguuugaauccccaguuggccucuuggagugccacucccgcccccagaaucuagagagugagcuugggaugggaggagagugaaugacaccagggcugggcagagcacagggccgccuggcggcucaccuggggccacacccacagcacugaagggcugugggcguggucaguacggguguccugggucuuugggucucuucagcugcaccuucagccucuucauaccaaucugaaagccguucauggccuggauggccgccugcgcgcuggcuggguggucaaagcucacgaauccugagagaacaaagugacggagcugguaaggggcgugguccaggcuucaaguggcuaacguuggucuuguucaucucuagaguugggggccucacucccaccucauccaaucagcucaacuucccuuguggugcaugggccacagccucacuuucuuccuucaacacugauguggcacugaguacuauuccaaaaccuuauacuuaccaggcaugcgcuccaccuugaccacgcccucagacccucacuggggcauucuagauggcagcuccaccccuggccacgcccccacacccucaaugggggucucuagguauguccacucaccgaaacacuugcucugguugguagcccgauccauaaacaccuuggaggagaugauauugccgaaggggaggaacaucugggucagcuccgugucuccaaacuccugggggaggugguagauaaacagguuacagccuucgggaccuguaggugggggagagaaagacauaaagcccccaaggagaggaggcggacccccccuggguugggguccaguccuugucucugguuguggauagagugagacguuucuccagacagggaacggucgggagcaggguugggcccugcaagccuugaucagu

SEQ ID NO: 5651 - RNA, 16469 nt, Mus musculus
ccagaguuuaggaacaaaauuuauuccgauuuaaaacagaauucaagagaaagauaugaaaagguggcuucagcaagacccucuggguuaaggggucagggccccgaccugcugcuugcacccuggcguccauggccgagggccuguaggagccuggcacugagcugugugccugagccucccccucacacgggaacaugcuucacaaaggacgaggauuaaaaauaguguuuugaguguucucuuaaauaggcugaaguuugaaauuaggacuguaauauacaagggucacagcagccgcuggcagccaccacaggccaggcuuggcucccuggaccaggugcuggauggugguuggcacucccagugcaccaagguggacacaaagaaaccaguguguccccugcaaucaggccauuccuuggugaggaccaggacagaaguagggagucugggguccccauccugaccuguguggcacacagccccaaggggcccugacacauuuccccugagcagaaccugccacucaccacuugggugagcugguugcugccccgggguuuggcuguggccacuguggcccagcacacuuggcacauacugcucaagagaggcuaacacuuugccggcuuggggugguccagccucagacaccuguacagucccaacuucucuuccuauugugcaacacagaugccuacuaugaggaccugggucucucauaggaugacccugccauccauguagcucuguaguguaugggauggcacagaucggacccucaacuggagacaggagaggagccuagugugggaaggugggggaauccacgggcuggaggccaggaaugugggugaucaucauggccacccaucauacucuagggcucugucaugcccauggucccuuguuuccuucugccugggauggcaauguggccacugcccagauuggcgugugucugagugcaugggcacucuggggccuggaguccagcuuggcaggcaggacaaaggcguggcuggcuauccaagcccagaacgcacgugcaaaaaguaaagaaaucugacagacagacagauagacacuguaguguauaugagcagcaggggccugccuauguccucucuggucauggccaucaccuccuauacgcugguccucuaguuuaggaggcaacaggcaaggugcagugacuauggccagggaccagugcgugggguggggccacugcccaugucuggguacggaccugagaauauuuggaagaggccccugugcaccccgcucuugacuggguuuggggagggcgagucuugcugaaccacauagacuuggacaguccuuccagcugcccaacuccacguagucccucaggguccccagggccuuuccuagccaugucagugagcagcgggucuuggggacuuaaucuccccaccccccacuucaccaacagcaggcccugccugcagcaggggaacacagggguuauggucacuagacccuguagugugucaccuggcugccaagucagaguggagaauauuucucuuuucuucaaaaacaaaaacaaaacaaaaaacgauuaggcacuucccaggguaggcacaggggccgcccacccccacuucuugggagucuagggggauggugcgagcccugagggcauacgggauaucaauaacuuagaaaauggguaguccaugguccccaagccuccagcuuuccugggggagaagucaaacucaggacuugggcuugggcugcaguggcccugaucuuaauagccuuguggcuguggggguaucucuggggagggcacacugcuguucauguaucuuucuuuuuuuuuuuuuuuuuuuuuuuuuuuuguuuucuaagaaaaaaaaaaaccucaagccacauugagucaaggccgaaaugaggccacucugcccuugaggaagagggacagggacaggaagugagcgggaagagagaugugccccagcccccgugugcccaggucccucgguuugggugaccggaugcggaggaagcuggcccugguggcagccaugccgcggucacaccagguuguacuccuucagguucagcugcaggaugguguccuucacagcugcgaacacaaagcggauguucucggugucgguggcacacgugaagugggaguagaugauuuugucgcugucaggguucagguccacaaacaucuucagaaugaacucgcgugcggccugugcaucccucuguggcccugcagaugagcacagugaugggcggcuuggucaguggccucccaggugcccagcguguggcagccaggccuuggggugacaguggggaccuggggcagugcucaccaucaaacucagggaaguaaucgaccaagugugagugcaggaucuugucuucuagaagguccuucuuguugaggaagagaaugacagacgaguucuggaaccagggguaggugaugauugugcggaacagggccuugcucuccuccaugcgguucuaaagcagacacguuaguugaguaggcuacccaugcccugccccugccagccccccaagcguguccccagcucaccucauugucugacuccaccaggacuuggucauacucgcuuagugccaccaagaacaugauggaagucacguucucaaagcaauggauccacuuccugcgcucugaccucugcccgcccacauccaccauccuagggagaucaaaggccacucaguucuagaugcugccuauaacugguccccauccccaaagggccaaguggcugcaggcccaggaugacugggcugguguuucuuaagugcucaagccccuuguacagauggcaguguuugcccagaaccuggguggccuuauagaccugaaucaccuuucuauagcucagagccacacagcagcugcccaacuggccacacauugccaagacuugaggucauaggccauguggucccuaacuaugucccaugggccucagcccucacuggaguagcuguggcagccaaggaggaaccuuggcugggagguuugggguagggacacucuccuggggagaugcagccucagugccgagggagcacaagccugagaggccacccaggggagugaguagaagggagugauggacgugguaugcucacacgcauggcccaccagggaaagguuuuaaauaggaacaugucucugcccuggggucagcaucauggugccacugggagucucacaaaacaccuuuaaucccagcacuugggaggcagaggcaggcggauuucugaguuugaggccagccuggucuacaaagugaguuccaggacagccagggcuacacagagaaacccugucucgaaaaaccaaaaaaaaaaaaaaaaaaagagggagcagaaagggcacaacaugccugcaggcccaggccccgugaccucccgagucuguggauguggguucugaaugggagcaaagcacauccauccccauggcaccccgugcaucuccaggguuucucuugugcucuucagguucacaggggucccaggaaggggucuaaaccucaggauccccgcugcugccuuccagucccggccaagccugcgcaucucuccccaucagcucccuacggucuuacagcaugcugaccaucaccugaagaugauguucuccaggucaaacggguacucgaugaugccaguggugggcacgcguacccgcagcacauccugcugggugggcagguagccuacuguggcgaugcgguccacguccgucaaguagcuacaacguagagguaucugcucaggagcccacuggggccauuggacaccugggacauggcacagaacccacaaccacccacagacagacgggaaccuggcacuggagggcugggaccuguguauuggcucuggugagagcacacuaucuccauugaucuagagucacaguuguuccaaauagauggcaggaagggauucaaggccucuggaaagcuggagaguggggcccacuacagccagggccacagcauaggaggcagacacuucagcaggcucaacucagggucacugacccaggugccuugcugaguccugagugcccugucagcugggauucucugcaacaccuucucaaccacagacuccucuaagcugugacuuucuccuagauguccucaggucucugcugcccugguugacccuccgggcaggcuaggacugggcucuucucccagccaggcauggaacagaugagaagccugaguccggccccugcucucuaagccucaucuuguucucucugaggccagcauguaggcaaugaguggucagaccagcccugcccuguguggacacacgaucugggcaggagaguagagugcugcccugauugggcggccagccuguggguagugagucuguggauaggcucuugggccuaggucaugcccacucugaccccauccacgucucuaguguuagccaugcaugccagccccacucacuacuuagccgagucagauagcuggaacucccgccugcgaucguaacacuccuggacaccagggucacuccacagcgucuugauggcauucacauacuggugcucaaaaguugugaccuucuccacaucgaccucccggaucaggagugcauuggccugagggaggaagggacugugaacuccuguggggggacccugggcaagcaaggagccugcagagccaguagggcagugaggggagccaaggccucuagaaagcgacaaggcuacaaggcccaccgcccaccacccaugcucccugaccacucuguguggguggguaugagggcugggacagauaaucugcauuccccuugaucuuguguagcccaggcugaccuugaacucacccugcaaccucuauguccauacacugggauuuacuagugcuggggagggaacccagggcuucauacaggccaggcaagugcucuacccacaagaacccagcccacccuggaaccugauccuuggaagcccagaaaggggaguugcugcacagggcacacauaagcugaggcugccucccgcucuugaaagcaccaggagguggcccuuccacauccccaggucagaggagccagugaaccacacaccaccacuaaccagcccccaagagccugaccguggaucccuccucuuuagucuucccaagguagccucuguucugggcuacuaguagauguggcucccagccugauaagguugaugacucuacacggcucacauggcacccaccauguacugggcugccugggccuugcugaacccuggaggggcagcuuccacacaucugccuguccuuaagugggaagaaccccaccugugacagugacuacccuggcccucauauaaggaaguaaguuggcagaaccagccccaucagccuguuuguggaaugggcagaaggcugcuuccagcugaugugccugcaaagcuuccacaguccccaccugccucccugcaccaacaagaugugaggcucaaaugggcccagaaucaucaacaacugucaggaggcugcagagacaccagggcagggcaagcgagagucaagguguucccuucuauccauauccaggaccacaggacuccaacuugacacaaggacuccucuacagggccccaugaucuaaugcaaaguucuuaaggcaauaccuggcccuugggagacagaggcagagggauggcaagacuggaucuugaagacccugagcaagaagcuacugagcaagaagacccuguuucuaaagcagaaggguuggggaauuggcucagcguaaguucaggccuaagaguccaagacccugagccucaucauccauccauccauccauucauacacacauacagaugaacacacagccugguggggaaggaucaagaaaaacugggcgaggagaaauaauaaguuggaaauaauaugaaauucucaaaaaaaaaaguuauuucaaaauacuacuuaaacaacagcaacaacagugaagcucagugggcaggagucuccaggaggucaggugauacugacaacccacagccagcagcccuccccuaccugugcuccuauuuccuaggucccgcccucaugggaggucccuuucacagacccggcccucagaggcaggucccacccacagaccccacagaccccucagaggcaggucccacccacagaccccgcccuugagggcagguccuucccacagaccugccucaagggcagauaccuuccacagaccccgccucgggggcagguaccucccacagacuccgccugggcuggcccucaccuuguucugcucauacuuguagaggaucuugagcgucuccauggcgcgcaccauggccugcauggcgguaaagauguucugguacaccaacuuggugaagccgcgcuuguccuccuccgaguagccggccccguggaugaugcgcaucugcuugaugaagguacucuucccgcucucgccagugccugcagaccgcgcaccuugaccagucaccacgugccccacaguccugcccaccuacugugaggcacuaugcugccaguuaccccagacguucugcaggcucgcccgcccaagggauugugcuuggcucccaccugagaacacaggguaccacucaggguaccacucaggaugcugccuguucccccagcuguggcagacaagcccugagucucugagcccuccauggcugaaagcucaguaccaccccccaccccccggaugccagaagcaccuggggccuugccaccagucucugggccagaugugaugguccccugaggucagcugcuaauuccuacuggccccuuccccugcaaccaacggggaagacccaucacauauggucagcacagagggugcucacucggucacccuagcccucucucaguguggacccuacccacaccuccuacacccgagggaaaugcccggggcugcagcagagagguugcugggccuuaggcagugggucugaggacaugcuuacagccaccugcuguguauguggcucuccuggggccccaccgcagucgcuccccuggccuguggcucagaagcuguuucucuacagcccacaaacacuggucccgaauguuggagacaagagcuucagcucuugugaugccugcaggcaugaucaccauggugagucauccaaaucugaaagggucccaaaucccaaaacucuagcuguuaagucagcaaucaacagugcucucuugcagccagccuggagaguugcagaccagccuggacaauacaguuaagaccugucuuuuaagaaaagacuuuaucagcucuuuuuaucagcucuucggcauguguggugcacuugcauacugcauacauucacaucugugugcgcagcucacauugaaggcugcguuggcguuggcaugagggcccaagucaggaguccaaacccacaagaagccugagagaugaggauggggugcccaccuguaaccucaaggcuuagggcauacagggcaucccgguucaacuagcugaaugagcaagcuugugcucaauaaagugggggaugguggacggauacucagcgcuaaccucuggccuccaugcaagaugcauacaugcaccugcagggacacaaaacacaacaaaugcacacaagccaaaaauaaaauauaaguguaaaaguaggacuagggcuguccuugucaggcagaacccccauuuagaaucccccagugagggggcugggggcauggucagggguagagcccuaccuauacuugucccccuccuucucccgcauaguccuccuuagagcuuauguuccuuuuggagucacaacuuuuaauuuuuuuguuguuuuguuuuguuuuguuuugcuuuucgagacaggguuuuucuguguagcccuggcuguccuggacucacucuguagaccaggcugaccucaaacucagaaauccgucugccucugccucccaagugcugggauuaaaagcgugugccaccacugcccagcacagcuuuuaaauauuaaaauccaaggcucaagagauggcucagggcuccucuugcugaggaccugggcuggguuccaaucauccaaucaggcagcuguaauuccagaauaucugccguccucuucuggccaccacagguacugcacucaugugcacaacccaacacagacaaaguuuaaaaaguaaaauaaaacgugaaaaauuacuaaaaccucugugcucaugugaguugugcucacacagacacacgggcaucacaccucuuucaucaguguauacucgauggcagucagcaguugccaaaagaugaggagccacaauccaugguggagaagggcaacuguaacaacaggcgcaggccaaggaaggcaccacaagaaccugaggccaggaguucacacugugagucagcaagcuaagccuggcuagcccugggcuucaggccacccuguggcacuauggacaaggugcaacucagcucaguacccaggcugggccaugccaccauguguggcuucaucuguggccaugccucuggaagccaagugugccacugucaugucuggucaaccagcacugggggcuggauauagguucaggauccccaugcaccagacucaagucaugccugggauccaacaugaugcccaguguccaugggcacagacaggagugacaucaaggagcccuaggggcuggugucccccuuccuggcagagagagagagagagagagagagagagagagagagagagagagagagagagagagagagagaaagagagagcgcuagcucucaccacaaacaccccauuuccucgccugcuuaggguggagucauaguucaccugugggcugacagcaggcaauacuaaggaaccugggguaccaaugggucacagagcaacagcugaagaacacccagcuggugccuuuccucugaggaugcuggacauggugucccuaaggggucugacaccacuaaucucuguuucaaagcucugaauccacagacaucagcuuuugcaugcauguucugaauaggccagggcaaacaaugaacccauguaccccguaguaggaucugugcuggagugccuugaugcuggaguucugcaggcauccuccugcagcuaucccucuaccuagucacauccaccuaaaggucagagguacccauggagaagggcaaggcuggggcuggcuggucacacagcaagcccauggcaccacuaagaggggccaugcugugcuagcaccaaguagacggcaagaaagaguggccacaagccagaccuaaaauaggcugcucagaguuccccaccuagagcaggaggacacagagggacugagccuccaccauaggaggacaacaggacaaggaagaagacacuguaaaggagaggcaggcaaaccgguggauaaacagauuguuggaagaagggauaaaugaaugugugugaggggguagaagaguggauggguggguggauagauugauggguggguggaugggugaguggauggauggauugaaugaauagguggauggguggguggaugaauacaugggugggagaaugagguuggaaguauguagacucuagcuguguuucccuggccuaguguucacaucuggacucaguguuuuaaugcaggcaguaugggagucagagcugccccacaaaaguugccagauggcucuaggugccaucuguaaugugggaaggugagguaggaaagcccucccagccuacauaacccaggcucuagggaugcuggaagagggagagcuacauguuuguacacugccaaguuugcuuccucccagguaggcccucagaaacucagcaccccaacuuagagucaggggaggaagugucaccccugggcugauguggcccaagcuacagcagcaccaauagccucaagguacaggaacugucacugaggcccacuucagggaacuucagucgaggagcagugaaguggcuugaugacacaugaucacugugacagacaugagcacaccugugugcuggggcuguaacgccugguccugucucaugacagagcccuggguagugaaagucacagcugcucagugacaguugccaccagcagccacaggccacaugcacuagccucuggacuugcaaccaugaucuuaucuccaagcugguagcaaagucucccagggagcccaagguguggacacugauggucucagagagccacaggccguaccaguagcuggcugauaguuaggacauaugucaccuacuguacaacagccaaagugagccuuaugcaccccacggaguagcuccccaccaacagcaaagcccccuguacuaucaugggcuuuuauaaaacuccacaaagccagagauaccuggugugaccuuaucuugccuccacgugucccuagguauagguaccaggcccugaaacucuguucauagcugacacuugcuaacagcaaagguuuaccuguccaccuguuggaagguuuuguuuaagaucuuuuuuagacaaguucuccuucuguagcccaggcuggccaggaacucacagaucugccugccucugccucucuagugcugggaucuaaggcgugcaccacacccaggcaguuuaaagguuuggccucccagauuuacaccucuggagggaaggcauggaacaaacuugcacuguggguuggaagugugaaaccagcuugggcuucauaaugggucccaggcucaaggaaaaucagggcuguggcuguagcugaaugguagaguacccguguggcgcaugugaggucccgcguuccauccccagcaugccauaaaccaggcuccgugguaaucaccugccgucccagcauucgguccagguggaggcaggagacgcagaaauucaaggucuccaucagcuacauagugacugugaggcuagccugggcuacaaggcagaaaacagaaucccguucuucuuauaggcaaggcauaaagaagaaugcagagggcuggucccccugcccugcaucacuuaaugacacccaucagggcuccugaauccaccacauggaccgugccuguuacccuguguccaccacauggcccuucuucgagauacccugggggcgcaaacaagguuacuaggguagggcaggacaacaggaagugcagacccuagcaugucagcccugggguggugcugcacccauuacagagcuguguugacaccugugacaagggcuuucugccccgccaggccuugagucagagcugucaaugguagcaggcccaacucugaagacaaccuacccauggcagggaccacugcccaccauguggagccccagaggacggccaugaggcaacuguccccuagagugaccacauucuguuacuuagccacccucagaccuuguggugacccagaagccagucaguccccugcaguguagagucugaggacaucaacagcacaccauguuaaagacagagaacccuugcaguuggcagccugacacccugaacaccguggaucaguggacacugcugugggacacacaaguguggaguccccaggaacaugcacaggaacacacugugguuggugccacacugccucacacgcaacaccacagcuuuucccauggagcagggacacuguaucacuugacagauggcgacacugaagccuggacauaaagaccuacuggucacaacuccaauaugucccacccccucuggcugucacaggcagccuaagcugagggccugcugggguuguccagguugucccuugaacacuccaggcagccgauuccauuggccaaagggcacuucuuaagaacaguacagcccagccgggcgugguggcgcacgccuuuaaucccagcacucgggaggcagaggcaggcggauuucugaguucgaggccagccuggucuacaaagugaguuccaggacagccagggauacacagagaaacccugucucgaaaaaacaaaaacaaaaacaaacaaacaaaaaaaacaguacagccuacaguaugggugccccaugcuaagcaggggccacagcaugaggaaaaucgguggccuggacagaacacugguccuugaucccuucccagcagcauacugaggacauguguaaccaucacacuggggagcugcuggcacaguggguagaggccugagaugcugcugcacaguggccugcggggaacaauuaggaguaauguccccaucacucacacuaaggagaacauggguucaaaggccuaugugugaugccgcaggcaccaaggaaacagcagaaacagcuccagcaaugaguagaugcaggcgccccaacucucaagccaccuagcccuggaaaacugaggcacagaccugcaaacguggcuccaugggacagcaaggaugcugacaguaaaguaccacccugcucacgcuuggucuuuuacaugcuacgccacuguguaaggccagggaaugcaacucagcucuguagacaccucagccccugcccugcccuggcuaucauuccuagccugcagugacacccuggaaggcacccggucaguggcugacaaagugcacaaacagcccaggggcugaccucucccuguauuuaccaugcuccuagggccacauagccuguccuuagcaggaccacuaguacugagugccagcuggagaggaagaagcaagcccaugcaggucaccacggcuacagccaccucagauaggccucgccacagaguggggacagcacugcacucguggaacccccaaguccuuagagauacaaccuguccccucuuuuggagacagggucucaugcugcccaggauagucuugaacucccuauguaguugagaugaucuugaacucuggaucuuccugccugcacucuaaacaccuaaacaccugguuuguguggcgcuggggauagauaugucuuucugggaaucaguucaaggaucucacgggggaggggcagcgcauccuuggccuccugggauggccugaagccaccaggaucuggagacagaagcaguaaguagagauccagcugaggccuucuucccagggcagaagucaggcccaacccuugggccacccccgccggauccccggccuuuggccgcccagcccacggcucgggacaggaagcugggagccaaccuccugcuuuauuuagaaagcugggcccagcccugcccggccuccgggacagggauuucuaagcgaaaguucuggguggcuggcuccccagugacagcacugcucugccccagccuggagccacacagggaagcagaggucccuagggucugcagagucugaggccauaggaaccucugaacagccugauuaaguguggaacuggaagcccuguuggccacagggucgcuccugguagucucaugcccaucacugcucaccaccagagccaccuaagugucccaggacaagccuggagcgugucacccuccaguggggaggugcacacaguuccguguggcuucaguucugagaacuugcacuggccaccaauuaguuuugcaaguuacuuuauaucagguaccaccaugcacaacuccaggggggugccucagccuagguacacugagugaugucuagggaugcagcucacuacccugcagugaccaggacgcccaccccaagaacaagccugcagucaaugcucugccuggcugaacaaucuccccaggccacacagggacuggaagaacaggaggaggauauaaaacccacucccagacuguuugccacagaugcacaccagguaugacgauggcggcuucaaaccuggggaaagaggucagaguccugcacacagagaggagcucuuuccaaaaggaccacucggggaauggggcagggggacccugccugcuccagagggcagggcuccagaagagcaaucccugcccugcuuccaccucaggcgguagggcacagggucuccacccuccagacagcugauguaaaaucagggacagccaaucaaugaggcagccugcaggaggguggagcaggucucaccgaacccccacccccaauaccugggacaaagagacugcuagagaaccaaggucauggucaccuccuccgggaagcccucacagcaagacccugagcagugcccaaugcucacucccguccucccuuuacccuucugcucuuguaaagcaaaucccagacucuacaacgggcgcaggacccuucugugggaagggugugacugcagacacaggugcccugagggcacagguggcaguuaagaaccaaauugccuuggguagaggcaaggugcugugugcaggucaaugcagaguccuucagcugcuggucagcuuagccaggccauagcacagagggccagggagcacuccugaauccgaggggacuucaaggccagcuuuggggacaggacagagcugggaugacacacuauugggcucagccaaccaaugucaucuuuaccuggcagcugcugacccccugcagaggugggcuagggccauacuguggcccccauaugacuacccuggggccacugcuguuugcucugggcugcucuguccucuucuuaucccauccuuccuggaaagcugcauagagcuuugagggaaucccaccaugcuggagaaaaguaaccaaggcuccaugacccugagaaccacacaggccacagcaacagaagacagcguguacuccuaccugacaucucucaugggacaauuggaguaucacugcccuccaccccuccuagucaaaggcuccccacaguccuuuccucagguucuccaaggccacccuuuguccuggguccccauucuugaacugcauguagcucaucugggaucugggaggggcaggcagagcuccccagucuguuuuguaaacccccacagggcccaggcuacccuguccucauuuugggcucuuauuuggggugacaacaagaggaccugggcucccuggcucccagcaacaggugggccuugaggagucagaaccccaggaagugacagacacacauugagcuucccuggggugggugggguguggagaggacaagacuggacccccaggaggcaggacagggccagggaggcugcaaggcugacugcugucaaccuacuggguuccggcacaacagaagcccaaagaagaaaagccacccacuccaauguggaggaauucagaggaucuauggaaaagagagggagacugaggaguacccacgaaagcaacaagccagaagcaaagcaggaccauuuggguguauaguccuuggagguagagaggagggugcaacccuuugggaacugucuuggggagucuguaauccaaaggggcaucaugagagcaagacagcuuacagggcucaccggaggcuauguggggacaauggaaaggagagagccuacuuggugcggcagggccaagggccaccuccgugcaagaauucucaggagcgacagaaagcaagucucccaggguccuggggcccaauguggccagcagaugcaaaaucucaccacagauaucagaggcaggaggcugaccccgaaugaaucuaaggccuggauaacagaaaggcuggccacaaagggucgcacaggcugagcccaggggaccacacgggagaagcuggccaccacaggcccaagccaccugcacugcucagggugcagcgaucccggaagggcugaccgcugcagggcagcgcugacuaguugccccgaggacauccgagguggcccgacaggccgugggcagcggucugaaggggucgcacccgacugucaccgcgcgcuacucgccggggaccagagaccgcggcggcugcagcacccugcgcgcgcggagaccccggcaaggcccggaugccccgugcacccacccgguccccgugacagaggucccacggcacgggcacgcagcucaccaaguagcagcagcuugagcucgcgccgggcgucgcgcuugucccgccgcagcuguuucucgaucuccgcguugaugcgcuucgacuccuucaccucgucgcucaggcaacacgccaucauggacuccagagucaucgucgcgguccuccggcugccgccggcccggcccuaccucuucccgguuccccgaaggccacggcccggccccagaggcgcguccaccguccgcgccgugcagcgcagccgccgccgccgccgcuacccgcagccgucgccaccgagcgccggcgcccgaggaccugaagcgcugccacgggccccgggacgggcaggcggcgcggccaaugggaggggccgcacggcugcgcgcgcgcgcgcgccgcagggacaggacuuuag

SEQ ID NO: 5652 - RNA, 3331 nt, Mus musculus
cauggggcuucccagggcccagaacuagggcucccucaccugugguacugagcuugaagaaacuggaauuccucuuugauccggucacagauuuccaguacugagaacuugaaaggcuggccagacugcagcggggucugagggggagagugggaaaggacacuagggugaguuccagggcaacagcaggcaggaguccccucccugguccccaccuccugcagccagagaugggagucuccguacucaccgggugccuucccugaggguacauccugcugauggaugggugagagaauggacccccccagcuucuuggaggcuugaggauguggcaaagggacgcugaggugcagagguggcgcuggggagagaauugggugcggggaggagcaggcaguagaauuuggggugcuaagcuagagcuggggugcaaggagacugagccuggaaaagcuaggagagaagccggagcugggggagggauuuuuacgcaaagaaagagcagccagggagagccugucggggcaggggaccaggaccccgcgcugcgcccccccuccagccagcgcguccgggguuguacaacccaggggcagcugcagucagcgccgcaggucuguggccgccgcccggggucggcgcugguggccucaguggcugcggagccgccucccuccgcggggcucggcugggagccgcgggcgggacccgccuuaagguggcaccgccgcccccgccugcucugcuucuucgguuccaagacccgcuggggaaacugaggcuuggguucgauccuaguguucccgccccacccccacucaaaaaaaaaaaaaaaaccggggggagagaaauuaggcaaaaaaaaaaaaaaaaucucugugcgcgcgccucuggagccgugggggcugcaaguggcuucucugggacagcgacacuaugcccuuaugaaggauaaacauccccaagaucgaaagagagagagauacacaccugucccaggaagagcagacccaggcuaugcuugucaaccaaugcugccccacucuggagagauccaggacagagcccagggcagcuuggucaggcucagagcccacuacagacuugcaugcuagugccaccaccagccaacuggguggccuccucuauccagauugggcuccuaaaggaccagacucuuuaaacuuagugcauagaacucuuguguaucuugaaccggaacacuagaaaaucuucugcaggggcuucaccacugaccccgcccccagaccuucacugggagauucuaggcagcagcucuaccucugaccacacccccagcccuucaccgagggauucuaggcagaagucacccaugaccacgcccccagccccucacuagggauuagagacuccacucuugaccacgcccccagcccccuuuuacuuuuggaggcaaggccuugcuaaguugccccugcaaagcuugagcuuggaauucucagucccuguaguagcugggacaacaggccucugugugccaucaggccaccuccuacaucccaucaaguuuaagggugucccccagagcugagaagccaccugucaccauggaaacccccuuccccccaggaaucauccuuuguuuccaacucuggcaggacuagaccucagaagaggaaggaggggacccacaccuucaaucccagcacuugaaaugcagaggcaggcagaucucucugaguuucaggacagcuuggucuacuguggugguuugaccaugcuuggcccagggaguagcacuauuuggagguguggccuuguuggaguagguguagucuuguuggaggaaguaugccacucugggagugggcuuugaagcucugccaagugccuuagucagacuucuucuaggggccuucagaagaagacacagaacucucugcuccuccuguaccaugccugccuggaggccuucaugcaccugucucgaugauuauggacugacccucugacucuguaagccagccccaauugccuuggucauggugucuguuuacagcaguaaaaucuuaacuaagauaucuacagagcaaguuucaggacaaccagguucuacacagagaaaccuugucucagggagagggagggaaaaaaaaaaaccaaggaaagaaaccugagcucugguccaucauuaaaucaaucaauaaauguaugccuggugcuacugugaacuacuaugcacugggaaacagugggcaacaaucauaggggaaagaccucacauccacauuaacguuuggaucucugugggcagcuaagucagcuacagaggacaggggccuuuaugagacuugcacggggccagcgcucuacagcaggaggauacuagcugaaaaccuaggacuuccaggauaaaaggacagaauggagcucucucugaucaaacucugggagaugagccacagagcagccaagaucacagcuggcuggucaggagcuguaugaaaagcaacaauuuagacaagcgaugacagaggaacaaacaugagccacugcgaucauaugugugggagagcgcucaguaagguuaacauuguagauggaacuuuacaaaguccgugggcccagaaagugacagucuuucugaccuagacaguuagcccucugagaaugaguguucuguaacuccuuggagcaucugccagaauccccgagaggggacugggggcguggucaaggguggaucccagccuagaauccuccagcgaggaggcuggggcgugauuaguaguggagccccccuucaccccauuccccacccuagcauccuccaguaaguggcuggagccauggccagggguggagcacucucaguaucuggaccgccauacucuccagcauccuaggcguugcccagccuuaaggcugucgcaggcgcuguacaagguguagguccuucuacauggaccauucuuucagguucuggccacucauccucuccccugcagaggccugugcuggugccuugaagcgccucccagcaccugcuacuagaaacacggcaucuuacuccucagcccuaguuucugcuuuacuguuuacucauuuuucccuugcagaccgaggaacacaccuggcuccugggaagucugagaaaacagugucccacaagcuguccccaggccccagcgguuccugauucccggcuuuuggugucugagaacuucugauccccagaggcccccgggacuccagaaucuccacucccugagcuaucgccuuugccaacccucaccaucuccccaaaucaagcuuguuugcuauugguugcguuucccaaucuaac

SEQ ID NO: 5653 - RNA, 10172 nt, Mus musculus
ucgccgccuucugauuggucagggccugcaggggcgguucgcugaguccggggcccacgugcaccguggccugggcccugauacacgcuucccucggugggugcagggggcgugguguguggguguggccuaguagggcguggccuaggcuggaggggcggggugagaggggucaaauggcccggggcccagcaggaggggcuuccuccuggccugacccuggcugaccucagaggcuuccucugggaucccuggggccucccuaaccucagagguggugcgugagggcagcccgcuuccugcgggcgggucgggagaagagggagcccgagggagggguguggacccucacaaaaccgacuucagcggggaguuuaccuagguugagugauuugggagugaaccaagugucguuucucuugucuccuuuauucuuuuuugaaaaauguuuuaagugugugccugagcguauauauuugcaccacaugcaggcuuaacuaguacgccuggaaaacuuuuuuuguuuugguuuguuuugguuuuuuggcuuauugguuccuggcuguccuggaacucacuuuguagaccaggcuggccucgaacucagaaaucugccugcuucugccuccuaaaugcugggauuaaaggcgugugcccggccugccuggcaaacgguccacgacuagccacauuucuggcugaucccgcuagggaguuggaggugccugguucucuauucuugguaucugaagagauacuaaugaggcccuuagcugggggugugugucugaaaccuuaguaguaguaguaaagccgggucuuggggaaagggagcgcagaagacauggggauggggaaggggcuuccuccccagcuggguccagaugaugaagaggcuacggggaugggggugggagucggcuuuucugccuucuaaaaaccuauaccuguucuuauaggacuuaaucagauuugugaccucaagaaucuucuagaugacuucccacagacagagcagugacaccuuugguggaauuuuggugagagagaaaugguggugaggggcacaguuagcuuccucucuuccuacuguguuugggguuuuggagacuaguucucucugccccccccacccccaccccgcaccgggagcucaugcaauccugccuaccuagcuaagaugaaaggccugcaccccagccugagccccucagugccugcaccugugaccccugacagcgcaggugaaaacccccauagaccagaccgggcccacauuuucccaaugucaaucaaguggugauuauuaacacuagguguucaccugguguggucagggcugagccucuccuagcaaguggcucuuuaguuccauguguuaacacuauauugggauuaaagaucguugcccagcuuuaauccacacuugggaggcugaggcagguggaucuuuuaguucaaggacagccagcucuagguaauuccagaacaaucggcuacauagacccuuugggggaggaguuauaucuccucccuccuccuuuccccuucuuuuccuuccuuguuucucuaaaaguuaagguaauaucagaagucuguguacuaaauugacuguagggcagugguucucaaccugugggucgugacccuuuggugguuccauacccugaaugucagcuuuuugcauucauaacgcuaguaauguuacgguuauaggaacaaaaguaauguuuugguuggaggucaccacaacaugaggaacuguacuaaagggucgcagcauuaggaagauugggaaccacuguuccagagccuagaagauucuaccaugcucugccacaccuaaagagauccagggcuggaagcuagacaugacuccacaccugggacuucagggagaugcaggcuuuauaguuuugaccuuugaccuuuccagccuuccaccuuauccagucgguauuuguccaucgugaaccagcuuccggaggaguucagcaggugaggguuucucucagggccccacaucugcaggacggauccuuguccccaaagaaccagcugugccuggacagugggaagucagccuaguuuccagugaaauguuguuuggguuuguuuuuaagcccggguguuguuuuuuguaguggugcaggcugagacaggaggauggcaaguucuaagccaccaaaccugucuucaaacgauugcuggcugggagaaugcucaagggcaaaaaaacaaaaacaaaacaaaaacugccugccugccuagcacgggcaaaggccagggucagucuugagaguuuggauggcgucuuccccuucauuuauagauuagggggcucauccucuugggguuccacccuagaaaugcaggggcuuuuucuagaagaaugugcaauuucuuucccccacucagcgucgucucugaaaugaugguucaccuagagaacaucuucagccuggugaguccacccugguggcagccgagguggggguggggggaggaugcugggguggggguggggcaaaggcaugaccuguacaaaagucccuggggcaggagggagccuggcugguugggggugggggugaagcagcaagaaaaugcucuguaugucaccuagggagagggaggcaggcagggcccugaggacugcaagaaaauuaagcuuggcuuuucauuaagaacaauauaguaaguaguauuuaaaagcuaagauagacagagcaaaguggcacacacugucauccuggcacuggggagaugaaggauuguucuuggcuauagugaguucaaagccaggccaggcuauguugggacucuugucuccaaaauagucucaaagaggugaagaccuuugcucagggucacuccuuguugagaccuaccucucaccugcugugugauuucagguguccacuauaaaccaguccuuccuagaacaucacacacacaggugaacuggggacuggacacguccccugguaggacagaggcaggcagggaaugggagccaugucagccucuggcaggacaugguuugauuccagggaaguaggagcugcagagugauggggacagagucagggagggaguugauuuaggguccacacaucuugcuguagagcauccuuccugccuggcuuccaggugcccugaagguccugugcaugacuagaggacaggccuguagaggggcaccgggcucuccccgcacccccacccccacccccugcccaagccaagacacguguguccccagcagccuuuccccugccaccuggccccuuucucaagggcacuggcaggaaggaggcgaugcccaaggccagaugucacuggcagggagccagagccaagacugcagcuuagcgggggugaggggggugggggggguggggguggggguguccagcggggagugggcagcagaggaacaggaagccaccagaacacaguuguucauucaacugccaccaucagccaguggagacuggggacugaaggaagcugugggcacauuugaggggcccagggugggagccaagagcuccaggcaggggcuggagugugaacuacagcugaggguggaccggaaggugcacugaguaggucagcagggagagaagggaugguuuugucugggagaggaacagcuccucugcaaagcccugaggcagggaugggccuggagugggaggagcagugagugggaaggcggaaggcagagaaggggacucggacuuggaggcugcggaguucuaaguguugacccugugagcagugggagcccuagaaggcugugguugaccaagggggguggagggggguggggaugaucaggucucaagugcagcagcagcgagggugaagugggagggaaugauugaccaguguguggggcggccacugccugaaguguauguguguggggguggcuguagccuaugauauccugggcaguuucuccgcagcuccaggcuucccaagcucccaggcuuuuaacugccccugagccucacuuuccagucccugcugugccaguguccucccccccccccccauuuuauacccccaaaucccccagagcaacagcucucucccccauucccacugagcuccaggcucacuagaaugccaguaaauugcacaauaaugagucgggaaaaauugggagggcuccccugggcuuugugcagccccaggcuggcgcugcccugcaauccaucaucucccagggaggcagauccugggccuuccagcuccaucccaggugcuccccucuccauccugggugcucuccaaaagcucccaggggaggagcagggcuaaauuaaaaacagugucuggcgguggcggcggcggcggcggcggcggcugcugcugcugcugcugcugcugcugcugcugcugcuguuugagucucugggccucaguuuuccaaugugaaaaauaacacuaaauccuuuguaggccuugcuggggugaggggcagggcuuugugcaucaagggcugcaucuaagcccuugaugauggugauuacugguuuucuuuucuuuucuuuucuuuuuuuuuuuuuugaaguuuuuugagauaggaucucaaagucggucuauagccaaagaugacccugaacuccugauccuccugccucagcuuuugaagggaagggugaacaagugugcaccaccaugccuggauguguagggugugguuuauccuggcgggaagagcuuaccuagugccaagcuuuggcacaggcuccccuuccccacaucugugcccucagcaaggcuccauccuaacuuguucuaggcagaaaacuucuuccaggcgauagagcgcuucaguagaaccccagaccuccuggagaggaacaagaugaguauugguguuggggcugaaggggacaguuggccaugucaugugucucaugaggccccaaugggcucugcccagaccacagagaacucagcuaaggaagaagacaaacaggucccagagucugcagcccuccagcaccccaaguucaaaagcaccccggggccucagcugcccaccagacgucgguuccucucagagagugaugagcuccaggacccacagccggucugggacgcggagccccaguucugucaaggcuuccugauccagggacucugggaacuuuucauggacagccgccaaaagaaccaacaggaacacgggggugaggauuccucacaggugagggggaacucccaggcacaagccuuucucucccucuucuucccucucuccuccccccaccuugccuguugucauggcaacagagaagcugcuggaauuggugaguacccuugacuggaaccccaaaggauuuuaccccauaguguccccucaguacccuccuuccucaucccugcacucugaccccucaggaacauccccacugcagccaggaacccccaggcaucugcugggugucccccccuggggugacgugucccccaucugacccaauucugucucccaggaaagcaaagauucaggccugugugacuuuaaaccagaaccucagcccaggcacagaaacagccugagugacucuggugagagggguggggccucggagggcagggccauaguuccugggucaccccugaauccugucuccuccacacagccgaccccuuccugaucaagucucccucagcucuucuagauuauuaccaagaagacgucagucggccccaaccugagacgcaggugagugggagaccuggaugcagauauggaggggaggucacaagccagcagcgucagcuucuuucuuuguaccacaggaaucuucuggaagagcugauaaauuucugaagcccuugugaguguuggccucugcagggagaaagcgggguuaccucacccuugucucccccaccccgccucccugucucugucccuuuuccauguccuuaacuggugguggaagauggaggggcuugugagagggcucagcagguaaaggugccugcucccaagccuaggccuggguuugaucccugggaccuacacaguugaaagugaaaaaugacucccgcagguuguacugccuccucucuacccuccacccccccacaccccauuaaugaguaaauauaagaacaacuuguaaaggguuaaagaaggaacgucucacuuaaaucucaaccuagauucucagucuuguaguuggagaacgaugucuuggagaaggggcuguaauaauuaggucuauaagggugcacaggagcucagucgacuugagcaaagcguuuuagaguagggacgcauguguggcuguggcaagaacugaagaaugugacuggagccuggcuccuagcgcucaugagguagaggcaggagcauuaggaauucaaggucagccuuugcuccauacagaguucaaggccaaccuggacuaagacccugucuugaaaacuucacucugugucccauaucccuagguccuggggcucugaagucuuagagagcagcuguaaucagccuagcacagcacucuggcaauuagagagguucacugucccccaagcacugcagaaggugcgugugcugaagcaccaggaacugcuauuggugguagcugugagcuccuucacgcggcacgucuucaccugcagccagagcggcaucaagguguggaaccucgugaaccagguggccgaggacagagacccagaaagccacuugaaaugcagcguccaggugacggggcagggacgggguuggggaugggaggugcuggaagagccacgacugacccucacucgccgggacgauccucugcaggacaacaagguguaccugcgcaccugccugcuguccuccaacagcaggacccuguucgcggguggauacaacuuaccuggcgugaucgugugggaccuggcagccccaucccuguaugagaagugccagcugcccugcgagggccuguccugccaggcacuggccaacacaaaggaaaacauggcccuugccggcuucacagauggcacggucaggauaugggaccuacggacucaggaaauagucaggugcagacacagggacaggagcacugugagcugcggacuacgaguucugagcucuuacccaaaccccacucccccagaguggagccacacccuaguccccucacuaggggauucugggugggacucuacccuaucccugaccacgcccacagccugcuuguuuaccuuuagguuaggguaagugucucauguagcccagguuguccucaagcacagaggaggagaaccuuaaacucuccuuaucuuccugccuucaccuuccaagugcugugugugccuggcuuauucguaaaucuuguuuuucgugggcuuuguuuuguuuuguuuuucgagacaggguuucucucugugcagcccuggcuguccugaaacucacucuguagaccaggcuggccuggauccaccugccucugccucccaagugcugggauuaaaggcgugugccaccacugcccagcucauuguaauucuuguaggacaagggagaacagaggcucaggacaaccugcaggagccuguucuuccacuaaguggguucuuggaacucggcucuccucuacccacugagugaccugggagccaucuggucaacacuuuuacuuuuauucauuuuaucuggcauagggucucacucuguagaccaggcuagccuuggaacucagugauccaccugccucugccuccagagugcugggaugacaggcuugugcugccaagcccugcucagauuuuaucuuaaggucggaucaggugacguuuucagggaugaugcugaacuugcucugaagccuaggauggcucuaacucgcaaucauccucucuuaaucccgaguagcugggaugacaauugugagucaccacagccagcuuugggucuucuccaucacccucauuguugaggcagggucucuauguacccuagccuggccuggaacucauggcaauccuccugccucaacuuccucaguacuggauuuauagguauuggaacauuaccuuuuagaggcagggacuaggaugaugucacuguugccuucuugccaaagguguuaagaguaccucagguuggguuagucccacggcuuugagggaaucuuagggacugucgagccuaggcuuaccccuuugcuuucuggccaggaaccucaaaggcccuaccaauucggccaggaaccuuguggucaaagaugacaacaucuggacagggggucuggacgccugccugcgaugcugggaccugcggauggccaaggugucacuggagcaucuguuccagucccaggugcacaggaaggguggcugcacaggcgugggccuuuggguacaaugacaaggugcacucagugucaggagagggaacagcccaggucagcucaaggaauuuuugagaagucacaggggucuuuaaaauaccuuuugucauacuggacaaugguggagaaggcugucgucccaguacucaagcugaggcaagaggaugaaaaagugaguccaucuugggcuacauaguggagaaggagcuggaucuaggggguagaauguuuuccugucacucagcacuagggagcugggggaaggagggucagaaguuuaagguggucaucagcuacacaggaaccugaaggauagccugggcuacauaaaagccggucucaaagacuaucguugcaaauauuuuaugcuggaguucaaggccagccugggcuauguggcaagucacuacagccuaggcuauggagcaagaccaugucccaauaaaaccaaccagggagacagacuugucacugccauaguuaacccugugaaguucauacaccucacagaaggaagguguggagacacagucgggccacagccagucagugagucauugggugggcgggcguucgggcggggaccuugcagccuggccgcccagcaggggucugauugcuaccucugccuggcucacccagaucaugagccuggcucacaguccgaccgaagacuggcugcugcugggccuggccaauggccagcacugccuguucaacagcaggaagagggaccaggugcucacuguggacaccaaggacaacaccaucuuaggccucaaguucuccccaaaugguaaggaguccacugagccugggcaugguggcacacgccuuuaauuccagcacuggggaggcagaggcagguggaucugaguucaggaccagcccugguguacagaguuccaggacagccaggacuccacaaagaaacccugucugggaaaccaguccacugaggaugggugcacacuguggccacuggccucucagaggacccugcuauuuacucagugcccagucagggcuuggguauuguccacacuccaacaucuuuuauuaacauaaucauaaucaggaguucagagucaucucuggcuacuuggggagcuuaaggcuauccugagcuauaaaaggcuucagacggcaaaacauaacaaaagacaaaacaguaaaacuuuuugcuguucugccuuguucuuugaggcaaggucucauguagccuagacucauucucaucucaaacucucucaguccuccugccucagccuccugggugcugcuggauguuagugaauggguggggucugcuguaaccucccugucuuccuuccccuccuccuaggcaaguggugggcgagcgucgguaugggcaacuucaucacgguccacagcaugcccaccggagcaaaacuguuccagguacuuaugugcagggggcacugggggcucugucagcgggacccucagcaucauccccacaggggucauuucugaagcucuggguggagaggaacugagcucacucagcugcugucucagguccccgagguuggcccugucagaugcuucgacaugacugagaacggcaggcucaucaucacaggauccagggacugugccucgguguaccacaucaaguacugacaacuucaacuccccuccccuaacugcacagugguggauggcaaugggugugaugggucugcagugcuucuagaggcuuccauggggugugcagaucccgaguugcguguaauaaaacaauugaaauggcag

SEQ ID NO: 5654 - RNA, 7968 nt, Mus musculus
cuggucgcggaucccaggacuggggaauccacuaagucagagagguagucucggccagcacugaagacuaagcuugcugcaucaggagggcgcaugcgcucuggaaagaaugcuguuuuucaccuccacguacccaccccacccucaggcacguaucuagggaaggcggcuacucuuucccgaccgucccuucaccacuuccggcggaagcggccucaacaagggaaacuuuauuguucccgugcggcagcgccggcgacgaugucggugaauuaugcagcaggguugucgccuuacgcggauaagggcaagugcgggcugcccgaggugagagcugcaguguucgagucaccgaaugaccccagacggggagcggccgggcgaagcggggcauugugggaacagcaugaaacauagagucuagacaaugggagggacuucccuggaaggagggggcgggaagugacacccacugcucaggcugggugacacggaggaaccugggucagggaaggagugaggggcuaaugggaacgagaccaaaucgucaggucagggaguggacgucuuaauugucagggaaaaccuggagcugugggaagaucugcagggccggaagcuggcacccuuuccugggggcaucccuguaccccacucuguacuccucccugaaucugggccagauggauccugaguguggggcugucagucuuuguuguuucugaagggguguaguaggguggaggguucucucuuuguagcccaggcuggccccgaacucacaggaaucuuccugccucugccucccgaguacugguguuaaaggccugcgacaccaugcccugccugccucauguuaacggagccccuagacaaguagagcugcaucuugauuuaggggagagagguggguuaucuaaaguccaggaugggggaugacgucaguggggaggucacgugggccacaaccagaccaggacaaaggaguggcugccugcaggaacagcacucugggaagagggcucggcaugugcaaaggcccugggguaggacacagcgauguguuaagaguguggcuggaacugagggauguugagaaggggcagacagagcauugacccacaggaggccugccacuugggaggucacguguugccuccuccugcccucugacccuacagaucuucgacccaccagaggagcuggaacgcaaggugugggagcuggcccggcuaauguggcaguccuccagcgugguuuuccacacgggcgccggcaucagcaccgccucuggcauccccgacuucaggucggugaacaaugaggggaaacugaggcagggcucuugcugauacaccucuagggacuaaggugagguggcagaaggaccuuucaguuuuccuaugucucugaaaggcccagcaaaaacuccacuugcccaaggaucagagcaugcccacauaauguaguagcugcaaggcaugcugggaaauguauucaugcagcucggccagccacuggguuuucuagggucagaaugacucaauguuguggagugacuagcucacccauaaccuucgguggcagccuaugaccacuguaaagcauucugggaacccgcagccggucuuaaccaguacucagccccagcuccacuagcuccccugccuuuguuuacccccagacccucagccccuccgccucuuucaugaagacgucccaugcucuuuagaauucuugccuacccggcagucauugucuccaccacaggauacagaaccacccuaagaacggggcuggggccagcaugggcugacuucagcauuaacaggaagagcccacagccuggaaaaugaauguuugaccucugugccuguccuccucugcuugcuauccucagaggcccccauggcguguggaccauggaggaacgcggccuggcccccaaguuugacaccaccuucgagaaugcucggcccucgaagacccacauggcccugguucagcuagaacgcaugggcuuccucagcuuccuggucagccagaacguagacgggcugcacgugcgcucgggcuuccccagguccgaugagucggccggggggcuggggcucaauugcaucucuuccuccuuauuggaccagggugcccuagcucaggggcauuuauuagggaugcaaagagggggaaggcucggagcccaaagccgggcaguacuuggucaaauuggggggauguaggcaggguuccaccccucacuggggugggguggggagguuggcaggggcuuuagggccaacugacuguugcggcagagggcgaguacaugacagaauuucuccaugucuuggcuacccugggacuugcccuguagaucaggcucacagagauccacuugccucugccucccaauggagggauuaaaggggugugccgcggcuagccaacagguuuuuuguaguggggaggagguauuugugaguuugugaagacaccgucagacagcuaugcaugcaacaguuccucagaaugggacaggcugggacauccuccaggaaagagaaguggacgccccuugugagugagcccccuaggaaggcuuucuggaggaggaggcagacugagcagcugguccaagccccaggaucugggaaggguccuuacuggcaucuucuucugcagggacaagcuggcagagcugcacggaaacauguuuguagaggaaugucccaaguguaagacgugaguguugcccguguaacacaagacccugcuccuccccuaagccagcucaggguccuagcauggccuagagaaggccagagacagucagaugaaaacagaccaacaaaggcucguagacaaauggggcaaacccuuucuucacagccccccaagggagaagcuggucaugcccuuggcaaugagggguucucccugcccugccuuugcuauggcucugggcugggugucaacauggcuugcacaccagagccucgggguguugagcaggacugugccuccugagcuuuggccccugacucccucuuagggguucuuuauucagacaggacuucauuaaaguugcccagguuauccugaaauuuggcauccuccugccucagcuuccugcgugcugagcucacaggugcgagccaucauguuucccuuagccuccucccucccgcacccucccuuguguggaugccagcggcugacacuggcucagcccccucugcuuguguuuugaggcagacuugcucucagaaccuguaccucuuugguuuagcugaguggccagugaacuccugggguccccagcucagccucccaagcucuggggcgacaauccugcuccaccaugcucuucguuuuccauggaugacucaaacacagagcccggagucugcuugccaggcacuuucagacugaguagucugucugucuaucccucgguuguuuguccugcucaguagcccauggguugagccuggcuacaccaccccccagcugagagaacauuagaaaaugugugugcacccuucccccuuuacaggcaguacgucagagacacgguugugggcaccaugggccucaaggccacaggccggcucugcaccguggccaagaccaggggacuucgggccuguagguaggugacuuuccucacacccuccaccugugaggaggugggcgcccccugacuccauucccugacugccacagaggggagcugagagacaccauucuggacugggaggacucguugccugaccgggaccugaugcucgcugaugaggccagcaggugggaccccacacuccccagguggaaauggguggggauggcuacgcagaccuccacagaaggucgaaacucgggugggacagcaggguuguccccaucacccccagcccagggcccugggcaccauaggugcagaggagaagcugagacacagagugaguggaagguuucuucgcguuccugcuuucagguuuuugugguaguggggagaauccugggccugugugcacuaaacaagcccucugcagaaucagccccuucgcuggaggauucuaggcaagagccccacccugaccacgcccccauaccuaacugggaacuuuaggugggggcuucguccugaccacgcccccaguaccuaacuggggcauucuagguggggcuccgcccagaccacgccccccaguaccuaacuggggcauucuagguggggcuccacccugaccuccagcuuugagucauuucaccauacaggaauauuugcuuuccuuuuuugagagaaggucugcuguguagaccagacuggccuuagacucaagaggucugucuaccuucugaaugcuggaauucaaugcgaaugcaguucgcucaaagcuugaaccuuuugauccuccugccucagccuguggaauagcuaggacaacaggccugugccacccagccugguugucguuaauuuuuaaaaaacuggccggguggugguggcgcaugccuuuaaucccagcacuugggaggcagaggcaagcagaguucugaguucuaaauucgaggccagccuggucuacagagugaguucuaggacagccaggacuauacagagaaacccugucuuuuguuuguuuuguuuuuuguuuuuuguuuuuguuuuucgagacaggguuacccuggcuguccuggaacucacuuuguagaccaggcuggccucgaacucagaaauccgccugucucggagaaacccugucuugaaaaaacaaaacccaaaacuggacagugguuuacagugagacaccaagacugaaucucagcucccaaguguuucuccagugccuggugggugggcgugagggcuggaaccugaggugggccugggccccacccacuuccugcucccuguuccaggaccgcagaccugucugucacccuggguaccucgcugcagauccgccccagugggaaccugccccuugccacuaagcgccgaggaggccgucuggucauugucaaccugcaacccacaaaacauguauguaccagugcccugcccggugccccggugcccccuagcccacgcugacugucccucccuuggcaggaccgccaggcugaccugcgcauccacggcuacguggaugaggugaugugcagacucaugaagcaucuggggcuggagauuccagccugggauggacccugcgugcuagacaaagcccugccaccucugccucgcccaguagcacucaaggcugagccccccgugcaucucaauggugcagugcauguuucguauaaguccaagcccaacagcccuauacuccacaggccccccaaaagagugaagaccgaggcugcccccagcugacccggguauguggggcgggaggggaacuugaaggaaccacacauguugagguuuuuguuuguuuguuuguuuguuuguuuuuuauauucuggggacugagcccagguuugcauaucucacccuggugucuuuucagauuuuuuuuuuuuuuuuuuuuuuuuugagaccaggacucccuagaucgcucaggcuggucuggaacucacugcuauagcccaggcuggccuggaacuagccugccugccucagccucuacuguaguagggacagcgggcagguacaccauguccaacacagcuccuuucuucaaagucucacugugucccuuguccagguccuuccagggaaucucagggcauggggaaucccacacauguggaagaggccgugucccagggauccacgugccucucuaccaaucacacccgcucgugacucaggaugugcccggagcagcagucucacacacuccacacaccauugcugcccccugcacgcaucucccccccauccccuggcccugacacagagccaccaagggcccaccaggcacccaucugugcuaagggccccaggcucccagaagcucccaaugcaauaaauacaaaaucccuuccauucuuuuacauuuuguuacauuuauguauuccguuugugugugugugguguguggagguucauguguggaggucagcugacaacuugaaggagucaggacauggaacucugggcaucaggcuuggcucaagcaccuuuaccugcugagcccucucaccaguccuguucccccaacccaccccaccuccuuuauuuaccuaaguguguuagaauccccacccagccaaaaaacggaaguuugaaggaccuguuuuguuauuuuguuuugaagucauuccaccccaacauggccaaauccauggaugaaaccauuccugugacaccaucaccucuggagcuggccuccugaccacuccaggccuggagacagaucucccacaacucucuugcucaugcaggcgcagugagaucuaacauuuuucuguggguucugagguuucaaacucagguccuccgugcuugcacugagccacaucccaggaguuccuaggugucugguuagucaaggucaacccacucacccaagauccaugugucacaggcugcgcccaacuugguagaagugaagauacucaauugcucgggucucuaugucucuguugucucugucuucccacugccuggucuggggcuuggucccacuacagggccugguuccccacaccagcauucuagaggaccuggucacucagauguuagggguggaaccuggagaaccucgacaaucauagaugcuaaguacagguagugaaucagaggcggggcugggcaccugcccaaucagaagcaccgacuucagcuuuguccaaucagaguccgaggcgggaucaugacugacauccugcaaacggcaguggucuccauucuaucaacugaaugguggagaaaugccacagaaaucccgcucaguuuggaggcaucuucauaugcguuccaaaucgucacccagaccagaaagucucccaccccaaacccugaguaacagggucaugacccagcaaagucuccacucgacguucuucuuucacagcucaccauccagugcagcagugggaucaggaucacaggggucucucacuccuaagagcauugauaucacgcacaguguaagggcuguggaggaacauccaccagccaucccucagaaagaaaccgcgucuguccuugagugucaguaguguggggaagccugcauuuaucuacaaucuucucaaagacaggaaaggaccucagagagaaacuacagauuucaucugugagggagagaaaaacccugcagucaugagccgagugggaaagcccucagacauuucucacccuugcagaugugcaugaaauuccacacaggagagcagugacaaggggaaacccucccuuggcuaauauccuguaggugguuuuugauacuuuguggguucuuccuuauaugagggugggggaggcuccugaauuuaauuccuuuuuucuuguuucuucuuuuagcacaacuacuaacaaacuaaaaccaaacaaccaaucaaccaacccucuaauucaccccccuccaccccaugugccagugaccaucaaccaaccacacugccucucggagcccuugcauuuuauauguccuccaagaagugcccagaauuccaaacauugcacaauaacagagacuaucugcagcuggcaaaaccacgccucugcuagagcacgaggcaaaucauugucagcugcuggggacaguccgaagcagccccaccccccacagacaaagacacauucuuauaauauuucuguauuuuuaaaagaagccuaaugggggcuggcgagauggcucaguggguaagagcacugacuugcucuuccgaaagucaugaguucaaaucccagcaaccacaugguggcucacaaccaugagaucugaugcccucugcuggucugaaguaaucuacauuguacuuauauguaauaauaaaaucuua

SEQ ID NO: 5655 - RNA, 19075 nt, Mus musculus
cugaucgggugucaccucuacucugcugcugguggcucgcagcuggagcggguaaccagagaggcugcuuggacgcuggguuccggucuggagucgccugagguagggggaugugggugagggaggccagggaagucugggugcuggugaggggugcuaccugcaacaguaugaacacacgcaucugcacacuugugacaggugcacacaucccacgcgggagccaaggcccaggcccagugcgcagcgucaccugugcugugucaccucuucagaaggcaaacccuuaaauccacaggccuucccugccaccuugccguggcgauuuccuucagacugguagcauguggacaacucuuuuggguguuuugucacccacccuuggugguagguguggggugaaagugaaccugauuaguagaggaggugggaucagugaauggauggauggauggguagauggguggguggaugggugaguggguagauggguggguggauggguggguggaugggugaguggguagguggguggguggaugggugaguggguagauggguggguggauggguggguggguagauggguggguggauggauggauggauggguggguggauggguagauggauggguggguggaacugcccuaaauagugacaguuuugaccagacuuucuugcaaaacacugacuuuccagugugucucccccuguagcuccauuacauaugaacccagguuagagguacaggaggagacccagcuugggagaacuuggaagcuccguuuggggagguagauaguucugugugggagagaggcgauuuugugaauagaaauuucacagagaagaguguuugugugguggggaguuuauggcaucaaugauugcacaaacuccagguugcagccugugugagcugcugaacuagugcugcugguugugaugcacgcucagccccacuucaggggacugccuggacaaggaggaauuaucucuguuuacaguugaggacaguuccuucagagggugcaaguagccugaacuuggacacacagcagauuugcccaggcuguguugugaggacaguguggcugaccaccccagcauccugucccucacccgacccacgccuuguccagaaacaagacgagagccccuagcaggugugaugaagacccuccgggcacgauucaagaaaacagaggugagucuucaggcuuggaggacugcucaguccucccugcuguggcucagaacccaccaguccuuuaggcuccaccugauccccuauccgcuguucccccagcugcugcagcaggucagcuacuccagcaggucagcugcuccagcaggucccugguucaguuuucuggaucaaaugcugauugcccacguagguucacugagucccacucaugguucaguucugcucacccaccccccacucagggucucagugguuacuggggcaacccuuccuccuuugcacaugcuggcaaggugucaccgagauacccccaaacucuuccugcccccguuuucauuuucaucgucguccgaauuuagugauuccugagggauucccaagugcucugcucugugagcccuggucuuuugcucacuaugauucuucaaggaaugaacuuaugugcauuugagagaggaaggauggcucagagaggugguagaagcuccucaaagccacacagcagggaagcgauaugccugucuccauuagaagauggagauagguaucaaugggugugaccugcagggggaauggggagggaagggcugggaggggggggaggaagcaagagauccagagagccagagagagcaagggagagcaugagagagagagagagagagagagagagagagagagagagagagagaacuguugcuuuccuagacaguaaagcuagacuaguuggaaaccaagucauugcacaugcugaagaaugggcuggcaaaauggcucagcggggccaggugugguggcgcacgcuuuuaaucccagcacuugagaggcagaggcaggcaaauuucugaguuuaaggccagccuggccuacagagugaguuccaggacagccaaggcuacacagagaaacccugucucgaaaaacaaaacaaacaaacaaaaaaaaaucaagauggcucagcagggaaggguacuugcagcugaacucugguccucugugauagcagccauugaucuaacugcuaagccaucucuccugaguuugauucucagagcccacaugguggagggagaaaaaugaccccacaagguuguccucugaccucugccuccaugcaugugugcauguacacaccuaaaugcaacuuuaaaaaaacucuuuaaaaaaaaaagauuuauuuacacgguagcugucuucagacacaccagaaaagguuaucgggucccauuacagaugguugugagccacccuguggcugcugggaguugaacucaggauucuggaagagcaaccagugcacuuaacugcugagccgucucugcagucccuauaaaugcaauuuuuaaguuaaggaaaaauaguuuuugaaagcuuaaucaggccagcugugauagcuaaagccuuuaauccuagcagaggcagcuggaucuccgaguucuaggccagccuggucuacagagugaguuucaggauagccagggcuacuauacagggaaacccucuguggaaaaaacacucaccuacuuaaaaagcugaauuauuucaaaaucuugcagccuacccacccuuggcaagagacacuuagcuuggaauguggguguauuuugguggggcuucgaagaaggggcagcaacagaguagggaggggugggucccuggugcuggaccagccugggcagcagaugggaggccuggucggccccuccccgccgggaaccugucugccacccucacccuucucugguuuccccauagcagccagggugaagcuuggcuuuugucucugcagccccuagggaagaaagugaacacucauggcugccuggaggccccuuggugcccugggccucuggguccucuccugcuguggccaagugccaggcugcagcccugcagauguuagcucaggcugagcucauucccaagguguccucaagguuccagcaggggcucagugggcucugggccccagauucucuuguguggaauggggacuacuuuaucuggggcacccuugcugacauucugaccuuauuggaggaaaaucccuccaggcagugauggaggcuuauacaguuuuggaagugggaacccuggcuggccuugaaucacagucuuuccucuucagucuccuaguauugcgaucauggguuguacagucacaucgggcucaaagcauucuuucucccuuuuuuguuuguuuguucuguguagcccuggcucucauagaacuugcucuguagaccaggcugcccucaaagucacagagaucugucugccucugccucucaaguccuggauuaaaggugagagccacugugucuggcucaguauucucucucucucucuuuaaagguggcacaugugugugugugcgcggguguguguacauguauguagauauguauguguguauguauaugugugucucuauauaugugccuauauacaugugcauauaugcauauguauauauauguaucuauauguguauauauuuauauauacauguguauauauguacacauauucuaggacucucugcagagagggacacaccaguaucuagaguguuaugggacacagaggcaggaguugcuuauuguuuauuagggagaccauaucuccaccugugcaaggcaauuucaugaacgacucacuucuccccaaguucugccucucugggauucucaucccacagcuccugucgugugucccugccugcugcuccgucuccaagacagcuucuacagugccaacuuacaugcacagaagccagagagcuagaaagucauuccgcagucacuugauaaauguagaacagaagagucucaggcuguggcccagggauauuuuguggguccugcauagagggcucuaauuucaggcaaggcagacaagugcccacacaccuuagagccagaaacggggguugcaacccccacuuccaguugaucuaaagauuccucugacccagccuggaagcugugcacagguccagaugcaugugccugaagaaugaaaugcaguucuuauuguguacucaugguguaccaggccuguugugcagggcggugcguucugcucagccucugcacggcccuccggagcugugucuggaaagucuaugugaaaccccauugcacauaugaggagggcggaggcuccaacaggugaggucuaggucagucccauagguggauaauggcgaggcagaccugggauucaaguuuggagugagacuugagagcuacuggagcgaaguaaauaaugaaagaguagauggguggacagguagguuggaggagugaaugggugagaggaugugugcgugaaugaagggaugaguaagccaaugcauuugcccaugaaaagacguuaguaaauggguggugaggaaauuaaugagcgaaugggugaaugaaaacauuagcaaagugcgaauaaugacuguuggagagagugaaugugugaaacgauggaugaacgaaugaaugaaugaaaagauaggcauaaauguaugaaugaaugaagacuggaaggugauggcugaaugaaugauguccaucauuguaaguaaggugagcuggaggugaggaguuagcgggcugacacccgauagggaccaucauggaguugcggggcggagccuuuucagcgggauggagcgugucggugcaggaguggggugguggggaagagagcacuauauagcagcgggcgagcgggccuggggaaaaugggaguaaccuggaacuuagaacggaugugagcgggcccugagcuuucguggaagaggugggaggggccugaaaucuagggggaagcugggcgggcucugugccugagccuggugaggaagggugcugagucuggagaagaggugugccacaggaggagggcagagccccgugucugaggagguaggcguggucugaucuggccccgcccuccugcgguucgccaugaagcagcugugccugugugcugcugccuccuucgcgguaggcguuugggucccucugcgccuuccccucuuuccuagaaagaaguucggcagagggcggggcgccuguagagccugggcgggaaguggagggcgguguugagggcaggcgugucugugcaggcguggggucagcaggccguugcgggaugcaggucuuggaggacacuguggacagugagugacucaggaacuguccauguuccugggcagugaguuuaaaaacauuagcggcugcaguucugcuggccaggccuugaugcuaccugggggcgauggucuuggcugagcagcugugaaggacggagcgagguucugggcgcuggaggauaguuuggaaaaggccagucaucccagcauucggaggcuaaggcaggggaucuuuaauuuuaguuacacccagucucaaaaaaacuaagacaguaaaauaauugugaacgaggagcuuggcaccaccaagcccuggcuuccaugcccagcacuacauaaaccaggugugauguuccacaccugucaccccagccucgaggacugggaggcaggaaguucaggaauucaaggucauccugacucccagggaguuugacagcagccuaggcuacuugaggcccugacucaaaaaacaaaaacaaagcuggaucauugaaauccucgcacuuugggagauuucugugacuuucaggcuacccuggucuacauaagagacaugcuauuuaaaaaaaaaaaaaaaaaaaaaaaaaguuguacccugucuuucaaaacuggcuuuggauuaaggcacacacaggugguuugaggaggauugauaucuggaagcugcccugguggugggccuggaucacacgcuggggggugcagguuucagagacacugucugaggcccccagcccaggaccaccuaucccacagcuccggcucagccccaccgaccucagcuccugcccacccuguggccggugcccuaucccaaaacccgcagccagaggcaggcgccaggcaagugcucagggguggguggggagagcccggagcaacugccccuguuccuugguggggaaaggacaucgacccacucagucccucgcaccucugggugugccaccgcagggccaagacuggggcaaaagugaccagcgacugcuccaggcaguggagaacaacgauguggccagaguggccucguugaucgcccacaaggggcuggugccuacaaaacuggaccccgagggcaagucugcgugaguguccaagcccuggggcugggguggcuuuggacauucuucugggguugaccccugacucgugccucuagguuccacuuagcagccaugaggggugcggcggggugucuggaagugaugcuggcucaaggugccgaugucaugagcacggauggagcagguacuuauggaaggaccgucccuggguggauggcagggcugcaucagcugugcagagcagggaccacagguccaacuguggaagcucacuguccacagugggagcucacuguccacaguggggcuguagcucaguagguaggacauucaccaaacaugagggaaauccuaaggucuguccucugaacugcuggcgcacaccugccaucccagcacuuguguggaaguacgaggaucgggaguucaaggcgauccucagcuacauaugaacuggagaccaaccugggcuauaugagaaccuguuaaaaauaaaaguaaaagaccccuuugaucgccgcaccagauggcagagagauccugugaguuuuaggauuuuuaaauuauuucaaaaacaaagauagcaaaugaauauagcaauaaaaagcccucugggaacagcacaguuuuaagaaguagcugaguuuggacauucaggcuugggaggcagcugagaauaccuggaggacacgccucuucucuucuccccucagguuacaaugcccuucaccuggcagccaaguacgggcacccagagugucugaagcaacucuuggagguccugauguccauucccugucuauacugaauuccagcuauuucuccaaaccccagcugcuccugguccccagcccugccuugccccuuuguuacagccaucaaaguagggcuauccggagggcuggaacauggguucucagcagaggaagaugguagaggggagaaaaagagccugaggggcuggagagauauaaugaaucugccaggcacgguggcacacgccuuuaaucccagcaauugggagguagaggcaggcggauuuuugaguucgaggccagccuggucuacaaagcccaggacagccagggcuauacagagaaacccugucucgaaaaacaaaaacaaaacaaaacaaaacauaaugaaucugugggucucauuugccucaagcuugaucuuuguucccugggacgcacauggaaggaaagagcaaccucccacagguuauccuccacucucagcagugugcccugccauaugugagcaugcacacacagaaagaaggccauagagaguuacaggaaagacccugagauaaagcagggagcaggggagggcaggagaaaucagucacuccggaaacagagaugacaucaccugucacuccuucccaggcuuccugcgugguggacaucgaggacagcaguggguggacagcccuucaccaugcagguaggugcagcuagauucucccgaauucaaggaaggcccucuaccaacgagcuacauccacagcccucacuagggaacucuagguggggcuccucccugaccacgcccccagccccucagaccacgccccccagccccucacugggauucuaacagggacucuacccugaccacgcccuuaguuuuuaaagaaucuguguucaugugucccugcguguggccuguggaagucaaagacaaucuuaaggugucaucaucagguacccuccacacccucugagacagggucucucucugaaacuggucuucacgauuaaagcuagguuggcugaccagugaaccuuggaucccccugccucugccuuccuggugcuggggucacagacaugcacucccauaccugacuuaugugaguuuugggaauaaggcgcagguccucagacuuccuagcccucucaguauguugacauagagucucucucuguagccuaggcuuaaccuugaagucaggguucuacugccuccgccucuggguuuuugggugacagaugugggccacugucccuaucugcuuugcuucuuuugaccugaaugcaguccccaacagaaccaggcccuuuugcccauugcacaaagaaguuaggcacauguacuagugggggaacccuauuccuuggaccccaaagccuagucccuggguguacaaaguggggugccuagaacccuaauucccuccagggucuccugggugccuugauugcagauagguccuccagcacaccccucaaacccagacuccauccucagagcaauuaaggacuuacuggagccagugagcacaggguccagguuagagccaccuguccccagggacggcacacuugaauuuacuuuagggguaagguaauuagccacuaauuccccagucagaguggcaccaccagguggugucgaugccaauaggggauaucuuaacaauuaaguugcauuuauucauuuauugugagguuagggacauccuugucauggugcuugugugacagucagaaggugacuuuuaggaguuguuugucucuccaccggcuggcuccuggauguugaacucaggucacuuggcagcaagcacuuuuaccaacugagccaucuuugagacccauuuuuuaauaaguuguuuuuauuugauuuuacauuuuugugaaaaaauauuuuaaaaauguguaugagugugguuugguugcaugcauggcuguguuccauauaagugccugguaccaucagaggccaaaaaggggugucagaucccuggaacuuuuacauacaugagcugccauguggguguugggaauugaaacugaguccucugugggaguagccagugcucuguugagccaucauuccagcucugagguuuuaguugagguauggucucaaucuguagcccaggcuggccccuaacuugcagccaucuuccauccugggccuuccagcugcugggaugacaaauguuaacugcuauaauguauagugaguucuaggccagccuagguuacagacuaagacacugucucagcaauaaaauuauaguguucuuggcaggcagcugucucucccaccuacucuucuuuuuucuugucugucccagcggcuggugguugucuguccugcucaaagcugcucuguuccuuuaaggcacacaugaacccccgggaccgggugagcugcuggggucucauugggugggagguacaguguuauccuuaugauagaugcucaccaugggcaacaccccaggcaucaucugcaaagcacgggugagacucaugccauuucauccucucuaccagucgggugccacaccccucaucauagcggcucagaugugucacacagaucugugccgccuccuccuacagcagggggcugccacaaaugaccaggaccugcaaggcaggugagcacuuccccucuagaccuuuccaucauaugcugcaugauuuggggcaaauaucuugaccucuuuaagcuggugaccuagucaccucuuccucccuucucuuccuggccuggguacaaagacaguuguaugguguuggggacaagccucuguccccucagcagcuccuuuaucccacaggacagccuugaugcuggcaugugaggggggcagcccugagacuguugaaguacuccugcaggguggagcccaguugagcaucacugaugcacugggccaggaugccacucacuacggagcccugacuggagacaaacucaucuugcagcuucuacacgagucugcacggcgcucuucaccucccagugguaugcaagcccuacccuugcucuccuaggcaguuucuggccaucuccuuauauguuacugauaguuucgagguacuccagucugcugucaugaacauuuucaugcuucuuaacucagggcaguuucaagaagccucaguggucugaggauccacugugauuuucugggucauccuuaguauagagacucugccuuuccuaagagguggcaccccacccacccacuccaaccuggagcuccagugcccugagucucugagagauuaaagguucuccccacccaggacucuacccauaggucucucuaccuuacugucccuuauucagaggcuggacuuuguggugccugacuaggagaccagagcaguuagaucugaguuugugguuagccugagguacagagcgagacucacaguaugaacaaaagaagcacuaaugcuuuggaagcuuugagagccuguggaauaccuuggguuggccagugaccuuucugagaacugagaacugugugcugagaacugggaacugugugcccgacuguuuccccucucuccccagccucucuagaggaggacuccggagaggccucaucccagguaggaauccggaauccgugaacguccccagugcuaugcaccacucacuguccccugaccuacaggaagagacagaccucuauguacagaguucugucauggccccuauccaggaucugucccugcucaguggcagugacacgaacaccagcaguccugcacacuagggacaguggaucugggacaggugacugaggacugggguugcuaagggcugcuucaggcagagcaagagcgggccuggccacuuuccacauuccugcccugggucugcugugucucaggcuucauggagaauagaaaaugacauagaagccgacagagccagggaaaguauaaaguaccaacagcgaaccguacgaucuagaguaagugggaagacacgggguccuucacaguauggaggaggcaggggagcugaggcugcugacagcagcggguggucacauuguauccccgaaguggauccuggcccuguacccaugugcuacacccccucugcccauaccagaacucagugucaagccaugagaaacaaggagcccccaagaagaggaaggcaccccagccuccagccagcacaccaguuccuguaagaguuggggggagccuguggcaaggugggauucugcuagcucuagagacuuuaccuaaagugguguccccugauggggaggggacaggacgaucgggaugcuuaugaggagauuguacgccugagacaagagagaggccggcuccugcaaaagaucaggggccuggaacagcacaaggaacggaggaggaaggagguuaggaggcugcagcccugcagucuggagcaauucccugggauaucauaccaccuaccuuccuauccuuccuucacccuuucuuccccacugucccuuugcuccugacaugcagcccccucacuggccuuucaacaaugcaggcucuguucagcccuagggccuuugcccauggugucugcaguacagaauugcugucucuccagcuguccccaaggcucccuuucuccaacaucuccccugccaccauauuugaaauuguaugcuucuuucauuucaccagagcacucuaccacucaaaggcaugcucgugagggcaggcuugcccauaagggcaggcucaggugaaagugcugagcucagaguggaugaauacuggaugaggaguggcccacggugaggaaugagugaacgcaugcaugcaugaaugaaugaauggcccugcacaggaucugcuacacagcaggcaauguaccuaagcgcccugggugaaagaacagaauggggucugacagugugaaggaucggucagaguggcacauaguaggugcucaguguacauggaaaaaagccauggcuaccagacacuaggugguagguggcuguccagucccaaccacuucuaccugcagccccuggaggcggaggccagcucagugcacagccuggagagacagguaggugaggagggcacagccaguguuugggaggguccaguguccugaaguccucaagugcugaccuaggccucuguaggugcaggagcugcaacagaugcuggcggagaagcaggaggagaaggagagccugggccgggagguggagagccugcagagccgucugucccugcuggagguggguggggcuugggagugcagagccacagaaggaaggucccuagggauuagggcguugccuuaggggcagggcaagaggcugggugggguggagcuuggaauggccaaagagauguaaggaaaagcagggagugaauguggaaagaggcuuucaucaaaguguguccugccaguguugggagggguaagggguggggucccagcaugggugaggagugugguagaguguggccaacucugacaugccagaacuucaccuaugcaccauggugcauccauaaugucccagccacacaugacuuccauaaaaaucacacacuuaucaagacuucugcaaacacacgcacccaugcaaagauucuagccccucugacacacacaucacaaucacacgugccccaaacauauaaauauaccagucacacacaggccacagcccucacacagacacagacacccacacacugcucagagugugcaauuagaguuggugauauagaccagucaauaaagagguugcugccaacccuacugaccugaguccacuccccacaugacagaaggagagaaccaauucuucugacugcugacuuguacuguggcgugugugcacauccugcaggcacacacagaauaagugugauaaaaugucccuccaagcacaccauggcacagacauacacagagaugagcauguauuuggggaugugcugggauucaagcccagagccagacucuggccagaacaucccucagugaugagugcuugccuagcaugugugaaggcccugguccauaccugcaucucacuagaagguggaagggccauuugggugcucagcagacacagacacagccaguuuggagcugacccccaaucccgcuguuguguggauauauggacauugucaguuugggaggaccuaaagucucuugucaguaaggagcagggucugaaggucuacuuugugcuggacuccuagaaugagagagaaaacacaagcuaugauguagcuacccugcaggaugaggagggugagaugccugacuucccaggugagaucugccccuccacacacacacacacacccucccugcugccuacccgggauucugagggguggauggccauguggacacaaaaccacgaccauggccuuccauggaggaggcacaugaugccagaagggcacagacacuaugauccccaccugccugaggcaaugcaccuccccacugagcaguuccugacugucccucauggcauguguccccagccugacucugugcuguucucaaccuugucaggagcugaugcacugaugccaaagaaccagaguccaucagcagaggaaauaguugcuucccuacaggagcagguggcucagcucaccaggcagaaccaggagcugcuggaaaagguccagguggggaaacugaggcaguggacaucucugcagaccucggggugggcagggaacauggugagcccaccucuuagccugccugccuccccacccccagauccuugaggaguuugaaaaggaugaggcgcagauggcagaagaaagucaggccgaggucgucccccuggucuuguaugaauccuuacgggcagagcuugagcagcuucggaggcaauacacagaggccaugcauucgcagcagcagcagcaggagggggagccacccagggcucaagaaggagaagagacagcauaccaggaaaucaaggauaagggaaucacuauccagaauggacccagcgucccagaccucaacggcaccacauaugcagaaaccaaagcaaauggaauggaacuccaagcaggaggcuccaagggugucuggaauacugaagcagggguuucagaagcagcacccauagaacccgaggcugcagguucagaggccacggggaaagacagacuggcagccaaggaaauggacacuagugcuacuauggcugaggcccuaaaugugaaagcucuaggugacaaugccgaaagugagccaguggcugccgaagauacaggaggaaaagagaauccaggaaugaaagcugaugagguggauguguuggcacaggcagggcucacagguacagugauuagaaacauggaggccaucggagugcgggauacaggaauucaggccacaggauuagaggcuaaggcagugaagaccacuggagugcaggccacaguggcggaggucauaggagugaaggucacaggagugcagaccacagcgauagaagcuauaggagucaaggacaccacccagguggccacaggagcgcaggccgauugcuggcaggccacggaggcagacugcaccggagcgcaggacacagcuauggagcccacgggggcacaggccacugugacagagacuacggaagccgagaccagcggcacggaggacccuugcgcugcgauccugcacccgggggcggcggcggcggcgcugcaggccgagcuggagacccggauccgcggucuggaggaggcgcuacgcagaagggagcgggaggcugcggccgaguuagaggcugcucggggccguuuugcagaggcugaggaggcggcgcgggggcggagccgcgagcuagaggcgcuucgggaauugcuggccacggccacggcuaccggcgagcgcgcacgcacagaggccgccgaguugcgccaagcgcuagcugccuccgaggcucgggucgccgaacucagcucuaccguggacgccgcucgcgaggagcuggagcgcaugcgcggggccucgguuccugcggacgagcacgagcacgcgcugagcgcccugcgcgaccacgugacccggcugcaggcgcagcuggcggaccuggcgcgcaggcacgagaagacuagcgcagaggucuuccaggugagcgccugcgccaggcuguccuuucagaggauuuccgcgugggccugggcgucugcgugaaugucuaucacauauacgcaguacuccggaggccagaagagggcguccgauuuacuggauguuggaguuacagacaugagccaccgcguggguguugggaacugaacccuggucuucugcaagagcagugaucuaacccccuuugcuauuucuccagcccauaguauuucuauuuaguuuuaauuuauuauuuucuauguggugcacacacauggcauggugggaaagucagauggcagccugugggacacaguccucucuuucucauguggauccugagcaccaaccaaggcuauuaggcuuagcugcaagcaccuuuacccugagccauucccgagcccccuggucuguguguguguguguguguguguguguguguguguguguguguguuuuguuuuguuuuuauagcagagacuugugugguugaggcugauuuugaaagccugauccuuuagcgucuaccucccaauuagagggaugauagguguagcaucaguaggaccuguuuacacagaggugcauguugggccagcucucuacccacugagucccaucugaguugaaaauuuuguuuuugccaacuauauugugugcccauagcuucacagugaggcccugucucaacaaaacaaaacaaaaaaagcgaacaaacuuccuuagaagggauugugugugugugugagacaguuuucguucuugcuuuggccuugaagucacaguguagcuuuggaacuccugauccuccugccucagcuucccgaguaucugggucacaggcuugcaccacaaaugaggccaccagggcacaaagaggccuaaccagcuguccagggacaaacagccaguagccaguggcucuuggcaggaccgggauguuaccagggucgggugggaaucagaaccuuccuugagguggaaugguaucaguucagcauggaagggugggaagagccgaaggauccaagccacuuuggggucuaaaugucccgagagucacgcaugggcuugggccacaggugcagcgugaggcauuguuuaugaagagcgagaggcacgcagccgaggcccagcuggccacggccgagcagcagcuccgggggcuucguacagaggccgagagggcgcgccaggcccagagccgugcccaggaggcccuggacaaagccaaggagaaggacaagaagguggguucccuccuugcucacuguugguguccacuaacccgagauuacacaaaacugaagaaccucccagccagcaagggcuugagaauuuagcccauuucucacaugugaaacugagucccagagaaggaagaaagucucagcagauucacuuuugguguugauaugcaaugguaaccaugguaacagauauccagccuguaacguguucucuaauuauccccauuugaaguaauaugcacagagaggugauaccacuccgacaagguuacauggccacgaaaugggucauaagcugggauuugaacccauuuacauauuuaaaaauguuuaaaaugacacauauuuauuuauguuggacuuggagcaugcauguguggucagaggacaacuugccugaauccauauugugcaagcaugugggucccagggauuaaacucagguagagagacaggcuuggcagcacgugucuuuaccccugagcuguaucauuggcccccaauuguaucuuuuuguguaugccccuugugugcaugugcaugcguggaagucacaggucaauguugggcaucccauaaaaugagauaaaaauccuaaguuggcuuuauggguugcugggucuggccaggcagccccaggcccuguuuuuuuuuccaaggugugccaacacaggccuuaagauaaggggaugcaggguguuuucuaugaagaaccaaaccaaaacaaaaaacuguauuuauugaccuggaggcuccauaaugucuggucccuguuugcugugaacagacauggcuguguaacaauaaaacuuuauuaauaagugucauaugugauuuggaaucccuucaguggucacaaaauagaucuuucuuuggauuucuuuuucuccagauauuuaaaaauaugaggaacauuuuaagcccugggcuguauaaauacagaguuuuuuggaauguucucacagcauucggaauucuccucaaaugaggggauuccuggacuguguucuggcaagcaccaguguggucagaggcugagucagcucagcuccuggcucgaaucagugacccugugccaggcugcccaggaaaggugccagagguuccuggucccugccuggcucggcauguucacucacaggguccccucccuuuugccagaucacagaccuguccaaagaagucuuuacacugaaggaggcucugaaggugcagcaguccaccccagccagcuccaaggaggaggaggcucugcgcggccaggugacagcccugcagcagcagauacagguacuggcucuguauauggggcaggggugaugggagccauagacagagcaaucgggguagagguggggguggcuggcaggguacaggcugggcaggggaccucagacacuucccgaggcagucacuagcagccacuggacaugggguuuugacucugugggcgugucucccucuagaugggcuucccucccuuuccauuccaagcccccuucucuccuucccuucccuccuguucccuuccuccuucuccaccucucuuuuguggcagggucucagguagaccaggcugaccucaaauucacaauguacacaaggaugaccuuguaccucugauauccccaucucccguguguccacaggaggaggcccgggagcauggcgcugugguggcuuuauaccgcacccaucuccuguaugccauucaggugaguccucugccuccugacuccaguccagcuuuauugauccccugacacuaccugggccucgguuucuccuucuguucagagccagccucaugguuucugggaacaucccugugcacugacuuauuucuugggggcauugauacccuggguuugaauagacagauuugcaagggaaaggguagcaucuaccagaagcaucagggugugacucugccucugucaucucccaccucaccagggacagauggaugaggauguacagugcauuuugagccagauucugcagaugcagcggcuucaggcucagggucgcugaggacacagcucaacuguucagucuccauccuucaccucuacaagcagaagccacagacaccaucuuccccagcucccaggggaugaacaagauucaacacucaaugggagaccagccuggggccuuaucgaugguggccagcugaccaccccacacucccuauagucuguuccucugauucccagcacuccccauuugauauauugggaacccugauaugccaccuacaucacaacccccacucaggaggacaagcuugguguguguauguguguguguaaaagggcggggggugggguggggcaggaauacccagugugacacacuggguaagggcagcuauggggcaggggacucaggacacaguuugaucuucugguuccauaacacgacuauggcaauaaauguaagugcaauguaauauuuaaagaaacca

SEQ ID NO: 5656 - RNA, 551 nt, Mus musculus
acguuuuuuucgccaagauggcgccgaaagcgaagaaggaagcuccugccccucccaaagccgaagccaaagcgaaggccuugaaagcuaagaaggcggugcugaaaugcauccacagccacaaaaagaagauccgaacgucacccaccuuccggcggcccaagacccugcagcucuggaggcagccaaaauauccucggaagagugcgcccaggagaaacaagcuugaccacuaugcuaucaucaaguucccacugaccacugagucagccaugaagaaaauagaggacaacaacacucuuguguucauuguggaugucaaggccaacaagcaucagaucaaacaggcugucaagaaacucuaugacauugauguggccaaagucaauacccugauaaggcccaacagagagaagaaggcguauguucgcuuggcuccugauuaugaugcccuagauguugccaacaagauugggaucaucuaaacugaguccagauggcuaauucuaaauauauacuuuuuuuucaccauaaaaaaaaaagaacauaau

SEQ ID NO: 5657 - RNA, 551 nt, Mus musculus; identical to SEQ ID NO: 5656

SEQ ID NO: 5658 - RNA, 1427 nt, Mus musculus
uccucuuuuuucuuuuuccuuuucuuuuuuuuuuuuugugggugcagcaaacuuuauugaugguauucaagagaguagggagggcucccuaggccccuccuguuauuaugggggucuaggguggaaacugugagggagaugcucaguguacgggaccaaguugggauagggacuccucagcaaccgagggccucucucuugcucucaguguccuugcuaggugagugguccaggguuucuuacuccuuggaggacauguaggccaugaggucuaccaccccguugcuguagccaucccaggaaaugagcuugacaaaguugucauugagagcaauaccagccccggcaucaaagguggaagagugggaguugcuauugaaguugcaggagacaaucugguccucaguguagcccaggaugcccuucagugggccuucaccaccuucuugauggcuucauacugggcagguuucuccaggcgucacgucagauccaccacacauugaagguaggaauauggaaggccaugccagugagcuucccuuucagcucugggaugaccuugcccacagucuuggcaguaccaguggaugcagggaugauguucugggcagucccauggccaucacaccacagcuuuccagaggggccauucacagucuucugaguggcaguguuggaaugaaccguggucaugagcccuuccacaaugccaagggggcuaagcaauugguggcacaggauguauugcugacaaucuugagugaguugucauauuucuugugguucacacccaucacaaacaugggggcaucagcagaaggagcagagaugaugacccuuuuggcuccacccuucaagugggccccguccuucuccauggcagugaugaugccaauagacuccaugacacacucagcaccggcaucaccccauuugauguuagcggggucucacuccugaaagauggugaugggcuuccuuuugaugacaagcuuccuauucucggccuugacugugccauugaauuugccauggguggagucauacauauagaccauguaguugaggucaaugaaggggucguugauggcaacaaucuccacauugccauguggagagaagacagcagcccugguaaccaggcgcccaauacggccaaauccguucacaccaaccuuuaccauuuugucuacaggacaagaauagcacuguacaagaagaugccacugucucuggaacaaggaggaagagagagccuugguuuuucgagauaggauuuuccuauguagcccuggcuauccuggaacucacucuguagaccaaacuggccucaaacucugaaauucaccugccucugccucccgagugcugggauuaaagugguacagcaccacugcccagcuauucuguguuuuucuuaaaug

SEQ ID NO: 5659 - RNA, 30909 nt, Mus musculus
caugcaggcuucugaggaagccaaacuuggucaaguaaggccuuugucuuaccuucccagugauagauaagugguagaaaaaggcuagaggagccugaggguccuaucaagcucacaccacaucugagcaccaguagcacaaguggcccaaaaaauugcuuuugggcaccugcauggucuucagcacuaagcaggaaaguugagccagugacuaaaagaauucguaacaacgcaagggauccuucuccacagacagcagguguaagucuacgagaaauguugccuagacagcuguaucucaccaauauuuuucucuugauaaaaagauguugcuggcugggugugguggcgcacaccuuuaaucccagcacucgggaggcagaggcagguggauuucugaguucgaggccagccuggucuacaaagugaguucugggacagccagggcuauacagagaaacccugucucgaaaaaacaaacaaacaacaacaacaacaaaaagauguugccuagaugugagaugucagaauuuggcccacucuagaaccugccuacagccaagggagaccaaucaguauuguuuuaaauacugauguaaacaugaaauuguggcgaaaucucucuucuuucuccauuuggaagucacauggagagggcaucaugcucacucuggagaccauaauuauuggugguauaguccucacucauuuaaccuuuugaugcccaccucugggaugguggcauaguaggccagugccaugacagaaggcugggaaaguguuauugcuuggcuaagaauguacaucugagaggugugaggaaaucuuauugaaauugcugaugcugacuuaauuaaucuuaauucauuuuaauuaacuuaaucuguuggcuuaauuucaaccugaaugugugggguauuauuucagcugugagguagggggaucacuucaauauacacugagcaaccaucuguguaugcuagagcccugugaaucaaaaacuaagaaauaagaaaagaagaacaugacugguccugauuuuuggccccagaugaaugaauaaaagaaaaaaguaaagaccaugauuacuccuagauauugugagggagaauucuuguaaauaaaugggagaauacagccagaggcagagauaaguacgagaugaacccuuaggcaugugagaagaggagggaggggagauggaggaggcagaccaagaagucaggcauguaaaggguagauaacaaaaaacaaaaccaaccaaacaaaaaauccuccaccccgccucugagauauacguggggaggacauaugggguaaaggguagccaagauccuagucuggagaaguucacgguaggggccaggcaugcaggccaacauuguaacagguagagacugagauaugcagagggaaccuggcagauagcauuuuugauaaauaggcgccaaauuuauuuguuucuggguuugagacauaacacucucugcccaggaggaagacggggacgugccuacugagugcaggaaaagugcagggaccacuuugcaguccaggaacaaguucuacagcaaagccugccuuaugaucuaggcccgcucuuggccuguaguggaagccggagaugggaaacacgaugucucuuagggacacugcuccugucacucaggccucaguagccaaucagaacuucgagacgagccuucagucauagugggcgggcacuuccuguccgccauauuacccgcuuuguugugaaucugaggaaagcacuauugaccaucugccgguaguugagcggagagugaggcgaacuuggaauccgcgccauggugagcgaggccgccguccccacgcggggaggauccgcggggucccaugugggguuguccuggggugcgggcaccggcagcgagauguggcgaccuucguaauugcguuugucacccgaagucgccgaguucccuuauccuccgguguggaagcagcaccucccagugagacgguuccccgggcugcgccggcgcacagcauaggaagcuagagaugaugcuuggacacgggcauccuucagcgggcacgcaugcgcggguuuuguugucagugggagagauuugcugacuggcagagcaaauucuuuucuuuagugucuuccagaaguucuguaccuggcacuugacauucggguguagcauccaucgcaguuaacucugcgcaguguaaagccugugucauuaacacauucgcauguagaugccacggugguccagucacguguguuaguaaggccagacucacugugauucccugccuaaguuguccaaaucgaccgaguauuaauuguguuuuuguccuaaguguucucucauguucugucggucucaaacagcacagucuuuauggcagguguaggguaauuuagaagucagacggugucaccgugccguuuauucagccuugugugcucauguuuucauucaugaugaccuuuugucaucggcuuucugucgcucauugcagaaauccuuagacucuuuacuggacguuuguugaaucuauagcucagauuauguacugaaacaauacugagacuaauugucuagagucauaagauuucucuccuuugaccaaguucuuugagucuuuuaauuacgaaaugauaauuuuggcuacagauacuugucauauugucauauaugucuuauugcuguuuuauccauggcgacauauaagagauauggagaucuuuauuuuuaauuuacuaaauuuauuugaugugcaugaguguuuugcuuccgugcauguguguucaucacuuggguguuuggaguccauagaagaccaaagagaccauuagaugcuccccaccaggaucuagugaucauuuugugucaucauguuagugcuggaagccaaacccagcucuuccacuagagcagaagucuuaguugcugagccaucucuugugucuuaaacuugacagacuuucaaaauuuuacaugugagugugcccauuucacaggcugaaaacugaggguuaaggugauugagguuuguuaaaagucuuguguuugggaguugggagaugucucagagguacuguuugagacucggucuguuugacacaagcuagaguuagacuguccugugggcaaauguguaggguauucuccugauuaaugauugauauaauagugcccaucccacuguguuuggugccacugagggcagguaguucugaguuguauaagaaagcagucuuagcaagccauaagaucaggguaguuucuuagucagaguuccauugcuguggaagagccaccaagaccacagauagcaucacuuauaaagaaaaucauucaaauagggcucucuuccaguuccagaaguuuaacccauuauugccacaguguggauuauggguauacauagcagacauggugcuggagagguagcugcgacuucuaaauucagaucagcaggcagucuggcuugagcguuugaaacugcccagcccaccuuuucugaccgacuuuuuccaacaaggccacaccuacuccaacaaggccagagauccuaguacuuaucaaguaguacuauucccuaauggccagacacugaaaucuaugagccuuuggguaccauucucacucaaccgaccaugagcaguaagcagcauuuaccaaguuugcagacuaugaaugcagaagccuacccuuuacgguuauauaauuuagcaaaaucuugucgcugccuugugcuggagacuucuuaucauauagagucuucuucacuauucucuaaauguguggugugauuucacguugggaaggcacauuaauuccagaacagccucaccuccagcuuucaggaaaauacuuuggguguccuauguugacucugguugucuuccuucuacuguguagcuguacaggcuuucugagccaaccuccucaauucuuggauugaagguuuauaguaccacagaguucuaaaaagaauucauuugauuuacauggugguauguucauaucaguagcaggaauagaacuuguguguguggagcauggcuucucuguggacaccggaaaagaaggaaggaaaagcuuacuguguauacuguaggucaaaacaggcuaggcaauaucugaguuacaggcuuuuaauguuuaaucagugaacuguaagggucuccauuauccugaugugguaggugaguugauguguucuuucccagcaugcauuaauucauaccuuaugaauuaaggcaaaccaaauugguggauguggaauuugaggaaguuaucuugggccaaugaaauuuccaaguggccaacucucucauauggauaaaugcaaaccugguugugucauuucaguuuagugacugaaggcaccaguauugagacacagggcauuuggcuuuggcuuguauaucaguauacaacacucagcaguucauacacugucuucuuaauggcauuuucucuaccagaaaagaacuuauauuguuuuaaaguugguauaccuaaauaguuuuuuuuuaaagcuuuuuauaucucuuuuaaaagccucauuuuuuuuugcaugugacauuguggugguugaguuuagcccccaaagacucuuguguuugaaugccugccucauagagagugggcacuauuaggagguguggccuuguucaaggaaguguaucaccguggagguaggcuuugaggucuccuauaugcucaaccauggccaguguaacacagucccuuucuucuccuuccuguggaucaaguuguggaacucagcucuuucuccaccaccaugucuacuuggacacuguuauacugccaugccuccugucuuggaggaaaggugaacuuccauucaucccuuuaaacucugccuugccucucugcugcacauuuauacuccauugaucucuguuauagucuucuguuuaaauacauuuugagcuuaaaagaacucaggcuaaauuccacauuagagaugucuuuguauaaauugaacuauaguuuuucucugcuguuuaacuuuagagaaagauuucuucccuuuggaaucuuuggauuggacaaagauuugaagacacccaguguuagcauccaaaacuccaaaacuacccagcugagaguucuacaccucauucugaaggcaaacaggaauacuggcugguuuugugugucaacuugacacaagcugggguuaucacauagaaaggagcuucaguugaggaaaugccuccaugagauccagcuguaaggcauuuucucaaucagugaucaaaggugggagugccaucuaugggcugguagucuugggcucuauaagaaagcaagcugagcaagccaggggaagcaagccaauaaguaacauucauccaaggccucugcaucagcuccuguuuccugaccugcuugaguuccaguccugacuucuuuggugaugaucagcaguguggaaguguaagccgaauaaacccuuuccuccccaacuugcuucuuggucacgauguuuugugcaggaauagaaauccugacuaagacaacuagcuuccagacagcuaggacaagggucuuaaagccauguccacggugacacaccuacuuuaacgaggccuuccuuggccaggcauauacaaacuaucacacaagugaaaaucugcuaagacaaauauagacuagggacagaaguuaaagcuuccugauaauugaggaaggggauugugaugguuugcauagguauagcucccauugacucauguuagaaugcuuggcacaugaguagugacacuauuuggagguggggccuuguuggaauucaugugacuuuguuggaggaagugugucacugugcaggcaggcaggcuuugaggucuuguaugcucaggcucugcuccguguugaaucaaugugugucuuccugcugccugcagaacacagaguccuccuuccugucugaggaucgaccaccucuaggauucucagaugcaccuccaacagcaagccugcauacacacugcuaugcuuucuaccaugaugauaauggacaaagccucugaaaccauuaucagccccaauaaaauguuguccuuuauaagaguugccuuauuuauggagucucuucagaucaauaaaauccuaagaaguugguacaagggacugggguauugugauaguccugaccauguuuuuguuugagguguguggauuuggguacuguaauggguuguauaugcucagcccagauaguggcacuauuaggagguguggccuuguuggaguaggugugucacuguggguguggguuuuaagacccucauccuagcagcuuggaugcaagucuuccacuagcagccuucagaugaagauguagaauucucagcucugccuacacaguuccugccuaaaugcugcuaugcucccaucuugaugauaauggacugaaucucugaaccuguaagccagcuccaauuaaauguccuuauaagaguuuccuuggucauggugucugaucacagcaguaaaacccuaacuaagggccuuuggauuaggaaagcaguugaaugcuuuaaguuguacuuaauuggccauaguauuagaagcauaagacagugguccugagggugauuugaacucugggugccugacucaagaaguuucagagaggaagaauuuuaguaugaugcuuagacauuguucuugugauauuuuguugaagaauuuggcugcuuuuugccuaugucugaagaggcugcugaggcuaaagugaagagauuaauuacuuugauaaaggacauuucaaaaagccuaguguagacucuguccugugguucacucucuuaguaagagaacauuuugcaaaggaauaauaugagcaaggacagauacaaaauauaugguucaaggauuaaagggguaccaggaaguggaauggagguaaauccuguguuuaagcagauaaauagauugaauauaucaaauggaauuauaggaauggugaucucaggcaagaucaaaaccagcuaagcuuacugugucugugcaauuguauaaggcaucguuauaccagguuaggcauuaugaccuaguuauuguuuucauuugacauaugaaauaugaucguccaguugauaaggguuagguuaugauggcuauuuucuguuaucaacuugacuauaucuggaugaccacucccccaagcccccugaaauggaggguguaccagugauccagaucuugagguauaaagauuuagaugcuuugauauggaucuugaaucugaaagauucaggcuuuagaucaggaucuugaggugggaugacauucuugauccacauugacacaagccuuuacuugugcuacaguggccaugauuauaaagauauguuaaaaaaaaaaaaaagcugagguccaggcauggugguacaggccauuaauccuagcccccaggagacagaggacagauuucugauuccaagguuagccuggucuucagagcaaguuccagguaaagaaaagcuaagguccaggugcagucguacaugcauuuaauccuagcaaucaggagacagaggcauauagaucucuggguucaaggccagcauggucuacugagaaaguuccaagacagcuaagguuaggcagugaagaaaagcaugggaaacagaaagcuguugaaaauagaaaauaauugaaugagguagacauguuccaguacuagcaagcagcagaacuuggccacuuaggacaaaaagcucucuuuuaugaaaagguuacuucauagguaaaauguuauaugaaaggggaguugcggaaggauguugauaguauguucaaagcauuguuucauuuuauaagcucauuauaaguucaaagcaacaguuucacauggccuugcuuuaucauacugcaaaccuguggcuucauccuuggacaugaccuagaaugaaugcugcuuuuccuugauuacaaguuugucugaaaccuguuucucuucuuaaugcaauucauguugcucaaugcaguuccuuauuaugcagccuuuauucuacauggagggggcacauucuauucuuuuguuuuuguuuuuuguuuuuuugagacaggguuucucuguauagcccugacuguccuggaacucacuuuguagaccaggcuggccucgaacucagaaauccgccugccucugccucaaccuuccgagugcugggauuaaaggcgugcgccaccaagccuggcacauucuauucuugauucuaacuuuauuacuucuuucuggcaaaaugacuaaaacccuucagcuuucuuccugaaauuauuugaaucaaguuaggaauucuaucaagucauuaauucaucuaaauagcauuacuucaugaaaguucaucuucauguugaucuguaggaaauuuggcuaauaggguggauccgaguucgagucuauccuggucuacacaccaaguuccaggacauccagggcuagacagagucugguuggagaaacagugaagaugcucacaagagagagacuuaugagucccagcuuuauacaauaacaagaacaagcugcagguggcaaaaacuugcuuuuccaaagagguguagaaaagauagauuaaacuuuuaauugaauaacagcagcaagaaauaaugaacaaucuacaguaaacucauuucuauuugcuauaucugaaaggagcaugaaaacacauuccaagcacaguucucuuuuugaagaaacuaaugucacaagucucuugguuucuuugcuugaaguguucucacaaguacuuagaauucuccucuugugacuccauuucuggauuguguuuagacaauauacccaaaauuguaauuuaaaaaauauauaagugagaccuuuuuuauaauauggaagagucaacacacacaaacacaggacuucauacuguaaaauuuguuuucaucauguauuuguuauuuuauuuagaaaaucacaauuucuuauuucagguuuauaucauauauaaaaauauauaaaaugugcaugugcccaaggaagccagaaaaguccaucauaccuuauggacauguaaauacaaauaguucugagccaucugaaguggguguuaagaaacaaacuugggcauacaacagcagcaaugcuacugagucuacacuccagcuaccaagggugucacuauaaugaaaaaauaaagaugcccuauuauucauucugucuucuaucacuugugugugaugaaagucccugcauggucauugaauguauuucuaucccucugugaaugggcucuauacauugcuucuuauuguuaauauuauucucuugauguaagugaagacagugaaauauuuuguuggggagagaugaguucagauuauguugggguaacuaccauuacuguuuuuguuuuguuuuggagacagggucucuauauagcuguguucauccuggaacucaauguguggacuaguuuagccucaaacucagagagauccaccuggcucugucuccaaagugcugggauuacaggcauuuaacacuacaggcagagaaugaaaggaugauguagauuuaaagcaggaacauugcuguuuuuauaaacagaaacaagucuuggauuuuacaauguauuaauuucaaauggucaguuguguccuauguccucagaauuuuuguuauaugcuuguuuaauuuuuugguuuuuuuguuuuguuuuguuuacgagacaagauuucucuguguagcccuggcugaccuggaacucuguagaccaggcuggccuuaaacucagagauccaucugccucugccucccaagugcugggauuaaaggcaugugccaccauugcccggcuucuugguuuucuuucuauuuuucuucucuucucuucucuucucuucucuucucuucucuucucuucucuucucuucucuucucucuuccuuucuuucuuucuuucuuucuuucuugacuuguuuaauuucaucuuuuucaaaaguuuuaaccauaugcauacacuuaucauaguauccauauaccaaucaggggacaacugacaguugucuauucuuuuuuuuuuuuuuuuuuuaagauuuacuuauuuaugaguacacuguagcugucuucagccacaauagaagagagcaucagaucccauuauagaugguugugagccaccaugugguugcugggaauugaacucaggaccucuagaagagcagucacugcucuuaaccacugagccaucucuccagcccccaguugucuauucuuuauuuccucucugugaguauuagaggugaaacagaggcagucauguuuggcaacaagagcucaaauggcuugaauccauagugacagauuauauaccuauuauauagaaaaaauauuauguaaaauuauauauaaaauuaaaauuauuacauauguaaaauuauauuauauauaaaauuauauaacauaaauauuauguaaauaacacauaaaaguuuuucacauugcauucacacagguuaacuuuuucccucauagagauguaacauagggauucaguuuuuuucuaccacaacuaacuuuuuuuuuuuuuuuuuugagacaggguuucucuguguagcccuggcuguccuggaacucacucuguagaccaggcuggccucgaacucagaaaucagccugccucugccucccgagugcugagauuaaaggcgugugccaccacgccuggcucacaacuaacuucuugucucuuauauaguacuccucucaauaaacaagaguaagucacuaaaaguauaugagggacauuagcuuuccucucaaagauuggcuuauaaugggucugggacacacacugugguaguuugaguaugcuuggccaaugggcaguagcaugauuaggaaguguggcagugcuggaguagguguggccuuguaaacuucaaguucuauauugaauugauagagagagagugggcagccugucuugucccugauuuuaguggaauugcuuuaaguuucucuccauuuaauuugauguuagguauuggcuuucuguagacugcuuuuaguauguuagguaugugcucugaucucgccaagacuuauaaaaugaaaggguacuggauuuuaucaaaggcuuucucagcaucugaagagaugaucaaaugauuuuuuuuuucuuucaguuuguuuauaugguggauuacaauguuggauuuaauauauagcaaaccauuccuucaccucugggauaacgccuacuugauaauggugggugguauuuuugauguguuccuagauuugguuugcaaauauuuuacuauuuuuacaugaauauucauaagagaaauuggucugaauuaucuuuguuggucuuugugugguuuagguaucaagaugaccuaaaauuggaaacaauuuugugguauauagguuuuugaaguaagaccuaaugauucuuugauuuuccucauugucuuguuauuucuccuuuuucauuucugauuuuguuuauuuggauacugucucccuaucuuuugguuaauuuggcuaaagguuugucuaucuuuuugauuuuucucaaaaaacucacucucaguuucuuccacuuuuuguauuauucuuuucuuuguuacuaauugauuaauucuagcccugaauuuauuuccugccuuccacuccuaucugauauguauguguuuuccuagagcuuucagguauacuuuuaaauuguuaguaugagaucuuucuaauuucuuuaugguggcacuuaguaaauugaacuuucuucuuagcugcuuuuauuguaacccauaaauuuggaaauguuucauugaauucuagaaauucuauaauuucuuuauuucuucucuuacccagaguucauugaguagagguuguucaguugccaugaguguauaggcuuucugguguuucuguuguuguuggaaguccagcuuuaacccauguguugggauccaggaaucaccucacaaaucacauggaucccaaucucagucugacagggagaguuuauugagcauacgccccagggcuguuugaccaggccaugcuccagauuugagaacugaacuaucacauugaguuaagauacuacagggauuuuaagcauaaaauacacaaacgucugugccaagauauucuaccaauaaggauuuagggaugggggauuuuuuuuuuuuuaaaauuaggaauaugucuuugugguauguuuaucccuuuucuauugguuggggcauucagcuguggcaggggacuuguccuguuuaacauuuuugucuuaacguuucuucuaggauaggacuugucuaacauuuaugucuugacuugccaaucaggauaucaguugcccacauacaugucucuuucugucaaguaggaugucaguuucagggaggucuugggaacuuaaacuuuacuugaccacuacucaaaauggaagucuuauuccaaaugguuucuuauauuggugcagauguuucucucuuuuaugaaugagguucccagggaagaagcaauccagcacagguauugcaggagcaaccacugcaggagugaccacuggaaggcagagucuuccuagaccaugaguaacuagaagaguuuucagagcucuaauaugggguuccuugauggaagagaacccaggacaacaagcacaaaggaaacaaacaaugaacagauacgacaaauaugacagaagaggugacaaaagucauaauguacuaaucaggagacucccucaguuguaguucaaaggccuuaugcuuggaugguuuacccaggauagagaaggcauuugggagccgaucccugcuaacacugccugggagacuagccccuaugucagguacuggcaugaauccagaccaaaagugaaaaugaguggacaaagacaaagaagacagaaaagaugguucaccacaguauacucacccagacaaagacaaggaagaaagaaaauauggaggcugcaugcucacccucaaauggaagugcaaacgucacugggacaaacagaaaagacaaagaagacagaaaugagauaagcagucacauuugagggacucacaacauaaaauucuaaggggacaacucaccgaagaagcaacugaaguggacacaacagcagcaccuugaggagaagagcagaucaggucgaacugagagcauaguccuugcagcaacaggcaaaaaaugagcccccagaaaaagagguucacaagcagccacaaaaaugaggaagaugaaguagucuauugaccauauugggcgccagaugcuggcaggggaauguuugcagggagcugugauguguauguuaagccuaaaacagugugauuaggagcucaucagugguccuagaaaaaggcaaggcuguagaaggaauuuuaguccuggaagacauccuuuaaauggggaguuaccuguguuguaguaaggaaagcagagggaagaguugggaaucuaucuacuuuacguagcugaaaaagaaaauaucauauuaacuauguaucugggauaggcagugacaguuuuaucuguaaaaagaaacuggcuuaaguagauaguauuauuuuauuaauuaaggaugaaguaauaguuauuaacacaguugguugaccugugaggauagauuaaauaugauuuuugaagcuuaaaaggaauuuuaagcaaauuaaaaaauuuuagaacaauuuuagguuaaaaagcaugaacaugguuuccuguguucugguuagggagaaaaaaaauuaagcauuuaaacagaaguguaauaauuuuggguuaaggguuucaaguguguuguuucaaguucucagcagcaagaucccaucuauuaugcuuuuguuuggcaagcucuuuuugcuuagguagagggggaggagccugcucugcuaugcuguggcugcuggcccuuugcuuuagugggcaguccuuuuuucccuguguggcuuuucuuuacugguacugcuguaaggugggggugugcuaccuaaaaaguagaguagaaagagaagcagcauaggggcuugguggcaucguauuggugggguagggguagggguagggguaggaauuggagucuguguuaauggccaaguggacuguuguuugagaugggguuuggugcaauagcuccgccagaaaacauaagugggaagaagacaaccugucugucgucagagugggaaggccugggucuucuaggcuauugcuaaaagccaggggcugcucuuggucuuuguuuaaucuggaguuccaauauaggucugcauaagcggcuugcuguggugugugucagcuggguagguccauguuguggaaccagaugugguucugcuuuuugcuucaccacuggggggaggggggucagaucaccacugagacucugcuuggggaggcggaacuuucuccccauugaggaccugggcuugugggaugcugacacaccacucaggggaggugaagcucagcccaagauagggaucacaccccaugcuucuccaggugagaaauggugcaggcugggauagauagaagcugugguucucaaacuuccccaaugcuacugggaaaugggaagaguugagaauggaccccugggcccccuggggugguagaaaucuggcuuagcucagaguaagugccaagagugacgagaggccuuuugcaggagacuuaggcauggcucuguaagacgaaugcuuccccgcacaguggucguuggugggagaggcaguccuuauuuguccaaacuguuuauucaugguagaaagaaaugcauacaacuuacucagggugaaccagagauuaaauaccuuuugcaggaaggguugcccauaaaggaagcuuauugauaaaacccucaaguccuauggagauaccucauuagcauggagcacccuuaggcucuaugguacuugaccaguugucaugguccacuuagugggcuguccuggucacguguguuccaggauaggaaccuggucuggaaugagaauugcugguuccuuaaucagguccaccuuacuaguuuuucugucuugugaaacaguccacagccuccaggaggaggaaccuuucuggaggaaauuaguuuuugaugauggaauuugaguauuuauacccucacuggacuugccucuuuucugugguugaaacagaacaguccuguucucauauagcuacaccaucaccgccauuacugauuguguuccaaaauuaugguaaaacagagaagcauuugcuuuuccuagggaagccauuuauauuauauaaauauauaaauaauauauauauauauauauauauauauauauagcgccugauauauuuauguucauguuuuugucuuaggaguuagguuuaucuccaugucuagcauuuacugugcagagcuuuacccauaucuugacuuuugaacuuuggcagaggguauaauuuuuacaccaggaugaugugcaugcaugacaauacugaccuaaaugacuggacugcgaguguguacuauuccccuauauuucuguauauuauuauuuucauuucgaauuuuaauauauguacaggagucuuuuauagaugugaggcuccugaaagcuugguguucacugaaguuaaaagagagcauuggagaacucucuuugacuggaguuaggaaugguuggauggugccucagucucagagcucccagguguccagguuaguugacucuguugauuuucccuuugaguugcuaucaacuucauggccuucaguucuucccccaguucuuccauaugaauccccaacaucuuuccagugcuuggcuaugggucucugcaucugauuuagucaaaugcuggguggacccuuucaaaggacaguuauauugggcuccugucugccagcauaacagaguaucacuaauaguguuggggguugguucuugccccugggaugggugucaaguugguccuguuauuuguugaucauucccucagucucuguuccaucuuugucccugccuuucuuuuagacagggcaaauuuugaaucaaaaguuuugugggugguuugggguucuucugucuccacugggagguccugccagacuacaggagguggccucuucaaguuccaugucuccacucaggcauuaccaccaaggucaccugcauugacuccugggaacuucccccacccagucugaagauuuccauucacuccugacccucuggcccuguuucccgucucuuccccgccugguccugacccacauuucccuaucuauccucucucccacauaguucucucacucccucuggcuccuaugacuauuuuauucuguauucuaagugagauucaaacauucuggcuugggucuuccuucuuguuuaaccuucuugggucugugugauauguuauggguuuccuguacuuuaugacugauaucuaaauaucagugaguauauaccuggcaugaucuuuugggucugaguuaccuuacucaggauauuuucuaguuccauccauuugccugugcacuucaugauguucuuguuuuuaauagcauccuauuguguagauguacuacucuuucuuuauccauucuuucuuuuuggauuuucucuuccauauuuuauguucuguuggugaugcuugcgucugugguucuuguuucuuccuagguuuuccaucuccaggauucucucaguuuauguguguguguuuuuaauugccucuacuuccauuuucagaucuugaacauuuuuuuuuaauuuccuucaucuguuuaauuguauuuuccuguauuucuuuaagggaguuauucauuucccuuuaaaggccucugucaccuuuauaagauuggauuugaggucauuuuccugugcuuugguuguguucagguauccaggucuugcuguacuagauagcugugcuccaaagguguuauauuguccuggcuuuuguugacuuuauuguuucauaggcuuuuagccaucuggaugucccuguuauaauagcaccuauugggaggggggcucaccuugaugaugcuaggccucuugugaguauccuugagcaggacaauggaacuaagauggaguuguaagucucccaucaauugaguguaccccuggggauacuugagggaugggauuguguggagauaggcacuuagaguuguggucagacauaggagguccacugggaugcugaccacucaagggcagcuggauauacccccaguggaaguggcaggcaggaaaaaugggugcaggaagggcaucuaugcuguauuuuuuucuaacccaggcagccugacuuauuaaacagccaucuauacauggaggauuuagucugagguuuuuuuuuuuuuucccgagaccggguuucucuguguagcccuggcuguccuggaacucacuuuguagaccaggcuggccuugaacucagaaauccgccugccucugccuccugagugccaggauugaaggagugggccacccacacccagcuagucugaguucuuuuauguucucuuuuuauuuagaucuauuacagagauugauggauuauaaaauuggaaaagaaagucaaggaaauguuuauuucaauuguuuuuuuuuuccuuguggggggaggggaggauuuuugucuagcccugggcuucuuagaacucacucuaugaacugggagguguugaacucacagagagcugcaggccugugccucaguaguguugagauuaaaaguguuccccaccacuacccagaaucaaggaaaugucuaaagugaguauuggaaguuuauugcccaagggagcucugaguucuggcucaagagguuucaaagaauuucaguauguugcauggacauuguuuugugugugugugucuugguaaagauuguggcugcucuaugcccuuuucugaagagucuuccuuaggcuaaggugaagagauuuagaucaauugcauuagcaaaggaaaucucacaacugccuaguauuuacucuguucugugguucacucucauuaagaaaccauuuugcaaaggagcaagaugagugaggaaaaauacaaacuguauuguucaaggauuaaaggggcaccacaaaguggaaugcagcuaacuccuguguucaagcagauaaauagauuaaauagauauuaaauggacuuaagggaaaggugaccucagguaagauccuucccaacaaagcucacuguuuaugaauuugugguuguauuaggcauaguuauuucagauuacacguuauuaugaccuaguuauuuuuucauuuggacauaaugagauaugaaugugugccaauuugacaaaugaugggauaugaagucuauucuccuuucucaacuucacuguaucuggaaugaacuacaauccauaaauggagggcacauaagugauccagauauugaggcaagaagauaacauguuuuggucauaucuugagucugaaagauacagaguuuugauccggauuuugagaugugaaugaaaggaaauaaaacuugagaccugugauucauguaauuuaugucaaauagcccaaagaguuguuugugagcuuugaaaccuggggcugagaccauagcagaacaggccaagacaugccugggcaggccugucauuacauguccugacuggccuggugccucccuaucucccacccuucugacagucuguugauguuuaaauggaccaaucaugugaaaccgugccaauuccucccccagccccaccccuuuucuauaaaaaccccuagcuuccaagccuuguggucgaaaccacucucuccugcgugagauacguuuugaaccagagcuucgccauuauggcuccaccauguggucgacaccucucucuccugcgggagauaugugucggccuggagcuccgucauuaaacuaccucaugcuuuuacaucaagauggucgucuguucgugauucuugggugcgugccgaacaggaauugagugaggguuuccccacuagguucuuucaugaugacacauucuuuugguccagaucaaaacaagccuuuaauacggaucuugaaguauaguggugaugcuuaucaugaucuaggaaaguaaaaauggggucuaggucuccugguauagggcuuuaaucucaauacucaggagacaggaaaggagaucucugagugccaggccagcccggucuacagagcacuuuucaggugaagaaaagcuuaggucuucuauguauguagucagaggcaugcagauguccugaguucgaggcuagccuggucuacagagcaugguccagguaaagaaaagcuuaggucuagucauuguguuuaaguacauuuaauggaagcaaucaggagacagaggcaugcaucucuuugaguucaaggacaguuuggauuccagagcagugaaggaagacauggaaaacagaaaacugguaaagauguuaauugagcgagauggcuauguuccacccucagcaagcagcagcacuuggccacuuuggcaacauggcuuuggcuuuagagccaggaauagaugugguuacugaauaucccuuccugucuaaagaaagcccugaggccagauauguaguaugguugugucuuaggguuuuuguugcuguaagagacaccauaaccaaggaaacuacucccacaguuacacacuuccuccaacaaggccacaccuaugacaagaagguaccacucugugggcccagcauauucaaaccacuauauuccacugcauggccccuaugggcuuguuuaaacauaugaguuaauggaagccauaccuaaacauagcaugauguaaaauacauuuagucgaacuuuaaaagugcccauagucuauagcagucgcaacaauguuaaagugcaaacuucaaagucuuuucugagauuuagucacuuaacuguaauccucuauaaaaucaaaaggcagaucacauaccuuaaacaucacaggauauacaguccccuuccaaaaugucauagugaguaaauacuggaacaaacaagaucaaaaacaaacugggccaacucaaaacugcaucuccauguucauuaucaaagugcuuuuaagaucuucagcuccgccaggcagugguggugcaugccuuuaaucccagcacuugggaggcagaggcaggcugauuucugaguucgaggccagccuggucuacagagugaguuccaggacagccagggcuacacggaaaaacccugucuugaaaaaccaagggaaaaaaaauuaagaucuucaacuucauucaucuuuguugacugcagcacaauuuucuuugucugauuccauucccuguuaguagcuuuccucaguagauaucccauggcucugauaucuugaacaucuuggggacuccaaggcaacuucaacauuacagcuucuuguuccaguauuugggauccacccaccaucuucugggcuccuccaaaggacuugggucacuucuccagcucugccuucuguagcacacuacagacucuacuccacugcuguugguguucuuggugaucauccuaugauacuggcaucuccaauacacuugggucuucucugcagcuaggcuucaguagccuuucauaggcucucuucauagugccaaaccucaacuucuuugccugacuccuucaauccuggacuaucaacugcaacugaggcuacaacuucaccaauggccuucccuggccugacauacugccaagccuaagcugcucuccaugaccccuucauacuuuuaaaaccaguacuaccugggugauuguuacacauuuccaaguccaucugcagcaugaguacaauauuggcuaccuauagaacacaacuucuuugugcuuucagaaaacacuucccagacgauuucaccucagugauacaggucucuucuuaauuacuaauuucuuagcuccagcucaccagcaucaauugucccaguagucccuucuaguuuugacucuacagccagagccacauggccaaagcugcugaguucugcugcauguuggaacuggaacccccacccccaccccauguucuauuacauuagcaccagcuuucuguuuuccaacuccuucauugccuaagcuuggcuguucuggaacuugcucuguagauugaugcugaacucagagaucuacauggcucugucuccuaaaugcuggggacaaaggccuuuacuaucucaccuggacuuaagcuuuucuccccuuggaacuugcuuuauaccagacuggcaaugaacucagaaaucuucuugccuuucuuuccugggauuaaagguucgugccuaaucuuagcugaguggcccugaggucacuacucccguaaucuguauaucuccuuaaacauaggauucagcuucauuucacuuccuggugcuccuucauuaccugaaccauauauuuuaugucuuuucuuucucaucuuacuccuuuucauuaaaaggcuuuucauaagcgugaaaucuaauaaccacacaacagaauuuauaacaggguguuuuuauauguccuuuaucaaugcaauuaguauaaaucucucuaccuuagcuucagauagucucuucagacaagggcaaaaagccacauucuucaccaaaauaccacaaaaacagucucuaggcuacauacugaaguucuucuccagugaaaccucuugcgcugggucugcacuaugcaaaucacucucagcaacaaagucuaacaugucccugcuagcauagcccucuaagccccaguuaaaggauuccacugcuuuccaaaauccacauucucccaaagaaaagcauggucugggcuaucauagcaaaaugccagucccuguuaucaacuucuaucuuaaagaguuuccauugcugugaagagguacagugaccaaggcuacucuuacaaaggacaacauuuaauuggggcuggcuuacagguuuggagguucagaccauuaucaccaaggugggagcaugggagcauccaggcagacauaaagcuggaagagcucugaguucuauuugcgccuuguucagaaagcuaacagaauagugguuguguuuuauaaaaagaccaggauauguuuuguagagcuugguauggcgaagugggaggggugccucagcaggacuauggugaagcaucccuuuccccugaggcaccggccauaugacagguauaguguagaauagaguuuauuuauuuauuuagagaaauaauuuuauuuugcucugaggaggaccccaacacuuuuaaaucuuacuuuuccaagauaaugaauuuguggaaauuaggaaaaucaaacuauugcaauuccgaucuggauaaacaaaaaauguaugauacaugaagauuucacgucaguugcaggucccuggugucuacguaagugaaguggagcuggaaaauacuuacaauguaaacaguaugaaggaagaauucugggugccuugguacauuccagacuggccuaguagauaacguuuucuuagcacuuuuuaccaauagaauagaguuuauuuagggauugagaagggaguagagacagagagggaguagaggagaugcgugccaggaacacauuugggggggggagaggaaaaggagagagaaaaauaggggugauggaaaaaagagagagacagagagacacagagagguaggaggggccaaacagccccuuuuaagcaaaccaggccuaccugccuauugucagguaacugcugggcagaguguagaaggaaugccaauauuacucuguuuugguuuuauugaaaaaggaggaacuagaaagaggugauauagaagcaggaauagggucauggucaucuuuagcugcuuucugcugacuuugaugugaugugucucugggaaaccuaugaaaauaggggaauguugguccagucuuaggagaguuuguuguuuucuuguccagagucugugggaccaucugugucugugagaguagauuagaguaucuguggguugcuucucuggagcuguccuggauguauauuuugaguaaacaccuagacuugccaugcugcugaauuguauuuaugagacagaaaauaaaauuaaguagguuugggagaaaaacuuuuuucuuaggugaacauuugaaacccuuaagucuugguaguuggggugaggguauucccaauccuggggaacaggagaggaaucccacccucuggaauagguagcaugugggaacuuaggcuauugauuggcagguguacuuaacuagauggagucuguuugguccaugaaagguagaucugauuguguuuucugaagcuuauaaguuuacaaaagagauauuugucaacagcaugaaaagucuuuaaggugaguuuagggaagacaaaaccuuuuguggagcaggagcaaggaaggcuuuuuccuucugucuaggagaaugacuauauaaaaauuuagcauaauaagaaguauuuuuaacuuagcauuuaaaaaacaaaagaaacuaaagccuuguccuugucaauaugauaguugauaauauagauuuagcaugagaaacauuaguuuaucacuaaaagacaaucaaaggaaaccuauacucugaacuugugauuguaaaaauuggaucucguauaguggaauguucuauaagaacucucuauuguuaacauuacgauaguggcauaacaaggggaggaaauaugaagcguuuagucacuagaaacugaguucagacaaggaagcaguagaagguuacaucuguguaauuuuacaccuaaacuuguguaccauuuauugugaggccugcaagcaaggcaaaccugucuuuuugauaagagaugugguagucuuagcuaguuaacagauugaccaaugagcuaauaaggugguggauuaccuugggguaaggagcaagagaucuguuuucuaguugucaaucuguaguacccuugcugucaauguaaucagaaaucugggaagaauaaauuauaaucuagaugucauauauuaauuaaaaugacagagacuggucuauagucuaccacuaaacaguuucuuggucccuuuggucucccuaacaacucuggcagagucagucuggccgucaggcucagaacgggaagcuuuuucuugugggggaaaugacucaccuugucuuaggcaacauuaauucucuggcuuucuucuguuuguccacaguuuauguugagcccuggcagcgggcaagcuaaugaagcaguguuucucaguguuucucauaccccaaucuaggcagucauauggcuguguucuuaucuucuaggagaccuugggggagguuacugucauaauuucagagucucugucuuuuaauaaauauuuaauaaauauuauauuaacauuauauuuagcagauuucugacaagauugagagccauuaucuauuaaguauaucugaguuaagcaaucugugcuuguuuaauuguuuguccuagaauguauguauuaaauaaagagaauauauuauagcuuaagagcuguaaugucaguagcaaaaacaagacuaaaaauuaauauuaaaauuauuuaucaaggcaggauagaaaucacaaggaaaccauaucuuaauuuuaacuuguauuuggagacccuaagucaggcuauuccucuaaacccaguagugaagucaggcuauuccucuaaacaccugcccauaauaaagauggggaauagucaugagaaugacuuuaacuaagauggcucugaagcuacagucagccauaugacugccauuagcuaagaugucacagaagccauagcuccaccuguggaggaaggucacguguuauaccuuagacuggaacugcagaggugugccaaguguaucuuagaauggaaugguagaagcauggcagagacaacaaacagacacauuuugucugauggacaggaaucuucucccugucaccacagacagccucuauugccgugggggucccagcgguuggucugagugguguggucuaagcagcuuggugugaggagugcacuucacggcuuggcugcucucauggagcaaauagacauuuaagcuggagcaagcagcagagagggggcaagugagcaggcaaccgcggcugcagggcaagagagcuaguguacccauuugcuuccuggcaacacuacagccuccacaaagagauuuuuuuuuuucuuauggggaaaaguuguaaggacagaugacagaaaugaaggggugggcagaugagugggauuuggguacaugaugugaaauucacaaagaauaaauuguguccuugggguauuuucuuuguuauugauugaggggguguccauuccaauggggguugugcccccccccccccaggcugaugguccuggguugcauaagaaagcaaauugagcaagccaugggcaacaagccaggaagaagcaccccuccauggucucugcaucagcuucuuguuucucuauguuucugcuuaagcuucugcucucacuguuuuugaugaugaacuguuguggggaacugugacugaaacaaaaccuuuuuuacucacuuugccaaauaugcaguguuggauuaaauauuugcucagaguuuaaagaguaugugauccucaauacagaaaacaucuaaaauaguugagaaggaaacaauguuagaaugcucuuuuuccauagcuuauggaugucaaaacaacucaaaaaugaaaauaacagugcagguucuuagguaugguuggucagacacaggaauggacaucacaggugaaacagaggaaucacaauggucuuccggaaaaacaggcagggagauuuccaguuggggcacaggcaugauaugaggcauuaacacccagcuucacuuguaucuucagccuccugcugucacuaacggcaccagaagucuauuuguugaucuguuugagugucucucuguauccucuguuaguagucauuucucuugcaaugcucuauggaauucagugggccuagaaaugagagaugugauccuacuuuucuguuuccuucuaaaaacacuuggagacuucauuugaaauucugugauauggaguaaauguaugaagcacucagcauucuggaaaaauauucucaauguaauguucauuuaccauacaguaaagucucaccauuuuuuuuuuuaauguacguguaugggcuauuuuaggauacagugaccuaugaggaugugcaugugaacuucaccaaagaagaguggacuuugcugcauccuucucagaagagucucuacagagaugugaugcuggaaacgugcaggaaccucacugcuauagguaagaaugugaguuuucccucacguucuaaacaaaccaagaacaagccuuucuugguuauugguauacuucuguaauuucuguugucaaagaggaaggauguaguaaauaaucagacuuaauauucagauucacuagagauaaguuaaaauuuguacaguaucaaauaauauaucauacauuuucugguacuauauuuuaggcuacaaaugggaagaccacaauauugaagaaaguugucaaaguucuggaagauauaaaagguaauuuucauguggaagcuguuacaaaugcauugcugaagaaaauauaauguggucugaaguuuuaauggaaagcaacagugugauuaagcccagguuuaaguacaauggugauuacuuaauucucagaagaccauggccuuuagagucagguaguugaccuguuuguaagggauuccucuaagaaaaaagacaaacaauaccuuaacacaucacacucuuuuagucaauagcccugugagagccauguuguagaaaugucaaucucuuuaguuacaucccauucaaauauccuuaaaaguauguccagugaauguccaauaccuuuuauaagcaaauaaucuauaguaaagcuagguuuacucguauauugacagugacuuuccagaguuuagagagaggaacaguuuaugggaagcaagaagauugauguuguggagaaacuuuaaucccuauagcacacgugcauggggcaacaaaaauuucacagaugugacugcaauguacaaaccuuuuaauuauuauuucuccuuuaauaggaauaauaucugucacucuggaccccagccuugugaguaucagggauauggaaagaagcaauguacuguugcaaguaacaguguucuucaaacuuacggaagaguccauacugacgagaaauccuguaaacguaaucagugcaguaaacccauugcaaauucuaauagucuucgacaacaugaaagaagucauaguagaagaaaacucuaugaauguaauuacugugguaaagcuuuuccaagucgaaguucucuucaaguacaugaaagaacucauacaggagagaaacccuaugggugcaaugaaugugggaaagccuuuucaacucgcagucaucuucaaauucaccaaagaacucacacuggagagaaacccuaugggugcagugagugugggaaagccuuugcaaguaaagguaaucuucaaacgcaccaaagaacucacacaggagagaaaccauauugcugccaugaaugugggaaagccuuugcuacucacaauaaucuucaaauacaugaaaucauucauacuggagaaaaacccuaugaauguaaugaaugugguagagcauuugcauacagcagagcucuagaagcacaugagaaaacucacacuggagagaaacccuaugaauguaaccaaugcagcaaagccuuugcaagccaugcuagucuucgaaaucaucuaaaacaucauacuggagagaaauucuuuguauguacacaaugugguaaagccuuuacaagucagaguauucuucacaggcaugaaagaacucacacuggugagaaaccuuaugaauguagucaaugugguaaagccuuugcacuucaaaguuaucuucaaauacacaaaagaacucacacuggagagaaaccauaugaauguaaucauugugguaaagccuuuacaagucaugcuaaucuucaaaaucaugaaaaacaucauacuggagagaaacccuauggauguaaucaaugugguaaagccuuuguauguaguagcagucuucaaauacaugaaagaagucauacuggaaauaaaccuuaugaauguaaucagugugguaaagccuuuacaagucgcaguuauauucaaauacaugaaagaauucauacuggggagaaacccuauggaugcaagcaaugugguaaagccuuugcauauagcaguagucuucaaauacaugagagaagucacacuggagagaaacuuuuugaauguacucauuguaguaaagcuuuugcaagucguaguuaucuucgaauacacaaaagaguucauacuggagagaaacccuaugaauguaaucauuguggugaagccuuugcuagucgagguagucuucagaaucaugaaaaacaucauacuggagagaaaccuuauggauguaaccaaugugguaaggucuuugcacgucgcaguaaucuucaaauacaugaaagaauucauacuggagaaaaacccuauggauguaagcaaugugguaaagccuuuguauuaaagcgugaucuucaaauacaugaaaggauucauaccggagaaaaacccuauggauguaagcaaugugguaaagccuuuguauguaguagcagucuuaaaauacaugaaagaagucacacuggagagaaaccuugugaauguaaucagugugguaaagccuuugcaagucgaaguuaucuccaaauacacaaaagaguucauacuggagagaaaccauaugaauguaaucuuugugguaaagccuuuguaagucauaguuaucuucaaguacacaaaaggacucauacuggacagaaaccaaaugaauguaaucagugugguaaagcuuuuguaagucacaguuaccuucaaauacacaaaagacuucauacuggagaaaaacccuauggauguaaucagugugguaaagccuuuacauauaaccgagaucuucauaggcaugaaauaauucacacuggagagaaacccuaugaauguaaucagcgugauaaagccuuugcaagucaaaguuaucuucaaauacacaaccgaguucauacuagaguggaaccauaagaauguacucacugugguuaaagccuuugcauaucacacuacucuuuguaaucacaaaaaaauuuguacuggauaggauuauggauguaauugauguaauaaaaguuugaucaucagcauaaucuugaaacacaucccagagaaaagucaaugucauagugccucuguaugucauagucuucuccaaaaucaugaaagcauuccuacuggaaaucaucacuaugaaucuaauagaugcacuaaagccuugcacagcaagcacauauuucccacugagccaucuucuugugcuuauagaagauuagcagaacuaugucauccuucaaaaaaauugucuuguuuuuuuauuauauacaaauugucaaccaagaauagaacaccacaguaauuugaaaaauaaaaaccuacuuacaaaugauaauuauauacugccauccauuucuauggguugguuuauucugaggaauaaauacuuguucguaacacuuucuaagaaacacaaaugaacggccgagaauuaucacuguggguaaaggagguugcugcuaagccuggugaucugagucuauuccgugggagacaaacaugcagguuuuucucugaucacuauacacgugcuaugacauaugcauacccacacagcaacacauacauaaauauuucugaaacuuaagcaccagugaguucacucaccaguugaagauucuugcugcaaaacuugacuaugugggucaaacuuacccugaggaaauaugaauagacacguguaaguuggcuucugacugacaggugcacacccuagcacagguguaugcauccagguaaaaauuauugaacaugaaauuaagaaaacaaaauagccacaguguugagaacauaaaugauuuaccgcuuguaauuaaucuauuguuguauuccaggaggugcuuuuuuuguucaucaaagaaugaugguuugugcauaaaucuuacauaauucuuucauucucugauucaaagauaggccauuguaaaaacaccucaguuagauggaaagguacuugccuauaaucacagcacuuguaagaaagugaguuccaggaugacaugguuauguauagagacccugucuccaucuaccccccaaaauccaaaagccaaccauccuaccacuaccaucaacaacaacaaaaaucccaagacaucaagaacaaaauaccccuaaaacaaacaaccauaucucuguuuuuggaucuuuucuuaguauaaucugaacucaucucuacucaacuaaauuuucuucacgcucauagaacuucuaaaaauaacagugaaaagcaauagcagaguccauucauaauaggauagauauccauucaguucuucaaugaucauuuaucagggacccuauaagugauagaagaccaagggaauaauggggcuucuucauuuucugcauuauaguugcauauuuguggucuggaauguugacauaguaguacuucucuuccuagcaguuacaacagaugggucagaaguaccucuaauuccugauacagaaguucagauacauucuucuggcuuccuuggacaucugguaugcaaagauuguaaaggcacacacauacacaaaaggacuccauauuuuaaauauguauauguaaauguaaaaaucauguuauauuuuuagaaaauaaaaauaauuuacguguau

SEQ ID NO: 5660 - RNA, 612 nt, Mus musculus
uuuugauaaauaggcgccaaauuuauuuguuucuggguuugagacauaacacucucugcccaggaggaagacggggacgugccuacugagugcaggaaaagugcagggaccacuuugcaguccaggaacaaguucuacagcaaagccugccuuaugaucuaggcccgcucuuggccuguaguggaagccggagaugggaaacacgaugucucuuagggacacugcuccugucacucaggccucaguagccaaucagaacuucgagacgagccuucagucauagugggcgggcacuuccuguccgccauauuacccgcuuuguugugaaucugaggaaagcacuauugaccaucugccgguaguugagcggagagugaggcgaacuuggaauccgcgccauggugagcgaggccgccguccccacgcggggaggauccgcggggucccaugugggguuguccuggggugcgggcaccggcagcgagauguggcgaccuucguaauugcguuugucacccgaagucgccgaguucccuuauccuccgguguggaagcagcaccucccagugagacgguuccccgggcugcgccggcgcacagcauaggaagcua

SEQ ID NO: 5661 - RNA, 612 nt, Mus musculus
uagcuuccuaugcugugcgccggcgcagcccggggaaccgucucacugggaggugcugcuuccacaccggaggauaagggaacucggcgacuucgggugacaaacgcaauuacgaaggucgccacaucucgcugccggugcccgcaccccaggacaaccccacaugggaccccgcggauccuccccgcguggggacggcggccucgcucaccauggcgcggauuccaaguucgccucacucuccgcucaacuaccggcagauggucaauagugcuuuccucagauucacaacaaagcggguaauauggcggacaggaagugcccgcccacuaugacugaaggcucgucucgaaguucugauuggcuacugaggccugagugacaggagcagugucccuaagagacaucguguuucccaucuccggcuuccacuacaggccaagagcgggccuagaucauaaggcaggcuuugcuguagaacuuguuccuggacugcaaaguggucccugcacuuuuccugcacucaguaggcacguccccgucuuccuccugggcagagaguguuaugucucaaacccagaaacaaauaaauuuggcgccuauuuaucaaaa

SEQ ID NO: 5662 - RNA, 1187 nt, Mus musculus
aguuuaguuuaguuuaguugggcuugaguaauggagucaaucugggugccagcuauaccacuucuggaccaucucagccuuauucuacuuaguuuauuguuugguggcaucuggguguuguuuucuaguuaucgcagccgaacacagguggcauccaggacagagguaugugauagccacucucuuucaaaacccacuucucucuaugcugaaucccucuggguuaguauaaauacuuagccucugaguaucugagggaaugagcagaggguagaugaaguugagacaauguccauagaugucuuucucuuaauucauuucaagaagcuuuagguacacaccuuugaugucagcacuugggaggcagaggcaggagggucucucugaguucaaagucauccuggucaccguagugaguucuaggacagcaaagacuacuguuucaaaaagccaagagaagaagaggaaagaaaagaaagaagaagagaaagaaaaaagaauaggaaagaaggaaaaggagaaaaaggaaggggaggacaggaagaggagguggugguaguauuaguaauagcuuuaggauuguguuaucaaaaagacacugaggaagaacauacacaauauugaagaagugcugccuaggaaccugagcugaagggagacauucagacugacauauauaaaacuuugauuugguaaaacauuugagaaacuacaaaaaaaaaaaaaaccuggugaauuauggaaauuuuuucuugauuuaauacaaagaugacagaugcccacagccucugcauaucauacccaaagucauaaucaugaaagcaaggagauuaaaaacacaaggauuggaaaauaaauaauaaagaauaacagaaaauaaauuuagaucauugcucaugcuaggcaaagcacucuaccacugaacuacaucucugguccauuuuuccuugauuuuuauuaaggauaauuucaggcagauugguaauguaccuagcaugugcaaggcccuauguucuauucuuaguuuaaggggagaaaaggugaucugaugacucagcucacugaccuuucauucuguuccaacccuugcuccauuauuuugaagcaaaccacagauaauuucaugauaaauauuuuaguacauauaguuugagauccugccuccacucugcaaagaagaaaaagga

SEQ ID NO: 5663 - RNA, 7191 nt, Mus musculus
gaugccaggucugccuccacaggaaguggugaaggugaguggcuggcuggauccuagcagcaggggcuucugggaugaugguguuggugagaugucuggagaucuugugagccuuaaggacagacuuucaucuugaaugugaacagagacccaugucagauuucuaacuucgcuguaagggucaaagaaaaggagcauuuuucucaaagccacuaguguaauugguaagcugguacagcagcugugagaacccaagguacacuguuguccuguuucucagaggaggugccagugcuugggagcauuuaccaggaaauggcaguaaugcagagcccugugcuacgaggaccuucauaacccagccgcagaggcaggugcauacauagagcgaaggaggcccaggcaaaccagggaugaugugaagacuggguuugucuaugauuaguagacucaaggugagagggugggcuucucuucagcgggagguaugggaagcaaccuaggacuccugcuggaguagcagaccaaaagccaacugacugaguggcccaugagcacuagacccuggaaaggcgagcccuuaagggugaguuguaguugagccacgccuggaaucaaguugcugaagggcacccaagccucucauuucaugaucuguauuccucucccugggccagcucuccuuuaagguggccaaagccacggucuguugacacaggacuguguggccguccauggagcagucccgcucaggagaugaucaagcagggcccccccaaaaucagaaagcacguaugugauguguacguaauuauguguggcacauaugcuuuuguccucuucccuaccccaguucuuugcuaacagaacauggaaccugaguuugcuccaggaaaguccuuagaucugaggacaguggguccuuccccaaacacaggccuaaacugugauugggcuaaacugagcagggcgcuuugccuaggacuguauuccccaucucccuuuugcuguuaggagcagcgacgacagaguucugacauggagauucuaugugggacaaauuuuugcaucccgacaaaagccaugaauuuucuauucccaucccuucccuaucucuuucuuagaauguaguugcuuaacgacaagacacuuggaacugcuaccaugaagcaacgugcugagggugacugagggaagagacaggaagucucuccaggcuccugccuugagcugccacugaacauguccuuguuccagauaauucagugccuuuauuguuccggccagcuugagguaucuuucagacacgcagccagacacauucugacaggacuguaaagguggagggaggccugcuacaucuccagacucugaggagaagcuucgaaaggcagcauguuagcucacaccccucugacucuaucuucagacagaaugggucaaguuguucucucucuaucaggucaccgugacccugcucucgugaucacauguguucucugccucuuccugcuccggauaauccuccugucucaaggagagccaaccuagacucugucugcaacauuucuuaaaauaaaaaaguuauuuauuuuauaugugcguauguggcacauguguauggaggucagaggguaauuugugggcagguucuugccuucugcucugugggucccagggaccuaacuuaggucaccagguuuggcagcaacuacccuuccucguugagccaucucacaagcucuacaauuguaaaaauacaauuuauuuaccacgugucuuugagugugcauuuaugcgauggucagauggugauuuggguuuuuuuuuuaaagauguuuuauugguucuuugugaauuucacaucacauaccccaaucucacucaucucuccucuucauauccacccuccagccuuccuacccauuccccaaaagaaaagaaaauaagauagaauaaaagaaagagucuuucuggaagcugcagugugucacagugugucccacagucuacccuuuggccacacgucuuuacuugcacauguugacugcaaugagacacuggucugguuugaggccuccagcuucgacuacaucaauacugaauccucacugagacuccucuccgauaucuugcuguugaccugugucauggagaucaugcagcuuugggaucugcaggaccugcuuuuacacaaugcuccagcagaucauagauggggucgauguuggggugggccaacucaaagcccugcaucugggccugggagguagcugugugccuuuaucaccauggcgagguugccaggacaaugcucacccaaggcagcagccagcuaggggacggaccuucuuucagguccuccggguuagcucaccucuucccaccccucaugccuuugccaccagggucagcucuauggugaugugugaggugaggagcagagccuaagugcugcagacagugaggggcggggccagcucucucacuuucccgacuuccauugcaguucaucugucugccagaggugagggauaggagguggaaggugggcauuucucccuuacccauguggggcugccaaggucagcucuacuguggcgcccaggcaaggggcuaugucagcuuagcccaaaugcuucaguuggcagcccgaaccaggaacauccgugugaucuuuggugcuaaaacaggccugggacaucaaaacagaucccggcugccauaggaccacgaauccagacauggcucccagcagcagccugggccccaauguccccagggccccgggauggcagcauaggcaacucagauuagcaugcaccccaagggcagcacagccugcagauagucacauggucucugguggcagcccagaccuuuagugguaacuccggucacagacaucaacacagaccccagccgcagcaggaccacaggcccggacauggcccuucguggcagcccaggccaggaucucaccagggccuccucacaucugccuguucgucacucccgugagucuccaguuuacauuccccauguccuuucccaucucuccccguguguuuuguugcucccaacccuccuccacacauuugcccauugugccccuggcaagagcuuggggagcaggaacuugggugucuuacuuccagcugagcugccagaguggccacggugacguggccacggugaacaauuggguacuuuuuuuuuuucuggccaccacaggcuggcuagccagccccugguuuuuguuuguuguuguuugguuuuguuugguuugguugguuuuuuuuuguuuuguuuuguuuuguuuuuuuguuuuucuuuugagacagggucucucuaugcaguccuauguagaccaggcuggccucaaacucacagagcuaugccugucugccucugccuucuucuucuucuucuucuucuucuucuucuucuucuucuucuucuucuucuucuucuucuucuucuucuucuuuuuuuuuuuuucuuuugguuuuucgagacaggguuucucuguauaucccuggcuguccuggaacucacuuuguagaacaggcuggccuugaacucagaaauccaccucugccuucugaaugcuccacuaaaggcauguaccacuccugaccuucaggggacaacuuguaagaauaaguucuuuugccuucuguguguuggggcauggucucucuuauuauucugcuacugugcuaugucugaaagacucuggcccauuccccaucuuuagccauaucaaugcuggggcuauagaagugaacauggugucuuugucgcuguuccuuugcugugaaaagauaccaucaccaaggcaacucuucugagagaaagcauuuaauuggggguuugcuugcagugucagagguuagcccauuuaucaucaugguugggagcguggugguaggcacggcagagguaggugcaggagaaguaauugagagcuacauccugauccacaugcagaaagagcgagacugggcuuggcaugggcuuuugaaaccucaaagcccauccccaaugacacacuucuuccaccaaagccaccauccuaaucuuuguaaaucuuuuaaacaaucccacucccuggugaccaagcauuuaaauauaugagccuuugggaaccuuucucauucaaaccuccacacacauguuccagggguuggacucaggauguccugguaauaugacaagugcuuugacccaccgagcuaucucacacauacccugcaacuuaauuuccauggcuaacuaaaacaugacaucuucauaaauaguguguccuggccacagaucccaggcagcuggguaugagcaccuuugaggucuagcaucccucaugcuguacaugucuaagguuuaaaugagaucaggcacacaugccgguacacagcuggugcucaaugggugcuuucuauccucccaucucccugagccugacacacagcacauacauguaguagcuauucauuccaugaagaacuggucccaacgucuccuguuuugagucuggucuaugcaguuguucaaccaugaccucacacucacgauccuucugcaauggccuucggaguucuggaauuacuggcaugcaccacuguuccggccaaaaucaagguaugaaagcucucaacaaaauuucagugcuuuacaauccaguuuuauuuugauuuauuagugugugugugugugugugugugugcauaugagugcucuuagagguaggaagagggcguuguauccccuggaacuggagucacaggugacugugccucgcccagugucacugcugagaacuaaacucagcuugugcaagaauagcagaagcucagccacugagccgucucccuggccccagaacuaccaaacuuuacugcauccacauuuuguagggaaaggaugagcuugugccuuuggguguuaauguuuagauggaaugguuaaccaugagacuggagaccacuuuuaaauauucaaauguauacaccccaaguaggauuaaaaaaauaguaaacagauaccgaguugguguccaggcuuaugugucagaucucacuucccacaucuuggguuacucacucuugaaauacacaucgcugcagcccgagggagcucacaguaccugcagacaggucaacacggagaggaugaacaacaagccuggaucugugucaucuuccaacuguuccgacaguccugauugacucagcguggagcagagucaggcccccagccaagccccgugaaagucuugugaaugggcguggcgaguauacuugcuaccauguuagccgaagagcaacaccuuuaguuaguuaguugcuaaugugccucaaacaucucaccuuuagauggcuuuggagcucaugagaggucccugcacaggacagccgggcagagacuggaagggaccugggagucaacacagaacuuacccagacaccaaauucucagcacacgggagauauuaccccaggguccccgagcaggacgggaggggcacugccucuagaucaggcagacagcagcaggugucucugcagguguggcuuuuaaaaaaggaaagggaaagccugugggaggugagcugguaaguccugaugggacauguguguccuguagccaaagcaugaacuuugguaacuggacuuugcugaucagucgagagaaugagucagacauaaggaaguggccaaauaaggagauggaccccggugacuagcuucaggaauguggaagugccuaaauaagggaauccgaugguuuagcaagggagagggaacgaaggggagggcaagaccuuugggugccauguuugucaugcuuggguauguuaaggagcccuuuggagacacuguaaccaagggucagcugugcucuuaaauugguguguaauggagaaguguaauguucuggacuguaaugguuguuccugguugucaacuugacuauaucuggaaugaacuacaaucuagaauuagagggcucaccuguaauccagaucuugaggcuggaagacagaaguuuccuaccuggaacuugggauggaaauuuugaggcauaucggccaugaaauagguccaggcaaguuaguacauaccuuuaauccuuuaaucaggagacugaggcaaggagaacucugaguucaaggucagccagggacaaagcaagucucagauccagguaugguggcauacaccuuuaaucugguccacaccuucuguggaggccuacauaaggacauuagaagaaggaagauucgcucuuugcuugcuugaauuuacuguuggaaccuacuucuacagaagaccagcugaaacaaccagucucgugggacugagcaaguacuagauccuugaacuucccauucacagcugaccaaccuuggguuaguuggacuacagacuuucccaccagccccaugagcugcaguggcuuuggcgcggacccugaggcggcgcccgccugugccgccuuggucgcggguccggcacccccggugucagcccccccugcgcugcccacuagcacggccgcggagagcaaagccagcccggcggggacagcagggggccccguggcuggagucgccacugcgggcacgggcccgguaguggcacgggcaggggagccggcagagcugcgcgggccagcuucgguggcagcgggcggcguggcucccccagagggggcaaugucuaacgggguuuauguccuaccgagcgcggccaacggagaagugaagcccguaguguccagcacaccucuaguggacuucuugaugcaguuggaggauuacacaccuacgaucccagaugcagugacugguuacuaccugaaccgcgcuggcuuugaagcuucagacccacgcauaauucggcucaucucacuagcugcccagaaauucaucucagauauugccaaugaugcccuacagcgcugcaaaaugaagggcacagccucuggcagcucccggagcaagagcaaggaucgcaaguacacccuaaccauggaggacuugaccccugcccucagcgaguauggcaucaaugugaagaaaccgcacuacuucaccugagccacgcaacccagauguauuugucuuucccucuguccccacaugagccuguuuucauaauaaacuuuauugugacaaaaaaaaag

SEQ ID NO: 5664 - RNA, 2056 nt, Mus musculus
uagcugggcuuggggcuucccaggcggcugcagggacucacuacccagccggggcgugcaccacucgcccggggguccccaaccaggaagaggcagcgcugccuggcgcagaacagccggcugccagcgccugcuucaccucagcccucagcagcaacccggacagaguuuuguagucuucccaucaacccgggcagcuuccaacaagcccuaccuuucuaugccaccuagccaauagacaagacacaaagaaaaaaagaaaagaaaagaaaagaaaaaggaggcaacaacacgcgccgcugucucuccuugcagucucaaccucuagccuggagaugggaggaagaggaagcgcaccuucucuucccaucccaacuccgugacccgcggaucccggcaguaaagagccccgaagaggccgaagggaagaggugagguuggaagaagcagaaagcagagcgagagaggagaaaauauccaacaaaaccacgcuaacgcgcccccuaccugggugcaacauacuuuggaaauagaagaugaccaagauaaaggauccgaagcaaguggccagcaccauccggcaaauucuguucauccucaucacuuccagcagcgccggcuucauggcuuuguccuggccgcggggacccggcuguccgggaggcgcgucccgagcgcagaagcggggaccccgccgcggggguaccagcaccggggaggcucagaacagagcuggcugggcuccggagcuggcucccgcuagcuucaccgaggcucuccgaggccccgacucuggucuagagggugaaaggcgcaggaguuggugugcaagugugaggaugcguggcuccggccgcgcgcuccugccgguccgccucgccucugcucgaugcuccgccgccuccucugcuggcgccugcggccgccgcugccuccucacgggccgggcgaccgggaugcgagaaggaaggugccgccgccgccgugcacuggccucugugacuguccaggccccccucccucccucccucgccaaaagcuacuucauugcgcuccagugaucuauauauuccagggcuggguuuuaccaaacgcaacucgcagcccccggcgaggggagggcgccggcgagcggggagggcggggccgcgccggggcggagcgucgccuccccccgccccuacccgagacguggucgcguccagcuguuucccggggaguccggagugcgcagcacgcucccgcagggucccaaaagcccucagucccugggcggagcugggccgcugucucgagguugcgugaacguuuccaugacacaaccgggaugggggaaaaccaugaauaagaugcuguagugcugccacccguucuccgguguggcgagaagcagguuaggugacagaggcaaacaggagcccugcugacacgcgaccauuuacaaucccugggcgguuuagcaggggaaguugccccacgcuccccuaagagcggaugcccuucucauacugaucaaaaacugggcaguuccguuuuucuuucaaaggacagcucagcuugagggcugcuuuugcaaagagguuaaagagagcggacuuaaagucaagguuagggaaacuguuccggcaucccaggaucuggugacugccgcugcuagccuuucugacacgugcccucacccgcaccccucggggcaaagcggguuuguagcuuuuaaaacuguuucaccaaaagguacagcuuucuguaauuuauucgaaguguaugagaaucagucggacggaugugaaaagacgccccuaaaaguccaacaaaguguugggaguggaggcugggagggggagauccaagccagcuuagccuuggcagguagagagaaagauggcgcugcuuaccugcauuguguaaaauguuguuaaaugcucagcuccaugcauuuggguggccaaggaucaauaagguggacgcgggucaaugauaaggagaucacuuuuaugccaggaaagcaggguuauuguaaagccugaccuuucuacuuuaccauuaaaugcauuua

SEQ ID NO: 5665 - RNA, 2891 nt, Mus musculus
ugagucgugcacgcaaaggugagauuuuauuaagugaaggcuauguaauucccacacauggguuuuucuugggacgauguguuuggagucaucuguacucuagggaguucugggaacucuaguguucagggaagaaucuaaugagaugaauugacgugggcgucccacccugcggcuacucucuacaugcuggaaauaugauggucagcccucgggggcaugcaagugauggcacaggucauccuuuguaaagugugggucccacagggcucugcuucagaaucuacacuggaccccagccaggcuaugcuguguaaagccccagaggugaagccagucagaacugugauucaacaagguggaauccauagaguccucggguagcagcguggccaccacaggcuucuucguaaaagcuggagucuggagaguuugguuagaaguccaacaucucucagguuacucaggaagaagguaaaguuucuuagcaccugaugaaaggcaaaugggaaguuaggacccaugguguguacgucccugaacaguaacacccaggaagcuacagcucucugcuguccccagucuuucugcagcuacagggaguagauggugucaccggccagauucccugaucagaggauuuguguggcugccccaagaccucaggguucaaaugcacuucccugacacagugcugaaacacuggcccuugggcuguuagcucagucagggaaauaccugggguaccuggccaaagggaccacauugaaggagugagccaauuccucaccaguggaggcuucucuuccccgaggcuacagaucacuugucugaugcagaagagguaucaaggugacaauugccugucauucuguccuuuguuaucuccugggguguucaucuaaugauagaagcagccauggccuauaggucauggauggaagagggagagccccacagcuaugcuuuggagaaaguuguuucccagaggucacagccccagagaacugcucuucucuggugucacugucccauaagaauaaagaacagccucuagugucaaacuguguuccuaaaucaagauguccuagagcagccaugccagcccugucauuucccuguccccauuucuauagaaaggagcauggccccaggaaaggaggaaggccccagcccagauucuccuuggccacagccucucuuccuuaagcgcaugccccacaaucagccgcuguguccccuggccagccagcugggccagugucccggcgcagccccggugccuccccugccugccggcuccacacuugugaauguuccauucuaacaggucacaaucaggagccuguucccgcucugggaaaaaaagagcagcccacaggcuuuuaaacucgcuggcuaauuugagguauuuaucacuauuuggagagcugugcuuguuuugagccuucccccaaccccucaccccacccccagcuuuccgaaacaucgagugaagguugugucucuagaaaggaagcuuguggcuccuuccgcugccucgggcuggcuucauagggcggaccuaauacaguagcuuugucugugcguucuucauuccaacuguucagaucaugaaugaggugcgcgcauacauacacacacacauacacacacacaaacccucucaguccaggcuucacuguguacacacaguccugcuggcugugucccagggugggauuccugacauucaacagcacaauaugcucauccaaccuggguuuuggauucagagugaccccuggcccagccagcccugacagcuugcugugugaccuuacacauaguucuucaagucuaggaacucacugugcgacccaaggcccaguucucuggugugggaaaagcuaaucaucucuagagauuagacugcuuagaaucuggucccugccacguccuccugccccguacucagcuguccuauugacuuccuguagguuggcaccucaaaagcuugagcaaacccaggaguaaugccaguaccuggugcacagaaaacgaucaacucaccaaauauuagcucagaaaaagguuccugauagaucuguauuuccuuucccuguucugggcauuuuuaaaaauaaagucugaccugacccaacagcuggccagcaguggaggcuugccaacauggauaggaggcucacugcccauccugcugaaggccucacuggccccaucaagacagggaagaccagguccagucaagccaggccagguaugcucgggacagaagaguccuuugaccacugcuucucugccuccuugggaugucaaaggggcugcaggagcaccagcccucaaaaccaagacccuuccuccugucccucuggagccuacagcgucugccugaggucuuuucauuuacgguuugccaucggcuacucccaucccugucucuaagcccucacaucucucccggcuuuuauuuucugcuuucauuuccccauauggggguuacccauaaaaccaaaccgguuuccccaaccacacccugcagaggugaugggcaagugagaaugggcuggggcuauguguggagaaccaguaaucccaacuuuucucauggacaugggguggggccaggucucucucccuccccucucccuucuguucugcuaguggcauccccuccuccugacaagucccuaccucgugccuguuuggacauggucgcuuucuguuccuaugaucuuagccaggggacauuggaggcacggaugagcagagugcagaugaaagcuugacucugguugugugacuuuguuucuucagucguguaguuguuaagagccccagugagggagaucacccccuugcugggacuccugcugcuauggcuggcauca

SEQ ID NO: 5666 - RNA, 9060 nt, Mus musculus
aucaggggcacauggaggacauguuuacucaaauagggcacaaggguuguaacauuuuaacgaggugaaaagggaaggccagcccuguaguuuugcaggcagacagcaccugacaccuucacagggagccuuggcagacuugcaggggcaggcaucgggugcugugcugccucagaccccacacagcuccagcugcccguucuuguauagcccgcuggggaggccugagaccaggacacagagcuggcucaagaggcuguuuuuuguuuucacacaaggucuugcucugcaaggcaauccaggcuggcuucaaaucugcaguccuccugucucagccuuccccaguacuagcacuacaagaaugugccaccaaauacuuuaaacacgguuuaaauagaauuuauucauuuuugacaauuucaugcauguaaacaauccaucuugaucauuggcaccccgacacccccuucaacuccuacaacuuccuucaauaugacgcucucccucaaaaaguagauuuuggggaggggguggguuagggagugggacagcuuaagcaacugugugcuuagugucccaauguuuaccuuagaaguaacggguccuagggcugggggacaagacauaaaaccacuuaacagacaguuccaauggguuucauaucccugucaugaagaaagguaagcccaauguacaaaauaauacuggagcaauuguuagccacagagagaaaccccaaagcagguggaaucuagcaggauguguauugagggcuuuuggugcugcuucuagaauuuggcauuucucccugggcuccaacaagaaaguaugcucagauaagaauauuagaaacagugaccaugggacuuuaccaccaccuucggccaucuccuugccuacuacguuacuuacuacccuaagugaucuucuuguucacuacuuggcuugcuuacuuugucuuugcucuaagagcugaccacguuuuuuggaugcaccuaggaggauauaaagcaggcuggagagaaaugaagcugcuucagucucaggacaggguggagucaggugaucaugcugucuaacguuuucuccucaauccucacucccuggagacccugcugacugacugaacuggcuuggucagaugugcuucaccaacaguaaaaucaguauauacaaaaaggaaugugugaagagaacuuuuugccaagacuguaacaugccaccaaaaaaaggaaaaaaaaauccagacuacagaaauggcacauauauuuaaacggcagcuguucauuacacgugcauagagugcuuccagcaacugcaggguuguuaauuaaguaaaaacuccaaucccagggugguggucuaguuuccugugaguuguuggccagggagauagaucccagaagugacuacugucacuauacuuguguguguacuagagcuaaauggucaccccuacugcuaaggacgccaaaugcugacuucaggagaccagaauaccaaccugggcuuacacaagaaagcacuaccccaaucccgagcaguuagcauucagugucagaggcuguuguucaggccccgaggggaagccaacucuuacagccucacuuggcugaggcucccaaguccuccacuaccugugugucccacaggaacagcagguucuguggugcuucaaucugcccacaguuaaccaucucccaacugucugucuagcccccuccaaccucgagcuaaagacaauccuauguccaaacacguacguacccaaucaaucacugugauuguuuaaaugagaaugguccuuacagauuuuaauguuugguuccuaguuggcggacaguuuaggaagaauuaggagccuuguuggaaaagguaugucacuggacgggggagggaggagagauggacagacuucugagguuucaaaagcccagcuaggcccagucuuauacacugcucugcucugccuggugcccugcccauccccacauuucccccagaaugucauagacucucaaacugaaaggaagcccgcaguuaaacacuuacuauuugccuuggucaugaagcgucucuucacagaaauaaaaaagacaauuauccucugaauauggggaucagucauacugaggcuaucaacuagucaccgaggggaaccucuuccacugggcagcaaggauuguaacccaugaugaucugaccuauacacggcagacucucuucagucagguaguuaugcgugccuugaacauuuuacucugcucuguucucaggaggaaaaugaccaggauaccuuuuucuuucuaggggcucagggacuauggaggaagguacagagggugagaagugcuagagggugggaaaacuguaguccaggcuugaugcccuaacccagcaugacuguggaacaguagcuuccaggaccaaucagagacccuggcucagagguggcaaagaugaaguaucacaugguacggcaaaccaccaggauaaacgacagggguguuaccaucuccuccaagucacagggacaugguuccucuacucaaguagccuccugaacagaccgcucgucuucccgcugcuggcacuugcuaacccugauaacaucaucuaagacugguuagucagugaaacagcuacaggucauccacacuguaagcuuacuagaacuggaggcauuccucgggcugucaguagcauuauaauuugaaaugacaauuuuacaugacuucacacucacacacaagacagugacauagcacauaguuguuucuaaacucucuucacagaaggagcaaagaucaaucugcucuaaaaggaugucaacugcuaucccuuacaaaucuuuaaaaggcagcuuggguuuuccugaacugaauauaggcaccgucacaccuuaaauggcagggggcugucauccugggcuugucucuaguacccaguucauacauaacaaacugcaaccugccuugauauaaaacauaccaaaaccccaaacuggcagugggaaucuuguaaccaauagcuacauuucaguguagaugagucaagaguuacagcccacacucuagagcaaacaucugcaucaaccaauauugucauuucuuauuuccuuucucaguguccaagagcacuacgcucucugcguccaagcucugagcacuuucuauguaaaauacaccuggguucaugauucuuugugacacguaaggacaacagcugaucggaacaggccgcccugccccuggcccccaggcggggaagugccugcuccuuccaugugggucauuucacugcuucuuuuuuuuacuugccggacuguccaaaauuucaaucuugccuuugccaccuucugcauucggaagcuuaauguucucgauggugacuucagagggaacgcagacaucuucuucggacuccgagcuguccccagaacugucccgagagcucucuucugggcuauccuccucuuuugaaucugaccgacucaucucaaauaaggccacauccuauaacaaagugucaggaugagaaauguccuucagggcaguucuguaacauguucuaauaaagcaacauggauggcuacagagagggugcaacaagcagguaaagauacucacugcuuuuccagaggaccccaguucaguucccaguacccacuaacuccagccucagaaaaucuaacauucucugcugguucuuaugggcaccaaauccauccuaagagcaaugucacugagugcuuuaaguaaaacaugucuuuaaaaaaguucuugcugccuacuauccauccaacagcacccauucaauaaaguggacuagaguaguggcucucaaccuuccuaacuauacaacccuuuaauacaguucuuauguuguggugaugccccccaaccauaaauuauucucacugcuauuccuaacugcaauuuugcuacuacugcuaucaaccauaguguaaaaucucuauucucuggguccuggcaagucgagacccacagguugagaacugccagacuacagucaggcaccccauuggacacuuaagacuugacaagcagguggccacaguaacauggccacaaucccagucuguaacagcagugggaagacaaccugaggucaaccugaggcucccccaccacccccaaaaaaaaaacaucacaacucuugccuuaaagaaauuuacauuucugagcaaaaaccagcacuggcaggcaaaauccugccugccacccacuuucguucagacacugaaguaggaauggugucugcacuuucagagaguagcugaaggggaaagauguaauuguagcaugcauaccacaagcuucugacaccacagcccugggcagaauuucccaccaugaaaaauuguucaccuggaacuaugagucaacaugaauagcccuucccuuaaaaaccaugcacacauaagaaauuguauguaacucaauuuuuaguagccauaaguuuacaaagccugcuuauuaaguaaacggcuacauucugcacugaacagcaugucaaacaggcaaacagagggaguauggcccuguggaagucaaguauguuuuaccaucuugccugugugaaaauauuugcuaauuuuacucuagaacgacauuuuaaaauaccauuuggugacaaguauauuaauuccauuguaugaaacagaaacaagacugaguuaccaucuguaugauguuuccagacgucucgucgauguuuucaauauugaagugaccagcuggagcagcugccauuucccuccucagcuucucauuugccugggccauuugugggaggaaggccugaaccuggucuagcacuggagagcgaacacagccaagcaaagcguauuaguaaguucuaaccaagcccucccagcacagcauuucagagcagaguuagcaacaaacccaucaacucuacaucccuccacuucugagccgccuugggcugcacuggagggugggugcuaggcccagggcuccaccaaucaguuacauuccuaggcccucugaacucgcagagcaauacaaccacacgauucaccaauuaacucaaauguucuguuacucugccauccccaaaguauaaaguucuagaaggcuggcauuccacaagaugacuggggagaaaccagacagaaugagcuaaugguuaagugaaccugcucuuuacagugaggcugucaaagucauuaaugagaucuauuugcauuuuuuacuaugucagucaccuagaacgucugucaccugcucaacugcccaccuuucaucugaaaauggcaacaccacccuucuuuuuaaaaagaaaaagccaaacaacaaaaagcaaaaagacaaacaggaacagguuugcgaauucucuacguucauaacuugggcuggcuucccaguccugcauaggaccaugccugcccuuccuuugaaacuugggucacucauguuccucauccugaacgggccuagguuucugcaguccugccuagcgcagucugcccugugcuguaaucugacaggguguucuagccaagccagugagcagucaacuuggcugaggagaauagcaccaaguuaacuggaugcauuucucauuaaccagccgacuaggcacagcugcacagcagcgucuuuggguuagucuaacgcagagaccagcagcauaggacgacaaugggcauggggauccagauaaaccuuuacuuucuaucucuggcuucucuuaaagcaaucucagcuuccacucuuuugcaacucaagaguucuaacgaacacauucaaucucaccaccaugcugacuaguuuugucaacuugacaccagcuagagucugagaacaacaacuacggaaauaccucugcaagacccagcuguaggacauuuaacuaaucacugacugaugggggaaggcccagccuauugcaggugaugccaccccuggguuggugguccugcauucuauaagcaagcaggcugagcaagccaugggaagcaagccaguaagcagcaccucuccauggucuuuguaucagcuccugccuccagguuccuguccugugugaguuccuguucuggcuucuuucaaguaauauacagugauuuggaaguguaagucaaacccuuuccuccccaaguuaccucuuguggucccaucacaucgaaacaaacccuaaccaggacagaaauuggucuaacagugggguauugcuguggcagagaccugacuguguguguuuaggauuguagaacuuugagcuguuaaaagcacuaaguguucagagcucagugagcucuucuguaggagccugggagauaagaauguugagagcagugcagacgauaagaggucuggcuugugacguuucagaggucaguuugagaguccuuuaaugacuaucucugcuucccacaguagaaggguuauggucucaugaagccacacagcuuaagaggguuccucugguccucacguuggcucaacaagcacccuuauucugagcaauuaccuagaauaaauaccugccaggugugguggcaaacaccuuuaacuccacuacucgggagguggaggcagagguaggugaaucugaauuugaggcuggcauggucuacaccgaguuccaggccagccagggauaaaaagugagacugucgugggaggggaggaaaaaaaaauggcccagcagcauguagcaguaauccuagaguggggugaggcaggagaaucugggguucagggacauucucagcuacacagggaagcaugaggccuggacgacaugagaccccgucucaaggaaaacaaagcuaacuagaccauagcuagcugggccuuuugggguuucaaaaacaccuuuuauucugaaaacaaaaaaaaaaaaaaaaaaaaaaaaacaaaaagccugcaaccagggaauuaacaugagaaauucuauuccucagucauuuacacaauauauuugauucuacgguuugauaugugccaugaagacagacuguccccaucaaauaauggauuaacuagccucaauugggggagugcccucuagaguagaaacuagguacuuacaagggcuccucugcauccgaacuguuugaaguguagaggucuuucugggaugaggcuuagagcugaugagcaacuggucccagauaccugaaaccacacacacaaaacaauucauggcauaaaacagcccugagcaacaagugcaacucagaaaugagaugagccucuacaccaaagaacugugagagccgggcccaucagcacagccugaagucugaaccaccccuaacucugacagaggaggagccaacacuccugucuguacgucuaucuccccaaccucuaguacugaucuaauaaauacacauugacaaacagggagggggacuaggcauggcagggcacacucaaaagacaggcaaguggaucucugugcuccaggccagccaaggcuaugucucaagcacuagcugcucuuguuugauuccuagcacccacaugggggcucaacuggacuauaauuccaguaccagagcauucgacacuuugugaccucuuaaggcaacagggaugcacaacgcacaacuuuaaacagcacaguuagcaaaauguagaccugcaaugagucuuugauuuuaguuaagaaauucagauaugcuuuaaucccaacacuuaagaggcacaggcaagaguucgaggcuugccugaucuacagaguaaguuucagaacaaucagggcaacacagagaaucacugucuugaaacacacacacacacacacacacacacacacaaaagguaagucagaagucagaaauagggcccaaaaagaggguuuuauggacacagugcuugccucccaaauuggaagcgcuauucacuccccacauaguaggaagagagaauagcccccuccacauaccagagguacauaauacagagaaccagaaacgguuauguagacuugggcaagucagacugggcuuuuuuuuuuuuguagaauauacuugccuagcucuccuaccuagaaggugcucaauuuaaaaaauuaauuauuccgaguugcaccuuuccaaacaaaccaacugcccaguccaagcaacaaacacugaagacucaagccuuugcccacuuuuuuuuuuuuuuuuuuuuuuuuuguauuuuguucuuuguuuauucgagacaggguuucucuguagcccuggcuguccuggaacucacuuuguagaccaggcuggccucgaacucaaaaauacgccugccucugccucuccaaaugcugccaggcugggcgguuccuaaugaacucuacaaggaccaccuggccuggaccggcuuggcagguagaggaaaaaaaaaaaaagaaccaccaccgcccagcgccgggcuggccuagucguaccccggacagaccccggcagcgucucgggcuccguggcauccccucccaauuagcgucccagacuccgcgguaucuccgaccuccgcagcgucucggacucucucggugucccauacccccgcagcguuccaggcuccccggcaucccuagccaucgcagggucucuggcuccucggcguccgcggccccgcaauaacccggacccccgacuccccacagcgucucgagcuccuuggcuuccccggcccugccgcgucucgggcgccucagugucccagaaccccgcagcgugcccgguccccgguagcauccccaaccuccugcagugucuccaguagcguucccgggucccgcagugucccugacccagcagcguuccgugucccuccaacccaccccgcucuccaccgucgcucaccucccgaacccucgcuccccgccgucagcagcucccuggacaccgugaccugcgagcaggcuacagaagacgaagaaacaccaggaccggucccgcgcucgcccuggaacuccaugcuuccaacccagcgccacugaaagaagcccggauauaggaaggcacggggaaggggcggggucaaggcagcaauuggccgaaacuaggaggugggcggu

SEQ ID NO: 5667 - RNA, 52546 nt, Mus musculus
cggggccgaagccggaagucacgugccgugacagcggcuggggugaggcccgcgucgcggcuguggcugcucggggcugugucugugggagguuccgcggcgauggccguggacacucugucgcccgacugggacuucgaccgcguggacgacggcucucagaguaagccccggcaucgggcgaggcgggccgggcggcgcugcggacggagggcggcgcggugcggcgccgcgcugcgcagccgcccucucgggacccucccgcugggugggacuggggcgcucugcgugaccguguggucgcgucuggccgugcacucgcacccugcgucccucccggaaucggugacgggccagcggugccaucgcuggggagccccgcgcgaggccauccucccggguuguccaucccgucccaggguuugccccagaugcucagccuucaguucuagaagagucuggguucccguuucgguuuccuguuuuucuuugcuucucaagccaacuuuugaaguuuggauucacguucuuagaaccacagagacagcuaaaaacagcucuuucuggccuuaaaaaaaaaaucaaccaacauaggaauaucuuauuccuucucggcccuuuauugauuuuuaaauagcugaaaagguuuuuaaaucuauuuuaacuuuuuaaaaaaucagaucugcuucgcaguugccucaugacgucaaguccaaguuuauguuuaaaaucacuuccaaccccaaaagccucauaguuuguuucagcauaaauggacaacccaaacuaauuagagacacucuggagguugauuuguuuguuuguuuguuuguuuguuuuuucugugugauagaagauauauuggggcgaguugcccaagaaauuuuuaaaugcauaccuuucccaaaaguaggaaugccuuuaaaaauaaaguacagcugcauuaugaauuauuuuacagagauacuagaccauguacagauuccuauguaacuguguuuugccuuuacaucuaguugaacuauguucagggugcugggcagaucuuaagauauuggucuuagucagcauaaagaaaaaucuagauggaaggauaguaaccaccccuucuccuccccccccccccccccauugugcgcugaggucccuacuuuaguuuaaucuaaccaaaguuggaaugaagguauacuggguuucagcuuuaaguggaaugaaugaucaguuauuuagacauaaucaguuuuuuagaugcucaggacuggggaaaggaguggaaacaggacgugggugaggacacaauauaaaaaccauguauguaugaaaaugccauggugaaacucauaauguuguuuacuaacuuuaaaaaguaguaggaaaacuacaagaaaugcaguuuguugggagggggaguauguuaugcacagagggccacugguucuuagucucuucuuguacuuuaagaacuuuuaugaguucauagcuacuuguuaucuuacuggcaaggaauuuaguguugcugucguuuacccaggucuaaccaggugaucucuuagcaugucuuucaaguacagucuuuaagaacccauuugcuggucaaaggaugcuuuggucauuucccauguaauagaguaagacauuaacacgggguuguuagcaguagguaagaggucucucugugccuggcuuucauuaauuuuggggcugugaaucauaucuagacuaauuguuuuccaaaauuaucuaagugagugcuguaaugagacaggcgucuuagugaacugaauugaugccccugauucacaaacucaguucaaaauaaaggacagaugucuagucuauauuucaugcagugugagucagaacauaguuuauuucaugacagcuccaaacuucaaauuugaaggaaaaagcauuuuuuuuuuagaagacaaagauugaguaaaguuauacacaucaguaaaagaaaugaauuggaauugaauuuuuggaauaaguaauaauucuuagguauaagaugaaauacuuuauaauuucacugaauaggcauaugaaaauccagcuauuucuggugguucuaaacuuaaaguuaccuauuaauauguaaauucuguaaaucccagcuaucuuuuuuuuuuuuaaauauuguuuuauuuuacaugugugcacagagucuacagaggccugaaggugguguuggaucccguggaucuagaguuaacugccacaugggugcuggguaccaaaccccuguccucuggaagagcagcuagagcucuuaguaggcaagcccucuccccauccucccucagccagccagucuguuuuaucugcuuuuuauaucuugauuauaauagcuaaagaauugaacaaguaaagcauuugguaagcggagcauuacugaaaugauaauacgauguaguagauugaaaaccuccaugaagaaagauuuggauguauucacaacauuugacuguguauagaauuagccaccuuuuaaaguuugcucuguaacaacacaguuugucccugcucccggaguugauugucuucgcaacauagcugugugugacucaaaaggauaguguaguaucuggacccagaguugucugaggcaugguuagaagcccagaugcuaagguauggggcugcagccuuucaaguacuugcacauauuugaagaagauucaaagcugaaugacuuucuaacuuuggaacuuaauuuccgagaagugagguauucccuaguaauaauuaacaguguuuuacugcaguuuuugagauuacuugaagcuaguauucugccguuuauuacuuguaauuguaacacacuguuuuaaaaauguagaaauucaugcugaaguccagcugaagaacuacgggagguuccuugaggaguacacaucucagcugagaagaauugaggacgcccuagaugauuugauuggcgauguuugggauuucaaucuugauccuauagcauuaaaggucugaauuuauuucauuaaaaauguauaugaauauauguuuauuuuagggcauacuaccucuugugauguuugggauuucaaucuugauccuauagcauuaaaggucugaauuuauuucauuaaaaauguauaugaauauguuuauuuuagggcauacuaccucuugugauguuugagauuucaaucuugauccuauagcauuaaaggucugaauuuauuucauuaaaaauguauaugaauauauguuuauuuuagggcauacuaccucuuguguuaaaaguagacaauaugcuuucauuuaaaaucuaagagugaaugaaauugguaacuucccccaccuuguuaagcuacauaguuuuuaaaauuuguuuucugaaagaaugauaaaaacuuaagauauaguagcacaaacuccacaaaaaugaccauuguuuuauacauagucaaauauauagauuuuuaaggaugucgcaaugaauuuugcugaauuacagagcucaucuaccucauauucaaaugaagauauaaaauauuucuuucauucaccaauaguaccuuuugacuugaaugaacuuggggggucuuaaugugggaaagauuuuuuuuuucuugauaggguuauuuuguguagcccuggcuguccuggaacucacucuguagaccaggcuggccucgaacucagagaccugccuaccucugccucccaagugcugggacuaaaggugugcacugccacugccuggagugggagcgccuuuuucauguguccuucagcuucuugaaugcuaagagguacaggugugcaccauaaugcguggcuuuaguucacccauguguaucgcacagcuuagugguuuuaaaaaaguauauucucagaacucauuguccauugccaucauccauuuacaacauuuucaccuaaaaaggaaauccuguacccaaaucaagucacugcccuccuugcccccucuacaagcauccccuagacacaggccaccgucaguuacuguaugucucuguggauuugucucuguuagauguuuucuauacgugagaucauguguuaugugaguguuccugcuugguguuugacuuaaucauguuuuuacagcucaucugugguguagccaguguuauuacaugcauauuuuuuaaacugaugcaugguguucuguuauauggaauacucuugccaaauaguuauccauucacuggggauagacauuuagguuuuccacuuuuggcuguuggaaauuaugcugcuuaugugucugaaguuuuuauguagucaugcguacacacacacacacacacacacucacacucacacucagaaguagaauuauugcguccucugguaacuguguguaacuuucugaggauuuuauuuuacacauacuuuggcaugguguguguggagagagaguacaaccuguuggaguugguucuuuucuucuggauggguucugggcauugaacucagaucaucuggcuugguggcaagugccuuuucccauugaaccauuuugcuggccccuuucucaucuuccagacuauuuccugaugugguugcacuauuuuacuaucccuaacaguaauauauaggaguuuagguuucucuacauuauuaccaacauuaaagaucauagccauccuugugaaugugacaugaaacuucuugguuuugugaaagauuugaauuaucucagcuuuucucuucuaccgauagaagcuuucaaagcucucucuguccucauauacagccauuucccuccccacuuacucugggaucugucuuuagucccuuuauugggcaauuauuuuguguuccuguucuacaagagucauagacucagauauuucucuauagaauuucucuauauaucucuauauauuucuauauauuucagauauauagaauuucucuauagaaauuacaaaguaaaugggagaaguaauuuuuaacuuauauacuuuauuguuaauauguaacuaaaagaaaggccuguuuuucacguaauagaaaauuaguuuuagaugauaaucagaaaagcguuaugagcaagauagaaaugaacugauuuagaugauaaaaugccaacacuguauuuuguuucugagcauugaguuuauucuuuucuccagugcucugcuuugugauaacuccaguuuggcucuuuuaguuacaguaguuuauuaaguauauguuuacauaucaacuuccaaacugauggagcucacuguuaguauguuuuuaguguuuucacacuguuguccuagagcauggcuagaaccaucauugugcugugaguauuguguuguguugaagguguuucuucuugaguguauuguacucuccuuacuuuuuugagauuaucuuaaacauaauaguugagaugaugguaaugcugaauauagucucacacaaguuaaauuaauuaauuuaaucccauguauuuagaauuucaguguuuuuuuguuuuguuuuguuuuuucccccaaguuaagaacugcucuuucucuuugcuucuguagcuucugcccuaugagcagucuucccuuuuggaacucauaaagacugaaaacaagguaugugccccuuaccuaaagucacuuagaagcuacucuuacugguuauaaugcacucuuucuguuuucacugacaaaaccagguccugaacaaagucaucacuguuuaugcggcacuuuguugcgagaucaagaaauuaaaauaugagguaaugguuuacauucuuuaagaucaucuaaaaguaaggguagguguagugugcaauaaauucugaccacugaaugauaguaaugcuagcaguccuaauaguccugugaccccagcauucacuacgugcauugguaacacugagaugacaaggcaggugaggaaaaggugaagaaauuagggcuucagcaggugucacugauagugugcacaccuccagagugggcagugaucugcuuuguggaacuuuccauauguguuuggaaccacugaacuuugguggauauuaguagacuucauuucucucccuuuuauauucuauaacugcugacugaugugggaagaugugggugaugaggguggucacauuaccaagugaaggcugaaacgggaggcugagcuuucagcuucagcacuugucucuguuacuguaaagagaagcugaauuuguuugaaagcuguuguuucugaauuuugaagaaauuuaucuguaaaugauggagugucauguuuuuagagaauuaagaauuaauuaauucuuaauuaagagcauaagaauuugaaagcaaccuuuuaaguuauuuuaauuuccuuaaacaggcagaaacuaaguuuuacaauggucuucuguuuuauggugaaggagguaagucagaauuuuagaauugcguuuguuguucccuuuuaagaaacuagugaacagaaagcuaaaagacuauucuagaacucacaugacuguagaguguauagagaaacagccaacacauuuaaauaguuuauuuaugcuuguguguguguguguguguguguguguguguguguucguucacagagcuacucugugggugcugugaaccuaauuuugguccucuggaagagccaaaugcucuuagcugccaagccaucuccagcugcuaaagcuucuuuguuguuuacugguuugguuaaacaagugaggaauggaauggcaaggcagcagcacauucucuggggccauggauggucagugaggaaguccuguguggacagagcuuuggguccgcuuggcagggaggaauggcuguuugaagguguaacuaguucaugacaugucauuuuucucuuuaguguaaaagucuaguguauuuaguacugugugagagugaaagaauauuaucuuuugucuuuguuguugaauuuaaauaaaaagccugaaguaaaauugcugcuuuuuaaagcuacagauuccagcaugguggaaggugacugccaaauucaaauggggagauucguuucauucuuacagguaacuccuuuuuguuuguuuguuuguuucuuuuaaucucuuuaagggaacugauuuuuacuaucucucaaaccauuuguuuacuuauuugagacagggucuuacuagauagcauuggcugucuuuguagacuaggcuggccucaaacuuguaaaagauucaccuggccucagcuucuucacauucugggauuaaagguuuguaccacuauucauggcugagcuuuuaaaauuuuuucaucaaaauuacacauaauuuauaggcucuggaacccucaauuucugaggucuugugucuucugagagugaaccauuuacuuagcaugagguuacaguguaggagaucauaacucguaaaugaucuaugaggaauuuuuggggaauaagguaucaggagaccugaacaauucagaaauuguuuuaauauauuauccuuuguauguaacuuguauaauuucauuuauggauaguuuauaaucuuuuuuaaauguaaagaugauuuuuguggagacggagaaaugaaauggcucaguuacuaagaacacuugcuucucucccagaggacugggguuuaauucccagaacugaccacccucaugguggcucacaacugucuauaacucgauuuccaagagauucacccagcacucucuucuggcuuggguacuaggcacucuuuugguauacaggcauauaugcaaacaagacccauacacauaaaaguaaaauaaaauuuuuaaaaauuuuguuuuugugugguagagguggcucauugguuaugaguauguacuguuuuugcagaggaccccaguucaguuacuugcacccuuacugggggcucauagcuacguggaacuuagaugaaucuagggauccaaugucuauggucuccaugggcaccugcacacacaggugcauacacacacauauauaggcacacacauacacacaugcuugagaaagaaacuagacuuuuuugaauuaucuuugcugcuauuauaaacugcaugugcacgcaagcacagacacacacacagacacacacacagacacacacacacacacacacacacacgguugaucacacaggaaugggaaagcuggaagaacaaaauagugaagacuuauggaagaagcaggucacauuuccucaucuaggaacagaagaaaaaugguuauguuugugagaucaagucuggcagcuuagggagauaaucugcauguaacuagcuagcacucacaccucugaggacauggcucuggucggaugcagcuaccucugaaaagcaguuuggguuagguugagagugcugaaagaagcgguccagcucucuguugugagcugccucugugggggugaacuaguagauuaucugauggaaacagggaaagacugggaaggacagccuuugcugcuuuccugucacauugucaggaccugacagcaagucugcugccauaggaaggcugcugcagaaaugcgguuugaagagucagugagugugaauuuuuauuaaauauguguuucuguuggugauacuguauucgguauguauaauaaauugagcucuuggccauugugccguaauccucuaggggcuacugauccaagcucccagagucuagcagacaugaccuuuuccugucuguuccucgguguagggguggagucugcuuccucuggcuugccuuuauguuugguucauuuagccuucagcuucucuguaccaaauuaccuaugugagauauccccuuuuacagaaaaguaaaugguauugauauauauuuacauacguaacucacaguggaauacauuuagacaguaagaaggucacugcaguaagacaaguuagcaugcccaccaugucacagagacccuuauuuugcuuguauuggcaaaagcuuugaugauaugaagcuaugauacuauguauauaauacauaauuauguacaaauggcuauuauauacauagauugagaaucacuaguguggaaugcuacaagaccuaaaauuguuugaacacuaauaaaacaucaccaauggagaauucuguaacccaagguaauaauuacuuauggacuauauguauaaaugaguuuugugcuuagauuuguuucuauucccuggcuaagauaucuuaucaccuaugugcagauacucuugaauggagaaaacucugcaguccgcaguacuucuggucuggagcauuuagaccaggguguuuagcuuauacaggcuagcacugucuugcuguguucucugucuggcaguaacauggcuacuguaucuguguuucagcuugcuuucucaauguaucuuugcccacucuuucauauuuucaguguugucccuuuccuugcauuccuuuaagaccucagguagucauguucuguacagcaguguggugccacaguauguguguaagagugccuuauguguugauuguccaagaacacagugucuuuaaaacagcgccuggagcuaguggugcuccucagguaucugaaggaaaggagcaaauggcuggaucuggauucuguuuuuuuuuuuuaaucaucugacaaucuuuuaauugauuuuuuuuuucuguuucugucucauggaaucuuucuguaucugcacugauuucugcuuuuuugucaugcuuucuguuuuuuaucuuccuguuaccauuuaaccuucagaaaguuuaauaacaaauguaaaacaagcuguuugaaauuacaggcuguuagguagcacauucaaaaugccuguauugcagcacaaggaugaguuaggaucaugaguucaagacuagucuggccuauauagcaaaaaccuguacgaaaaaacucuuuaaaguucaaagacuuuaaguuguguuuaggucucacuaauagcuguguaaaaaguucacuguccagacauuaucuaauguauuccaugaaguaagagagaguguguguguguauugcaaacugcucuuguuggugggggagaccaacacauaaaaaagcaaugaauauuauuguucaaggcuuacaguuuagaauagaugaagguuuaauaagguuuuaaguauuuuagauggaaauuuguuuuauaaggcuaaaaguugagagcuuuaaaaaacauugucagaaagucuagguaugguagaucugaguuaauaauaauugauaaauauucuugggauaagugauaugcacuuguaugugccaagcuauauauauauauguauuucuuuaaagaauuauuuauugucuguauauuaguaguacacuguagcuguccucagauuuaccagaagagggcagguagaggcagguagaacuuugaguuugaggcuagccuggucuacagagugaguucuaggacagccauggcuauacaaagaaacccuguuuugaaaaaaaaaaacacaacaaaagaugacaagggaagugauuuagagugacuuguggagauugcuuucuguccuugugacacuuguaggcuggcagucauugucacucuucagaucuucauucacuuacagggaagggaugauuggcccugccauuuaggagcugcaugagugacugaaacaguagacucagaaaauggugaaaucaugaaaugcaggagcagcagagggaggaaugaccuggccugcaggaggggagagaaguguugauugcuugagggauucugagcucuggcugcuggauagcuagagcuuugguuguguuacagcauccagucuaaauaucccgacacugacaaagcagucuuguaacgcguacucaccaugucauuucaggaacuguccugcuuugugacgaggugcuacgaaguggugaugaaugucauccaccagcuggcugcccuguacaucagcaacaaguaaugcgccguaggguuaggcugcuuuuauaaaauagcaguaaggacuuucuggaaaaauaguuaauagaaacaacuuauuauuuguguacucaguauacaugcuuaggauguucagacacugcuggagguuguguuccuuuuuuaaggugugugcuuacagauaauugagauuuuguucucaccaaguuuaugaaccugauuuugucugaaugagaauauuggcaaaagaguuuuaaagaccuuucaccauagaaaagagcugaugcagaauuaaccacucguguguguuuguuuuccccuguguacauuagugguucucugcuguuucauaaaguuaugugacuuuucguaaauaggacauaaaguugaacgaaauguggcuuauuauuguaguauagcccuagaaguuugaugccuugcuucucaguaagagugagaacugaagaacgagucugacaugugcuuaagggucuuuucucaagcaccaguuuugauagaguaagagauuguaguugauaaucgagaaauuccaauaguugauuaaguuuuuccuucuacuuugaugccaaggcacauucuuuaaguuuaaaaagcaagauuacucaucugcccguugucagguuuuuaacccaugauggcacagcaagcaaggguagcccaggcucugcucuggcuugugccugcaaguuuacgacaaauacaugcuacaguucuaagagccuguauuuaaacuuggauguuauuuuauuauaggauaggacccaaaauuauagagacaacuggaguucauuuucagguaagaguuaauuuuucuacuuuucuuagguauuugaccaauuaggacauauacuaaugcuagcaugccaccccugucucugucccuguugucugucuaguugaugagccaucacuugcuaugaucuggcacuuguacuuuuccccaguagugcuccacugcagguuuucuguggucaacaaacaaaucuuuagcaucacaauuauggagaaaauauuaggcaaaauauacucgauuuaggcuagugguacauuugaggguaagaccugaaucuuaauaaaccaauugaucccuccuuucacuaauuuaauaauuaacccaauguguuuuucuuuaaaaguucacaugagacuucuaacuagugacuaaaugauaaucauuaaagguuuuuugacagacuauguaugagcacuugggagaacugcuaacaguuuuacuuacccuggaugagauuguugauaaucaugucacgcugaaagaccacuggacuauguacaaaagguaugccaaccaaaauguuuuuaguuguuuuacuuuguacggcucaugugauaguuuuaguaguaaaaauuagaauacuaauucugauucuuuaaaagaccuagagcucuauacugaaaaagaaucaugcccaauauuuacuuuuauguguauguauauguguuuaugucucccuguuucaugugugucuguacauggguaagaggggauuggaugcccuggaaccagagucauaggcuguuguaagucaccagacucagguuuccucuguaagcacucaaguauuucucuggcccuguccaguguuuucaugagcagucagccacauuuguaguagguuuuuguucucaaacuguugcaguaugguuauaauuuguucuuugcacugaacucuguucaagugaagguuugugccacacauuuauuaaaaaugcuggaacagucuuuuacauuucuauucaguuuacauacaaauaguaacuagauguuugguauaugcagagcaacaggcaauugaacguaaggggguaaagagaggauaaacauuuuacuaggguugcucuguuuacauuuuccgugugaagagccggguaagaauaacacauacacauuuuuuuccugggauauuuuuaacuuuuaagaauuuguuagguagauguaagaucuuucuuuaaaucuucuacaagguugcugaaaucuguccaucacaacccuucaaaauuugggauucaggaagaaaaguuaaagcccuuugagaaguucuugcugaagcuggaagggcaguuacuugauggaaugauauuucagguaaguagagcuguaucagggucagcauaugaguucuuagagguugugcagaucagaacuacaguaggacacuuuuguagaauacuuuugaauuucuuuuccuuagaaagugcuuuggcuuuuuaaaaaagccacuauuaguauauuaaagcauaacucaauauauaguaauaaauaaaauaaaaaguuacuuaaaaugaaggcuuuaaaaauuaaacugugcaaaaauauaaaaucgaaucaggcauggugauguaugcccuucuaaucccaucacacaggaggcugugcaaaacuaaggccagcuucugguacaaagugaauucuaggucacccugagaugcauaggagaccccaucucaagagaaaacaaaggcaaaaaucuaaggguuucaaagucuaggcaucauuugcauuaaauauugucuguuauuagcuucuagauuuagguuuuuaagauugccuuuaaaaagucugaagggcuggggauguagcugagugguagagcacucgcuuccuuggcaugcucaggguccuuccuaaccguguaaaggaacaacucagaacccaaagcaaacaauagaaaagcuuaguuaguucuuccugcaccagugggugugauuuggauguacacagauagggugccuucuaaaugaaaauguacuggaaccagguaaaaacauacuacuccucauucuauggauagacccucacagugcugccagaaaucccauuccgucuacucugucugcuucgugugacuuuuguuuuuauauuaucacaguuuugacagauuggcuccagcucuuucuuuuuaaaaucaguuucucucuuagauauaaaaauuaguaaucccuuagaugcaaaauguaguuauuuuagcucuuuuuuuuccugggacauuucuacacaugcaguaugugaggagcugggcagugacugugccuguuaucuccuagcauuggaaaagucuaacaggauuaucauaaauaugaggauggucugggcuacagagugagauccugugcacgcacacacacacaccuaccuccaaaggguggcacucugaacaagauguugcauguggagagaugacucagcaguuaggagugcuggcuugaagaggaccuggguuugauuccuaguaccuacauggugguucacaacuaucagcaacuccagguucaagguaucuggcacccucucuggccucuguaggcagugcaugccuauggugcagagacauacaugucggcaaaacacucaaacacguaaaauuuuaaaaaugauuucagcugggagagguggcacacaauguuagucccagcauuugggaggcagaucucugaguuugaagucauccuggucuauauaaugggcuacauggacccuuucucaaaaaacaaaacaaaacaaaacaaaaaagucaaaacccuccuuuccagugugucagccgugguuccuuccauucaucucugagcuuuauucugucucuucauuuggggugugagugccuuauaacuggcacucauauaaguacaugcacauaucccaucaaaggacacgagagcuacauuugauaguaaaaaccacuacagaaguguuucaccucaccaagguguugauagcuuguuacugagagucugaguuucuguucaaauguuuccuguguaggccuguaucgaacagcaguuugauucucucaauggaggaauaucugugucgaaaaauagcacguuugcagaagaguuugcacauagcauucgcucaauuuuugcaaauguggaagccaagcuugguaauauaaauuucuucuuugacuaauuuaucaaguuuacauuuccuuaagaagucaucuauuaucuguuguauuucugugguguuccuuuaucaggugagccuucugaaauugaccagagagacaaguauguuggaauuugugggcucuuuguacugcacuuucagauuuuucggacuguugauaaaaaguuuuauaagucuuuauuggacauuuguaagaagguaagaacuugaaacuuauuuucaguuugcaauguaaauuuuaauaaagguagauauuuaaaagggcuaacauaaaaguuuauuuaaaaaagaauaaguuaaaaaaagaauaauuuacuuuuuaugaaguguaacugugucagaaagaaaauagagcuggggaggugugugggucauggaggauuagugcuugucguccgucugucgugaggacugggaaccagccucccuccaggacuuagguaaugccgugcgagcauggcagcccgccuuuacuuccagcagugcugguauaucuucuaacuucugauacuaccuaucaugggucagaggccucuggaugaauacaguggaggaaaauggaggaagacgccuaauaucaaccauagguuucagugcacacgugugcacacguguguacccgcacacaugagaaggcauacaugcacacaauacacauucacaugcaaaaauaaaagcagugguagcauuguuuuaaaguacaaacacccuugaaaugagcaaauacaauaaacgaaaauaacuguuucauaucaagauauauauagauauauacacauacauacauacauacacacacauauacauacacacauacacacacacacacacacauauauauauauauauauauauauauauauauauauacauauauauacauauauauguauauauauauauauguauauauacauacauacacacacacauauauauauggugaguguacuuagugugugugugcacauuaacuuugcuuucuuucugagacagggucuugcugugcagugcagucuggccucagucucagccauccuucugccacaacuuccugagugcuggcauugcaggagugcacccaugcccugacauguuaacauccugucaguacuguuaccauggccuugccuccuccuuccuuuggcuguccccuuugcccucauuaaauuguuauuuucaucuucgcuauuuccaugauaggacacccaguuucagaauugaaacuuaguuugugucuaguacuaucaaauaauaacagcaauaaggccuuggcuauguuuaagguuauuuuuuuucuaguauuuuauuaauaugcccuggcaguaauguuaugaaagguugaauuucaucaugcuuuuuauauauuauuaauuauugugaaaucuguuguguguaugucuguguguguguguguguuaauauuuaggcagaauaaaguugcugugcucaccacccauugggaaugcuuuuguucuuucuacaauaagugugaggggaagacacacuguaacacauugagacuuugguaacuguguuuucugagcugccuucccugugugcuguagcacucuucagcacagcaucauugggucugcuuucuuuuccuucccuucaggugccagccaucacuuuaacugcuaauauuauuugguuuccugauaauuuucugauucauaaaaugccagcagcugccaaacuucuagacagaaaaagucuucaagccauuaaaauacacagggauaccuuccuacagcagaaagcucagucacuuaacaaguaaguuuuauaaaacaacuguaaaaaaguguuuagauauuugauacagaaaguacuugaaucacaagauacuacguaauaacagacaauauuuacaguuucuguauugauugucuuucacauuucuguacuaacugacuuaguguaucugggugugcgugugaaagaagacagcuugcaggagcuggcucuuucccaccgugugcugcucggauccagauccugggccuuaggucugcaugcauggcaaauucuaguucuaagcaucucuccaguccccagauugauuuuucaagaacuuugcuuucuuucuuaaaacucaaaacuauuuuguguguguauguguguuugguguguguagugugugugucaucugauuguuguguguguguguugcuagagagaacccaaacuguaacguccugagaagagcuggauggugauauuagaggacugggaagcaagccauuagagacaucugagggaaaugugguggugucucugaauguguguggcguucagauucagaagggagcagauuugaccucugcggcucuaccuagaaggccuuuacuagacuuugaagggacagugacagguaaggacaacauaguugccagcaguguggaccuuuggaaauggagcaggcuuuggacaaaagauuguagcauugagucauggcccccgccccaucuucauggggaagaaaugaacauaacuaaguucccuuuuaggucacaggaaucuccagauaccucacuggucucaucuauaagacacaguaaguaggacagccugucagccgacgcuccugcuccugggauugccauuuccugaggagacuggaauacugagauuaaaccucagccaggccguccacucuuaaguuuaaagugucaugugcuucucucagcuguuugccaugacgucagcugaggagaggaaggcaugaagaagugagcuuggugagcugguacuccagcgucugccauguagcuguguggaccaagugugcacagcuguguaugugcccaggaggcuguugggaggaaaaucuaguaaguggagauugaauguuuucuuuuccaagaccccuuaucugacagaguuuuaccccaaagcauuuuuauuuauuuacuuaauuacuuguuuguugauuuuuaagagacagagucucucugcauagcccuggcgauccugaaauucacuguguggacuaggcuggccuugaacucagagauccaccaugccugucuccuagugcugggauuaaaggagggugcugcuaucccggcuaugucuaggcuuugugaguuuaacacauuucuguaaagucaggauagagcuccaugaucugaaaggaugguggugcuggguuuguuguuuuuuccuuccaguuuccuugcaguugugccagagaaaccuaguauucacucugcuguuguaaaauguaggggcaggugauccuaccacuugacaggagggugugaggugacagcugucugcaggcaguucuguugcuagaaguggaaagggagcugggggcuguccucugcucccugcugucagugccccugaccccucggacagaguuggugcacagcugcauuuuaccauuccugggugaugcgggcaagaccugccugugggguaggagguuugagcuuuccagagaccaucaagucccuauguagauacugacacugcuuuuuaccagugcaggggauuauuuuucccuuaguauuucccaaauuuauacuuuaaaauggagcuaacaaauggauaacugaaucccucccguccgucccauccaacaacaagaugagcugggaccuggagcaguuucaguuuuuuauccuugaaaggcagugaugauccgccaucuggcuguaagaguagcagcaggacugacagaaagcucugcuucauccacauugucugacccaaggcugguugagcauguuuuuuguguuucuaugcucagaauuguuuuuuccugccccaguuuccugagugcuagggauuacaugugaccugccugccauaaacagugcagugaguccucuccucuccauuucuuuaccuccucccuccuccugcccugucccuccccccucgcccccuccucccuccuccugcccuaucccuccccccucgcccccuccucccuccuccugcccuaucccuccccccucguccccuccucccuccggccuguccucucuugcugucuuuguuugcuucuggggcuuauccugacagugucaucaugugccguggguugaguaucugccauggauuuggguuucaauccuggcuccugaugugggcaggacauguuacuuuguguggcaguuucaucuucucuaaaaugaagaacauagucccuacaguuaaguuuuggggagggaaaggagagagauucacugagugggauagaggggagcaaagagagggaggcucacugaauugaaagguucuucaggcaagagaauuaacucacagccagcacugcagggcccugaaguguaagaugcuucaguccuguuggacaaagcaggauguccaccuaaagguuucuaagggaaaaagagguauugaguuauaaggaagcagauuuaguuaaugugugacuuauacugugugacugaggcaggggagugaggcauguguaacauggguaugugauagguccugcuuuaucuggguaggggcucaguuuaacccaugcagauaacaguaauaaggauguuucaccccccaccccagugacaggcaugaggugaguauauuuauacuuguuuaaaguccuccugagggccugaguuuucuaacuacugcauaagguuaauaugggguuugaaugaacuaauuugugucaaguuuagcacaguuauugguauagcauaaacauucaaauuagcuuuuaaauuuagauucuggcuucuuuuacuauuuuuuuuccauuaaaaccaaaaccuauaugugccuggcucuguaugccauguauguguaggugcccacagaggccgauccccuggagcuggaguuguaacuugaguugugagcugccaugugggugcugagaacuaaacucggguucuuggcaagaguagaaagugcucuuaacugcugagcaucuugcuagccucuguucccauuguuuuuacucucacugaagauguugucuucuuccuccugcaucauuauaguugcuuuauagauguuuucuuuacgauggcuuauuuuuaacacauuaggcaaagugauagugauccuuagaaccauuccucuccaguggcuucucuuagacaagaccuuagccuagucccucccccucccacccucccucuaugucugaucugcucuucugucccucuuucucuuugcacucuagccauccuggguuuuuguuauuacugaacaagcuggguauaguucccaaagccuuagggcuuuuguacuuguuuugcacaucuuauuaaucuggcuagaucauggcucagaaucauccacacuaugaucauguuacuuaaaauuauagaauuaccucaggcccuggucugugucccugucugcccccgcgucccccaggauguaucaccagacacuuaaaaaugguuuugacuuugguuauugcuuuagccuauaacuguccuuccuagaauccaagcuuuguggugccaggaguuuucaucugcugugcucucagcuagaauuaaugucugucuugcauagguacucacugcauaguuauaaguucaguaacuuaugugugcauauaggauuccuuuugaaggcuugagcauacaauuacugcuggaagggguauuuuacucuugucauaugagacguggacauauauuuuuguguuccuuugcuagagaugugcagucuuacuacgucuuugugagcucauggaugaugaagauggagucuauguuaucuaaagagcagaggauggauacauuugcugaagaccucaccaacagaugcaauguuuucauacagguaguuguguguucuuagaauguuuuggguauaauuucaaauuugugacuugaauuuacaggaguuacacucggccacaacucuggaaaggaggguuauguuuauauuuaaacagaaugaggagcuacagagauagcucgcggugggagcacuugcuccugcaaagaucccauguuugauugccuggcuuuaggggagucagugccucuagcucccuggguaaguacauuuauguuuaugaaaggcgagguccugaagagcacacucgggccgucaagcuuagccgcaagugcccuuaccugcuugccagcgcuccuuuggguguucuugaaagauuaucuuuuuauuuccagauacaugaggauuucuuuuaccuuuaauuuaaaagauuacauguauuuagucugugugcaacuguauuaauaucagacacaaaugaucuccaacaaaaagcaucacuagagaucaacaugucccaggaaguagcaauacauguugcucucuacugaugcuuucuguuggagaucauuugugucggauacuaacgccguugcacaguguuucuuuuggcuaaugucuacaugaugugucuuuacugagccuuccaugcagccuuuguagcuucuuacauggaaugugugucuucuguaaacaguguauauuuucccucagucugguuuuguuugguuugugagugagagagugaguguacguguguggaugcgcuugauucuguggauguauguggaggacagagcuuaguauuagaugucuuccucaauuguucuucaccucacuuuugagguagucucucacugaaccuggagcucacuguuugagcuggagcagccgaguagcaauuccuuugggagaugucuguuccucuaagcuagguuuauagacaggcaccccugugcccagcuuuuuaaaugggucuagugaccugaacuugggcacccuugaguguguugcccacugagccauuuccuuagccaccaucuuugucuucuuaucgggccaugagcugguuucugcccuuguucucuguuucugacagagccucugagaagcagcuucagugucagccucacugcucuagguuccccccagagcuugaccacucacuuccucauuuuccugggagcucuuugaugcuuuccgcgaguguuaccaagcucuucuaaugguucuuacuaggaaagucaucuguguuauguauucuguccguaacaguaaagacaaacagguuguuuguggcgugagcaguuaacauacuugaagacucccaccaaaagcugcucucucuuuuuuuagauuuauuuuuauuuauuauuauauguaaguacacuguagcuguuuucaggcauuccagaagagggcaccaaaucacauuacagaugguugugaggcaccaugugguugcugggauuugaacucaggaucuucggcgcugagccaucucacuagcccaaggcuucucugucuugccugccuuggaugcuuaccauuucuuauucugcuuuuagcuuucccagugguacauaaaagugcagucuaaugugauaauccucuagcugacaagguaaaacuagaguaugucacaagccucagucuugugccacucucucaggacacuguccucuguuauauuccuuuguucucuaaauugagcacaucucuucaacacagagcuaguaagguucagggaaacuggcucugccacuuugcuagucagaaauagucaauccuggauuagugcuuucuuacaugugcuuaggaagcagacuagcaggcacuuagccaaauuaaucaaaggacagaagagaagaucuaaauuaauaaaauuacacauagaggggaggauuacaacagacacugaggacauucagagaaugauaagacauauuuaaccuguaaaguaguaggauauaaacuuagcccacagaagucagccgucuucuuauauacaaaugacagacauaguggaagucaggaaacagugucuuuuauaauagcuuaaaaaaauauguguaucuugggauaacucuaaccaaacaagugaaagacuuauacaauaaaaauguugagagugaagaaaagaaauugaagacaccagaagauggaaagaccaccuauucuuuuggauuaauaguaugaaaaugcccguuuuacaaaaggcaaucuuuagauucaauacaauucccaucaaaauaccaacacaguucuaaguagaaauugaacaaaacaaucuucaacugcauauggaaacacaaaagcuuaggaugguuaaaauaauccugaauaauaaaagaacugccagacauaugaucaucccagauaccaaguuguaauacagagccguaauaauaaaaguggcaugguuguggccuacaaacagacacguuaucaguggaaucaaauugaagacccagauaucacacacacacacaccuacuuguggacaccucguuugaacaaaaagucaaaaguagacacuggagaaaagacgguaucuucagcaaguguuggugcuggucaagcgauggauacauguagaaaaauucaguagacccauucuguacuguacaauagacccauacuguacaaaacucaacuacagaggagucaggggccucagcauaagagcaguuucccaaaucugagaagugaaaguaagaauagauuuaaacucauuggcacaagaaggauuuucuggacaggacacugguagcauuggcccaaagaccagugaugaauaaauggaaguccauuagcugggaagcucagggacucaaaggacucuaucacuggggcagagugacagcuaaagaacuggaaaacaucuuuaccgauugccagucugauagaagguuaauaucuaaaauacauaaagacuaaaaauacugaccauccagaaaauaacccaguuaaauggaguacagagcuaagcaaagaaagaugaggcacagauagcugagaacaaagcaguacuacauccuucgccaucggggaaauagaaauuacaacuacuuugggauuucaucuaaucccauucagaauggccaagauauaaaacagaagauggcuguugaggaugagggaaaggagagcauucauucauugguaggagugcaaacauguacagccaaucagugugguuccucaggaagucaggaaucagucaaccucaagauccagcuaucugcucuugggaauaaggacucuauaucuuacugcagagauuccugcucauccauggucacugccccucuauucauaauagccaggaaguggacacagcauagacguuccucagcagaagaauggauaaugaagauggggacacuuauacaguggaauaucgcucagcuguuaagaaacauaaaaugaugaaauuuguagauggagcuagaaaagaacauuuugagugagguaacccagacccucagaagaugaguauguguuugcaucugaauaacuaagaggucagguaccagggggaagaggagggucuccccaggaagggaaaauagaauauaguguuauguauugauaaagagaagucuagaauaggagaguuagcucggagacuguggcaucacacaaaagaccauuacaauuucuagccagagggaguuucaguagugagaugggaaaguggauacaggaucccaccccuaaccaagaaaauauuugcuauugauaccugcuggcaaaaggaaaaaaaucaaccacauucagggcccauguccaggagcuguuggccaacauaaaacaaauuacauguuuuuauauguauauguacuucugccccccuccauacccucccguuuuuguuuuauaugguuuuugugggcuuuuguuuguuguuuuguauuuauuugaguagguaggaaggcagagaggaucugcagagaacuagggaaggggaaaacauccaaauacuguaugaaaaaaauuuuuuuaaagauauauuuauuuuauuuauaugaguauacugucacucucuucagacacaccagaaaaaggcaucagaucccauuacagauguuugugagccaccaugugguugccaggaauugaacccaagaccucuggaagagcagucggugcucuuaacugcugaaccaucucuccagccccccaaaauuuguuuuacuuuaaaaagaaacuaaagaaaaauguauaugaauguguuugucguuucaaauccuuuggagguuuaaaugaaaacaugugaggggcuggaaaaauggcccaacaguuaaaagagcuugguacuuuuucagagggccuguguucagauuucuaccccucacaaccaucaguaacuccagcuccagcagagccaguggccucuauggacaccuggacacacacacacacucuuaaauguauaaucccauucauuaucuuacuuacuauuuagucucccuggaguuuagaggaauuggaguuuagaggaguuaaaaaauacuuuuaaguagcaaaagacuucugugcuccuuccuaacagaagaggaggagagaaugcguucuaguucuuggguuagaugagaggaaagugacaagaggcagauaguagguggccuguggaauugggcugggccagcgguucuucaccugcugagcuggguacccuccuauuguggugaccccagcugugaaauuguucuguuaguacguagccugguugugcugcuuuuuggaagcacaauguaagugucugacgcacaggcugagcgcugcuguccaggcagagaggaagggugcuguuagcucgagguucagaagcuccuuugcaugucugcaguguucagggaagcagcuuugcccaccugucaguuuccuuagucugugauucccugcucugagcaucgcagaugggaucuugucuccucagcaguuaggaugcggaugaauuaucagguauuucccuggcauuuacacaccauuuuacugaagggguuuucauuuucuuuaagugaauagcuuuuuaaaagccaguaaauauguaaaugucugguauuugauaguucaggaaauuauuaagggcugauuugaaacucacaguguugucaggaauaguauuucugucucuuuaagaauuggcuugaaaagggacauugaguguuuggagagaugacucagauguuaagagcgcuggguacucuuccagaggacccguguuuaauccagcagcacauaacugccuauuacgcugguucuaaaagauccaacaccugcuucuggccucaggcacugcauucaugcauugcacagacauccauguagguacaaugcccauacacauagaaguaauaaauaauagacuuagaaauacuggcuauuggcaugcuuauggacaacauacauggagagcaaagucugaaugaaaucuguaauuccaaugcuuauuuucuuuuguaggguuucuuauaugcauauaguauuaguaccauuauuaagaccacaaugaaucucuacauguccaugcagaagccuaugaccaaaacuucagugaaggcauuaugcaggcucauugaacuucucaagguaagucagugcuguuuuccuuugccaccaggacuggggacaugaccucagcuacaguagaaugcucuuggcggguuuugcuuucugguugcaucagaauacaaacuugggagaaagugaacuuaaaauugaaaagaaccucugaagagcuaucgugcuugacuaauacaggcacuacuuuauacaagggugcgugcugacagucucagcucagccuggcucgccaggcucacguaacgugcucagauuagcuuggcucccugggguaaucagugcauucgcuguuugagaaaaccuauuugugcuuugcuggggaugguucuauugauuguguaaaaaauuuuugauauauuuggaauuuggaauguuuauagaaaauaaucuuuuaguagaugucuuaucuuuuuauuuuacuuuuuaaaaaaauuuauuuauucuauguaaguacacuguagcugucuucagacacuccagaagagggcaucagauuuuguuauggaugguugugagccaccaugugguugcugggauuugaacucaggaccuuugaaagagcauucgugcucuuaaccacugagccaucucgccagcccuuuauuuuacuuuuuaaaugacuuuguuguuguuugugguguuuuguuuuguuuuguuuuguuuuuuuccagagcugaggaccaaacccagggccuugcucuugcuaggcaagcgcucuaccacugagcuaaauccccaaccccuuaaaugacuuuugacaagugcaggugcuuaauuuuacugcaguugacuuuuccagcauguuugugugucucuguguaugugugugugugugucuuuguguauaggcguaugugcaccugaguguggaggccagaggucaacuugagauauugaagcuauguacuuuguuguuugagaccagugaggcuccaugcuccaggauccuaucugucuucuaggcacuggggggauaagcuucugcugccauggcugccugguguuuauguagguguggggagucagaccugguucuuaaugccugugaagcaagcagacacuuaaagacuucagucuucucugcagccccaagugguggauuuuuguugguuuuuguguaugugugugugucugugugcguuuguuuugauuuuaccuucacacuccucuagucucauuuacagaucccuuccuuuccuagggucaugaagguuuucuuuaaugauuuugcauuuaaguuuuaaguuaacuuuuauuucuuuuaggcaauagagcauauguucuacaggagaagcaugguuguggcggauucggugucacauauaacacagcaccuucaacaucaggcucuuaguucuauuucuguagccaagguaugcagauuauuaugcauucagguuaaugaagguaucguguucugcuguuuuaucuguauuucuugccagauguguuauuucuacagcgcuguauccauugcauuuuguaauguuuacaguuagcaggauuguagucucugaaaguuaucaugcuugacuaauuuaggggcuucuucauacaagacuacguguugacagucucagaacucagccuggcuuaccuuaaaugugcucagaaugguacucuccgauguaaucagugcauuagccaacauuccagaaaaccaucuaacuuagccuagccuguuggaaagcccugggugccccauguaaccuacugaaaacccuacuagcagcuaaucuuaguagagugaaaggaaagguuuugaccccucaauuuuagaaauguuuucuaguaagguugauguugaauguguuuaaaguaaaccacuguuugcucuuccuguagugcucagacaguuagcgaggccaaguucagaacacugggggaaggaguuuuucugugcucucuggagcgcugcuguagagaacagagaagacacuuuguuuccuuuggaaacuuaaccauguuagaaucaaaacuaauaauuaucuguuucaucuuuaagaaaagaguaauuucagacaaaaaauauagugaacagcgucuugaugugcuaucugcucuuguuuuggcugaaaacaccuuaaauggaccaagcacaaaacaacgacgacuuauuguuucuuuggcauugagcguuggcacgcaaaugguaaguuuauugcucuuauuaaaggaaucaugaagucugagguucacaauuuauuuauuaaguaagaagcuuggccuuguggugauuacacuugcauguuuucccuuucugcuaauagaaaacauuuaaagaugaagaacucuuuccccuucaaguagucaugaagaagcuggaucuuaucagcgagcuuagagagcggugaguagaacugaugugugauagccaagggccugggcaguagaacagcuguucccucccucccucccucucucccucucuucucagcccuccccacucccaaccuccauuuacugaggggcccaggcuggcccugcagcacugaguucacaggccuguuaccacacugagcuuggguucucuuuggcacagccaggguaugaagagauccacaggacauauuaguuccucucuguaacucuuguaaugugaccaacaggagacugguucaaccuugucuugucuuagcuuugcuuucaaaccuggaagacuucacaugacacaaagcaguugcccuucaggguaucuggcagaugacggcaguauccauuguugguauuuuagcagcgucacuacugggcuucccaacuugcugcuuuauaguaaaguugcauucucugugagacacuugaagacccaugacacaccauauuguauaguuguauuuggaggugacauuugaauugcagucucagaagauagucauuggguugaacuaacgugggaaggcuuccuggagggacguugaacauugaacuuuugacaaaguucagcucuugcauugcagcacaguuuuuauuuagucuucauaacugucuuugcuauucugagaagcugauauauuuguaguuugugguguuuaauuuucaguccuugaaagaaguguugaaccaucacuauaagauacuugggguaauucucuucugcaagucauuacauaguaauuugguagcaaagacaauggcuaggcuaugugugacaggguuuuguggucauaguggcuuuuuuuuuuuuuuuuuuuaaauacaggaucucauuguauaguucuggcuagccuagaacuggcuauguagaccagguuagccuccaucucacaggaugcugguauuuaauauagauaauugagugccuaagauuuggagggcuagaacagcaaaacaaaacagugaggggaugccaaggucuucuuaaaacuuaauuuucacuguggagacaugcacauaauuaugcacauaaugcaaguauuauuucaguuaauauggagaaguuuauuuuaaacauccauuuaguauucuggguuuuucagcagucuuaaaucuaaaacauaugcagaauuuugauaaugcagaguauuaaaguguuuuguugccuuugcucaauuugaaaaauaacuuaaguuuucugacuuuguuuaaugauguugggugaaaugauucagagaauguaaagugaggaagauagaucucuucccuucaguacugaaggucgccacuaauuacucauugccuuauauuguagaguccaagcacagugugacugcuguuuuuuauacuggcaucgcgcugucuucccgauuuauuuagaugauguauaugaaaaugcugucgaugcagccagauuacauguaaguacagaguaauauaagaguaagugucauuucuagugacuuuguaaguuucaaauaggucauuugauuuaauaacccacccuacaacugaccugcaaugauauauugaacaguuuuauuaugcauaucuaaucuaaguucauauaguugguaguuaaguuguauaucaauuguuaugaguaaaauuagaccuguugugcucaacccugucgaggcaguuaaccaccuaacccucugugcuuguaguuuuccauucucagcucacuugauuugaucuugcucaauaauuuugacacuucuuggcaggcugcauguuacucaguuucucuguggaagucuguguauuugauguacuuagaauaaaagacuagugaguguuagcuuuucuucuuuuucaugugugugccuauaucacggguuucaggguuuuaggaaaauaaagcagucauaggaaaguauuuucccuuuaggucagaguuuuuguaugcaauuaccuuugcaauuuuauuuaaaauucugccuuuucuaaacucagguauauuuuaauuuucuuacuaguacauguucagugcuuuacgagacugugugccugccaugaugcauucaaggcauuuagagucccaugagcugcuuuuggauugcuaugacaaggaaaucauggacauuuuaaaugagguaagauuauauugaagauagaaaguuuaagagcagugccuuggggggcuggagagcuggcucagcgguuaagagcaccgacugcucuuccagagguucugaguucaauucccaguaaccacaugguggcucacaaccaucuguaauaagaucugaugcccucuucuggugugucugaagacagcuacaguguacuuauauaaaauaaaauaaaauaaaauaaaguaaaucuuaaaaaaaauaaaauaaguaaaaaagagcagugcuuuggaagauguuucagagugaagcugacuucacugagucagaaauuauuuaaacaaaccuagguguaacggugcguacuuauaauuccagcacucaggagauugugaguuccagucacugacccuuucucaagaaaacucaaaccagucauuuauaaguuacuguguaaaccauguuuggaagauaggacuaaacaugaguaaaccuccuaacaccuuccuguuucagugugauagaaauuaugaaaaauuuuguauaaucauauucccuuuuugcuagcccuucuggguuaucaaaccuugcaaaugaucaugaauauuuuuauuuaaaaauauagguaacuggcuagcuaguauuugguacucugauagacaagcaaagguuacuguugacauugaaaugucacuguuaacacagugaguuuuguguguauguggaggcucucugugcaccugugcuauggugcgaguguaaggucagagagcagccuugggugucuguccuuguuuugagagaggaucucugugugguucacacuguacaagccaggccagcuaguccuagaguucugaggaguucucucaucuuccauuucacucuaggauuacagaucugucuaggacuaccaugccuggcuuuaggggucugauucuggggguuugaacuugggucucacacuugacuacaagugcuuuuaaucugcugauccguuucuaaauccucaugauauaagaauuuuuaagauuuauauguauuuuucuugccugcauauguuuguguaccauguacaugcagccccugugauuuuuaaugauaaucauaaggaaaucuauuuuucuuuacuguacauugcaagguuauuuuuuuuuuuuuugcugcuacucuucauaaauuuuaugcuuuguauuacauaucauguuccacauagugagguuggcuguuauucaugaaaauuaaauuuaaaauauuuaugaaaauaaagucucaguauuuaucugucucuuggcuuuaaaaaauauauuacacuuuucaaacaaaaauaaaauuuuaccauugagagauuggcaucuuaagucaagaaacuuguuggucaguuugucuucggugcacaaugagggucaaggcaugcgcguguaggagugaucugcagugggagccaucuugaacagcucuggauucccucugaacagcauuugcuggauaagcuguguaaggagaucgagaaggacuugcggcuuucugugcauacucacuugaagcuggaugaccggaaccccuucaaaguuggcaggaaagacuuggcgcucuuuuucucucugaacccuauucgguuuuucaaucgauucauugauauucgaggugaguuagugcucuucuuuguaugcuuguccugugugucuucugaccugucaugaggaucuuuuguucauuccuuagcucuuucuguuguuucacuuuuauuucuuagcaaauugcuguguagcccagguuggccaagggccgcaucuauagcccagguagaccuuagacucaugguucugcuacggcuucugaguacugggaugacagggguauuccaccacacguaauccuugguuuugccguuacuguuuuguuucguuuuuuguuuuuaaauauuuugaagguuucacucucuggcugaggcugguuuugaacgugugcucuuccugccucagcccacugaguguugauacaauuaccuuauuuuaaaggaaaacuuuaauuuuaaaaucauaugguguuuuuuucuuuuaacuucauuucucuuuuaucauucaugaaucaagcauagcaauuugugggguuuguuuucuuuuguuuuuguagcuuauguaacucacuaucuggauaagacuuucuacaaucucacaacaguagcucuucaugauugggccacuuacagugaaaugagaaaucuggcuacgcagcguuaugguuugguuaugacagaggcacaucuuccuagccagacuuuggagcagguaugugcacaguguuucugguauggucugauagugcgacaguauuaauuuaagaaauguuuucuuuaacccuaaucagucagucugucugucuaucuuucuaccuaucuauuaggcauguauuuuaugugugaguauuuugcuuuuauguguguaucugcaccauguuaguaccuggugcaugcagaggucagaagagugucaggugucguggaacuagagugacaggaugaacuguguggguucuggauccaacaccagguucucuguaagaacaaguacucuuuacugcugagauguaucuacauucccuuaauguauuuuuuaaagaaagguuuuguuauauaaaccucauauuugucgagaauaaaauauuagaugguacuaaugggcuuuacaguauaauguaucauugucauccuagaguucugcugagaaugugaaauacauacauuuacacacacucuucaggaaugugcuaagauagugagauggcuuuacagaauucuaaaagacauauacaaagcuggauuugaaauggguuaguacguggaauuuacugcaucaggaagacagcucucuguauaguugcaaaucgcaaagaagcauuggguuuugcuaauuagcugauuuguaauaugugaguauuuuaugaauguagcaauuuaggcucucaguuauuuuguaaguauuucuuuuaaaaauaauuuaguuaauacuuaaaaaccauuuauucugucccaaaauuugaggaucauaauaccuauuguacauaccuguugaucauaguaccugaggaacaauaauaccuguuauauuuauggacuguuuccagggucauuuuguguguccuuauauucauuuauuuaaauaucuaguauauguuuagagagcacuggauaaucaacuguguuuuaggauucaguucauaugcuuauagccucaggggagauaaaacuguaugugaagaaacuuuuaggguagaauauaguaaaagguacaguauuuauguguauugugaugagacuuugaguacuaguuaggaaaagcuguagacuaaucugugguuuaccacugagaauuagggaagcauguggagaauagaggaucuuaauagaguuaaagggcucagggccugaugggaaaguucagcguugaaagcacuugcuuuucuugcagaggaccuggguucccagcccccacaucuuccaugggauccagcagccucuucugaccuucgcaggcaccaagcacacaaguggugcacagacguauauguaggcaaaauacccauacacauuaaaauacauacauacacacacacucagaggcagaggcaagaguucuaggacagccagggcuauacagaaaaacccugucuuaaaaaccaaaaauauauguuuauauuauacauacguauuuauguguguuaaauguguguguguauguguguaugcacacacacacacacacacacacacacauacauauguauauauauaaacuggacgggggccugaagauguggcucagcaguuaugagccuguagugcucuuguggaggaccugaguucagucuccagcacuuaaaucagaaggcucacaacugccuuuaagucucccgcaggugaucugauaccuucguuuguacacacucucauuuucauauaauuaaaaaaauaaaaccaaaucuaaaagggauuugguauagucaaaagaagcauaaaccuuugaaauuagaguuucuaaaauuccaguguucucucucugccuaguuguuugaccuuagaaaacuccauuagcuucauuuucuucacuuccgguguuuacaagaauaauacccacagaaguggaugcucacagucagcuguuggauggaguacagggcccccaauggaggaacuagagaaaguauccaaggagcugaaggggucugcaacccucuagguggaacaacaauaugaacuaaccaguacccccuggagcucgugucucuagcugcauaugaaucagaagauggccuagucagucaucauugggaagagaggccccuuggucuuguaaacuuuauaugccccaauacaggguaacgccagggccaagaagugggaguggguggguaggggagcaguuggugggaggguauaggggacuuucgggauaacauuugaaauguaaaugaaguaaauaccuaauaaaaaauuggaaaaaaaagaagaauagcuacuguuucugagaauuacaugugaagaauaguucuuguuuaauuucguaaaaguaguaugcauuguuccagauguucuuaugucuuaaguacuuucuggaguauagucauuaguuuacuuuguaaaaaaaauugaagagacauugaaagauggucaggaaacaggugugacgcugggucuugugauuuaaguugugucugcacagguaggagggguaaaauacaaagcagccaggcguucucaaggaggugauuccggcuguguaaguggggagggucuuggacuuucaguggugcuuuuauguaguuuuaaaaagaauguaaacuguuggucagcaguguaucaguaagguguguuguguugguacacauguggcugaugaugcuuaacuaauagucuugggguuucuguguggauuuuguuauagggacucgauguccuggaaauuaugagaaacauucacauauuugucucaagauaccucuauaaucucaauaaccaggugaguggauuuaggaggagauuuuauuuauuguuuugugggguuguuuguuuguuuuuugguuuuuugguuuuucgagacaggguuucucuguguagcccuggcuguccuggaacucagaaauccaccugccucugccucccaagugcugggaguaaaggugugcgucaccacgcccggcuguuuuguguuuuuaaggaaggauuucacucuguaguccugacugcccuagaauuuauauguagccuaggcuggcuuugggccuucagaguguuaggauuauugugguauacuacuaugcccaacucggcuaaagcuguaaaugagaacgucuuuauuaauaggacagccaaaagacuaggaauugacuuuucaaaggugaaaauaaaauguguaaaacagaguaauugcuuagagauuuacaguguaacuuuggcuagccuggaacucgaugcauacaccaggcuggccuugaacucacagagacuugcuugccaggcccugggacuauaaaggagugcaccaccacaacugcaguuguuuagacaccuggcuauuguuugcuccacugugguggugucgucuucuuaaauggcuuuucaauaggucauccuuaaugaaacagauuucuaaacugucuggguuauucaacaguguuuggaauuggcucuaauuguucauaaauauguuugcauugcagauuuuuauugaacggacaagcaacaauaaacauuugaauacuauuaauauucgacacauugcuaauucgauucgaacacaugggacggggaucaugaauacaacaguaagcaucuuuuuguagguuugguggguaauagacuugucaaauuuaguaauuuggaagaugaguuuuacagacuauuuugguaagcacacauuacuuccuguuuauaucaugccuggauuuccauuuuuccugauggcauaaauaaauauaucucuuguuaccauuguguuggaugagggggcaccaugguggaaaaagcaguguaugaccucuuaaccgucugcaccguaguuguuagcagugggagucaguacauuguaugugccuguuggucucuuaugcucucugaaaaugacuuuggaaaugagucauuggacuggcuuauaaacuguauuuauaaacuauguaauacuugaaucucagcucauaucucauucuucuaaagauuugugaaucuggguuggccuucuauauagucauucucaaaaguaccugcauuucaccuuuagaaguuauggcagcugaaauguaaugauuugauaauacauguuaaaguugucugccacucugcuggaaaaggaagaccaaggccucuagcgcugcaacagguauauugauugccuuguaugcaaaaggcuucagagccauauagcuagaugaguaauuguuuauaccugccuccagcauccuguuccuuacauaauguccuuccagccuugcagguuaguaauaaggcaccuuacugauggaggugcagggaacaugaguauuucagccauuuagaaaguauauaagagaauucuagaaauuucuaugacuugggagaucaaauaaacuauuugaacauuucagcuccaguaguaauugaacuuuauaaauaguacuuuuagaucaccuacucuguaacuuuauuugaaauuucauauuaacuuuuuauuuuuuaauuuuauagguuaauuucacguaccaguuuuugaaaaagaaguucuauauauuuagucaguuuauguaugaugagcauaucaaauccagauugauuaaagauauucgguuuuucagggagaucaaggaccaaaaugaccacaagguaugcuauguauucuuaggagccugaguucugacucccaccuuggaaugacagagguuuaugcuggacuuugguacuuaacgucucugcggguguagugcuugcaugugucuccugugucuggccacuuucuccuguauauuucuuauguucucuguaggcuuaagcauaaaguggaauaugaaaugaucauuguagcuuagauuauuuuauuuuauaauaauauacacaccaaaacaugcugguguugaagcacuuacacagugucaggugcaucugccaucccaucaugucuuuucccaguuccuugccuggaggcaggagcuuuagugagcaguguaguauagggcccuuccuaacccuucacaguagacaugugugucuucacacauuuacacagugcugcuuuuuacugcaaaauagagcaguauugguuuacauugugugcuugaugucugaacauaucccuuccuagccacuuuuuaagaguuaaccauaaaggggacuuguuuaauccccaacuaacucauggguauuuuaguuuucucaucuucuguucuuaugaacagagccacagauaacauaucuaauuggagaccauuucugaaagaaaauaucccugaaaagaaguuucuagaauaauggaugagaaugaguacuucagauuucuggcacgugcugucuaacacucuagaaauacuacacaauuguuuccuaccaguaguuuuuaggaaugcuguuuuauugggcuggagauguagcuucuugcaaguaggcuuuucugcugugccaaaggccccagguucauuccccaguaccauaaggaaaacagcaguaacccugaaauaaacaaaagcaauggaugcugccuucauaaagagaauucuauucuucuuugcccucccugugcaggguuucccuuugugaaguagagagcuguggagcuguaggaaguaacuagugcaggggcagugacugugaagaugaagagcacacacgcucacaugguucuggaccuguuugcugguuauaggacuacuuggaucacacuucagacucaucuggccauagccuugguguauaauagaccucaguguguuacauuguagaaaaauaacuacugagacagaguacagucaucaguagacagguguacucuaugucuuuuuacugggguggaaguuaugaguaagcaugcugcuauagagaauugcuguccucgauacagaugaucaguucccuaauuccauuagccagaauguguaaaagauuuuucucgucucuaaauugaugaugucgacuagaaauuuuguuguguuuuauguuuuugagacagggucuccugugagguuagccucgaagugggucuagaacuuucuuucuuccugauuucaccucucaaaugcugggaucauaaguuugugccaauaagcugaacauuucaagcagcuuauauauuuuauggaaggaauguguuuauaaagucuuugucaaaaagccuauagaaacuugguuacauaucaggaacaaguacaucuaggggucuuaguucuuuuucagucugauagagugguuaggggaucagaauggugguggggaugguggcauuuguccucuagcgaguaccaacacagcagccacaaaagcauuguccuggagcaccagugggcugcugcugggcaacagacugggcaugaauugaccuugaauaccaaaaagguuucauuauauagauuugucauuagacuugauuuuuaaauaauaaugagauacaaaauuagaaaggacagugauacuggcaucaguuuaguaagaauuuuauauuuuaagggccuaaaaauacucuugaauuuaucucuuuaguauccuuuugauagagcagaaaaauucaaucguggcauaagaaaacuuggaaucacaccagagggacagagcuaccuugaccaguucaggcagcucaucagccagauugguaagucgcuuccaggggucaggaaguacaggugccaggauggcgggcaccguguguaugagacggcucuuggaguaugugaauaccucuaccugacuccagcccacuuacugagcuguugugugggaacuagauaagugcuuaaguaaaguugguuagaacagauuaagacacugacauaauaacuaccccagaguuaacauuaggaguuaacugguaaggaaaaguuaguagauuaguagguuccauguaaauuuuauuacaguuuagauacugaaugaugucauuuuguacguguguaggauuuguguuuuagaagcagacuugccuucugaaacccaggacauaauuuuuacaaagaagaauuacucuaaagcucaguguucuccaagcuguucacacgugaaaucccugggaaugccugccgucacagcaagcauuccugugaaauaggcacagaaccacuuuuaaaggauccaaagagaaucuuagaaacaaaugcugcuguugacacuccagccaucagaccagucuuuucgauucauaccugucugcugaagucgaaacuacugacauuuacugagcaugacuuuguauaugcauauauauacguacacacacauacauacaugcacaguauguaaaguauuauuucuauucacuuauccugaaggauuuaauuauaacaaauaaagguauuagaugcugaugauaugacaauaaauggagucugucuucuagaguuuaauuuaagaugaggagguugacauacaaguaauguauccaguuugaucuaggccaaagcugacaaaugguagagccuggaguugaacuucaggagccugacuaggguuuuugcucuuaacuguuauucucagcuagccucuuacauuuuaaucaaucaauauuaauugaaacagucaaacuaaguauuucauuuuuaaaagaugcauguuacauauuuuuuuaaaagccugaacaauuggaauagucuuuaaaguagaucaugaauaauuuuuguuguguagcauuaauaucagagcuguaauucuuguaaaaaauuacuguuaccuuuuuauuuagccuauuauuuucuuccaaauaauuuuaguuccauuauauaucaaauuccuauugugauccaagacauguuugcucuagggaugggauagugaagaacucagaggucauaugcaguggauccuuauuuuagcuggggagagaggcagacaaaggcccauuaauaaguucuggauaaaauguaaugaggcugagcaguccuguguaaugauauucaggaagacuuccagggaagugacguugagcagggacuuuaauaaugggacagaauaaaccuuguaugcaacuggggaaagaaaauccuagacaggcaggcagcuggaaguguaaaaacccugagucuccuuggcauuuuugaggaauagucuagaauagggcuagaaugaagcuaaugaauaccugacuagcaagacacaauggaacagcaacccugagcagggucauacaggccguggugacagauggagaauggaugcauccugauagggaacuauuguaguuuucaggaagggcaugacagcccaucugaauguaugagauccaggauuugaugagguggagggauacuguggcuucugacgucguaaugggaagucaagccagccauggcauaucacauggucuaggcagcagacuuggaauguggaauuuggugaggcugguuuugauccuccucuucuuauguccacugacccgggcauugaacccagguccucacacuagauggcaugccaccauaucuucagccagauccuggcuguuuucgaggaagagcugguguaauuguccauugauucuguaugagaugugaaagagaggaaggagccagggugaagugagggguggugagcucagggcauuggacccaagcaaaugaagggacagaacugcuaguucugaaguaggcaauguaguaggggauaaaaagauccuuagacuugggugugauuaauauuuuaaauuugucuuugauauauagguaugaguacuggauaaaagucuagagaucagaggaguccaggcuagagagacaaauuugggauguaccaaguaaagauucccugacacuacuuuagagugagugugugauugugugugugaaauuuuacuauaauuuuaaaauguuugaccauuuuaaugaagcuagcaauucuaauuuaucaguuaaauuacguuuaucuuaaaauguuuauaucuaaaucuaacuuuuaaaugcauaaaucuguaacuuuuuuuugaaauagaaacuaaaacuauagaagaauauuuugguauuuaggauuggagacuucucaguugacuacauaauauaacuuguuuugauaucagaauugcucauauaaagaugugcuuuuuugugugugauuuuugaagguaaugcuaugggcuauauacgcaugauaagaucugguggucuucauuguagcagcaaugccauuagguauggauucaaacauaauuucuaccuuuuuuguguaauuuaaucuuucaugauacuauagagaagguauuuguccuuguucaauacaauuugaggcuguggaucucuuguuacugcccagaccucugccccuuacauguacucaguuaaccuguuuucuuccuaaugaagaagaacauguuaaucccaacauccaaggaacuuuuuucucuuauauuaacauuauauuauggggcuagagaaaugguucagcaguuauuccuucagaguacuuggguccauucccagcaccaguaugacugugaacaacuggcugucacuccaguuccaggggauccagcgccuucuuuuagccuccacaggcaaagacacacaggcaggcaagcaccgauacacauaaaauagaaauaaauaaaucuguaaaaaaaaaauuuaaagaaggguguguguauuauauauacauauauguguauauauauaaauguauauaagacuuauuuuugaaaccauuucuuuuaagguacaguagauugauauuuuaucagaauaacuaaugaauguaaagauuacauuuugaauaucaggaugugaucgaguauaaaauuuuauuuggaacuaaagugauguuaacaacauuacacgcuaagauuucccugaguucuuauucagcucuugguguucuguaguccuuugauauguuuugauugcguacauuuuacuugcccugaugaauuccuucucucacguagauucgugccggaucuugaagacauugugaguuuugaagagcucgugaaagaagaagggcuugcagaagaaacacuuagagcagccagguaaccugaugagugggaaguuaaagcuugcuuaacaccaaacaagaccagaaggcacugaaaauauauauggcaguauuuuguagucucuacuuagcaaaugcauuguuuuuaaagacuacaguauucuaagaucuuuccaacuuaaccagaaagugcucuucugaaaccugcucuccacaugcagcauguucuuucugaagugagugaccuuggugaugcuuaaaaccguauuuguaaaauaagucaggcagugcugaagacauggcucuguggcuaagagcacuuguugcuauuguagaggccuucaguucccagcagccauguggugacuaaaauguuacuuucacagaagaguugaguauacugauggucccugaucuaaguuaaaugauuuuaauaaugauauuauaaaaaugauaagcauacgauugaagccauauuucuugauuuuuaacuugguucuuuuuccaagcaaucaguaugcacucugauuauagugaugcugggcagguguaacagggagcagcucccagccagcugggagguuucugcucuggcuaagcuuuucacauggccagcuuacuaggauguagccaugucccaggaugaagagcaccuguagugauaucaugggaaucucaaagaaccuuguguggugaaggcugagaacaguagugguugugcuuaacuccccagacagugcagcugcuguugugaagacuguaagacgcucggcuccuaaggaggcccaggucaaggguaagcagguacugagaagcacgagugaggagguuaagucagcagaauggaauuacagagaacaggggcucucaagaaacagaaacccagccaacaacuguuauggaccagauacuuacugccaaaccuaaagucaagccucagaguccacaugcugaagggaggaaaguccugcaguuguucucugaucucagcauuugcguacacaagcacguggaugcacacccacccacauacaugcucucacacuaguguucuaauaaaaugacugaugccauggcucagcaaguaaccugagcuucccucagaaccuugucuucugacuugcacacucgugugugcucauguguguggcacaugcacagucaugcacaugcaaguaugcacauguguguggcacacacacagucauacacguggaugugcaugaaaacaauacaugcacaaaaguaauacagacuacucuuucagcccuaggaugcucuauucuauuuuagggacuaaguucauuaacuaauacugacuaguuucugcucauucuaaaguucaaggacauuuuaugcuguuuccugauuuggaguggcauuacauaaccuaaugagagacauggauuuuuaaaacagccguaccuuuaaaaugaacccaaagaacguuuuauuuuugauauuuuguaggcauuuggacucaguccucagugaucauacacggaacucugcugaagguacagaauauuucaaaaugcuuguagauguuuuugcuccagaauuucgaaggccaaagaauauacaucuccgaaauuucuauaucauuguuccuccucuugugaguauucucaaaacuagaagugaguuauugauggguguuaauacagauucaguuuccauaaagcaugguguuuauucuugccuccuggcugucagugaaaguauggugucaggguguguucuagagcuugggcuugcugucuguacugcaggguuagaguuggccggcucucacuagccauggcaagagagacccuggggacugucaguuccuggaguagaugcacauaggaugugcgccauaggaucauguuaacuguaaugcagauuaauuuacuauaacaucauuuguuccaaaauagcuuuuaagagcuuacuuuuugguauaacuucucuuuucaguuguaaguacuagcaccugaaauaaauuuuguagugcuuucuccuaaaauauguuuucuuuacuaauuuuacaguugcugucuuuagcucaaguuaucaaaacuuacauuauaaaagcaauuauagcagugagagaaaugguuuauauuagcaaaaaaaucuguuucuagguuucuauacuacaucuuuuacauuuuuuaguggauaucuuuaaaaucugaacaccccucaggcauauguuagcuuuggauuacaucugacuuggaugaagaagaguguuucacaguuugggauaugaauuacuccauggaguacuggccuagcaugcaugaguuccugggcucugucuucaucacuguauauccuggauaugguguuccguucuuauaaccucaaaguuaucccuggcuagccuggacuauaucggguggugucuuuuaacaaugacaacaaaagcugcuggagagaucagucaauaguuauauguacuggcugcucuuccagaggagccagguuuaauuucuaguacccugcauggaggcucacgacuguaucuacagucucagggaauuugacacccucuucucacuucuggggcacagcauacauaugguguacacauacacacacaugcaaacauuuauccauccauccauccauauauacacacauacauacauacauacauacacacauaagcaaacaugcauauacauaaaagcaaaaaaauuuuaaaugcuuaaaauaaugaaaacccuuucccugacucgcuaauaauaacaacauagucuacugguaucaacaccuauuagagacuguuagguuguuauccacugccaccaccuuucucgucagauaucuguuacuuacuguuagcuuuguaacugauguggcagagaugcucuugcacggcugcugagugcucaggcugaagauguugguuauuugcugauacugcaugaacuugaauucuccccacauuuccuuaacuuagagaucuuauauucaggccaugguggggacugggaaagcauugaugagcuuugugaagucuggauuuauagaaaaucagucauguaauagacuaagugcagcacacagacauagugugcuauuuuuuaugcuuuguagucuaaaucuugagggcgguaaauauaaaugagcugccaaaaaagauugcaauggauguugauaaagaucucacagauugugacagauguuuugcagguagccacugcucacuaguguucuaggggagcugugacggcagaagggaagauugcuuuguuacagugauuuaugcuuugaggaaaaguaaagccauuucuccgucccuuguggcuuuguguuugacuuagcguuaguuagccucuuggaagauucaauguuuucacuccaaacugugcacaucacuucuagugagcacugugccagggcuaaggacccauggagggucccucucguaagaaaguccucaggaggcacgcaaggacuuguguucucaccaagagacaguuugccugaggcacauguucaggagcugagaagaaauucucuuuguacuucuugaaaugccuguuauagcaucuaaauuuagcugauuuuguuagcuuaauuguuuuucuguaucuucucuuuuuagacucugaacuuuguagaacauucuauaaguugcaaagagaaguugaauaaaaaaaauaaacuaggagcugcauuuacugacgaugguuuugccauggguaagcgcaauagaacuauuuugccaucgauuuguguuucccuuaaaaugggcucuuaaaaaaauugcuugaaaauggguuuaugugccuuacaguagauuauuuuucucagcagcaccugcuaccagugcgagcuuuuaaacauggccuuucugucauucaggcugucauugaccccaccacggagcuuacugucugucugauuuccccuucccuugggcuugcucuguugugguuuuaguuuuacaucuuaacaguuaguuucauuggugccucuguaauguccucuuuucugucagucagcuuuggacguuugcaucaugaauaagcuuuucuccuuucagccccccgccccgguuuucuggugaugucuaugauuguguuauuuuauuuuuauuuuuucuuuaguuuuuuaacauuuuccacuuauuuuuuaaagcagaaccagagagguugugguuaacguuaucauuuuuguugagaaaugugacuugaaaguguugcuucaggugccuagccuggugcguggagcuguggaugcaggggaggaagcguuucuguacucgcugugauucacauuuugcuuuugcugacuguagguguggcuuauaccuuaaagcuuuuggaucaguaccaagaguuugauucacuucauugguuccagucuguuagagaaaaauacauaaaggagaucagagcaguugcuaagcaacagaacgugcagucaacuagucaagaugaaaaacuacuccaaaccaugaaccuuacucagaagcgacuggaggucuauuuacagguaguggaucuaaaugcccuccgacugacuuaguguguauuacacucgauacccaaagccguauggcaagugagauaguagcaguaaaaagaacauguauuagaguugauaguuggaauccauugaucagaagaaaauuagauugggguaggcaagauggucacuggauaagcugcccuaggacuggaucagauccccagacccagguagaagcuggggagguacaguugccugaacuccuaguaccuagaaggcagaugcaggaagugccuuccagcaagcuggcuagcuagucuacccagagucagugauagaccacgccucaacacacaaguggagagagaguagccuaggaggcuacaccuccauacacacacccacaugcauggauacccagccacacauguaaacgcgcauguacacaccaagcacaugugcacaagacaguacuaccuuacuguuuccccauaacuaauuuucuuuuuauuucaaauuucucauguaggaauuugagcugcuguauuucuccuugagcagugcaagaauauucuucagagcagacaagaccgcagcugaagagaaccaagaaaagaaagagaaggaaggucagugcguggugucagcgugcaaagaccccaagucuugacagcauacaugagugucccacugucuuguuaggugucucguuuacuuaaucuucuggaaaacaauacagcucuagaaaugugugggucccaugagauagagaagaaagguccuguaacagaaacaaguuuaacaagcagauucuugggugauguugaggaaucgggagggaagggagcugauggacugcagcuggagacggcugugcggagcaggcgguugggacagcaguggagugaggagcugucacuuccugggcuccugagggccugauagacagcauccacugucugcaugggaggucccgagcaucaugcagcagugcugugccugaugguuguuuccaucugagccgcaaggacagccuugugcccacucugguggggugaaggaaccucacacaccuuauucuuuguagaagagccuugcucagcaucauaguuagugucuccauuucuaucaaaccugacauggaagggugauugucuucucugaggaauagaugguuccuuuuuuucugucauggaaaucaugaaauuucguuacaggaacuaggugauguuuaguuuuauggguuuuuuucauaaauugagauguauaauauuuucagaaaauaagguggugcuuaaaauguuuuuuauuuuaaaguaccccucuccaucuuugucacaagugagcaguucauguggguagacacuuaagugaaguaguuauucuugucaguguugcauauguuaaauguuacucuccaggguuagguauuagaagcauauccagguaucuuugaaucuggacacuucguguauuuaagccauaacuuguccauacuguuguuuggguucuugcucaaaauaacauaucccggcagaugcaucugaacugugagcugggaccauguaaagugacaguugugacuuugaguuugcuaaggcaucuaucucauggcacagcagaccgagcagauggcaggugggcuauggagcugcucuggggccugcagcaugaagacagcaggagccucccuggccuucaggcucaugcuguagcgcucuugucuuguucuucagggacugcuugauggcguuacucacgugccucgucaguuuucuuuuuaagacuguugggcuacaauuugcuuagugaugagaguugcuuaaauuaguuacauuaguuuaauaacugacaucugcucauguaugauauauacacaugacaguuugcaccaagugccaaggauuuguuugcacaaauaauaaaauguuguuuuuaaaaaaaacuauagccaaguagugauggcucacacuuuuaaucccagcacucaguggcagaaguaggaggcucucugaguucgaggccugccugggcuacaaaaacaaaacaaaaaguaaauaaaaauaaauuaugagcugggugcaauggcucaugccuguaaccucaguauuucaggggcugacacagaaagaucacugaguucaaggcuacccugggcucuacauuugagcucuagaccaggcuggcuugcagagccuuggagaauaaaaugaggagcagggagacuauucagagggaaaugcuuagagaacuugaguucagguuuccagcaugcauguaaaauccaggcaugucugcaagcccagcccacccauggggauucacuggccacccuguauagcuaagcagagagccccaaggucuauuagagucccugcuucauggggcaggagagcugucuccacaguuaaacgcgcuggcugcucuuccaaauaaccuggguuuggguucacuucccagcaccugcauggcaguucacaaccaucuaacuccaguuccaggggaucucaugccuucuucuggccucugcaccugccauacauuuaggcaaguacccauacccauaaaauuaaaaaauuaaauuuaaaagaugaggagaaugauagggguacacagccaguguuuguuaucuggcuucuuccagaugugagugugugcaugcauucacauacauguguacauguacaccuauaccacacacacaaaggaaguaaaauaaguacucaguacugcuggcuaggcacucaccugggcuauucagacucucacauucuagcugcauuuccaucaguaauggcaauacaucacaaaggugauuuccugugugaucaagauggauggaagauuucucuacauacuuaaaaguaaacuaacuaguauaauuugugauguuaggaaaacguuuuauagauacaacuuuuuaacugacauuuaguacuauagcuuuucucauauuuauuaucuuaaaguugacauaauuuuucuauugauguuuguacuugugcuuucagaagaaacuaaaacaagcaauggagauggacccgagagcacugugucugcagaucccguggugaaaugauggugugcagucgucagacguaucaugaugcuuuuccagagacauggaugcuauggcgugcuugauaaguugucauuucccaggucacaccuaaggagacuguacggacugcucuggcucuggagucaaguccacuuuauuucugaugcuccagcuuucaagggccgagaagcaaacgguaagacuggaucuuuggaguguaggcugaaggcgccccugugaaacugccaugaagcuggcgaagggcaaguccagaucccuaacccaucgccucccuucccuguacucuguguguguuuguaauuugucugugucuuugauucauguugaucucaagucaugggaaagucagugcauaugcgguacacagccaguaaauaacgcaguuaaaaagaguugagccugaaagucaugaagcaucuguaucagagacugugugaggaugcuagacaugagcagacuguuacugccugugcacagcguggccagcuggugauccuuccuguguuguuggauuccacgugacucacaugagcugcugaugucuuuggugagacauuuuauaauaguuuacauugcuuugggaacauuuauccuccaacaauugcuuuaaauuuaagauuuaauacucaaagaaaacucagauuaagccauagacgggacccacuugacauuucacuagguuugaaggcacucugugauacuagggaagaaaagaaugaacuaucuacagccaaacucagguuucuucauuacuuuaaauugaaaucuugguggcaguuuagacagaauuuuacuuuaaaucaaguauaaucuaagauauaagauuaaauaauaacugcacuaugacagguguucagaaauauaccacugugagaaugaaacuaguuaagucacuuacugauuuuaaaagaaugaaagacuuugagcaaauuuaguucccaacaagcuacuagcuuuauuuuuguaaagguaugcuagcugauaguuaaauggauuaaucauggccuuuuuugaacguauacuaaaaugaugccuuugggauggaaaggaagguuuagaacuuuaaauauaauacagaccuuuuuugggaauugcuuguuuuuuauugcauuuaccugcuuaaccauuucuuuggauacaucuugcauguaauccuaacacuuagaauucugacauucuuccuugguucccgcuuuuggaguggagauacagugcccaaccuagacucagugguugcggucagggcaacugucucagcccaagcuaaauacuuugacuguuaagucagaagaaacagaauagauuggaaaugguuuuuauuauauaaacauggcuuauagaauuaugaacaaagaauggauuaaaggcauuuaauguuuguaauugauacuaacuguagagauggcccuaaagcaugcugcauaauuaauaauuuauauuuucauuauuauaaauguuuauauuaaugauacuggauuugauuauaucaaauuagucaccauuuuauaguaccaauauuucugucuuuuucuuaaaaauguucuuuaauuauuccugaacaugagaguucacauauuccuuggacacuuaaaaugggaagugacagguaacuguuuuaacuuuaguuaaaaauaaugucacuggggcuggugagauggcucaguggguaagagcacccgacugcucuuccgaagguccagaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaauaaugucacuguagucuggauaaauuauaauaaguucauguauuugaaauaaagucucugaugagagaaauauuuaaaugguauuaaacugcugagcaacagggcuucaguauguucacaccuggguuacuguauacguuggaugaugguuuucuuuugcuaacaauauuuuuucagaaauauuguaauuuaaauauuaacaugaguguuuuguuguaaauucacagaaaacuuaaugauguucaaauucucaggaauuaagaacuaaccauaacauugucaguucugauuaaauuuuguaaaagacagcaaguuuguuaucucacuugagugggguucuccuuucccuuggcucaaauagaauacaauacguauaauaaagcauuaauaaauauaauuucaaaacugu

SEQ ID NO: 5668 - RNA, 3531 nt, Mus musculus
ugagacaggguuucucuguauagcccuggcuguccuggaacucacucuguaacuucugccacagugacgaauaagcguguucucaagugaucauuugcaagucggguuuccacucgcucacagagccaaguuagaaaggucaugaucuuagguaacuugaacuucaccuauccauacagaccaauaacaacucacgugaguuguacugcaggcagauuggagccuuugcuagaugguuagauucaaauccugacuuaaacugucauugauugguaacaugcaaugaagccaaccuuuguugauauuuuucaacagugaagcagggaucccaguaacacacacacacacacacacacacacacacacacacacacacgucuucggaaccaagcucuuucaaggaaggaaacauagaacgcuuucaaguugcuuugaaaacagccauguaguaaaggcccagugaggaaccuugugccacuauaacuugugagauggcguggaugcuucugaguacagauguuacaacaucugugcaggaugcagcacagagccagaagcuaucaggcaguaggaucaagcugcuaauaauuccucagaacucugguaggagccuggagagaagcacgguaaacccgacaguauuagccacugucuauagaguaugcauuccauacaagacccacagcagcuuugugggacacacugcuaccgcuggcagugacaugcaguuguucccaucacuacugacaggccagagaagugacacaaggagaggcggaaguaacagcuccagacagucauuguuaauuuugggacagaacaggaaccugguuugugugacucuagaacucgagcucugaagcaaggagccugggcucugcuggggcugcagacgccacagccaccuuuucaaagcuagaggagguaauuucucuguauaaaaauaaccacauaugggcuggcaauggcucggcagaugaaggcccaacggucaaaguuugauucccuggguaccacaugguggagggagagaggugaccucuccaaguuacccuuuuaucuccacauaccuguauguauguacacacauacauucccagaacaaauacacguaacuaaaaaacccacacauguagucacauaaauguuuugcguuccaguuaucaaugcugcaggaacucaggcugagcaggaguucccaggguuuggacaugacagugugccacacaccguguuugggucuugccuccuucccauuuaaggagggguagccuggcaucagcagagggggacagguagggauuaagucuccgugcugcuguuacuccguacaagcuaagcaauguuaggccacgcucuaagccuuucugauaugcuagccccaacggaaaacagagaucacagcagcuaccuuccauagcagcacuugcuguuguaaaaugguuaacagcauacgguagguucucuccauccaacacauagggacgaagacccugcacuugagagugacccugcccgaacaggucauccgccaaaucaaacaucuaucaucuuccuggcugaacacaucaaaagaauauuugcccaggcugcuuuuccaguccaaucuuccugggggacuuucuuguucccuuuacagggagucucagccugagcccacugugcacugcuugucaagaugaggacaugggacaaggcacuuuacucuguaacuaaguucccagguggaagacacagugauugugguaccugcauggaaucuuucaaccgaggcaaguuauauagccagauaugacccugaagggggcagugggguaauaguuuccuaccacaugcugggggagggaagggaccagaacacuuggcauuuuaauuacuaauguagagacaaucuauuuaccugaaauccaaaccaaaaacuaaaaccaauuagacccacuaaugcauauuugaagaacaaaugaaagucuuaagagauuaagucauccaaccaauccggugggggugggagcucucccugcaggccaccaacuugucucucaaucuacaugcagggaugucuacagaccauuuaaaagcugccuacaguuucaggauggggaauggggagggggaggggaaggagagggugucccugaaagggcuaguggaacgaauagacuggggcauggucuuugcguuuuuuugucuuaugugagugcuuuuaagguaggcagggaccggccgaggguuucaggcaucaguaagauaaguaaauaaaguuuggagauaagaccauuaucaaguccagaacugagcggaggagugagggccgacaauggguguguuucaggccaugacucugacaacaggggugggggcgaggggcgucucgagaagacaggcuguugcuagaguccaguguaaggugagaaguagacaagagugaagucagaaggaauuuggagggcgggaggaaccugagggcugcagaaggaagugccaguacuuggagacuacaccagaugcucuuccuggucggucuucccacccuaguguggaacaauguaauuuaugugaaauuacuuuaaaaaauuucucaagauaccuuuaauuuuuucaugucuuauuuuuccucccuucaucucaggagaaccagggcagccuugcugggaggccuuccugccugaccuucaccugguggggugagaucuggccguuuuagucaaaggaaaauucccaucgccugagggggucaagaggccugcaaguggccucuggcuuggacaaggaacugcucagcaggccaaggccuaggcuuaucucagagccuugguuugucggaaaggggucuuuccaauggcgcugggcagcucaggggacccagcuccauccaggcccccacuucccuccucuuagguguuggucccuguuggacucccgaacuuuaccgggagaucggagcccuggagaagggccggguuccuccuucgagccucccuucguuccugacuccgccuuucucccugagagagccgggguuccgaagcaucccucucggggacuuuccaggcuccgcgguugcuccaggagggcccugcccugaccgugccggagcugggggccugcagggccucggcggcuggaggggacugugacucaccgccgguaacccaacaccgcugggccuccuuucaacccagccucccccugcuccagcgagccuggcggccuccgccacaccauaacaaacaugaagaaggguggcccaggaggcuacagccccgggccacagagcgugagccuggcucugugcguugucgccucugcggccucggggaccugcgaccuuuauccgaggccgaucggcccaagcuagcugcggacggcccgcaguaguuccggagggugagugcgggacgcucggggaggggacaagagcacugacgauccccaaccccuccaccucgacccacccgggaccuugcguccccacccggcgaggacaaagcagccgggccgccgccccggccugcgccgcgccgcacaaag

SEQ ID NO: 5669 - RNA, 755 nt, Mus musculus
ggacagacuccccuacagauguuaguucccucuccaaauuugcugucaagauccuaacccccaaggugacagcauuaggaggcagacucuuggggaggccauuaagugcagugaaaugcugugaccuuacagaggaaguccaucuccuauccaccacgugaagucacagcaggaagcuuccuucuacggaccaugaccagacacuaaaucugucaacacuuuaucuuggguuucucagccuccagacuugagaaauaaauuucugccaugugcaugcauccugggauaugcuguucuguuccagaagcucaugugggcuaaggcaaugcccaaggcuaccaugccugagaaacagaccugggacaaggguuuggaaggaagucacuuauuugcuuguugaucccaggaacacugaaaagggaguucaagaaaaccaaacaagggaagaaggcacccugggaagguucucaaccgucugccucucaguggacaggggacuccaucucaccagggacaacagagaauaugccccugaguuccccagcuccagcaaugcaaagaggcuucugcaauuauccucagcuauugguugauacugucccuggguacugacacccaacagucaaccugcagugucucucuccaugauucaagucuuaggaugacuccgaauagacuaaaggugaggagcugacaauacuugcugcaaacagaaugaggugucugugauccugaauaaauguaaacauguauca

SEQ ID NO: 5670 - RNA, 5228 nt, Mus musculus
ugguuuuagucaucaaaugucuuucagggaacaauuuguauuacaauuucccucaucaaagugcuaauuuaaucucuucccucacugggcuguaacucacauaggaguacugcaauggguaaaaggcccuagagaccuagaaaaugggcuguccccggugacuucccgugaggucugcgccauucccauucuggaguggcaacccaggagauggaugucuuggggggaacguggcagauuuccucucuguggaucacuucuuaaaaccuccucugcugcagaagcaccagccccugguggggucucaguuuggucucagcugcuuagcaucuucuucagaugucuggaucugguccugcugccacaacaccgugacagcgaugccuggaaaguccaucuuuuguuuucuccggaucucauuuuccucaucugcaaaagauaacacaguucagaccaguggcucucccacuguaaacauggguuggugccaccaggaaaccacguuaacagagaugacagagccugagagauggcucugucaguaaacagcuugcugcccaugcaugaggaccuggaccccagaaccugcauuaaaaaaaaaaaaaaagcuggguguggcagcaugugccugucccugagccucaacuagccaaucagacuacuacccaaaucuuugagcuccagguuaaugagagauccugugagaggaauugaggacgccgggcaucaacuuuuagucucuagaacaucugcacauguaccuguucaugcaugugaacacacacacacacacacacgugcucacauacacacacacacacacacacacacacacacacacacacgugcucucucucucacacacacacacacacauacacacacacacgugcucacacacacgcgcgcgcucacacacacacacgugcucucucucucacacacacaugugcucacacacacgugcucacacccacacaccacacaauucuggucuuguagguuuguaugugauagaggugcagagggcugagaauaauauaucuccauuucuuucguuucuuuucuuuucuuucuuuuuuuuaauuggcuauuuuauuuauuuuuauuucaaauguuaucccucuucccgguuuccccucugcaaaccccaaucccauccccucuccucccugcuucuaugaaggugcucucccaucuacccaccacuccugccuuacugcccuagcauucuccuauguuggggcaucaagucuccacaggaccuagggccucccuucccauugaugcucgacaaggccauccucugcugcauaugcagcuggagccauggguccccucauguguacucuuugguuggugguuuagucccugggagcuuugcugggucugguugguugauguuguucuuccuauggaguugcaaaccccuucagcuccuucaguucuuccccucacaucugaggaugcagcuauaccacuccugggcauauacccaaaagaugcuccaacauauaacaaggacacaugcuccacuauguucauaucagccuuauuuauaauagccagagcuguaaacaauccaaaugucucucaacagaggaauggauacagaaagugugguacauuuacacaauggaguacuacucagcuauuuaaaaaaaaaaaaacgacuucaugaaauucccaggcaaauggauggaacuagaaaauaucagccugagugagguaacccagucacaaaagaacacacaugguauguacucaccgauaaguggauauuaggaaaaaagcucggaauacccacaauacaacucauggaucacaugaagcucaagaagagggaagaccaaaguguggaugcuucaguccuacuuagaaaggggaacaaaauaaucaugggagguagagggagagaggauccugagagggagagggaggggaaggggaaaagggggacaggaucagguguggaggggacagggguggggggacauacagagggucaggaaauugaaugaggugaguggcaguuggggauggggaacuggggguagccacaagaaagucccagaugccaggaaagcaagaggcucccagaaccuaacgggguugacauuagcugaaauacccaacaaaggggcgagagaacccguagagaccauaugcagagguuagguacggcccccaauugaggaauggggccacccacccaucucaaaaaauuuaaaccagaauuguuucuggcuaaagaaaaugcaggaacaaagaguggagcagagacugaaggaaaggccauccagaggcugccccaccuggggauccaucccacaugcagacaccaaacccagacacuauugcugaugccaagaaguucuuguuagcaggagccugguauggcuguccccugagaggcucugccagagccugaccaauacagaugcggaugcucgcagaucuccauuuccagucggucucugucauuguucuauugauggcuuggggcucucaguuugcgaagcacuggaccggauaauuucuaaguuacaaauccaagggcaaaauuauacuuguauggcgcuaggcauuuauuuccaccuauggggaacaaauauggaaggagguagcuauagguuaaaagauauaagauauauauauaagccccaacucaguaauuuuuacaagaauuaugaugagcaaauacacuaagccagcauacauggugcaacgucauuuccuguucuuuuuagagauuuauuuauauuuuuaaaucuuauguaugcgaaucauuugccugcauacguuuauauagaucauaugggcggcuggugccaguggaagucaagagaaggaaggcuuuggauagccgggaucuggagucauggauggcugugagcugccgcgcccaugcuaggaauggaaccuggguccucagcaagagcaacacuugcucuuaccugcugagucaucucuccagccccccaccccuuuuuuuauguguaugugucuguaucguuugauaucugcauaguauuccuccccacaacucugugcaggccaggcuucuaaagacgaugaucagguuuuccacugauacccagaggcccuucuuccauucaccucacuuguuagcagauccaaguucucaucccccauuucuaaauggaggaucaggaauccucacaacaguuaagccaaagcucaggaguuccaagauucccaccucuuuccuucccgugcuggguaguuuuauauccacuggacacaagcuacagucaucagaaaggagggagccucguuugaaaaaaaugcuuccauaagaucagacuguaggcaaaucuguagggcauuuucuuagugauugaugggguggggcagcucauugugggugguugccacaccaccuccaguaggagcugugugacagaccaaggugaucaaccucaaaaggaggaggccuccuggaaccgguuguggaacucuucgccggagaaaaaaauauugagccguaguucuuaugacaaucuaucuguuuuguuuucucuuauuccuuuucuuauuuacacguuccuggcagccuaggccaagaucuuaagugagaauaauggguaagaaaccaucccuagagaugggggucacuaacaugaccuuauccccagggaaaccaacgcuuuacuuucuaaaucauuuacaaagcuauuaugauagauaaaaacuuucccaacaauaaaaucucauauggauacaugugugucaucagagauggauuuugguauaugguaaagaaagccuuaauuagaaagaauuacaauaguuuaaauuuauacauugaagauuuauaaaaaaaucaggcacuggauauuaaauaauaauugaccauggggcuggaaaguuaguucagugguuaagggcacugaccguuaaagauuuauuaaccugcuccuggaaauaugccacaagccuuggaugacagcgcccacugaauacauccuuuuagaauuguuauauuuugaugauuuauaaugauguuaccuguuuuguuugugguucacuaaauacauaguuucagaguuguaaugcuuggauaacuuuugugcuuuacugugccaaaugauuuuuuuuugguaucugugauuguuucauuggauauaguuucuaagagauguaauguuugguuuuuuaauauauaaaauccccugcuugggagcugcaaaauacacucagauucaaacugccucuauguuucuguuugucacugccaaacucuuacccaccuagcuuugaggacccucauuccagggaccccauacccaaauggggugguccauggcaggugguaccauuccuggccugguagcccuggguucuauaagaaagcagguugaccuggaacucacucuguagaccaggcuggccucgaacucagaaauccaccugccucugccucccaagugcugggauuaaaggcaugcgccaccacugcccagccaagacuacacagagaaacccugucucaaaaaagaaaaagaaaaagaaaaagaaaaagaaaagaaagaaaggaagaaaaaaagaaaagaaagcaggcugagcaagccauacagagcaagccaguaagcaggaccccuccacggccccugcaucagcuccugccuccagguuccugcccugucugaguuccugcccucacugcuuuugacgauguacaguugauacagaacugugauugaaauaaauccuuuucuucccauuugcuuuuugaccgugguguuuuaucauagcaaugcucacccuaacuaggacacucucccuuuccacaucacgggggauaaagccuuaacacaccaccacccucucuucccagccuccucuuuacccccauaacuggggaucggaggcuaaucaccagcagccugguucauggcucaugauacugcggaacaccacucugcugcacaugaaggagacagacagcaagacagauggaguccugccuucacuguaauccugguccaguggggaaacaggaaauggccggaagaaaugaagacagguguuugugccucacugcccuuccugucucuggcuugucuuuggggacucccccauagaucacaagcacagccuuucccaagugucugucugucugucuguguccccuucccacuauaucuuccaugccuaccucuggcuggcuccugccaucagcuccuggggaucucaugaggcug

SEQ ID NO: 5671 - RNA, 7772 nt, Mus musculus
agaacccacugacugaaggucauaacaaagcucaaguguuuauuaagaauuaaaaauacuguaaagaagccauacaguucauuucacaguaaacuaacaaaucuugguuuucuuuucagcuuuuucuguuuuuuuuuucuuuccuuuuuuuuggggggaggggagagggaguggaagggcaaggcagccaucaaaaacaauacaucucaaagggcaaggguacauggagaacaauuacagaaacgcagcccacgugauccucacugacagaugggggccgggcgaggcgaagggaggccucuccagagacgcugugauaaaacaaaaagaccuggcccacaucucucgggaagaugcccaaauccucuguggaaaauacagcucucacaucagaacccaaagaacacccccuccaaacgcacauggugaccccuccuagccugaugacacaggugggucaccaggaccagaagugcacugggccuucaggaccuacugaauuugcauaguuaccguuugauuggauuagggaauggagagagaccacgccucugagagugacucucaggcagguuggggguggaugugggguccucuuucgcccauucagagcugaccucuaggaguuuuuaccaguucuaaauggaagacaagaaugagacagcuucuaaaaacccuggccaggaguauaaaaaaacaaaaaacaaaaacaaaaacaacaaaccaauaaaauuaauuuuccuuaaaaaauuuuuuaaaaagugccccccaccuguccuuuguuguuuuucuauuuuacuauaaauuugacugccugacaggaucuuuuuuuagguuaaucugcuuccugauaauccccaguuaaagccacugucaucuuucuaacaggagacacauccuuuucugcacagggcuggcugggccuucaggaagccaaaccaaaagcagaaacaggacuuaagaaaccaaaggugugugguaauaacugcaaauaaauuaacugggcacagaaaaccagggcgguguccagucgguaucugcuacuuuccauggggugggggaggggcgagaaggugaugagagggcaccugggagaaaacaaugggauuuuuuuuguuuuguuuuuuuuguuuguuugguuuuggucguaagaaacugugcccacacacgcaguucacuuagaucuuuucauggaucuucucaacuuucagaaacaaccuauccaggucguuccgcaggucauccagcaagcccuuggcugacucuaaguuauucucauucguuucgauuuugacggaauaggccaccaaacuguccacggcaguccugagcauuuucaagucugacuccacuuggcucacugaggauuucagguugucuagagaggacagucuguccaggaaguccugaggaggcaagcccucggccugggcuugguccuggcugagcagugagagcacuugcuccugcagugacuccacgguaccgggcagcucacccaggcucugcuucagcuccuucaagucgcuggacagcgccagcugggucucccccaggcuccugacugugcuggccaggucagaugaggagcccagguuucccacgugcuccugcagcauagccaggcguugcucguacuccuggcucuuggacaggagcgacuccaggcuuucgguguggcgugcagaagccaccugcauugaguagaccccguccucuacauacuggagccuggcacccaggcccucaaucugccucugcaguuccucuaaggcuuuggagucuuugaagacggcaccuuccucugacccaugggccccgaccuucagcugcuguagcucuuccuccagucuccggauguccucugggagacgagaggaggacuccucggaccgcagaagcuucuccgugagggccugcagagccaggcgcucugagucggccgccugcuugaacgccuguugcuccugcuugaggcucaccaguucccgcaccucuguguagacgucggacuccaucgucugaagggaacucuucagggccucaaugucccucucccucgacaucauggaggccuggaccuccuucacggcguccuucagaguuuucacguccugacugcgaucccccuuggauucuuccagggaggccaccuucaucuugaccucauugaucuccuucuggcuccucuucuggacaucagugaagauggcgauguugucauugauagacuugguaagcuccgucaggcgcuccucgacuguguucuccagggacgugaagucccgcucccgggcauccuucaccacguggaucccguccgacagaucuuugagaaucucauucugcaacuucuguagaacuucgcuaauucgguugagcucgcucuccccuuccuucacggcuuucucugugagauccuguuuaugcugggaguuucucaggagggacucgaaagucccaaauguggcuugcagggauuggaccuacgaccaaaauccagacguuagccacugagaacaaacagcuguguucgcuuacgcuagcuaccgcuauucucugcauggcccgucccaggagccuccagaucagcgcucuccuucuaaagguaguuuuacgugguggcugugaucaccaacugcacggccccuccagguacuccagagucggcucauuacccacaucagaccagucagcauaguccauaugcgacugucaacccucuccucuuagcaaaccgacaagccaugaacagaugagugccaggcaggcugacaggguggccaacgccuuuucccacugagauugcuggcuacaggaugagggaggccuagagcugcucagaccagcacgugaccagaaacccauucaucaaucaagacagcacacggaaacaggcaagaugacauucugaagauguaacucaaucccugaauacagcuguuucugagggaguuuacucuugaacuguugggccaaucagaacagucuauacucucuuccuucccucccucccuccuucugcuauuuugggcuggcuuucuagcacuugcagcugagcaucacaaauuuucuuaggaaauagccugagacacauggagacacuaggcacaacgcuaagagauuaagucgaggucgguaucuaucacuuccaggugugcggucucuggccagccacuguccgacuucaguguccucauuuaaaaaugcgagcagugggccaggugauuucuugggacacucuggccuuugagaacacacugugauuuuguugcuacccauucauucggcauaaacgccacucucaacuagcccagcaacuccaaucacgcugggcuggcacacugacgcagaagcccugcuggucaggaaccuaggucuuaggugugacaccuguaaugucuggugacaaaauaguaauaguaauaauaauaauaauaauaauaauaauaauaauaauaauaaugaaagaagaguaagcaucccggcaguguagccuugauucuguaagucccuagguucaacuaacuauuucuggacuauguaagagacacccgcuaagacaccaugagguuguuaccagcuaaagccaguguggagcgcucugugcgauaaaugauguuuuuaacagucaacaauuaaacguauuucaaagagggaggaagacugccauucuagguuaaacuaaguuugaaaguuuuccagggguggagagaugccuacgugguuaagagaacugacugcucuuccagaagucccagguucgauucccagcaaucacauggcugugacucuaguuccuuaggaccugauguccuccuuugacuuccucagguaccaagcaugcaugcaggcauaacacccaaacacauaaaauaaaaagaaaucucugugugugugugggggggguguuccucuccauuuaaacaagagaugaaauagguugcuugccuggcauucacaagaccuagguuagagggccaagcacuuaauaaaucgggucugguggcacacuccuguaaccucagcacucaggagggagaaguagaaagaucagacguucaaaucauccuaggcuacaucugaggcuggucugggcuacauggaaugcuaucuuacaaaacaaaacaaaacaccaacaaauuaaacaauaaggcucugaagccaagcuggguaggcaaaucuuagcucaaugcuucacugcuguuugcuccuggacgcguuacauacugucuguauguaacuuguuuccuuugccacaaggugugacaaaaauaguaccugacucaccgauagucaccgugagaacugaaugagucuaaacaaguaaagugccuaacugugccuaacccucgcuggccgcuccacgcaguagcuacugucuucaccaggcuaagcucuguccugaguuccucagaggcucacggacuccuagcaacaucuuccacucaaugccaaaggagaaacagaacagggaugcacacaggauacccuggcugcagcgcaugcccaccgacugcuccaggaacucaaaaucacguucacuucccaagucccagguuggauccgacgacuccccuccccagccaaauacaaccugagucauaaaagaauacgccgagaaggcacuagagagaggugaccucuaaaacuggguuaguaaaucacaaugccuuccuguucuaagcacagcacugaaaauagaagcaugggggugagcccagagccugcaacauggcaggcuaccuucaguguuuucucaauggaccaaagaauggaggaauucagagcacugccugauaaagccugggcaggccgagcuccuauuuaaucccagguuggcacuucacaaauggcuaggaaguuaaucagaucagaaacuauuaccagucccccaaggaacccagugucuccccuucugaggucauggggugugugugugugugcuucuuuaugcacaaagugcucauaacaguuaaaauguacuggauggaugucuguccuuuugacaugugggggaugucugcuguguggugcgugaaugccagcgacggaauaauggcugcaacuccaucccugccuuuguggagccuucugggguaacaguggacaggccggugcuacuacuaauggcugacagucaacggggcugucgcaggcauacagaggccagacacugacugcucucccuguucacuuguuuguguguuuguuuguuucuuugacacaaggucucuuacuggagcuggaguaccccgauuuggcuggacaggccggcuggcaaacuccagagauaccuccugucugugccuccccaacaaugggauuccaaguguggacuuuuacacaggcccgagaaaucugaacccauguucuuaugcuuucacaguaagcacuuuaccagcugggcuauccccaaucccaguucuuacaaaccuugauggcgccuuccucuugccuggagaaugagaaacaggcucaaagaggaaagcgauuugcauacagcugugaaugggaagggguaaaaccaacaaagagaccaaaaggcaacauaggaacuaacacccauguucuucaaccuggaucuaaccacuuugggcucaagcuuccaacuuccccuguauucugucacuggaaggcuagcuaccuucuguccuucagguauagucgagauuguccccuuaccuguauggggucaugccaucuccugauacuucuaaugaccagcccugucccacauacaaacccacaagcccuuucuucucaaagugugcauaaguuccccaccccugaaaccuacuuaggaugccacuucacaagcuugaucugcgccuuuuccuccuccauauccuccacagggcucacgcacagccauacaacuaucaggcuucaauaaauauuaugacugauuaggaagagaggaaacgggcuagcgaucagacucccgcggggugucuguguucuuaggauggucugacauucagcaggcagagcagaaucgcccacuucauuuccccagcuaagucaccucccuuggccuacaccacuucacaggcugacucacuccaguugcucuuccagucuugagaggaaauuccuaguggugcacacucaacaaaaaaguagggacuuggcagggcaagcggcaugcugggaaaggaggccgugguuccgggcucagaaauggcgggauuuuuuguuuccguccagcaagugcguuucauugagcaaggauguggguggagaggauggagaaggcacuagagggaagggggcuacacuugggcuggaaggguagaaacugagcaguuugccaugagaguugucuggucauuccugaaacagcucgcuggggaauccuuccucacgaauggcccacacuuucuuccacaaucugcgacucaagccagcuguggucugugucaacucacuuugugucucuuaaaccucaauauucgggucuggaaaauggagucaaauuugucagcccucucuuccucccucuaguuaacucuuugagugaggaaauaaaauacaugaauacgcugucuacacaccacauaagugugaucuaauacuucuggccuguguuuccccuaaagcuggaguaggcgacuucaaaggcccacaugggcuccuugguccagcuaaggacaagggaccuaaagauagacguuucaucugaacuuagcaaaugacuaagcucacuagcuucccccacccccacccccaaaacucuaggucuauuaaaaacuggcucgggugacuccuacuggcauagccaaggugaagucuugacuagaggcuuccggggaugcgaugauuucccuuccaggcuccuguucgggcaacucuguccauucaacgguuccuaaugcaaaaagaaugggcuacguagagccugccggcuuccuuacaggucaccgcuaauguccugugacaggcccuuggcccauccucccccaauggucuggccauccucagaguccgcuccaucccucucugagaccauuaacaaagcgggucugggaccgcccuggcgacuagggcgcuggggucccagcucuugccacagggccugggcaggaaaggaccagggccccuucagggagggcaggaguagagucccgaccccgcaaaagcuggaguacccaccuucugcucgacgcccugcaagcccuggcccagcucaucccucugacgggagaaguccugguggccacgccggaccugcuggaccuccuccaggacgugauggacauaccagcccgagaaggcggccgccgccaccagggagagguagaagagaaaguugagcacccggccaagccugcgcgagcaggacgcggaggacgcguuggcgguggcggcugaggaccggccgcgguggccgccccggugcgccugguucugcgggugcugcggcgggugcggcgcgggaggcugcggcugcugcggcgccgccggcggcuucuucgccacgucauccgcgccgcccgacgggugggcgcccuuguccgaggggcucgcggcgccguggccgcccuuggagccccuuuguuuggccgagggcauggcggcggcggcggcucggcgggaugggcgagcggggcgcgcggcccgggacgcuggcuccggcucccacggggacugcgcgggcggcacgcgggcgcagcggcgucggagcggccgggaacguggggcgacgaggaaggaggccggccgcggaaggaggagggggccuggcuccgccgccgccgcggcgccgaccc

SEQ ID NO: 5672 - RNA, 5924 nt, Mus musculus
cagcacuauugaagagagcaagucaggggagacauuccagcucaauuccagcucgguuucaucaugcuuacaacuaccaggugugguguuuucugcaauaggaucuuguuguggacauucuuauuuauggcugaaugauauuuuguugugaacauagaucacauuuucuuuaucuauuaaagggcccuuagggucacuuagugucuuagcuauuaugaauacugucaugauuaaacaugggcauguagacaucuuguugauacucuguuuuaguugucuuuggauauauacucaaaagugggaaagcuaggucauauaaagaucaagauuuuagggaaccacaaugggagcuggagagauggcucagcgguuaagagcacugacugcucuuccagagguccugaguucaauucccagcaaccacguggugguucacaaccaucuguaaugggaucugaugcccucgucuggugugucugaagacagcuauaguggacucacauacauaaaauaaauaauaauuuuuaaaaaucuuaaaaauuaagaaucacaauggacauucauucuauauguuucucuaccuucucucuuuugaugcuuaccaccuuuuugguuuuuguuuuugguagucauucugagaggagauagaaucucauuguggcuuguauuugcauuucucugggcuaaagaugguaaguauuuuuuucuauuaguuccagacuuguauuucuucuuuugaaaaguaucuguucagauaauuugcuuauuuagaaacaguguuaccuagauuuuguuaucagguugaaaauugugauuuuuuuuuuuaagugaaagguuugggaaccgugcaucuuccaaggcaggucuaccagugccauuucccguaaagcaguuuaccagagccauuucccauaaggcauguucucauuuaauuuuguguuacaauuugguuauucucauaauauuucaaaauuuucaucaauauuagcguguuauggggcucugugauuagagucuuugaagauaauauugugaaugucaaaauaccaacacugacaggagcucagaagacugcagacaguaucauaggauguaggcucggcuaaaacagagcccgagagaauacugaaagcaguuucagccuggguaacauucaaugagcuagccaacccuaacccugugguggucugaauagguuugcugccuccccccaccccccucuagacucaugucuuugaaugcuuggcucacagggaguggcacuauuaggagguguggccuuguuagaggaagugugucacugggcuuugagguuggcuaugcucaagcucugcccaguguggaaaucagagccucuuccuggcugccuguggaagagucuccuguugcugccuuuggaucaagauguagaacucuuggcuccuccagcauggugucugccuggacccugccaugcuuccugcgguuaugauaagggacugaaugucugaaacuguaagccaguccuaaugaaauauuuaagaguugccuuggucauggugccucuucacugcaugaaacccuaacaaagacagcaacauugccugcugcagaagugucuguugugaaaaggaagagucuccaugacguccuacaaggcuggcuguaaacuaugggucuaaaugaaccuuccuucaugaaacugcuguugccagacauucuaucacagcaacaggaucccacuggcaaguuauuugaagaaauuaacacagcuacuucaaccuucaucaaccaccacccugauaagacaguagccauccacacugugucaagauccccaccaacacagaaggcucuggugauucauagugauuaucuuacuugcuuaaacuguuaggcacuguaugauuacacacuugaugggcuauggcaugguguaaacauacauuguguggacacugaagacccaguaaaucuuuacuaauuuauuuauuuuuaaauuuuauaugaauguuuugcccacauguauaacauaagccggguacaugucuggugugaauagaggucagaagaugauguuggacuccuggaacuguaguuacauaugguugugaaccccgaugugggugcugggaauuuaauccagguccuuagcaagagcaacaaaugcucuaaaccacugaacccucaaacccaguaacugucgauuuagugugaaaagcucuuuauugcuuuugucuguaaccuccgagauaugucugugugagcccugcaugugagaggaggggcagacaacacagaacaguauaaaaguccacaaguguagcagauaccgcacaaggguucagagacaagugacgaaguuccccaaaaugagauaagcauugagaggugggucuacuacucaaauguuuauuuucuuucaauauguaaacuuuuugaagauuuauuuauuuuauguauaugaauacugucacucucuucagacacaccagaagagggcaucggauccauuacagaugguugugagccaccaugugguugcagggaauugaacucaagaccucuggaagagcagccagugcccuuagcugccgagccaccucuccagcccccucuauuaaucuguaauucuuuauauguacaauuuuauauaaauuauuuaucuaauuucuuuucuuauugggaaaauuggaaugaaagggggcuuuggcucuaaaaucagaaagaccaggguuccaaucuuguuuccucuccauguaucagcugugugacuuugggcaggugacucaagcucucugaguguccuagggguaacuggagcuaaaggaggcaugcgucuuaaaggguuccaggaauuucaacugaaaugauuggugaaagugccuaccacaagccugguauagagaaugcuuaauaaaucauauccauucuuauuuaaguuuauuaacugcaacuuagaaaauacagagaaaagcagacauaaaauucacccuuugugugguuuucuuuaccacacaaagaaaaccucggugggcauucggcauaucguuccaguuucuagccaagguguggcuuaguuugcuuuggccuuuuuguacuaugcagcauuuuuaauacaaaauuaaaaucuaaugcuuuauuacauuuuacucacuuagcgauuuacaggggggagacggggacacgugucaggcugugcgcguggcggcuggggacagcugucaggaguugucaguucucuuucucccaccuugucaguccgagaauagaauggagauugucaggcuugguggugagugccuuuaucugcugagccaucuugcaagucccuaagucuaaguuuccgguuggguaacacaggcggguuucccuuuuuuuuuuuuuuuuuuuuuuuuuuuuucucgagacaggguuucucuguguagcccuggcuguccugaaacucauucuguagacuaggcuggccuugaacucagaaaucugccugccucuuccucccaggugcugggauuaaaggcgugcgccaccacugcccggcacggguuuccccccucuuaugaccacugcaguguauugaaucugcuugcggauuuaaauuaaauccacuccgucaugucaucccuucacguuagacuuuuguaggaguucuaguuguuuauuccuauuauaaacagcucagcaauaaacaagucugguugcaaaccuuuuauuuuuuauuuuucuuuagaaaugaaaacauagacgucgucaucaugaauaguccuccugauccugauugucaccgaaaauaauucccaagacagcugaagaggccuucggguucaggcuccgcccauccauccaucugccccacccuucauucuugcuucguuccaaagaagagaaggaagaagagagaagggauugagcagaggccugggcacgcauggguccccucuggcagugggcagagucacagggcggaagcaaguugucuuucuuccugcccagcuucaaaugcagccggagagaggagcuagcugggaacuugaacaucugcagaaagccuggauacuuccuucugucuuucuucuccccuguggcagucagggcagggcuuccucuuugccugugccugagcuucuggauggggucagaggcaagugugccuuuuucugagcucugucucgcccaguguagacaaacagacacauguacacauguacacacacacacacacacacacacacacacacacacacacacacacacgacugucuuucccugcugaaaggcucccagacagagcuaugcaggggaggcugccccacagugucuagcuccaaguaggccucagaauuuuguuaggagaguggggcugaaaacccuuuaaucccaaaguugccuccaggaagcucuccuggagcaguaaacaggggcagugggaaaguccccggugagauuugugugggcucaguauugauggccgacagauccucacuucucuggauuauuagggacaaaauccaggcugggauuccuucaccaaagcugggagauguuugacaacugguuuaaguuauagcaacuggcuauucagaaaggaaggaaggaaggaaggaaggaaggaaggaagggagggagggaggaaggaaggaaggaaggcggagaggaaggaaggaggaaggaaggaaggaaggcggagaggaaggaaggaggaagggaggaaggaaggaaggaaggaaggaaggaaggaaggaaggaaaauaucugauuuacaguguuuucagauuccuaguuuaaauccaccuuggcugguuucagaggcagcagacgguuuacacaguuucugaccaaagguuagccacaggcucuugcaaagcagaggaggcccacccuggccaauugaaggcagcacacugaaggcugauucucucacuuggucaccgugugggagaagaaggauguagaaaugaccucacugagguugagaacucgggaaagcacagccuguaggcuucucucugcaaaccaaccccucgucaccauggauucccucucuaguccagacaugacagcuuuuggaguuaccuccacacugagucauagguagagacaaagaagccacagcccuugcuugaaacauccuggaaagguuaaccaguccuucuuuugucgcaggcugaggacugaaggcugcccaguggugguggugacaaagucagcacuucccuuuguuagccuuuggaugcugugacaaagccccagagaccugacuuggaggagcaaggucaagguuggcuagauccguugcuuuuagguaugggaugaugcuaaacaucaggacaccuggaccaucugguagaggaugcugcugccguugugguagcuaggaaacaggaagacagaaggaagacaggaggcaagagcaugcucucugugaucgucuucuccaagcagucugcaucucugagcuccuaacaccucccccuagugcuguugaaugauggguauauccaugcaaccacugauuaggucagggccuccauggcuugcucaucucucaacagugucaccagcuagggucugcuccuucaauacugggaccuuucagagagcauacauagugaccaucuuaauaccaccaaaacuuugcucucauuccuucuugucuccagagugcuugaaccaaagaggcaucaaggagucauuuccuguuacauagaagggcaucauauuuccucaggauuuuucuuuacccucagcuaguuuuguaggcaaagauaauagcccucuguuucauugagugcuucgauuucuuuuuauaucauaaguagguugcugacacacuauguguugacuaaucauaucuuuucuuuugugaauuacauucauggcuuuagcucacuuuggaguuuuaaguuagauuuuaaugucuucaauaaaaaauauacucaucugca

SEQ ID NO: 5673 - RNA, 101069 nt, Mus musculus
aauuguaguguagaagcgguaggcucgcagaugggcggggaacagcccgccaguucucguccgcuaugggggaaugauucauagaguguuaggagagacaguucugcucguggaagcccgcugcgaagcccaacucuuccccaaggcuggcagaccuaggggaguaggcagggccugggccugacucagucucugguggcuccucaggccuccaccaagccccgggccuugucaggggaggccuccgggcgccgguugcugggggagcggugacgucgcggggugaaaguugaggggcggugacguagggccugcccgggcggaggcuggcggguuggaggcuggagggagggagggaaggagggaaggaaggaagcugggaaggagcgagguagcgggggcgcgaggcguuuaccugggaggcagcggcuggggcgcgcacagcggcugcggcucccccgcaccugcggccauggaugaagagcgcgcccucuacaucguccgggccggcgaggcgggggcuaucgagcggguccugagggauuacagcgacaagguaaagaacucuggccccgggcguucgcugucuuguccccccuccccccgggccgccuucggggcuugcacuucgcauccuccccaucccccucauuccggggaugcgcauugcucucccccgaaaacguuuccggcuugggcaugcguguuugugcccccagccuuucccacucguucauccugcaucuacccauugccuccacuauaaugcccacuccgauuucuggcccagcagccuguccuguggucuucuuccuaaacgugcaaggcacacccccagaaucuguagaugcgcggcugcccagugccccguuccuggaugcauaaaaugcaugcgaggcuuucucaccuguauagugugaaaauacaugcuucucugcauaaacacggcccuugucaugcacaaaacauaucagcaacgauggcaggucuuuguguaccuguaccauuguaugguuuaccaggcauugaugucuuuuaugugaucuccuuugauauccuccaagugcuuauaaaguagaugguaucaaccuucccauuucauagaugaggaaaccgaggugcaaagaacugaaaucacgccccaaggucauggacauauguugcaaguggguagaaaauccaacuccuaauaauaccuguuauuuguaucgcauuaacagcuuuucuguucauuaucucauuuaaucuugacagcaauccugugagguauuaucuguguuuugcaauggagccuccagaugggcuaaguaacuagcccaaggucauuccugggagccagagccuucccaccuagguuuucaaacuauccauucacuggucuuuugcuacagugaucgguaucuuauuauuaauaccacuuucaucucuggaggagcucucucuccaaguaccauuagaucuuccuuuuccuuucagcaguuucucauguuugcuuuaauaaguagccuaccuaacaccuuuaggcuguuugggagacuuguaugacucucuucucugaagacccauccaucaccaaguuacaccauauaccuaacagguaccuuacuguuccuuuccccugccuauuuaucagcccucucugaaagaaacauggcuguaugccccuguggaccuucucuucugugccuacuacuccgcucucauauauuuuguaucagugaacugccuguaugcccauuucugcgcuuaguagaaaauaccuccagaagagacauacuucuuguuuuaaaagaaccuucauacccacuuaaucuucccagcaaucuagugaggacagugaggaggauauuccucauuucacagagaguaacacucaggauaauaaugucuucccaaagucacauacccaaugaaaaauaagacugagaguugagucuagcucuccaacucuaagucuagugccuuuuuuuugcugugauacauucuuagguagaaugcacggacuguacucuagucaugucuuagccccuucaccugauaggcuuuaguguugaucauaucugccuaauuuaggagaaacucauuuaaugcguagguguacauacugcguauauuguauuauuuuuaacuugauuuauuauugcuuuccagagaagauaugggggagcuucaagcugauuuacaaagagaaguauaauaguuuggcuauuguguugaaugaacuucuauuaacuguuaauguuuuuuuuagcacuuacuauaugccagcuagcuaacaaugauaggaaccuuuuuuccacaagccagggaggagggaaaaccuacacugggaucugaguccacucugcgcuccguuguagcugaacaaauuagguccccuuuuuauuuguuuccuccaauuuaucccuuccucucccuguuauuccuucagguugguuucuuaucacucauggcuacguccugucagagcuuggcuuccccuuuucauauuggaaauguuuucagcguucuuaggaucaucuucuguuguuaaggcaaugucuugaaaggcuucagaggauuccuagacaccuuuuuuuuuuuuuuuuuuuuuggccaagccaagccugagacugugccgacuugguguagcugggagcaguuucugugucaggagaaagcacucauguuuacuaucgguuauaguaggaaccgugcaguagggcuuggagcacaagagugcugggccucauguugcaaugcagcacugccccucaaagggagaaccggauggcaugacuaggaaggggcucuuugcguccguggucaggcaggaagaguagaaguaaacuguccagauucaugguguauggggucugaaaccccccaaaaguagauggauagcagcccuucagauuucuucucuggaaaaauggcuuugaagcauguaagaguaagcagugguuguagcucugaggagucaagcagaagaggaaugagcaguauggggagcccaguucauguuuggcagaggagccucuucaugcuaccuuuuuucuaauaagcugguccuugcaaggguaguagaaagaaggugggaucuggcauuaggugaaccuugguccuaagcucagcucugcugguaacagcuucgugacuauggauaaguuauguugagccucugagaccaguugccugucuguaaggagggauucagacaccauucuuuuuauuuauuguguggauuagauuaauugaagucgagugccaggcacuaggcacaccgucaugagguagugugcucagagccagacucuggaugcugauucuccauuuguauguggacaagcucauguugcuuagccuuugcuuuguauuccucugucagcugaggggaaaaguuacaucuauauccuaacgcuuuugucaggacugcgcgaguucuguguguaaaguaccuagagcaggaccugcugcugaagaaguagcccauggcuguuugcuuucagcaaagcauguggcacucaacugaugugacauaguaagaauuuggggaucuuucucccucuuuuaucuuaaccuuugcaccuucuagugguaccauuacuaugguauaucucuuacugcaucuagagaagacaguaccuaucugacucuagaaugcaccuaauuucucuauacagaaauucauuucuaaguauuccugcuucauucacuggcucuuguuauuuuagggagagaaaucucuaucccauaaagaaaaaaaaaauguuucugucaaggggaaguugcuuuggaauaggaaaauaguucuuugaaauaagacuggcuguuucucacucuuuaaauucaccuauuaacauuuauugagugccuucuaggugcuguguaauuuccuaggaauuuacacauacaauccccuuauauuaaaaguuauaagggagaugggagcauuuucauguuucuuugaauaguagauuaagguccagaaagacauagugcuugcauacaggcucaggagcauaugguggggagugguguguguguggucuuagaugccugaccaggucacguuugcaggacugugccacguuucccuuguugguucugcugcugagcauaggaaggcuuuguuuuauucucaggugcaguguacuaccuuguuuguaacuguugagcccuaggcacucuccuuuaguuacagaaugaaaugguuauuuugagaugucuugcuaugguuuagacuauccaagcucuuggucuuccuccagagucuguucugacagcagguucacuagaaacguuguuugccaccauuaucuucauugucaugcaccugagguacauuguaauauggugauuuuguuguuguuguuuucauaacaguuucucuguguagcccuggcuauguuggagcuugcucuguagacuaggcuguccuugaacucagagaucugccugccucugccucugccuccugagugccagaauuaauggaauaugcuaugccuggccacauugugauuuuuuuugaaccacaggaacuugagguugcacuagacauugaaccuggucaugcuuaagauaaaucuauacucugcuauugagcugaaagaaccaaacuggucaacuagguaaggaaagugacguguggucuucacuaugacugauaaauugauagaugacaugacaagccauaaggccaccugggcaugucucuguuccacagccaucuucagcaggauuccauuuuggaaauagagcaaguuuauggucagaugaagacugaaaaaguuacuuaagguacugucacugaaguaggucuccaagaguuaggugcaggaaaggaggacugcugauagcucaagcgcaucauccuugugcuagagaaugagaccgauagaaacugauggaaacaguucuagaagugcagccucugcauuugaacggggacuuaaauauccuggaucacguaggaggaugcuucgcuuuccaucuuugaggcugagcuuugacuuugggcuugcccuagguuuuugcauggagauauucuuguuacacuuuguucuuaguuccagauuguucuacagucuguuuugacaucuaagaaguagucuuugaguauaucuguagacaucaaugaacuaacucugaauucucuaauaggucaguguuuagccuguaguaguagccauguaaugaauaccuaccaugugcaaagugccagccauagcauauacaaaauaaggaaaaccuuacggagugcaaagugcagcuugagcgggguugcaccgagugagcagugggacuggacccaaacuugagguugugugacaccugagguuugucagggcuucuuuuaagugaugaagccugcagcccugagucuggugugucacugaaagguucuagcuuucuuaggcuuuaaauugaacagugauuuuacucuuugauuuauauuugacuugcucuuguucuggaaaugaaguguauaaaagcugguguuuagcuggcuaacagcucucaggaggcauccacaccuaggacgcucguucucuucccaccaguugagcuucagaaaggggagugaggcaacaagauugaaaguucaaggccacccugggacacuuagaaagcccaggcucaaaaaauuaaaaguauuuaaaaaguguuggaaagagaggcagagagcauguuaggucugagcuagcuuggauaaaugaagcaagccuuacagacuuuaaaaguuugugucaaaugguacugcuugagcagcaguaugccagccugggauguccacuccucacguggcuuucugccuccagucuugcucuccuugagcuggcccaugagcugaccccagcaucugcugagcacaaaugauuuuugagguaauuugucaugccuacaugcuaguauauuuucuaaguaagcuuucaugugacuagaugggcuuuugaaaacuuuuauuuguaaaauguuacuuuuuauuguuauuuuaaauuucuuauuuaaaguuguuuuuaauuuauguucagaccuacagugaaaaagcaacagaaaagugaaaaacuagcccuugauacuaugauacuauuuuaaaaagaauaauucuauauaggaaauacuuagaagauauuuuuguaacuuaauaucuucccaaaaaauaauuacuuuuuuccuguccuuucuuuauaaaugccauuuuuuuuuuuuaggaaaaauaauaaguuuuaacaaguagacacuuuuauuccaaauaauuuacagaaguaacauuuuauguagaauggcaaaacuaagacauuuugguuucuaaguacaauuauuuucauuugcagggagccuuugcugaacuuccacauagaacauuauuggcuugccaccuccuuaucuuuaguauugagugucagugaaccuugggccuguggcuuccuaaguauaguauagcccucagauuuaugaccuccucuucccacuuucucuccuucccuuccuuguucauuuauucuuucuucauccuuuauuccaaagaguuuuuauuauaaaacaauccuagugagucaccuuucuuugaguugcuguguaauacuuuaucagaugggcuuaugcuuaguagaauauucugacacggacauacaugguuuacauucagcuugccucucucucuuacuguguuagaaggcacuguugugaguaugcuuaugcauauaauuuuuccucucauucugcaugacuccauuaaaauaaguaauaggaguaggaguucugggucaaaugggguaaauguuuuuauggcuucuagucuguguugccaaaucacucucccuuuaaaaguuugugucaaaugguacugcuugagcagcaguaugccagccugggauguccacuccucacguggcuuucugccuucagucuugcucuccuugagcuggcccaugagcuacugcacaaaacacucaugcucuucauacuccacccuggccuucccuggucaucgggagccugcugucauuucagauguaaaguuucaaaucugugccuucucucugcaacaccaguuccaguugguuugcauccgugccugaguagccucccugagguuuccucaaaugaccuuaucucuuaaccucuugucuucccuuuuacuguugcuuauauucaagacugccucucucccaaaauuucuacagcuccuuuaauucaaaaacuguuugcugcaaagcugcaaaacagaaccaccaaacgaugcuguuuuuucacacuuaaugcccccuuuuuuugugguggguggccaguccugugggucaguguggacagggaaauaaacaggaaagcagacagugccgaggaguggcucguugguuugccucaggaagaguucaggugggauugauucagagagcacaugcucucugugagaguuguaauucugugcuccugguuugugaccaccacucccuaugcaaacaagccaguuauucuacccauuugccucugcucugcuacacaguggaaaguauacacucuggccaaucauuccaggggagccacgauaccuuucucccugccaguuaauuuguccuuaaucucauuagcagcacuaguagcagcagcaacagcuuccuaaugcauacuguuuacuacuugccagguagugagauauuuuaggugccauaaaugucagaacccucacaaucacccucugagcuaaggauuacuucauuuucauaagaggaauccaggcacaguuuacuagcuugaagucacaacuaguaaguucaggagccuuuuugcagguuguagguugucucccugcaguucucugaugauuucuuauggaauucaaaaaagagaauccuagcacacugaaagaccuuuccaaaucucaggcaagucugugcuuccguucucgaguucuuucaggugccauccccuaacauugucccauguuucagucccagagcugccagcuucauggauguaucacauacauucacacaccuacagcaaacuccucauuucccugagaguccagcucagacguccggugccuugugcuaaccauuccaccucuuuggauaguugcugucuuaauucucucuucucccauuguauuuaugccauaaucuucucaugaggcuuuauguuuauuuacuuacacaucugucuuacuuuaauaagaauauugagaugggagaacaguauuuauuaaaaauuaguuuauauauuuuguuuaaaaaucuuuaaaguuuaucauauacuaaaauaacaauguuucccuuuucccucuucagcauagggcuacuuucaaauuugaaucagcagaugaagauaaaagaaagguaagguuugggguguguguguguguguguuuaagccugggugguuaaguagugggcuuguuuucaucucgugguuguugguuagucuuuguuuucaguuaaguuugucaggcuuccugagaagaaagaggugcaagguuuaggguggguuacacagagucccgcuguucaucccacagagccccugugcuuacaugaguugggaaggguucagugggacuaucacuagacuuucuuacugcuaaaagguugcccauuuuugguggcagaauucgagguuguaaaaaaugccaggcuaacguaaagcugugcuaagccuggggaaagcagcuuuuccugcugcugccccucagccgcaguuucucagcacugagcuucuuauguuguuacucucacuacacgagacuaccuaauguaugcuugcguguuggcacugccuauggcugccuuauuugguguguuaaaggaucauguuacagaggagaaaccaguccugcccuuuuguuuuucuggguccuguaccuccucuaucccagccucacugauucaggauuaaacgaagacuauggcugaguuaguucccagugucagaaucuuagaugcugguaguggauugauaaccuuacauacguccauuuaccucgcuauagccaaucucugugccuguuucucuuauauuuuugcuugugagccuagccuguaacagcugagccaucucuccagucugugccugcuucucuuugucuccuaagauuuauucucuuaaucgagaccuucuucuggauuacuguauaaguauguuguuguuuuugagacaggguuucucuguguagcccuggcugcaccagaacucucucuguagaccgggcuggccucaaacucagagaucugcuugccuuggccuccccauugcucagaugaaaggcugcauccccacugcccagcgcuacguuaguuuuugagcugucgaccuuucacuauguagggacacgugguucuaguugcuuguccauaaaucuaaggcagcagucaggccaugucauucuuggccuuaaaaucuucccgggacuuccuaugcugacagggugacauaguagugucagugaucugaugucugcauugcuucuacagccugcaauuucuauccccuuguguuuauguaugaaguguugaugguuaccuguacauacacagucuuuauuuauagcuuuccucuguuaauuacucuccaugguaaaccuguaggacuccugcugguugacauuguugcucaucucuguuugucacaucugcagugcugagcucagagugaacacucaagaaguucacuaaaucagugucauggaguggaaagaagacuuacuuuuggauuuggacagugccaauaugucaaaagauaccuuuuggaguagagauuuauugaaugaacauguuuuuuggauagcuuuaaaaacuggccuucuuagggacagucccuuaucuaaugagucagaagcaggggcguagacgccaagcguauguacaucucuagaugaucuucacacagaaugcacaggaucuguggaggacaagcugguaguuagcuauuaaaauuaagaugccuuuugcccuuugaccaaagugugucucuuuuggagaucgguuuuguuuagauugaacccaagugaacacuuuuuuucaucaaaacauacaucaagaggaaaagauuggaaauggccagcugagguguauugggaauaaacacaagcacauuaauuaacauaauagaguacuaggaggggguagaaagagagaaagucuauuaugugcuguuggaaagaaccaaguaagcuuuuaaagcuggcagugaaauggcagacucacgauaaacauucaagcuagaaaggcagcuacuuaccauguguuugauuagaagaacccacccucuguuuauuacauccacgcuauauuaggggucaaacuucagaaucuuggguagcacuuucacuuacaauaaguacauuaagagcaggagaccacccaguuaguagaguguuggccacacucucaguacuugaguucaguccauagaaccacagaaaaauucuaggcacagugacacuguaaucccugcacuggaaagagagagacugaagaaucccuggaauacacacauacacacacacacacacacacacuugcacauaucuacaugcacauacagugugcauaaaaagcugaauacagaugcauuaucucaucuaaaugucauuggagaggagaauuuuucuauauuaguuauccaugguguuguuuucuguaaggugguaaaaagccugacauugucuaaccacucucccuacuuauugucuauauggguuugauuccaucagcauucuucugauauacacacaacuccccauaugcucaaaauucuuccuacuuuuaauauuuacauauaaguacauaucuuuccacguacuuuaaaucauugcuauguugcuucuguugccuguuauggugugaacauuauguaaaguuguuaaacugugcucuaaguaaugcugcaaacgucccuguguguucagagcagagacggguuuuuccuaauugcuuugaugcagagguuguuuggaucuguuggugugagaucgcccucugcuacuuucagaucucuggagagaguaacuucugcccugguguuuauugcaguguguguagauuccugcuuccugggaggucuguuauaaacaagagucauuagggaccuacguagguaaucuucauuaaugcaaaacaucaccaaacaaacccauuucagucuccaaggguuaaaaccacuagugacacuuugaugccuccagugccuuucagauacugacagggaaacugcaggacagccccaugcucacagcuguagaggcucucuguggaaacagagcaguaggcacugcacugagcccaguguggaaacguaagaaaucaaaugaccauacagauccuuugcuguccuguacuguccugaaugugcuuccagagcagcggugcucagccugugggucauggcccauuuggggaucacaugacccuccucacaggggucgccuaagaaccucagaaaaacacagacauuuguaguaugacucauaacaguagcaaaauuacaguuaugaaauaguaucgaagguaacuuugugguuggggucaccccaauaugaggagcugcauuaaaugggcauauauagcaguaggaagguugagaaccauuguucuagagccuucugucaagucauuacauugguaacaacaaaucaagacuuugcucgcuuucauaaaggcagugcugugcuagaaaaaucaaccaaacauccacccauaguaauaucuuucuaauauuaaaaaaaaaaaaaaccaacaacuuugugacaaccuagaauaagaggcaguggcgccucucugcguagggugacaagugaugcucucuagaucuggucccugacacuucugcuguaauuuucaguuuuacagagguuugcuucucccucuagugccauucaguguggugggcauuuaacaaugagacaaaugcucacacugcuggaauguggugaaugaagccuuauacagaaaggauucuucaguaggcauaguucuucugugucuacuccuauguagcugucucauuaccuuuugaaauauaguuuggaauacuuaaaauuaugauccaauaccuuguuuuaucucucucucucucucucucucucucucucucuuuuucgagacaggguuucucuguguaucccuggcuguccuggaacucacuuuguagaccaggcuggcuuugaacucagaaaucugccugccucugccuccugagugcugggauuaaaggugugcgccaccacgcccggcuuguuuuaccuauuauuucaucacuguugagacacuauuuaagagucacgcuuaaggcuggagagaugguucagcaguuaagggcacugacugcucuuccugaggcccugaguucaaaucccagcaaccacaugguggcuuucacaaccaucuguaaugggaucugacgcccucuucuggugugucugaagacagcuacagcauacucauauacauaaaauaaauaaauaaaucuuuggggaaaaaaggucaggcuuaagguaggagcuagcaaaggggaauguauguauuuucuuuaaggaauaaaguuggcugcaauucuaaugucugugcaucugaugcaaaucaugacaggugcaugugaauuauugcaguuuggauagaagcaccugcuuauuuacauccuccccuacaguggcgggcugcgauuagcugucagugcacacacacauguaucgugcagaucugugggcugggggaaagcaaauggugaauaaccugcauacccgcaucuugagacagcgagggcucuuacuuugcuuuuuaacccaaaauguuucucagaaagcaguaaagaguauugcaauaaaaguugauaaagauaugucauaaaaugaauuggguuggguuacagcucagggacacaguuugccuagcaugugugaggcccuggguucaauccucuguccggggguguggagaggaguagaauguuugacccucuuugaccuguaccugagaauauagcauuaucaccgguggaaaaccuuccuguauauaacuaacaucaucuuccucagaagaaugagcacuaacauaccuaaaguacaagcauguuucauagcuuuagacucaguucucuuaagugguaggucaguugcugaguugaaauugugagcucuucauggggacaagaagccuggauuauuuacccuggauucuuagcucccagcacugcaugaggcccuggauaggcaccuacacuaaugcaaguuaagaugaggggaaggaacuuggaaguugaguggaggcuagaauuccugugaguagagcauauugugugguucuguguuuuacgcucuucuaguuacacaucagaauugcaaaauacaacucacaguguuguucacugaggaagcaagauacaaaaguauauuucaggagugaucacggcuuggaguucugcuaaauccuacacagagaagugcagcaaggaaguccacuagaugcugcugcuugacuguacugcuguggaguaggcuuuuuugguaaacuuuugaaucauaauagauugaacugauuuaagaccauaauuauuuaauaacacaguauaauacaauuguauuuuagaauagugugauugggggcauaaacauaaaccagugcuuucuggauuuuuuuuuuccaaaauugaacuuucuugauuucuuuauuaaauuagaguaguauuacuuacaaagccaguuuauauagugaaauaaauguaucugaauacaaaaguccauuuuguuauuucagauacaucaguuuuuaagcuuucccuuuuaggcguggaucugcauauuagaacaugugucauuuacacgguuccucagugguccuuugcacugggacccaugcuaggcuuagauuccuggcuugcuguuagccugugguacuugguuugaugcauacucaguuacagauacauaggugcuagcgauugucacugcggacuguggaaaacgaguggcaagugugugaauuuccuuccuccaagggaaaugugccaaggcagaauuguuaauccuuggcuuugaauccacuuguagguaacauagcucgaggcauggaugcuuguucugaaagccuuuguucuuacucuggucagcugaaaaugucaaaguaauuaaaaaaauuuuuuuaaacaaaagcuuaauauuaugucuaaauuugaaucaaaauuuguuggauaccuuuaccuaagggaacacauagguacauaguacaaauaaagugcucagucugaaaccagucucuuccaagacagccuuuuaguggggaaagaguacagcuguagaaugcuuucuagucuagccaaggcucucagcgccugacucccugcgucuuucccucucccagcucucccccaacucagcugagacugcuuuuuagcauauccaagguuuugcgugccccucacccuacagaugaugacuuuaaauacuuuuaacuccauucaaagaugagcacucaauaucagguacacaccucagguuuuuauuuuuaaagcuccugucuagcaggacccuaguacagaucuuaacuguuaggcagaaugaaugccuagccauagugcaaaucaagccauuugcgcuuuauuccagacuguaccuuucacuguagauguuuugccagauaggggaaaaggacagaaaagcucuucuaauuuaggguuuucgcgugaucuuuaaaaacaaugacugugugugugcacaugcaugcucauaugcccacaggugcacgugggaauggacaugacauguguggugagaccugagauggggacucucucuaguccaguuccuggaauggcggcuucacucccacguuguuaggagcuucugcugugcaguggcugcguuugcugguccuccugucuguaccucuuguuucucuuuagcaacacuggcuuacugaugcagucuggcacgucagaacucaggucaucaggcuggccagccugugcuuuuacuuauuuacugagccaucuuccugggucacccuaugugaucuuuauguuacuuuuuaggguaccuuccucgggggauaagaauaguggaacuguggaguugggggaggcacauuuucucaucugaucaucccaguuuauuuugcagccaggauaguguauggagcucuauaaacuagcacccuaaugaaaccuaucaaaauuauuuuuuaaaguaaacacuuuuuuuuagcccaaagaguucauaaugaaaaaaacauuuacugaaaaaaaucuggaauucaguuaagaaaagugaaauugguggaauguguccagagcuccccaguagacaggcauugugaagaacauuggcugugaguugaggggcugucuucucaggagggacacaauauuuacauuucucaguuuacuuuuuucuggcugccuucaagauuuucucuuucucuuuagcuuuuaauaguugguucuuuccuucuaccauggccucuugggacccaauucaaauugacaggcugauuuuccaagugcuuuuaccagcuggaccaucaugugguccccuuuagugauuuuuaaaagcaucuguguaaaacagaaugucuguaauguuauggugaguaaauaguauauauaaauacaauguuuuugccagacccacacaaaggugaaugggaacaaagcuguauuguacugaagugacuccagaugguaacuggaauccauaagaacaaaucaaaagacccagaagugauaauaaauaaggccaauaaaacaaauaucauaugcuuacucuucuuuauacagcuuccuuaaagaugauagaaaguaguaauuauaguuauuguuggauuuguaucacuugcaguauuacauaaaagaaggcuacuuuacaauaauauuucuauaccccuccagaaaauuaguauuaaucuggagcagauccaauaagaugcauauaguaagccuuaaaacaguggcucucaaccuuccagugcugugaccccuuaacauggugacucauguugugcugacuccaaccauaaaacuauuuuuaauugcaacuucuuaacuguaauuuugcuacuguuaugaaccauaauguaaaauaucuguguuuuccgauggucuuaaguaacccuugugagaugugucauuugauaccaacggggucuagacccacaaguugagaaccacugccuuaaaguuacaccuuaaguacauaacucagauguugaugacuguaagacuucacugagaaugauuaaaggagauuuaaauaaaugaaaaaaaaucccauguuuguggaauggaagacuuacuacugcuagaauauugguauuugucuuacugauccacuaauucaguauaaucauuucuagaauucacgguggcuucuuguuagaaaucagcaggccaguucugaaaugaaaacaggcacagaauagcuuaaggaaucguggaggggaaaagugaaaauggagcuggguauggugagguguuuuguaaucugggaugugggaaauagaggcaggaggauaaggguuggcuacuuaaaaaguuuggguccauccugaacugcaugucucaaagaggagcgggaggcagacucagcaguuucagacugggcagacuguugguguccaagacugggaaccagcaugcgagugacugugacuaucagcaaaugaaguguuaccuggaaaaccaugaauaaaugaugugguugguccuuaccuugugcuacacuccauucaaaaaggcaaauggaucaaagaucuaaaucuaugagguaaagacuuaaaauuuacuggggaaaacagaaaucaccauucucucagaugauaccaaaaacauaaacaaaagaagaaacagacaaaaauggacauugucagaguuaaaaacauuugugcucuaaaagaaacgaucaggaagauaaaaaugauaauuugcagaauuagagaaaauauuaaaaucacauauaugguaaaaauuucacuuaaaauauauaagaaacucccugaaaaaauuugaagcuuuaauuaaguuucuuuuauguguaugaguguuuuggcugcuuguguguuugugugccacauguaugcuuguauggagucagaagagcaaucagagccucggaaacuagaguuagagacacuugguaacauguaggugcuaggaacugaagcggguacucugcaagagcaacaaaugcucuuaacuacugagccaucucuucagcccuaagaacucuuacucagaagacaauugaauuuaaaaugaacaguaaacucaagaucuagguuuccaaaauaaaaacugacaucauugguuacuggauaaagguaaaccacgagugucauaaaucagcucaccucugccaggcuagaacaggacaaagcaauacugacaagagcgggaaccccugagcauccguucacccacuacuuguaggaagugcugcagccagucuggaaacaauccggcaguuacucacaaagcuaagcugcguaccaguuguaccccuagguacugagaguguguuacaaaaaaaaaguggacauagucugugcaaaacucugcgugcacguacacacacacacacacacacacacacacacacacacacgagguuugcugaauaauaauaaaaaaguaggaacaacccagauguccaucagcauguaaaugaugaacaaaauauguuauauuccugcaguagacuguuauucaguuaaagaaauaaaguaacugauaugugcuaauggugaauggacuuugaaagcaggcuaagugaaggaaauuaggcacaaaaggccagacagauguuguaugauuucugucagugugaaacguuuuggauaacagauccuuggugacagaaaauggauuagugguugccagggagcugggacgagggaaaaagaggagucaggguuuacugcugauggguauugaguuucugaugggagugaugaaaauauucuauaauuagauagagaugaugguugcacaagugugaauaugugcucuaaaaacaaauagguuguggacuuuaauagaacagacugugugaacuguaucugaaaacauuugguauaaaaagaaguguuagucgauacaguauacuauaugccuguuacucuuacaagucccgugcgucuuugugcgcauuuaacccuuccaacaaagcuuuaaggugcauucuguggcuuuuuuguuuuacaagagaggaagcaaagguacauggaggaaaugcuguuuaaaccagugaacugguaggccaugauucaaaccuaagcagucugucccauagcccagguguuacaccauaucagacuagaaagacucauuguguggcuuacaaaucuccuuauuuucugacuuagguguccaaauuuugagauuuguugcaaaguauagacggaacuuaggcacugagcugaugaccagcauggagaggcaucagauagcaugcccuccacgaggggccaugaugcagaugagagcacuuggaaugaggaacuugugaggaagauguggggccagacaaggcuucaguuccucuugccuuuaguggccaugcccagagguggagcagugcguuacagugugggcuugugcauccuuccauagggugacccucugagguauccucaccugccaucacucaccagcacugcucccacuuggacugacucucucaguuuccacguuccucgcuggucugcucauggcucucuccauucuuugguuaccuccuuccagcuacucagacacuuuccuccugcccaguaacaccuccccagaagcuuccucuuagaacugcuugcauaauuuauucagcauuuaguauguagcuuaaguugauguauaguaaaagauacuuagcacuuacucauuuuacauaugugaaaucucuaguauuauaaauuauuugagucauguucucuuaucgcucauuaacccaaaauagauguuuuuuuuuuuuccgcuuaauauuucuccuaaaacuuuuuuuucucauuugggaaauugugauaugcaagaaaugaagauauuucuucucuaacugccaauauucaauaccuaaguuuucaagacuaaaguuuuacacauacaguguggaaaaaaggauuuuuuuuuuuggggggggaaauaaagacacuuaaauaguaagagaaaaguuguggacugguuuaauguuggaagagaagauguuuuuacauaugcuucucugccuuccgucaggacgagacgggcagcugauggguuuggaaguguucuucugcaccuaagcugucuuucccaucuguuuaugaauguuugaugccacagcagggcuucucaggacugcuccuuagcgaagaagguccaugauuguacucagagcucucagccauaggcugugcuucugacugugcuuaggauuuuauauauaaaaaauagucacguuugacgcccagaauccuuuucuguaaccuuuauuacaaguaugcuucucuauuguaagaguaacucauuagcuguuuaguauuuuuaaaauacaacuuuugaauaguucucuuacaaaacugacaacaaauuauuaacuuacuucccacuacugcuauaguaacuucccuuggucccuucccucucucccucccuccuuucuucccucucucccucccuccuucccucuuucccuuuuuccucuuccuucccuucuucccaucacuuuagcucuuccucuuucuugcguuugcucacuugcuguacacagagggcagaaguugagaacuaucagauucagguggcugaccuugaguuccaguuaagaacuaaaauuagaucccuguggaauauauaucccuugacgucugguggagaacgugggcauaaccuugaacagccagaaagacaaaauccaagggaguuuguuugacucuaaaaauuuauuugacaucuccuuuaauaauuuaaaauucauaugacuuucguauuacaauuuguagugcauuuacauguacaucccagaauuuuaguaucacuguggucugagaagaugcacuaggacuuugacaugaugccauguccccaaauaaacaugcauggucuauuuuaagacugaaauccuauccugucacuauaagguccugguugauuccagugaguaacagaugauguaggacuguagugaacauagagaaaauaucaaggggaaaguccauggucacugaagagaaagugccagacugugaguauagcuuauuucauugccaguacaaaagaagagcaagaaauguuaaguaagaugaaaagugcagaacuguguuuaagaauacaggucuguuuuaggagggggguaaauuacaaccccuauuuuuauucacuggguuaauuuaauacggaguaauuuuuaauguuaggaacauucauuuuuaccuucauuuuacauucauuuauacaaguaucacguauaugucugcuccuuuaauuuucccaauaacccaaaaaguagguauucuuuacagauguggaaguuaaagaagccugccauuugucccaaguccuaaagcugagggaaguggcagcugggggugaaacccagagcuucagccaccuguuaauccuggggacauagcauucugcagcucacccucagugucucugauguucccagggaagagcagacauacaucacagggccugccucccuccaaguuggggagagagauaagucucuacaaaaguucacaguucagagucaaacauguucggaucuguagccaagauagcaagaacucuggacuuagagcaaugauggggagaaagauagcauuauuuuuaagacaggaauaauuuagcaaggugagcaguugagaagacacacuaaauauuggaaauaagaaauucagaaggccuccggagaggcccauacagguauuaacaagucacugugccugcagcaaggauacugugacacugauaauggaauauaaguuuauaaaggucaguuacagggacgcuguugagcuugcaugugcuuagaugacgugacacugugagacugacagagaaggcuugucaucagcagccuuccugcugccaacuuuaggaaaacgucccucaccuuggcaccaaugcugccggccaaguuagccggcuggacacagggagguucguuggcuucucucuccuuccuuuucauccaggugugaguaccgcugucacugcccuuccccagcuuccccuccugucuucacucagacccuguaucucucacucacugcggcuucugcacagcaggggaacugcucucugcgcuucugccugccucaucgcuugcuuagugcuauccacauuaaguuagugcuguucccaaaauucaagucuaaucauuaacaccgcaaguuccucguuuccuucuggaguaaguccaaauucuccaucucugucaucacacagcacaaccuagucuucugucucuuuacaaaaaggaagaagacagcaucucuccaccacacagucccucugaucgccaccacaguucucuucuccugugucuugacaguaucuacuguccacuuucuccacugcuuuuaucaagguccucaugaugugacauugccaaauccuuaggcuaguugaucuuuugucugcauuugaaacagcugagcauuccauccucaaaaugcuuuugucugccucccagaacacccacacuucuaaauuuccucuuaaagaccagucauggcguuggcauuuuccagggcucuuguaccuuuucuuucuguuuuccucuauacaagcuaaucuagucauaacugaaguguuccuuccucauagagaagcagagcuucaguggcugcuuaaggcucucccacaucuauucagcuuccgagcugacguccuuagaagcaucucagauguacaaugucuuacagagcucucuaaggcuguguaagccaggaauuuucucccagacaguacaguucuaugagucccuucccucugcugucaccgcuacaacugaagcugugcuugcuuucucccagccgcucuuccauacacagccagguugguuuucuucugcuucuacauuuuaauuggauuuaugucuucucugcauaaacucuuuaggaacuuuucauagcagucaagcuaagucuguaagacuccacgcgccccgcuuccugcuuacuucaggucucaccccacggcaggcugcugcuagugugaccauggacuuuccacaccucagccugugcucugugugcugucuuccucuacuccgugcacuucagaaugucuggaagcaucacccaaaggaauguuucuccaguaacuuagcaaagcauccuggcuacuuccguuauaaugucucauaguaaugauuuuauuuauuuucugcuuucucaauuagccugugaucugcucagcaucagaauuuugccuccguucaacagucccgccuccccccccacacacacacacgaugccuagaaaaucccacacacugaaaaugugugcuagguggcugaucauuguuucucagugagggaagcggauguuccuugggagacauuugacaaugccuguggacauuuuuuuauugugaugacuugguggcagugcuggugugcuauuuauuaacaugcuguagccacuaaaaaugucaauaaauguccuaaaacacaaaacagccuuccaaaacaaagaauuuucuaauccaaauugucaauaugagaaacaucuggcuuagaucugugagagcacuuaccacguuaguguggcuuauauuuccucgucacaguccacuugacucuaaauuccuuaccuuuaccauugucucgccacaucaccuaggauuuauaagagaguuacccagggaauucaugauuguggcuaaagagaggaacaaaugaaugcucagccuagccuagccugucuucaguuauuugacaggaaguguugcugcuugggcuuugcagcagaccauaagauccauugcacaugaagcagcagcauagaagauuauggaaagaacaugcaugagacccauaucucaaauguguguucuguucagguuauaacaaaauuuggcaagagucaacacauuuaaaaugacaaccaagauagaagugguaagggauuaaaguguuagcuuuuacuuuucaaguaacugcucugaggugaccauccaggcaugugaacugcucugcuccgagaauuguuugaggguggaguuguggggagggugcauuucuuuccaaguugucaagucagacuucauugccuaagcaaagucuuagagucucacaaacagccuagacuggaaaggggagauagauagauagaucauagcacugcauuggcaggagcucagagaccuugucuguaaacuagccaaugugcuauaaccaagcagccuggguuacuacuuaagaaaggaaggauggacaacuuuccauuuuuaccuuagugccuaaugaugaaacucuagaucagcauacuuaaugaagcucuauaguuuguauucucuggauuccaguuggcuuuaguuccuuuguuauguacucaaagaaaauuuacaaaaguuaaaauguauuaucuauaauagugccucacagauuauuugugauaaaagacugagggcuuuaguggguucauuuuccccuaaauugcaguagaauaguacuuuugugaaacauaaucaaaauuaaucacuaaaaaaaaaccauauucuuaguugucuuagcaauauuagccuccugugaagauugcuaagugaacccucucagauuuuauaucugucucagcgucuguccuuaccucugcgauaggcugugagaggaacucacccauguugauaugcuuuuagaagugcuuucugaaagccucuuuuggguucauguguauguagacagugguguuagguuuuuaaacuaagguguuuucuuuauguuuaaaacuugaaauuugcuuucaaaauagcuuuagaagccaccuccuaccaguguacagaucauaauggaucauuuaaauguucacguuccuucauagccccucuugcuuguuuuacagcugaagccaacacugaacuuaauucuacagauacauaagaaacccugccuuuccugguuugggagagggugcccuucagcgccuuguauauuaaagcaugacauuggggaagaaagaagcccaauaaagugacaugcucacaauuauguuacuaagugggagauacuguggcauagccauuggucuacaguagaaauugcagugguaucaggugaucuggcugaauccccaccuaucuuuuagcucagugucuuuaugcagucacuuggucuacuaagaaucauauaauaaguauucauacacauuuuuuaaauugaaaggcacauauaaacguuuuuaguaaucugcaaggcucauaaacaaaaacauaggguugggaagccauaccuuguaauguggaguccaucacgccucugcauuucaugcucacacuguagagacaacaggcaguacagucagugugucuguuugaaguuguauuucugagggaagaccuagagaaacggcucaucaaagagugcauagugcauuucuagaggacucaaguucaguuccuagugccuacauggguggaucauugcugucugugacuccacucccaggccaucuaaugccccuuuccggccugggagggaggguaccaagcauguaugugguacauagacguaggcaagacacugauguauauaaaauaaaaauaaaucuuuuuaaaaauguuuuuauauaaggacccuguagcagcugggaaaaaaugaguuuuuuaaaaugucaggaaacaaaguuagguguacaugauuacaauuguuuguuaaaauaauauguauguuacuaaagucagauagcuggacuaagggcaaggcccuuggucuggcauguagaacauaguauggcuguggguauuguuuucauuauuauagcuguggaaauuuugcacauguguacaauguauuuugaucacaauucuuucucuaauuccuccugauccacaccucucucaacuucuuguccuuaaaaaagaaaguaggcuucuucuucuucuucgucuucuucuucuucuucuucuucuucuucuucuucuucuucuucuucuuuuuuuuuuuuuaaguuuauaucuuaaacaacauaaugccuuuaaguaaccuaaccccuucugggaaaguuuccuugucugaaagccuucuuuuuucuuuuuucuucacaagaacggaaguuucugcugcuuuuuuuuccuuccuagaaagcagaguuaaaacagcguuaauaagacacugagguuugcaguuuaggaacuugaguugguuaguuuuguggauguguccuguacugcacaugcucuguaaaugguuacaaggaaauaaaagacgagaagcuuccacgauggucuggcugcuguuagggcugcgccauggccucucuuacgagaugcauguggugauaucccauuguccaagugggaaaaugaagcccagaaugugacugguguaaguuaaauaccaugucuacccgcacaccuagcaccauccccuacugagaggaacucaggguggcuaagucagguuaaaccagcucuucugauuuaaacgccuuugcagugcguuuucuucuuuuuuaaagaugaagucuuugugcugccugacagcuuuuaguuguuuaggcaaacccuagaaaaaaaacagacagacguacuaaauacaagaugacuccuacuaaucgaggccgugauauuccuugggaaggaaggauguuggggguuaaaguguuuagggaaaacuuggaguaagauauaaacuuagcuuagaaaauggcugcacuauaggcagagaagauugacauucagggauggggagggucagaacacaagagagauaaaugugagauauuuugucaagaacugcaggcucaaaggaugccuuguuagaaugguaugagaguacuccagagacagguuaggccagcagacgcagaacucccguguucacaugugggggugggguggugggggugggggccuuugcccaugugcagguguaugcaccccccccacauacauaccacacuacacacacauaccacacacacacauaccacacauacauacugcacacaccaucuaccacaccacacacacacacacacacacacacacacacauacauacacauacacacacacacacacacauacacacacacacacaaaacacacauaaauguuuaaaaacaauuuaaagacagauaauagggucuuaugccaaacugaagauguaggauuuuuugucuugugcuuacauauaauagaaaccuguguuaaauguucaucacaugccaguccuuauuuuauaugcuauauuuaugugauaauugaagguaagugcagugucuaaagagaaaaauaacuuaccaagguaaccaggcacaaguagacgaggcaagauuugaaacaaucaaguuaaggccaacuccuguuucugauuacaccauccuauuccgguuguaggaucauugguaagaugaacaaguuucaagcccaggguuagccuuaaacaaguagugugccucacucacauauggcuuuuaacauuuaaaaauguuaacuugugaucagauagcgauacucauucguacccauacugugcuuacacacaggaggccaggacaucgcagaaguugauguucaguggccuucagcucugauuacuguucuaugccaguguguuugcaguucugcauacaucugacagugagccuuaguuaacuaacaucuaagaugugcuagccuguucuaacuggauucacuacugccagugugucugcaguucugcauacaucugacagcgagccuuaguuaacuaacaucuaagaugugcuagccuguucuaacuggauucacuacugccagugugucugcuguucugcauacaucugacagcgagccuuaguuaacuaacaucuaagaugugcuagccuguucuaacuggauucacuacucagacugugguuucuggaccaccagaggagcaacaucaucaggaaacuuaguaaaaggguuccagcuucccccccauauccguugucagaagcuggaggugagguauaauagcuuucaguggaccuugaguagugauggggguguugguguuuaaaaaccauuagaaucuacucuagacuuucaguucaggagcagauugcuuaacuuuauuguuaaguguuuguuauuggucuuauacuuugucuguguaggcccacaauauguuuuaagcauagcauugccugggcaguggcagcucaugccuuuaaucauagcacuugggccucugugaggccagccucaucgaguuccaggauagccagggauacagggagaaacccugucuaagaaaagaaaaauaguaaagucgauuuagagaauacucaucuuugccucagugguaggaugcuuaugugccaugcacagagcccuagguucaguccccagcaccaguacacacugauaaauacuggcuggcagggcagagugaaaggaagacaugagggucuuugaaauauagaaauaguauaggcagucagauagagucauagagaaggcugucucugcagcccuuuugcuugguuguaacauacacacucaguuuuucugacacaacuggcuucuucuaaauuucuuugacuagaaguuauugugucuaguaaaauaguaaguaucuguuaacuaccacuugcuuguuacuuucacauguucuuuuuaugggcauauggugugcauacauguauguauguguaggcacauaauagggauacacauaugugggcgaguaggauguguguguacccaagauugauggcaggcguugucuuggucacccuuugucuuaucuauuggacucauuuuauuggacuuaucuuauauauuggacucaguugaguccagaacguaccaguccuaguucagauaaccggguuagucuggggauuucauuucugccucccacacccuggaauuccaggcaagccaccaugcccacccaacaugaacguggcugcuagggcuccaaccucugaaccuguuauguucuugugacaagcacuugcaucgcugagccaccucuccagaccuacauguucuuaaauacuuguauuuuccgaaaaugaguuaacagcuaacaccuuguauuuaccagucauuacaugagguaugagaaaugaggugcucagagaaccuaggauugacagcugcugggaaacagaaacucuuguguuugguucuggguggucuguggugagccuuuagcuuuacagcauaaacucgagguaucuuagacgucuugcacguucuucauugguuucaguuucccaguccuuuugguuugcaugcagccuuggcuauuauaauucacuugcaugguaucuucccucugugucugaagaagaaagggauuguguagguguuuguuguuguugcuguugcuuuuaguuuaaagaauagauaucuguguacuaugccauauucauauauuacauuuuauauuuaauauaaauauuuaauggguguuuuguuggaauguaugucugcaccauaugcaugcaacaugcaaugcucaugcaggccagaagagggaguuguauccccugaaacuggaguuaagauguuuuugagcuucuaugugguugcugggaaucggaauaggcuagcuucuggaaaagcagccagugcuguuaauagcugaacggccuuuccaguauuuccuguauucuagguuucuuacguaggaagacagaucauuucuuucuugaaaagaguuguguggugguacagacugcuugauucuaaaauacugccuuaucagugaugccaagacaguaaaagagagccuugcucucagguguuccgggguaggguuggcaugguuacggaauuugucuuuuagcuugucaaguaaagcucuuuuauaccuuuauuuagaggacauauuuauauuuaaaauuaauauuuucauuagauguauuaacauuuccauaugacuaggcuguaccaggaaauuacauaugaccuugggagucuuggcaacauaauguuugacccaguuaguuucuuugugaggaguuaaacucuaaugcuaggcuaauagauggaaauaauggaguacagaaugccuuacucacacauagagugauagcacuggcuuggcaugcaugugaaugagauuaacuuugagagaugcagaccugcaguuuacaaagaaagcuaacauugaauuuugaggcaguguuacuaaauuuggcgauaauacaaauacuuuuaaaacacaagauaagggcuguagagagaagucagcuguugagagugcuuacugcucuuccagaaggcccagguuuggucucagcacccacauuggguggcucauaacugccuguaaguccagcuccaugggagccagcauccuccuaccccauagacaccccacacagcuauggacaguuccccagcuuuagccuuaccucuccagggggaacagcugugauuccccuuugcgccaauacugugccuuuuaaggcccuguuaagauuaaagcuaucgcugggcagugguggcacacgccuuuaaucccagcacuugggaggcagaggcaggcugauuucugaguucgaggccagccuggucuacagagugaguuccaggacagccccagcuacacagagaaacccugucucgaaaaacaaaaaaacaaaacaaacaaacaaaacaacaacaaaaagauuaaagcuaucgaagauaauuuauucuagugauuuaaaauaaaauacaugguuuuaagaaaacaaaaaacaaaaaacaaaacaaaacaggaaaccguguacccagaaggcagugacugcaucuccagcuuguccugugucacugauccacugccccguucaaguuccucacccuugcuggaccuuaauuuccauuucuguagaacaagugagagaugugaacaaaacagaacccgucuucugguucugauauuuuaugauuuaucuaaaaguaaagccagaucuuauagccauaucuuuagccugcauugguagaaaauacucuuuuugaaaucauuugagcagauaaugauuuuggcauacuuguuguuuuucagaaacucugugaaggcauauuuaagguccuugucaaggaggucccaacgacaugccaaguguccugccuggaaguacuccgcauucucuccagagacaaaaagaucuuaguuccuguaacaacuaaggaaaauaugcaaauacugcugagacuagccaagcuccacgagucagacgauucuuuggagaaggugucagaguucccaguuauuguggaaucauugaagugucuguguaacaucguguucaacagucagauggcacagcagcuuagccuggaacugaaucucgcugcaaagcucuguaaccuccuaaggaagugcaaggaccgaaaauuuaucaaugacauaaagugcuuugacuugcgcuugcucuucgucuugucacuuuugcacacugacaucaggucacaauugcgcuaugagcuccagggacucccgcugcuaacccagaucuuggaaagugccuuuagcaucaaguggaccgaugaguaugagucggccauagaccauaauggaccuccucucucaccucaggagacagacugugccauugaggcccucaaagcucuguucaaugugacgguagacaguuggaaggugcauaaagagguaaggcugggaaaacuacacacauccuucuggaauuacgcaucuggguuguucuuacagcugcacacaaaagaggagugcuaaguuuggaaauggaaacuguucccaguucccucauuagucuguucucuaaauugaaaaauauuucuuucuuagcuugccuucguucaagggcuggagagauagcuuaguaguucugagcacuggcuccuuuuccagagccagcccuggauucuguucccagcacucacauggugacucacaaccaucuggauugcuaguuccaagagaccccauguucuucuuguggccuucaugaguaacauggugcauauggugcagcuauacaugcaggcaaaacaccuacaugcauaaaauaaaaugaaaaauaagaguaaggacugccaucuuauaagaugacagacucuugugaguggcauaaccguuguccuuuuugagugcccauuaagaacgagguucaaguggcagauuggaaggaaacagaagacuaaugguagguucuuguguugaugcugucugacaaguuagaauaaacccauuccauugaaacugaccaacaaaagcuguugucuguuaagcagagugaaaaccauugcgugcaccugucauuacagucuccaaggggcuucuuuguagugcuacagagcccuaagaggcucaaaccacacagagccagauauucauguugacauacaguucuaagaaacaggcuaauuacaccagaaagugggaaauacuguuuuaaaccgcuagacuuauuucuugacuaagaucuuucucuggcuuggaccuuccaacaacccuaagugaggcagauuugguaauuuauauuugaguuucugcaagaacagcgugcuaaaugugaaauuuaauuucaggaaauucagaguuauaagucaagggcuaucaaucaagucuuuccuucaucaagaauccuaccauuucacauugucuuuuucaguggcccuaaaaacccagugcaguuuuagcuccugccuuugagguuaacauucugcgcuguccauuugaaguaauucucacccauguuuuugccagcagucugcuggagaaggauuaucagugcagcuauagugggagcauacaggcauccgaguuguaaagugcaaauaggucuguauuuugaaagcaaauauuugaagaucagagcuagcagcuguuucagaugacuguaguguagucagcuuuuacugagacuuggcagggaaagauguggaaagcccacaugcuccauuuaugcuuugaaaccaaauauuuggaaguauuuaaaauguuaugacucugcuuauuucguaccuucugugguuauuuuuauuacacuguuuguuuugguguuuuaaagaucuccauuuaguuguaaaagcaccucugagaguugguuugccauuguuagacuacauuguuuggaugacugacaagauggcuucuaccucagugucuguuuagcagugugugugggaggcaugugguaaggaucaggacguugagaugagcuuucuguaggaugcuucagcugaggaacgggcacuggggagcucuaggagauguugaaauagcaaagccucguuuaguguuccagaggcucguucuccaagacauaggcucuccccauaacggauggaccggugguccuuaaauagcuuuaucuguaagucaugaggcaguuagugcugcuuuuaugaaguaugugucaugagugugacacugggccaacacugaagcuugcagaaauauaaacaguacugaaaauaggaucuuugacaaccuauuuauaaaagaaugccuucauguggcucuguagucaacagucgcucaacagauguuuauaaacaauugcuagacauugucccaggcauugcagagcacacuggcaagcacuaaucaucguccuugccuucaugacacuuuaguaguuucauaggcagaaacaggcaguaugucagcaaaucgauguguaaugaaguugcguguagugcaaggagaggagagugccaggauggagacgcuucuggaguucucuccugggucugaaggaugcagggacaaaggcuuccuagaacuaaacaugauuacaagacacuccugugcuuuuuuguggggcagucauuacucagccugcagaggcuucugauccaguacagagaaaugggguggcugaggugggguggagggagguguccacuuccccuggaauucagugucuucucuuuuugucagacugaggacauuuaccucagcugagugagccagcagaaugguucauuaguguuuuaaauaccaaccaagaguccacuuuuuaaaauaaauacuauuacuuuucugcuuaggaaaacaauacacacuaauaagcagccuaagaaagaggcaaauaagggacaaaaacugcaagcuaucuguaaacucagcacucagaagacagcacugcuugcaguccagucagucuucaucgcguacugugaacagagaggcagcuuuacaaaacacugucacuuuauacucuuccucucuucccacgcuguucuugaagaacagugggcuucagggcugagggugugacucaagaacagcuccuuagcauuugugagcuccagauuugagcucccauuugccaagauaaauugcuuuuaagaauaaggguuucaaaauguguuccucuggcaggaacgucccuaggaguggccucugggggugagucuccuagguuccucaucucuacacugagaagagaaauuuuaaaaagagaaaaggaaccuuugauaguuuuacuguugcgauugucucuuuacacuuguguugugacuaagauuuuguuuggagaguaaaaagguucugcauccaagacagacuugauaauccucucucccugagagauccuagagaugaugaaucucaugaaagaacacuuauaaguuuaaaggcacuugugaguauaaacaauaccaaugaguauaaauaugaaaauagaauuccucauauuuaucggccuuuaacaaacgcuacuugcauauuuaagcauggauguaaugaacuuucuugugaagucuacauucugaaguagaugagccagaggauuucaaaaguuuaaaguuuuguaagauauauauugccugugugugugcaucugcacucucaaacccaaggcaucugacuuuaagaugcauuugccugugguauagcccagcggcuaguuuggcuuuagcuacuuuagcagguagguuuaagacucccuucguuugcauuucaccagaagcagaagauuaaugacuggguguuccuugagguuuaacaaauuaguacccauuguuugugccucaguguuaaguuccuguugccuacaaaugcaucauaacugauuaauuugaagaucccuuuccuuacagcugucucauuuccacgugugaaccuagcuuuucucucucuuccucccucccucuccucacuguuuccuucugacucccuuucuuaaaacgcuauauuugaaaaggugaaaugguuucucuagcagcguacaagguuaguucuagaaaggauaguuuuaaaauaaucuugucuuuuucuauuuuauuuucuucaguaucucuguugauggagcaauucauguuucacagaguuccuugauuuaauucacauucccuugcccaugggcccgaguacugcuacagggaaaagcugcuggucagggccagacagacagacaucagagacagacagacagcuggugcaaacagagaagcacguauccagugcucagaaggugcugugcacguaacaggaagcaccagaaacagucacggagaacaucauagaggaacaccgggguuauucuagagacugaaggaaaugggagaaaggaugggacgguugaaaaacagagcuccagcuaugcagugcuuacucaguaaaucaugucagcaaguccgugugugccuagguuacacuggguucuaaguggggcacuagugcaaggugaagcaaccugcucucaaggcacuaacaaucuaguagggaacuguuacagacccaggaaaguacaugcucacuuguguccuacucugugucugcugcuagauaacagcaggcagaaguuggugauuauaaauaauagagcuuuacuuuguuuuuagagacuggggaguccuaagugaagaagucacaucuggaaaggucccccauacucuauccuguuaugguagagaugucacauaggggaaaagccugcacgaaggagcacgugaagagucaggugguaauggugcuagccuuuaauccuagcacugagcaggcaaaagcagguuggaucucuugaguucgaggccaaacuggucuacagagugaguuccaggauaaccagguuuacacagagaaacccuacugaaaaacaaacaaacuaaguaaacacccccaaagcagcauauagacgugugaggggacuagaggucucuggugacagcacccaccuguuguuccuuagugcagcgcccacaugaccuuaaacacuucuuaaggacccuaccaccauugcuacuaccauagaaauuagauuucaauuugaguuugagagggacuuuuaaaccauaagcacacuguuuguuauagaguuuacuguuuuuuucuauauuuuacauacuugacaauaaagaaccacauaacagugaauaccagaaccaacaggucuuuggccuuccucucaggcauggguuagcuauuuuuggauaaaaauauacaggaaagaauauuuuugcaaguaaagggaucuugcacaguuaucacaagaggaaagcagugguaagcauagagucaugagaagugacggcuguaagagaugccagagcuuccuccaucuucaucucacugcgcugcgacccuggcaccacgcagccugccugccugccucacucuucuugucuguuguccccggggaugacccuuccucucuuccugggggugggguggagugucauuucaggggagaggugaaaauacugauguccuaaagacagcucaucugaguucugaaaccaggaaagaacacuucugugugcuguauuuaccuaaugguuuacuuacgguguuagugagguauaaaccuuagccccacuggacauaggaggacccugagggucagaaagcugaaguugcuucaggaaauucacacggugguaaccaacaguaggaaauacuguccauucuagcacguuuccuaaagauuaaaaaaaaaccauauauuuguguaccugugugaauuuauacacacuaugugcacacagguauuuacagaggguagaggcuauuugaucuggaacuagaguucuggguauuuguaaaugaccugauuugauugcugguaacugaacuuacauccuaugccaaaacaguaaauugucugaaccacugaaccaucucuuaagccccuaagcauauuuuauuuuauuucaugccauucuauuuuauguuuuugagacaggguguuacuuuguagcccuaguuggccuagaaccuaugauguagaccagccugaacuccaacacacaagagacccuccugcugcugccucccaagugcugggauuaaaggcaugugcuacaacacccagcugcaaauuuuauuuuaaaaaaugauugugugugugugugugugugugugugugugugugugugugugcgugggugggugggugcgccacagguucugccaugcgcauauggacaguuguguagaguugggucuccaugccccuuaguucagggaaccuaggacaucgggcuugcaagacagcauucaccuagugagccaucucucugcgccacuuucuuuguugaauaaagacuguuaacugauagcgugacucuaacaaauauuuguugagauauagacuaaaagaggagauuaaaguguacaaauaaacuacccacccacagucgacugcuuaugacaccugccaguacaauacggaagaggauuucuuaaaauaaauucuacuaguucaagcagaugcgaaaugcauugaaauccuuacuuuauaucauacacaaaaaauuaaccugauagaaaagagaccaaaauauacaaaauuaaacauuaaagcuuauagaagacuucauaacuuuaucuuaaacaacucaagcauuucugaaauaagcaaagacucuaaagaagauaaaauaaggaccgaaccuuaaagaaaauuuaaaaauuggucuucauaaaauaaguucaaagauaacgaguuaccgaggacagggacccacuccuagaaccccagcacucaggacacagaauucagcuuagugaggugcaugucgaaggagcagagauguguggcguuuuggcucauguagcacauuaaaugugcccugcaggaaagugggcacagggcuuagaaaggaacuuuccaaagagcugugcaaacggccagggagcauaagcgaagccuuuucacuccgucaucuuaacaugauauuaaaaccaagaaacgaccacgugcgaagugauuguguagcuguggagaaacuugagggugaggucccccuuugugagguguguucuaucuguaugcuugaaaauacugcuuggcaguggucucugaacuucagaauccaaacugugguguguauaaguaccuacagagcagcauucucucuccugggugugaacacgguauguuacauauaagauguaacacguauguuuauggcaccagucuucaggauggcccuaacaggacaucaucaaaggcuggauaagcacacugugaugugauguauucaguguauuugagggugaggugccccucauaugauaacagugcuucuuugaaaaaaaaaaugcaguauguauauaugugugcauguguguauguguguucacgugugugagcuugcauauguacauguauguggaggucagagguugauguuagcugucuuccucagucacuccccacuuuauuugcuugaggugaggucucucacugaaccuggagcucacuuuauccccugagccaccugcccagccccuguaauguuccugcaccguauccaguguuuucuaaucuuuggugaaggccccauacuuucucaugccauugcagacaagcaacagaugagcugucaagcagcagaaagaaucccugcaacuacauacaacacgcagcggucuccugacuagagagagacugagagucugauuugcaauuucugucauacaaaguuuaguggcagcagaacucacuaaugugguauuggaaguuagggcuuuggagcauguccucugugggaucaggagagcucuggaguucuuaauccugccauuacaugauuuuuguguugcuuacaauagcugcucauuuugugcaaaguuaaucaaccauacaguuacaguuuggucaguuuucucucuguauauuauacuugacccuuggauuaguuuacuguucuccuguuuaacacaugccuucugucuucaugaagaaagcuagugggggaaauaaagcuuaauuaaacauaugaaauuacaaauuaggauuucacaaaagaaacuuuaacaagacacuauaauauagaugagguagaaaacaaaggagcucucuggagguagaaagaagcagacagcccagguucagaaguugcucugaacagaaacuuagguaaugggcaaagggcacauuguagacagaaaguacaauuagggaguaagcgguaugcaaagacaggagauggguggaaaguggugucugcaguggcagacuggggaaagaccaacauggauaauucuuaagaggcuuguccugaucaugagccaaguucguuaccucugggaucaagaacugucugguguagaaggaagcacuccugggcgugguaguuugugcacaccauaaucuccagcagugagcaggagcugugcaggggugugaguucaaggucagccugguuuaaacagugaaacccugucacaaggcuggagaugugacucagugccaccagcaaccagggugcuaucccaguuuucaaaaccaagaaaugaucuuaucagugguuaagcaguaguugaguuugauguagguuucaugggcuucauguacuuuagggcauguaagaguucuuacacaugagagaauuuucacuccagucuuggggauggguugugaaugugacaacuguuauuccuguccugcuaguuuuagugcugguaguucccucuggucgccuucccaccucagccagcucccucuaccccaugauugcgucuugcuucuuucccaugucuuguauuggcaccagaaguugcacuacauuuccuuccuucccucucccucccuugggcuggguuguuacucagcauuuuaaagugcuuugugcgguuuucuuuacuccucacagaaccucgaguuuguggagguaugugggagggagcugaagaugagaagugacugaugugaggucauagccuagacucuugcuugacuccaagagcaaaaccauccauuauaugacugagaccuccaucuuuuuuaaaucucuaugugaugcauugcuuaaaguauuuuuagccuuguuaugaguagugaaaguguauccuguuguuugagucugugagagacaucuuagaaagacugugaauuauguaugugugugugcaugauacaugcacacauuucacuuuagaugaacuuaauuauauacuaagaacuuuuaaaaaucauugccuuugaagaaagagauucccuguaguauaucuaggcuaucauaauuaccucuuuauugcuguguccucuuuuaugagagagagagaggggaggaagggaggauggaggggagaagagagagaaugauugauugaucaccuugauguuagauacauugugauugugcuaaaugauagcuugauagauaaagcgcuugcugugcaggcgugaggaccagauuucuguucuccagcacuaucauaaagcccacuuggaguguucaugcugcagcagugauauaggcucuccggagcaaguuggcucacuagacaagccaaauaggugaguuagggauucauugugaggcucugccuugguaaauaaaauggagagcaauaaaggaaggcaccugacaauuaccacuggccugugcacacaugcagacauacaucacauaugucugggcuucacacacauacacacacaccaaaaaagaaaaagaaauuauaaugccccaagaucucauaaguagcagaaauaaaacaaauaauuuuguuuauuucucauugcuaguuccuucuuucuuguucccugucuuuaauuuuuaacacugccagagaauaaauguuggaaaaguaaggggaucuaauucugaucauuugugguaguuauauggggccugagagagagaaaagauaaaagagaaugaaaugguaggcauccaugguguuauguaccuacuggaagcucagggcucaggaggcaaagguacucaagaccaguucaagcuggguagcuaaacccuaucucagaggaggagaggaagaagcggaggaagaaguuguuguacucauugcuuuugaaagcuaagagaugaaaguuucauuaaaaaauggacaaccagauauaaaagaacugucucaguauauagcuuagauuugucguuagauuaguacacuggcacaguauacugcaaagaacagaagaaccgggacugucgagaaaugaaaauccauaaguggaauucauuuuucaaaacaguaaaacaugguagcuggaucagcaccuccugacaugggcgauuucugcacguggucguggcuauuaauugaugagaaauggcaaccguuugcuuauugcuuugggaguguuggagugucuugccauuucccugaauggaauggagagagagugguguguuagugugugguagacuccuuuguuacggcuucaacugcagcucuuccucuccacuuuguauuucccacagagcgauucucaucaguuucgugucauggcagcuguccuucgccauuguuuacuaauuguagguccaacugaagacaaaaccgaagagcugcacagguggguagccuuuacauugcuaucucagugaagcgugccgcccaugcuugcucucucuguguaucugcuugugaugguuaauuaugaguacaagaaagggaaacuauuggauucaaucagguaagccugaaccgugcgcaguaugaaaucuguuuacuguggucuuugacucuguuauguugaacuccagggucagacuugggcauuuguuauguucagcacuaaaacccagagcaguauugaacacuuugagaguagcucccaggcugaggauguuacuguggcagagugcuugccuaccaaguacaggcccucagcaauuagaaaaagaagaaaacuuacuuuaguugucacaccaaccuuuugagguagauuuuuuuuucccaaaagauaagagagcuaaggucuccuuuuuauuacuaaacuuaacaaauacuuccccuauuucauucuaaggguauuuaacagaaaguguauucuaugcaguaauaauuuaaauuaaaaaaaaacaagagagucauaauguccucuauuaaaauauauuagauagaguugaggaguguggcucaguggguaaaagggcuuccuguaagagcaccagggucugaguuugaguccccagagcgcauacagagggagguggagugcaguaacagugucugcaaucccagugcuuuauggggaaaagggaaguagagacagaagcgcaugggcugccuagccuguugcagcaggaaaacagagacccaguaucagaacaagguggaaggcagagagcaaguugaccugagcuuguuuucuuuucuuucuuuuuguaagaucuguuuauuuuauuuauaugaguacacuguagcugucuucagacacacaccagaagagggcaucagaucccauuacagaugguugugagccaccaugugguugcuaggaauugaacucaggaccucuggaagagcagucagugcucuaaaccacugagccaucucuccagcccccugacccuguuuucugaccucuuuaugugaacagccacauucacucacacaccaguaugcacauaccuccccccacaaaguaauagauacauauaaaauaaagauaauugcaguuauauaacuugucuguuaaagacauuaauggaguguugucuggagcuagggacgaacagcucaguaaagugugugucuacugugcacaaguccugggauuuaguucccagcacugaaaauacaaauuaccauugucagaaaacaguugagcaggaguugauacaguuuccaguucucuuacuugcuguggauuagguuuguaauaacaaagcauuugacuucauuagaagucuccuaguacuuauaagaauacaaagaauuacugcacuccaccucccucuguaugggcucugguggccaguccagguggcucacgccuuuaaucccagcacucgggaggcagagacaaguaagugucucucugaguucaaggccagccuggucuacaaagugaauuccaggacagccagggcuacacagagaaaccuugucuccgauaaaacaaaacaaaguugaaaaacaagaccaaccaaccaaccaaccaaaacaaauggcauguuaaaucauacacagcuacgaagaaauagcuuuugcauugacucugcuuuauaaagaaguuaacaugaguuuuuucuacuaaguuaccacacacacacacccuuagcuguuauuuuuaaaucaaaucuacauaauuaauauaauuagguagaguaauauguuuucugucaugcugaguuuaaagguagauuuuuauauacucuguacccuguagcccuucaaaaugucuucuucaugauuggaaaguauaaauucugaggugggugaguugguauacaucuguagaaccaaccauccagagcagaguacgugagcguugugaguccagucagccuggguaauguggugugagacacugacaucaaaaauguguaaauguuucccuuagucacagaccaaauuccuuuaauuucuggagacagugcccacauuaucugcaguaaguucugucuuaaaugacugcauuaagcgauuuuacccuuuguuuuuguuuuuuuguuuuuguuuucuauagaagagacacuaacaguucaacaucagaauuaaaaguguuuuuguuaaaaagcuuagaaguauacugauuuaaaaaaaaaaaaucagauaacccaggcugaggaacauacaggcuguaaagaggaaauucuggcagguagacaggcaggcaggcacugcugugcuagccucaaguagcucugccaggagucuccaaagaauggucuccagaucuuagcacagugcucagcaugugucaagagagcaaaacuacagagauuguucagauuucuaaaacguaaucaaguuucucuuccuuccuuugcuagacucacccuuuuaaaaucuuucccuucacaguuacuuugauaagauuuauuagcuccgcugugaguguaaggauguacuggagaacacagccgggauuaugaucauucucaggcgcucuugggagacgggacuuuugcuuacccagcaguuugccugcgauggccucgagugcccuuuuacucagaagaaggugauuaguaucaaucggaauaacgauggcuccuugcuaauccuuuuaacuagagagagcugcuccggucucagcagcugcugggcaccuacugcaggggccuucgcagugaccugagcacagugcuuauggaaaacuagaaggugcaaggcacauuggaaauauuuacucuuuuuuauauaacguuuuuauuuucauuaauuuguugagaauuuuauucaauuauuuugaucauauucacugccauccccuuguauuaucauucuuuaaaaguuauucucaaggguuuuuauacuccuuuuuuucuuuuaucuuuuuggagaauuauuguuuuuugguuuuucaagauaggcuuucuuuagcccuggcugcccuggaacucauccugcagaccaggcuggccuugaacucauagagaucaccugcuucugccuuccaagugcugggauuaaaggcgugcaccauggggccuggcucuauuuuuuuuucccuaugcuuugacuuaagaaacagcagagcagcaugaguaguccuggauaggguaauugugguaggaugcugacuaugugaaggucugugaagccuccuggcccuggcacugaguaaggucuuaauagcaugucugccugcugcuucugugauaagcauagugaaauuuaaacgucauauuuaguccagaaguuucuaauugccccuugaauacauuuuauuuagaaacuuacuuuaguguguauccuuugaucauauaaagaugcuuguuuucugauauuccacuuuuuuuuuuuucagaagccagaaauuccauuuauauuagaugauaaaggugcuuuagaaaagaaagagcccggcaucuuucugguuugucccugugagugugccccauugcuuuccucaaagaggugacgaggacgcaggccugagugcgcagcucacagcagcaggagccugagcucaggccacucggcauucucagugcugugcuguguuccuucaguuccuucugagcagcuggaguauaguuccuguugucugccuuugcguuaaagacaucccacuucucuuccaucucugcugugugcuuggaaguacugucagcacucuucacagugaggaagcuuagccauucauacuuggauucccagacuugcaguuaggcuuuccuuuggaaaggaaggagaaguggaaaggagggacagccuucaugcugcuaggaaggaugagacccgagcucagguuagcuggcuguaggcacuuggcucagguuagcuggcuguaggcacucaguuccuguuccuccugcacacuaaggaucucucagcucgugcuuauccgugccuuugauccaugaggagugaguuucuguguggggauauaaaacccucuucuuuuacuuggguguuggcuauauagcuucagccaccauuuauugagaagguuuuccuucccuauugcucuugucaccugguaugugucaggccguuugcaucccuuucugcuugaagugguguauuaaguuuucaaacuagaagugugauucuccaggcuuugcuuuugcaggauuguucaggcuguucagucucuugacauuccaugugaguuuuaaaauuaguuuuucuauuucuauaaaaauaucauugguaggaauuacuugacuuuggaauauucagcuccuaauaauauugccuccuaaucucucucuauaucacacuuuaaauauuugaaaaugaacugauuuauuuccauuuauauuuaucaguuaguuaccuaguauuagggaccaguuugagcuuuagagcuaaaaacgucaaagcauauaguccauucuccaaggcucaccacuuagugcauaugugagcgaaugagucauguucuguccacgcucuccuccuguccgucugcccuaugcucccccccauucccgcgagcacugugucagugaacaagcuuauaugagagauaggagagcacagacaaagauauccacuuuggagagggcagagaggacucauuuuuguuguuguuauuguuaacucucuuggcucuuuuuaaacuuaguuucuguaaauaaguuuuccagguaagaaaggauuguugaaaccaugucccgcugagugcuguucuaaggugucauaaggacauccacggcauaugcucugaggaaccgacacuaaauggggagacaagacauaaauauuaugaaaaguaaaauaacaacucaagacaagaauagaaagaccaugagauaguuuugaguaguuuucagugacugauuucaguaacaaucgcuaaaggacaaguucacugugaucugaagugagggucuuccucacagaucuguccuuggccuguucuugaccacuuccuaccuuuagggaauaauuuuucuguuaucaaaagacuuucagguuuacuucuagccuguguauuccugaacaucaguucgccaugaacaucaguucaacccauucucccucauaagagucucaccacucccaacuaagaucagaccaacaaccucacagccccgugggaagggaucuaaucuggcggaugaucuccucuccacugcaggcacaguuccucaaaaagccgaugucugcuugcuguugucacugccccucucagucaugcggaucaggaacucaucuuguuuguugugaucuguacacuuaggaccuguagccccaucugggaaaagcuguguuaccaggucacuucccucuuucuuccuugacaaccuggcccaggccucacacagcccugucagcuaauagccugcuuuuacuuagcaagauggcuuggcagcaugggggagguggguaugauugcugggguucuaaaggccuucaaacucuuucuuggcauagccauagaaaccucaaaccgucucaaucuuuacuacaagacuucaggggaaaauacuaagcgucauguaggcucuguauaaugaaccgggcaguauauucccaccauggccauaugccaguuacaucagcuucuucugauugagagcugucucucauuguguaauauuggaugaguccauggaauuagaucugaggcacuggccucacucuuaggggaacauucugcuuuugacagugucucucuuccuauugucaaacaaaacauuuucauggcacugguccacgcuuucccugccucugaaagccuacuguucugcaaaccagauggcucuguauucaaaauagucugccuuuuucuucccuagacaucgccugcuuauuugggccugugccuucgcuccaucuggaauugcuggagugcuuuuugccuagguauuugugaggcuggcucccucucaucauuuagaacucagcucaaauguagcuugcucuaucaguucuccagccuccugaugaagacuugugcauaugaaaccacgugcacacauggacguaccuacgccuguauuauccucugcuucacuuuuuucauggcauuuaucaauaacuagaauaauauuguuccauuauuuucuugcaucuuuauuauuuacuuccugaagugauuagcuaaaaaaauaaaaauaaaaagaugagacuggagagguggcucagcaguuaggagcacagacuacucgcucuuacagaggacccaaacuuaagucccagcacccaguucagguugcacacaacaacaguaacuaacucagcucuaggggauccaagacuuucuucuggccuccaaguacacuuuuacauaugugugcauaucuacauacugauacacaaaaauauuccuuuuaaaaagagaaaaaagaucuuacaugucuccucccuuccuauauaccugauacacacacacacacacacacacacacacacacacacacaauaagauauaaucauuuuuuagccucagccuccuaagugcugugauuccaggugucugauaucaugccugauuaauuuacaacuaaaaaauaaaaggguguguguauguguguaugaggugggguuauguauacgugccagggugcuccuguggagaucagaggacaggcuuauggaguugguuuucuuuauaccagagacuaaccucagguauaaaggucaagugccuuuacccucuaagccaucuccuuggcucaauuuccaaguuuuuaaaacacauuucuaguggugcauucuugucaccucagcacuaaggaggcaaagguaggaguaucaagaguuuaaggucauagucagcuaccuagcaaguuuaaggccagaugguuugcuggugugugugggacucagucucaaaguauuuacauagugaauucaaggccauccugggucacgugagagccagucucaaaaaagaaacuugauuucauguuguagccaguaggaucuuccuggcuuuacuuaagauguagcaaacaaaggauucugccauuuucuugucagaaagaaaaaagcgcuacuguuuuccuuuucagaaaucacuuaaagugguuugcccauuauauaagaauuugcucaauuuaaaacuauugaagcaagacugaagauuuugugcaagguuagcauguuuaacagguuugaggccccggagagcaucccucucccuuacaaaaagguauggguaaagcaauccauaaccuaccugaguguagccgguugauuguauuaugaccaauucagaauuugagugagaccaaggaaaggacaaaucccugcugccgcaccucaccgguaggugaaaaggcagaacaucauguaagacucaggugugggcgccagugucagugcagugguuaaacagcaaagugagauuucucuucgucucuucaagcacaaauagauaaaaauugaauauuuucuuucuguaccccagugaaucauuuuauguaacucuguaauuguaugugcccuauccuacuuuacagaauauuucuuggacuuaaugucucugugggauuaccugauuuauuuuugaucacacaaaccaguuaacaugcaguaaucacaauugugcuucuacaaccuuaccuagaaaacuugaguuuaaugucaucagcaaaccaucuuaccauaaagagaagcaggacgcuuagauagacuaagugcuuucaucuuccucuaaccugcuugccuccuccucccuucucugccugcccuucccucccucuuuguaccacaaaaagcugagguacugcuuaagaacaaagcuacagggcuaugacaguuccugguuuuauaauguagcgaauuccuguaguguuuacaugaaaauggacacauaaaccaaugaaacagauuaaagagcuugggaguagaccuacaugcuaugaauguguagucaacuguacucacacagcggugccaagaaugcauauacuuucuucaagaaacaguggguugccacguguaaaauaaugaaguuaaacuaugaccucucauuaugcacauauaagccuuaaauguaaagucuaaaacaguaaacuuagaauacauaggauaaauaagcccauagaccuuggucuuagcaaugauuuguggguacaacaccagaagaacagacagcaaaggcaagaauggcuaggugggaauucaugaaccugaaaaccugugagugcaggagacugccagagugaaaguaccccugugccauaggaaccuguuuacagaggcagcaucuaaaauguaucuagauagggaacuuguuguuuguuuugcuuugaugcagagucuugcuuuguagcucaggcuagccuugaacucacuauguaucguaagcuagucuucagcuaaccccugcuuuagccuccugagagcuaggauuacaggccuuguuacuauaaccagcacaggacuguuaacagcaccccccccccaaaaaaaagagagagggagaggaggaaagaagaggagagagaaggcaagaaggaaggauaaaggaucugacuagacagcucuccaaagaugugcauacgaaaacaugguuagcauuacuaaucuguaaaaugcaaaucaaagccuuaagauucaccucacaucuguuauaguggcugcuuaaagaacagcacaaagcuaggcuguagagaaaggagaaucuguguauacuggcagcaagguaaaacaauauagccauugugcgaaacaguauggaaguucuuuuaaaaauugaaacuagacaugccauuugcuucagcaaccacacugaugguuguacauuccaaagcaauaaaaaucaaugucccaaagauauacuugcauacucauggucaucauauuacuauucacagugucagagacaugaagaccgccugucaacagacaaauagauaagggaaauauaaggagaggagaaaagauagagacggggcagggaagggagaugacugaaaucucuaacacuagauaagcagagaaaaugugggaagugugugcauguaacagaacagcaucccaccguguaacagaacagcaucccaccuuuacaaagaaggaaguccuaaaacucccaagaacguauguagauauagaagaugcuaacaaguuaaaugaaccaggcacaugcaugauccucuuuuaauaaggaaucuaaacuagagacacuuagagggugagguccuaugcuagugauggccuagaagggaggcgugggggagugguaucaucuauuguugcuguacagcagagucuaccauuagcaauacuguagcauauauuuaacacuugguaaaaagguuagaucuuaggugcucuucccacaaaagaaaaaauaauaagcuuuucuuucuuucuuucuuucuuucuuucuuuuuuuuuauuaacugaaagagaucaggagaaucuuuugaagaucuccagauuuggcuagcuuucuuuccaggcuugaaaauauacacauaagccucaauaggaagaaagucuaugugacuguaagguucauugcuugcugcggauuggugugggccgcuagcaugcaccucacugucaguguuuguugaguucagcaguugauggaaggccaaaucuaagguuguccucccuccccacagcugguaagccuucugcguaucaggaggggcugggagccugagcuggggggguggggugucacagcacagugauuaauggucucugggaacuggaaaggagaguaauauacacagcauuucuacccccuggaguaggaaugcaaacaccauugugcaaaccugugcauuggcaccgacuucuggaagcuggagaaucucauguacucuucuaccacaaauaaaacugucagagaaugacagagcucagaaggcugaccuuccugcuuaaaaagaauagcucgaacacagcgagccagaaaauuaauuuuguagcuguuugagaacugaguucaauagguaaugagaagaaaagccuuaaacauccaaauauuuguugauuccagcucuacauuuggcuuccuagauaugcugaauuucuaaacauuccuccuggaaguggauguaaaggagaaccagcccuuuguaauagagcgacucucaaacucuucagccuggucugggauagaugcagagggucacacugcugaugcuuuccagagauggccgucuuguguuuagggggaaaucauagcauuuuggaauggcuuguaccgguuuagagaguaauucuuagguaaaguucuuccucucucuucucccgagugacucugguuccuaauaauaauaguuuccaaaugcuuaagugagaagcaagccauuuuaaaguauaaauuagguacccuggaagcuugcaagaaaagaaaucuaaaguuuguguggaaaguguuguacuuuaauugccuuugagagucauaaaugacaggacagagaguguguggcacugacagcagcuucagugaggacaaccguaacuuaggcuuuaccagcgaccauguguucauaacaacaguucacuuguuuccugacccacaguucauaccacucuuuauugucacucauuuucuguacugucuaauuuauaacggauuuucagaaaugauuuuuuaaaauuuuuuccauaauauaaagagaauaaaauauugauucaugggaaauaaaaccaugcuucaaauuguuuuucuuuuuguuuuauuuuuuagaaugucacuaugaauuacguuuaaauugcuaugaucugaauuaagacagcaucggcuggauuaagcccugacuuugguuuccaggcgguuauacuuuuaaacuacauuugcaaggguuuauuuuuagucaggaugugguuauuuuuagacgugcuucugugucacuaggaaauguaaugccugucuuuccauuguuguuuaccaggaaguccugggguacaggcuauuaaaucagcucacauaggaacacugccucuccuggcagauaaaacugugaaacgguauguggagaaagaucuccuuugcaaacaugccucggucugaaucucuacuaccauuuuauccucuugaauacugggcgcuaggacaagguuuuuagggaaugccaaaauacaagguuuggguccccugcuggugugcaucccaggcuccuauacaauccagggaagucacaaggccugggacagagaugggacaguagugugagagccaacggugagagaggaaagggggcacugugcuuucccuugaaauauaaaaaauuguauuuuguacauuagaaaaaaaacccaagucuugauacuguaguguuucucuuuaauguuguugccugugauaagcugcuuaucacauugcuucucaagugcuuggugcuguaaucggagggacaauaaacagcacuggacccacaaaagcagcucaggcccugacgagcaugcagagccaccauugucacaguagauuaaagagcuggcauuacagcugccugauuccuguucaguguuucagaagguggcgugcuguccugucauugugucuguccguuuaccauugcuccuuuuuacuuugucguggguaugguuaagacaggucuuucuuuucuuuuaguaaaugccaagucauauuaauggcucaguuugaaaaagaaaaauuuuaauugacuccuaaaagucaccucugaacuuuguauuauguuugcauuuuaaaagccuauucacucaaauuaaaauaauuguauuuucaaauugccuuucaguaaugccgucaaccuuuuaagcaauguuccagucucuuguuuggauguucucauuuguccauuaacccaugaagaaacagcccaagaggcagcaacucuagaugaacugcccagugauaaaacaacggagaaagacacagcuuugaaaaacaguaccaugguauacaauggcaugaauauggaggccauucacguuuuacucaauuuuauggagaagagaauugauaagguaagcugcuggagugggaaggcgcaccuaagcccuaugugccccgcauagagaugacacagcaugagcgcacagcuuguccuuggugcuuggcaugcuauauaguucuacuucuccaagaacauuaccaugauaaugacacauuggaagaaaccaaggaauuuauguaauguucaaauuguauuuuacaccaaauuuauaacuaaugucugaaaguaaaggaaaaauuagcugcccuguaaaugucagaaguaaaaacuaaccucuccaaaugacauguucaaaguauuuugucuucaaauuucucuagucugucacucaguuucuccugaaaggcagcagugucacauagaugggucucaaaauccuuugcuucuuugaagcacauuggcugggcuuguguaaacccuaggagaaaaauguaggaagaagcaggaaagauaaaaccacauaguaaaaugaagauaacuuauggaaauauuacauaaaguaacuuuuaaagucauuuguaaacguugguauccuccccccuuuccccucccuccccucaagaaagucuuccuauucucagaugacauggaggagagccccagccuuaggaacugaacuaauauggcaugcaugguuuucuuuauagggaagcagcuauagagagggucuaacuccaguucucagcuuauuaacagaauguucccgagcccaucggaacauccgaaaauuucucaaagaucagguaauugcuuacaucuuaaaguuaaaacuuuguauauauguuguuaacauagaacuaauaaagucucgugauaguuuucuuucagaagaucagaaaccuuccagccagaaguaaaugaucuugugcacauuguuauucauucauuuaaccagcaaauguuuacuggggucucugugcugugugcuguguugcucugcgugcuccacacugagcuuguuacucucaugggcuuugccuuacaggaggugaugaaaagaguaccuguauaacuuagcgcaugggaaguguccuaaagaaaacagagggacagaaaggagaguugugacacaggagcaccuccuuguacaggugacagugagcagaaaguuggguaaauagcaagugucucugagaauguugaagaggaucuaucagagagaagacauuuaguguucucagacgcaggaaacaaggcagcuaaugugacagaagacagaagggagaggcugucagugcggugguggacgaguggcaagcguggauaacacuuuggauucucucagaauaagaugagaaagcacuggagugcuuucaggggcuugauaggaggaccucauguggguugagaagacuugagaugcugugugugggaggagaguggaggaugagggguggcugccacaacacacagugagagcaguccuggcaacuaaaggcguugcaggcauggcaguggccagaguucauccuuugaguaugucuugaaagugcggcucacauagugcacugagagagagauggggcauuagcugagaagaagcagugagcucugaacugcucacacuccucugaaacucaagacuuggacaguaacaggcuccugacaguuucagccucacucaccuucuucucaggccccuugcucagugcuuucugcuccucugugccuuuccuucucuuacgccuaggcaagcgcacaugaaguucauggcuguagucacuccuuucuagacagcauuaacugcgcucaacaauaugguugaaucagccuucuaccuacugugggcugcuacugaacacuugaacugacuagacucccuuaacuuuacaaccaccaacaccaggcagcuuuccagaacauuccaauacauuuuacaacuccuuuuucuguuuguuuuuuguuucaaaaggaaacagagucccauguagcccacacuguccucuaacuuacuauguagcugaggauggcuuucaacuccugauccucaugccaccaucuccaguguguggugcaugcuaggccagcccucuguggacagaggugcauuuaagugccugcccucuguagcauuggauauaaguucguaccuccaugaagcucuuacuucauuugacucuugggacacaguagagaccuuuacuggucaucaucccaguacaaaauguuugcaugccuaagacaacgcaucuuauguccaccucauuccucucuuguugguuuguugaucacacccugguauagugauuuugaacacaucuguaugcugaugauucccagauacguaugcuaaaacacaaaucugagccauccucagaucgguggacauuuauaaugaacugcucauuuugacuauuggauguguaguaguuuuccuucgguauagccaaaauuaauaccauacuuuuccguccuccuuucccauuucuuaguuuuccugugccauuacuaacacaacccucuacuucacuggccauuuauaaauuaaucauugucauuuugauacauggugaaaaugaaguggacucuuuacuguguaucaagcacaugaauagugcugauaaaagacauuagaaagcaggaacucguuuauugguugauugacuuaauguaugugaguacacuguagcuauguucagauacaccagaagagggcaucgguucccauuacagaugguugugagccaugugguugcugggaauugaacucgggaucucugaaagaacagucaaugcucuuaauuguugagccaucucuccagccccaaacucacugcuuuugaauagagauaccuuagaagcaugguagcuguuuuagcaagcuaaacuaaccaaccaguucaaccuacuuauaaguuugauuccuuuaaggcauucuaccuugacuagaagaaccuugcuaaagaauaaugaaaggaucccuaauggaggagcuagagaaagcacccaaggcgcugaaggcguuugcagcccuauaggaggaccaacaauacgaacuaaccaguacccccagagcuccuugggacuaaaccaccagucaaagaaaacaacuugugggacuccugucuagcugcauauguagcagaggauggcucagucggccaucaaugggaagagaggcccuuggucuuaugaagguucuaugccccaguauaggggaaugccagagccaggaagcaggagaggguggguuggggagcagggaaaagugggaaggguaggggauuuucagagaggaaacuaggaaaggggauaacauuugaaauguaaauaaagaaaauaucuaaucuaaagaagagagagaaaaaguaaaguuagauuaaaaaaaagaaaacauuuuucuauugaguuggcuauuauuaaacaaauugcuguguuaauuuugcauauuucuuaaauccugauaagauaacugcuuucauuccucuggacuugauaaacagaaauauuuucucaguaauauuacuguuaaaucgagaguaaauuaugaauuuaaaaguggccucuugaagaaauggaauuuuuucaugaugcaaacaaauuaggaaauugucaauuuuauuguaauaaaguauauuauagcuauuugauaaacuggucucaauaaaauacgaagagagagagaaaggaaaauaucuuauggggcuggaaagauguaacaggucaggagcacucguugcacccauguuacagcucccgucucucuguaacuccaguucucggggauccagugcccucugcuaucuccgcaggcacugccuuacauaugcacagacacacacaugcaggcaaacacccauacacauaaaaugaaaauacuuuauuuucuaugauuuuuacuucuuaauaaaagcaagaucaagguucgaguuaacugucuauguuugcacuuucuaaugaggacagcuaaagaagccugucagucagucacaugcuguguucacgccucaauauguaagacccuguguguccucaggaaagacugcaguauacguaagggaugagauaagacaggugaaaggauaacuagaacuaagguguguuggccuggguucugucaggguagugguaucccagaggcaggacacugaagaauaccgcagagaaggggaggccugagccugucacucugaagguccaaggaugagggauccacccggugauaaccaucucacugccaucccagugggacuguagggcaucacagggcacauuagucacacugcuuguugcugggacagaauuccugacagaagcaaucuagggagagaggauuuauucugguucauaguuuaagagugugguccuucaugguagggaaggcacgguagcaacagcagcuucaaguugugacauagcaauuuaagucauuuguucauuucucaucagaccaggaagcagagaaggggaaagccaguauucagcuagcacguucaugaccucacagugcaaaauauggucacuccacuucccaguagucuuaacucacucuagcgccccuucaaagguacaagguuguagcaaccugagcugcauagugaaagccugucugaaaucaauaaccaguggcugggccgauggccccgaggguaagaacacuugcugcuuaaccaugaggaccugcauucaaguccuaguuagguaaaaagguugggcauggccaugugcaaucuuaggcacuguuggugcuuggcauaggagggaugaugaagaugacuggccuagcucuagguacacuaagucacccugucucaaaggaauaaggcacagaguaauaaacaggacacacaguguugucugccacccacguauaugccugcaugcauacacacacacaauaacaacaagaagugcaaaguuccuagagucaagacaaccuucugucuauaaagucaagaugacuuuucuauuuccaguaugcacugauggcacagccacuauguauauaauuuuauuccaaaaaagaaacaaaaguggagaauugguguaaagucccucggagaagggcauugaguuuuguugaacauugccaguugacugcuugcugaucaugcugcugaucgcccuguuuuugggguuccuuuuauggcuccacuccagcaucuccaauguguaucauccuacugggcacucauugcaggggcucugagcacgcagcaaacuucugcuuggccgucuuggaaaucuucauugaugcugucaugaucuuaugagucuugcauuuugcauaccugcagaaucagcaccauguagauagcagaaaaauccgccucugauaugaacucugauucugcuugagccacugcugcagcaacagaaccuuaucagauggacacagggagacaaauccugugcuggucuuguaucggaagccagcagagagcacccugggcucaguccuugagacaacacuaucccgaaagaucucuuggccuguaaugggggguggacgauuugggagguggccucaaggcuuuuacaggaaccucauaauuagcauucuugcugauaucuaacagucugucuguguacuucccuaaaccauucccuuagucacuuuuucuguucauuccuuagguaagcugcaaaucuuauuaauccucuauuuccuuuugcuuccaacacuuacuauaaauccaacaguagccaguaacacuaacaucauagcccaguauuuuauuguuuugaaauuucucuguucaaauaaacuaguucagcuuuccuaauuucagccuugucuuagcacaugaauucaguguggucaaauucuuuaugacaguagaauaaugauaguuucccccuccccacagcccccauuuucccaucagauucuacuuuccuuccaaaauuaguuuccuagcuccuuccucuucugagcccuuaccagaacuuccaauuaaacuccauuuauaacacuugaaauuuccuagccuauuccuccaaauucuucuaaccucuucuaguuaguuacccaauuccaaagcugccuccccauuuucagguauaguuauaguaacaauaauacauguaguuacaguauacauacacuauuacaauagaauacaggauauguacaagguuuacauauaguuacaacucuguaguaguuucugguaccaguuuuucauguuaccgucugcucguaacuauugcagugaaacccugaggcagccuaaguuuacagagaaaacagguucuuuggucccagagauugaagagaaaggcauuggcacuggcuuggcuaggugaggcuugcacggcacguggcagaagugcacguucacagggagcaucucacgcagaagccagcgugcacucgcccuuccaacagcucgcucuccugcaaggcuuccacaguugccuaagaacagcccugaggucuuuuuuuuuuuuaauauuacuuguuuuauguauaugaauacacugucacugucuucagacacaccagaagagggcaucagaucccauuacagaugguugugagccuguuaccugagcucacaguuaagguuagcuuacaccucuugccaccaccauaguagggaucaugcuuuaauguauggacccuuagagaaugcaaggagaauacagcacagucuacacacagggagauaaugaauauacauccuguaccuuguccaggagccucccuugccauagucacuuacagaucuucacugcuagucccgcccacuuuccugaaugguaacugaaaagcuuaacgucuccuuuucugcucuuuggauguuggccaaaauccugagcauauuuguccugacacuccacucccccagucccuguuccaccacuguuuacagacuccagugcugauuauaacucaaagaccugacuuccucucuuccuuuucuccaucucccuccuagcagcugccaaaauguacagccugccugucugguuguuuuucuuucagacucuaauaaaaugguccuuggauuuuaaagaaaagaaagggcagaggaaggaggaggaaagagaaaaacaagccucuacagaggauacagcguagauagugcucaagaaaggcagacccuaacggcguggcucgcugguggggcacgugcuugacagucacagggccacaaacucaagcucuagcaccaaggggaaaauaacagauaauuaacuaugauaaugcuguaauugaagcuaugucuaauuacuuauuacauguaguagcaacuaccuuauuaaaucuagcucagucguacacaaaggaaauuggccuugagugcucuguguuugagcaauuacaagugaaaacuggaaauuacugacccagguuguauuagucuagagacucagagaagaaaugcuguguuugagagaaaaacuggauacaacuuaucaaacuuauuggaagaaagugucaauguauaugugcccuuugagagugacaggaaacagcagggcaguaagucuuuaagaaaccccagaaauuaacugauagauucugcaugcuaacuuuugucuguaguuguacacacugcauauuaaggcagucuguagaaaucaccuauugggugucucauucuucuagagauaaggauuaaacucaguagaauugaauugacucagucaaauaggauguguuuuaugguuaccuuaugccuuacauuauacuccacccuucuagagguauuuuauauguggaucuuauagacauuuggauaaauuccuugucugacagguggucucuguuuuaauuuauagcuuuauuucaauucccuguauuuccugguacacucacuguaaauaaagagagauggaaggggaaaaucaguuaacuagauuaaauaaaugcuguauguauacagccuacauagguauagaguaaaauguacuuugacuuuguaaugggccucauuuccuagcgcaaggacuguucauauagaaggcacuuucugugacuuggguauaguuuuuccucuaagaacaugucuuagagacuugaugucaccagaauggcaguggugggugaugguguagaaccuuuaagagguauggccuuauggaaacuccacagugggcacugccucaguggggucaagguaguuccuaugggacccuucagcucuuacaggacaaacugaggagcuggccugacccuugaaugcuaccuggccuuuuauuucuccuacaaacaccccugcuuuuaugacauccuccuccauuaggcccucaggagcaguagaaggaguggguaggaucuccuguucuccugcuuucacucuccagaacuguacacuaaacaaaacuccuuucuucauuaaguuagcuugccuugaguauuuucuuauaguaacauaaaugggucaauaauuaaaaucacuuggacuuauucauuucccguuuaagucaacaaauauuuguuggacaccuacaguguuccaggcacuuggaagagacuaauaaagaaaggagaaaaccaucccuaugaaacuaacuuuuuaaaaagauauuaggggagagagagagaugcucagaaagacacaucccacagcaugaggugugcaucuuaaaauguacuuuaguggaaagaggcacacaguaaauauuugcuauuccagguggucagagcaugagaaggauuguggaagauuguugguggggaaugggaaacaguaaagucagcgagggaagaggucagggaaugguuucccuucacugagaggagaccaguggggagggagggagggagagaaggagggagggagagagagacagagagacagagagacagagacagagagagagagagagacagacagacagacagagacagagagcuguuauuguagcuagaauagagaaaaaucguuggugaagaaagguuaucucuccuccaacuuuuuggauuuaagugcuucagauuuguaaugguuuuagauuuagggauaucugcccagauaucuggcaguggaacccaaggguaaauacgaaacccuuucauguuguguaugcagcugauccccagagcuuuaagguuguuuacacauuuuagcaucccuuuaccuagccuaucacaugauguucauuuucccugucacaugcaguuucuauuugugacaucauguccgcacucaaagguuccagauuuuggaguuaggaauauucaaucugaaauagccauuauacaauuaaacaacuaaaaugcaugaauuaaauaucuauuaugcuguuagaauuaaaagaguugagcagucaguauggccugggccacugaggaaguaugugaaagaaugggaaagcauggauguugcugcaggugggggaggugcaugugugaacauacccacauguauguacaggguagaagacaugacaaccucagaugcuccaucuuagacaccaucugcucucucccucacucuucccucucccucacuguccugaaacuggccaacuagaucccccugucuccacucccuucugugcaagcccaugcccuggacguuuuccuguguucugaguauugaauccggucacacagaaagcacuuaacuggcuuuauaaccccccuuuugcuuuuggacucagugucgcucugauggggcuaaagcagacuuugaacuuuuauguucucucagccuuccauguacguggaucauaagccucugugcugucacagccagcaagaaagaagaacgugacacagacuucaaauuaauuuuugcuaggcaccagaacacugcaggugcugcaauagcacagggaagacauguuucuauccacacagaaccauacaugagauuauuugaggucuggauguugcugguuaugaugguaguuuauuucauguuauuuggaagcucacaguuauuucuauuuguuacucaugcuaaaaacuuaguuauaauuccuuguaagauuggccauugccucgugccacucucauguaucccagcacccuccauugaugauggcuucuuucaccuuugcaaucagguuuuaccgccuuugagagaugugacaaaucgaccagaagucggcucaaccgugagaaauaagcugguucgucucaugacacauguugaccucggagucaagcagauugcugcugaguuccuuuuuguccuuugcaaagagagagguagguuaaacucucuuugccuuauguuuuuuaucuuugggaggaaauuuaagaaaauuuccuguuggguauagcauuuuauugcagucuuugcaggccugacuacuuaccugcugcuguuaagaguggcuacgcagaugaccagaaguaguacucgucaucauuguuguguguuccccaccuccccagggcaugcagacacauacuuucccaaacacacaagcgucuaaccuuugccugugugugcuuaccccagaccuuguagugucuccggcuugggagccauugucagacaccugucuuaauccaggugaccagugaccaguacgguccugcuucugcuuccucccaacaucccagggaaagguugguuuccucacugacucuucagucuguggucacagaauguuucucaugugauauacuugauggauguccagaagucuguuaagguguggccuuugcccuugagauaacaaguaauaucucuucuuuguauaguaucuuuguauagaaaucacaucuaaguugauuguuauuucauuuuuugaugaaccccgguuuuguaagauaguuaagagaugaaaaacaccccugucaaaaucucccccgcccucucccucuuccucucucccucuuccucucucccucucccucucuguugaacuuagggucccauccaugcuagucaauugcccuaccacugugcuauauuccucaaauuuuuaaaucuucuguauccuuaaaccuuguuucugacuuuuuaguuuaaccaguuacguuccuauaaagauggcacauuauuagcaacauaauugaaauguuguuauaauguugauaacgguuauuagcagugacaggugucaggugcuugacccucuuucaaaccacugccugacccacuaaggacacuccacugguaacauggcuucacuucagcuucuucuugaacaagauugaaucggccaucaguagaaagagaggcccauuggucucgcaaacuuuauaugccucaguacaggguaacgccagggccaagaagugggaguagggggagguuugggggacuuuugggguagcauuggaaauguaaaugaagaaaauaccuaaauaaauaaauaaauaauaaauaaauaaauaaauaaauagaagaaaaagauugacuuacaccuuauaaucaaaugguuaucacaguugcucacauguguugccaaaauaguggcugauuggaucuucuuagaucacaaaugagcuauagggagauagguuaguuaguuaagugcuuacacaaagaucugaauuagagggaaggagggagagaaggagggagggugggugaguaggcagguagguggguggguggguagguggguagguagguagguaaguagguggguaacuaagcuaagcuugguggcacacacuuguaaucccagcaguggagaagcagagacaggaggaucccugggaaaagaaucccuggggcuuguuggcuagacaguucaacucaguugucaggcuucaggccagugagagacccugccucaaaaggcacuggacagcauuccaaagaaaugaugccuaaaguugucgucuaacuucuacaaacucaggcacacacaucugcacccauuuuaaaaagcguguguguguguguguguguguguguguguguguguguguguguacacgcucauaaaacuacagcacauauacccguugcccacucacuuaaaacuggaugucagagcggagggagauacgcagcaugagaacccgaguucagaauccucagagcccacggaaagccgcgcgcucgccgcugugcgugucuguaaucccagugcucccacagcgaugauguccacaggaggcggacauaaaucuccaugcagaggccuuacccagugcgaacaagagaaagcaggaugggcggcugggaccggcagcuagccgaggcuagcuccccuccacccgugccauggcacgcuugccugcacucacacccacaaaggcuuugggugauuacuguguucguagcacuguuacuucucacggagaagacuguugguucuguauagauuuuuuuauagugaacauacauuucuuaacuuguacaucuuuaaaauucauaaugaguauguaucuaaggacagugccaccuuacuggugagucggugcuuagcaaaugcagcacauacuuugcaagugaacucugugguuauuuucauuugagauaguuggcauuguucuuccuagaauaucuaguacuugggaaguuuucuaauacagcugaacucagaccuagccuagcucagcgcaguuauuuuuguguugcuugguuuuuguuuuuggauuuuggauuuuuucaauuaaaauuugaaauuucugcugggcagugguggcacacgccuuuaaucccagcacuugggaggcagaggcaggcggauuucugaguucgaggccagccuggucuacagagugaguuccaggauagccagggcuauacagaaaaacccugucucgaaaaaccaaaaaaaaaaaaaaaaaaaaaaaaaaaaaaaaaaaaaaaaaaaaagaaauaucuuaguguaaucacgugauuuucuuuccaaucuuauuagaauuguauaaauguauucuuggaauaaaacccauuuauucaagggcgggugagauggcgcaguggauacagacggguuccugcucuugggcuucaccaccugcauuugacccagacaucuagguuccauacauagagagccgacuacugcaggugaccucugaccuccauaugugugcaagcacccacgauaguuaaaauaauaagugaaugaaugaaugugaugaguauuuuuaugcuacacacagaaguauacaaaacagucaggauuuucacccucauguuauuuacuuaugcaaauaacugcagcagccaaacccuuagugaugaaaauacccgcaguguccaugugaagugacaggugaaaauuacccuuugcagcaguuuguugcuugaggacugagggcugcagggauuggugaggaggcacugcuguucaggugcaacucagugcugcgacuaaggagcugcugaccagcaaguaacuuccuacuucuuauuagaaauagauucuucucucuuacaguacaugccaaccacagucgccccucccuccaccacucccugucccuaccucuuccccucccccucauauucacuccccuuccaucucccauuagaaaagaacaggccuccaagagaugacaaccaaccaugacaaaacaaacaguaagacaaggcagaagccuucaugucaagucuggaccaggcagccaacuggaagaaagagucucaggagcaggcaggagaguuagagacacaccagcucccacagugaggaguccuacacaaacaccaaguucacagcuacagcacguacacagaggaccuggugcagacgccuguaggccccgugcuugccacuuaagucucucuggacaccacuuuccucugggacuccccaaauggugaggggaaacacccagugaggaccuccccauuuaggcucuccccauaauaucuggcugugggucucuacaucugcuucuguugucugcuagaggacaccucugugcugacaacuagacagagcccugaucucugaguauagcagaaugccauuaggaaucauaggauugauggauugguugauuucugccagucaaucugguucuaccccagcucucuggacuagccaggcuuugguuccuggccacccaggcagugccgggcaugagcucccucgcagggaguaggccucaaaucagaauuggucggcugcuccugaauguucuguaccaccauuucccuguaucacaucuugucgaucaaaggcuguggcugcguggguguccauauuucccuucccuagccugcagaguaccuuccugcuccaaagagacgagaguguagugaggaaggcuccaugcuggcaccgguuugaccuccccauggcaaagcacaugcagauguuuauuuuuuucuugcuuucuuugaaggauuuauucguuucccccaauuguuugucuuuuccuggauuucuuuaauggauuuauucauuuacucuuuaaggaccucuguuaucugaaggucuuuuuccugugcuucuccuguguuggaauauucugguccugcuguuguagcauugcagggccuuaguagagauguauugcccugguuguuauuguguucuuacacaggcaucuaggugucuggguuuggggugauuauaggucuaggugcugauuucuggauuugucuuuguuggguggguguuuuguucuucaguuucuguuuccugucugcauuuucagagugugugauggcugugugcuaguucuuuuacuggucugcuaggcuguguguucauagggaaugccugcuggugauggaggcugggaagcagugaugagucagaggagggaggucaggagggauagucugugggguccacaagagaaguggacaggagggaggccacagcuggugguguguugcugugccagagagguugagggacugggucuagggaaacagaguggaggucugcagcaacccagcugguuuucuggcaggugugaccugcaguugagggauaagguguugaguggggggagggagguuaggaggugauggucugugggauccauagauccauccaugugggcaaggggggaggggaggcugcagcugguguucuggugcagcaguguuagcacugugccuaagggguuggcucugggggagcagggagagcagcaaggucuaugugcaggccaagucaugucagccacaguagcugaaguuucuuaaagaugcacaaacccaugugcagugugaaggcgcuguagucugugcucaaaccacagaguagcgcaguaagcagcagucagaagcaagaagggucaaguguuaacagacuaggcauggcaggaacgccuaggugucugaaauccccaucugugccagggcagccuacuucucuagccagcaggaaccaaaaugcuaacguguagucagguuaccaacuuguguugagcugugacauaacuauaguuuauuacuuucacaaagucagcuuccuggaaauuaugcuaagcaaaaacaaaaacugaauucagaaaaaccaaugcuacccauauuuucuuuuauaugugaggucuaaaugagagaaaaaugugaauccuaaauguguaaagggagcuauuagaaggggcccaagagcugagggugccuguaauggaaugcauguagugugaaagcaggagaaggcuggucucauggagagggaacccugccggaaggggguaagggggaggaagagaauggauaagaagcagccauagggcuggagagauggcucagcggguaagagcacugacugcucuuccaaagguccugaguucaauucccagcaaccacaugguggcucacaaccaucuguaaugggaucugaugcccucuucuggugugccugaagucagcuacaguguacuuauguauaauaauaaauaaaucuuagggccagagcgagaaggacugagcaggcggaggagaccagagcaaauagagccaaccggagguccuaaaaauucaauucccuacaaccacaugaaggcucacaaccaucuguacagcuacaguguacucacauacauaaaauaaauaaaaucuuuaaaaaaaaaaaaaagcagcagcuauaaugcggugaguagggaaacagccaaggaagcgcaucguuuugccugcuaacauuucaguacaauucuucuuacaauaauauacucucuuccagcuccuuaaaaauagucuacauaguuuagccaaaagaaagugaucugugaaacauuucacgccuuccguauguggcagccgcauacggaagugguagggugaguuacaaucaguucagcuugagcugccuuguccagcagcgcccccugcagcccugugccaccugcagcccugugcccccugcagcucugugcccccugcagcucugugcccccugcagcucugugcccccugcagcucugugcccccugcagcccugugccaccugcagcucugugccaccugcgugugccucccuccagcucaggcugcgggcgggccuuuggccucucucuagcuugcugcuaagcugcuucuuugccguucauguuuuucuuccugucuuccuagaagccuuccucugugaguugguccucucugugcuuggguuuaauuuuuuuuuaagcuuuugcaucuuggaaucuugaaauacugaugauauugcaugcgcuucucaauaugucugugccaggccaggccuggacggccuuugacagccguucuuuucagucuccuuugcugacacucauuccggucccacauugaauuccauagucacccucugaacaccacugucucacuccuggcuucugccucaggaugaaccuggcaugcuucgccuguggaccgcacaucugcaccugaguuucucagggcugccucccucuucugucugacguggaaugcauuuucuccagggcccauguuccucagccuuucuguguccuuugcucacacccucugugaagggacgucaucuacaguuaccccgccuaccuucuguacauguaaaaccaauuacaccuuacagauuuuacuuccuagauaccauuuuuaauuuuuuucuuccauuuuguucccacaccacuucauguuauaugccuuuaaaaucauuuucuuaaaauacuaauauagucagaccuccuguuucuaaucagauuauuuuggucugucugccagguggcuacuaggguuuguuauaaaauguggacagaauguugccauugccccugugugagcucgcagggcuuccucaugcuugccuggggaagcccacauucuacucccgccccuugccucguagaguuguacugugucaguguaccccgucugcuucuaacuugaugcuuuagcgcuaccugggcugcccuuccccauggccucagaacacuaaguuuugucuucgaagagcaccguggacucaucugugaagaacacucuggcuguugcggcaaaguugauuuucuucguccugccguuuugacucaucuguguuguuucaagcuuccccauuggcugugcuguaacgauguagagcuugcauccccaacauccagcuucuucacacuggagaucuuguaucuuacaggcaguuaugcucccacaaauguuacuuaaaagagcaaacugcucccugggaguucagucacgugggcaguuagcaugugucuccccacagugggaauaaguucuuaaagcaggguugugcuugcuacaguggcaaccgggagggacacuuuuaaguggaaguaguuacagaaacaaacaauucaggaucugagaaguggauacgauagaacauaacuuuagaaagaaugggcugcaagacaggagccguucaaccuacugguguuccagccuuuagggggagcaggggaggcguccuccaggaagguaacauaguuagcuucguacugaacaaaagaugucuugugcaccuggagagaagcagaaaugggaagauacaggucuaaaaaacaguacuaguuagaggagcugcuggaucuagaggacguagaguuuaacuggauggaaagguuccuacugaggagggaggagaauggucucugggugugccuuccucucaguaaaggaauggaagcccugcuuugugguaaaacaauagaacuaaugucuguguaggcuuucaacacugccugccagugugugucucaccagcacccacuguguggcuacauucucucucuaguaucuaguauccuuauaaugucagcuuucagggagucaucugauuucagcagcaucuucagguaauaacugacaguuaccaugacagaacaggcauccuugugugagcccaugagugcacauacguagcaccaucagaagaucuuuccuuuuuugguuagccagguucagucaguuuccuuucuucccuacacaguguccagcaggguuucagugggcuauuuagcagcacacuggaagggaagcgaacgcuucucccgcacuccucucugcuaggaguuuauauuccacuuaacucccgucucugcuucccaauaucuuguuguuuaaaauuuuaacaaaauuuuauuugacuuuauuuuuggagcauuaauaugccuuaaaucaucucuguaacccauuuaucucagaauugacauauguuccaguaaaagagcaguaaauauucuuucauuaaaaucucaggggucauuauuagcuaggcauuaguguucugagggcuuagauuugugguccuugaucaugaguggauuuguaucugaccauugcaaucaugucuuaaggauacauauauacucuagacauuuguucccuuaauucauuaugcauuuccuaacuuacuugaaucucugcaucuuaaggcacuggcagcaagagacagcguaucagauuuauuaagguucagauuacuaccccucauuaaaugcuugcauaguguuugcugguagcacugaggagugcaguuacugauagguuuuaagguuagaaugacgaguguaagcugaguguggaggaccugccugugaccucagcauuccggagaccuaggaaggaggaagugaggcccaggccagcuugggauacagaguauaacucucguuuaauaucuuugucuuauuagcccaugucucauuuuauacaaauggaaccaguuuuaauauuccuugagaggagggauaguuucauguguccguggaguggcuauuuucucuaucaaaggggugcucuccaguuaaacacucaaaacuuaacagcuuuauucauguuucccaggcucuuuauaguuacauacucugacuagacuaucuccuaucucuuucucuauuuuagcccuuuauaauaaaaaguuaauuuuaguuuuuuaaaauuuauacaugaauauuauuuccaacccgcaccaugccaacuccuccaugcccuauuuucucaaauuccugccuucuucuaauauaauuaugcagacauacacacccugcugagcugauuuaguuugcuguuaugugccuguguuuagggcugcucccuugggauuggccaaccucagagagcuccucacuggagaagacggauuccuccuuucucagcagcuaccgagugccaggcacucuucaccuaaggguggggccuuaggaaauuucuccauccguguuggcauauugacugauggugucaucaugcaggcuuuauuuaggaagcuacacuggagauguaaugggugcagcauccccuuugugccugcaaaacugucuaguagcaaauacccuguaauucucgcucucacagucuuucuaccccgccuucccagugccuugagucuuagguguaaguguuccuuguagauguacgggaugggauguggacuccacugccauuuauucccuguguguugaccagucacgggccucuguaguagccuccaucugcuucuuugacgagggaugaggcucuauuuaucugugggcaucaggguaaguauuuagaaugcaguuagagauuagguuccauuggggaaaugacaguggugguaucuucugugggguccaugaccucuccagccagcgauaguugccuagcuuguaguaccaggcuuagacagcucucgguuagccucaggauagcaggguuacuguugcaccacugggacucucuugacaggcagucauaggcuccaugcuggcuuggacugcugcuugcuuuugucccuuggcagcuuuuauacaccuucagauccugggaaaguccuaagagaggagcuucccaggguacuucccgcuugaugccuccaaguccugugucugaagugugugguguccucaguaguggggucuuccuucaaguucuggggagcaaccaagggcaauggcaguggccuauauuggacccuuccugaucaacaacuuaaauagggguuucccaugccugucacugggguuucuguuagucuuuuagucacuugguagggagcauuaucaccauaugugacauaacuccaugcaaacaacacacgugugcauacacacacacacacacacacacacacacacacacacacacuauguacuuguaaguaagcuuaugguuguuuucaaacauucuuagaguugcuuuucucucucuccuccuucaguaugauccucugucccagcggaaguccacacauauuuuccccuuccuccuucuuagcaccugugugugcuucucugaauuuuucuagcauuuuuuuuaggugaaugguauaaguuguggugcuuucaaauguagguuuuaucuuggcuuuauacauggauaaauguauaguguuguuuucuacaguugaccuuagcaugucauuuuaugaacauacuacucaaagccuucaguaaaguuuuuaaucuuuuuauuuauacauaauugugcaccuugaaacgugccugaagaaaacaaaguacacuuauauaaaguugccuauaauuguucaguauauuccuuaaaaguuuauaagucucucugucucucucucucucucucucucucucucucucucucucacacacacacacacacacacacacacacacacacgaaugcacucauguacacauucaugaacacacaccucuacagugcaggguuucuuugcaaagauuuuugugucagcucauuuaaaggauguuacucugucaguagggucauacuuaacagaagaccuguaucauguauucaucccucagacucugugugugugugugugugugugugugugugugugugacagagagagagagagagagagagagagagagagagagagagagagagagagagauaucuaacacaguaguuaaauguaguauucaccaaagguaaagauaagaacugacuuuuugcugcaaaguuuucuaaaauacucagugagagguagguaguucuuauuccauuucuacagaucagaauugggguagagcuauaaaauauuuuauccaaguucagccagcuaguaaugcugauaguauuaaaaucuagccagucugacucagugacuuccuauguuuauauguuguugcuaacuuuuuauguuaauguguguuagguccacauguauguguacauacgaaggcccaaaguugauuuuuggugucuuccucaauggcucuccgcuuuauuuauugaggcagggucucucaauugaacucagagcuugccaauaccuaggacauccuuccugucucugucuugcaaggauccacccaucuucuacauggguucuggggaucugaacgcuggucuucaugccugugucacagccaucuccccagccagccccauccugcugacugguacuuuagccuuuccuauuugcuaauauccuuaaguguuauuauuucuucuauauuuuucuuccuauucccuuaaggauuaaaaaaaauuaagguuguucaugccacucaugcaaaaaucucaaucugacuuuuauuaucuuuaguuuuaaaaaauaagaugagagaucaaaaaguuaaugcaugacucuuacuguaggagcacagaggcucuacauuugucaaaguguguacagaagaguaauuucagaauuccugauaccuaaagacaguuucuucaucuucauagcagcuaggagcauuuguagauaguucuguuuagccacuuuaugcuuaaagcguuccugccauggcggggacccccaccuccucugugcuggugaguggguggugaugguaaguacuuaguuaggaucccugucuaaaacucuauuguguuuuugcaguggauagccugcugaaauacacuggcuaugggaacgcugcaggacucuuggcggccaggggccucuuggcuggaggaagaggagauaauugguacucagaggacgaggacacggacacugaagaauacaaaaacgcaaaaccaaaguauaguacuacguuucuguucgcuuaaguagcugugccuuucagggagugguuugucuucuuucuuuggcucucauuguccauugcuuccucuugggaauuuguaaguuuuccaucuccugguguuucuagagacagcuucaaacagucccuuagaguaacuucacaugauugaagaagcaugagucuuucaacaagucuguuacccucuuucaagaagcaaguguguggugacgauuuuagaugcugauaaucaauuugaaagaguguguuacuguuugccucauaacauacagcugacaccagguuuuuaaguugguuuuuugauguuucagucauuuucaguacccuugcauuaaaccucucgaaaguccaaaaguguugcaccaaggcacauaacuccaaaaggaaaggagcuggcucugcacugaauuauuaucaaacauacaugugggaacucggguuuuaacggguguuucagugcccugaaggaacaaaccugaaauucugugaugucucuaaguugggauguaccaaggaaagacaucgccguuuccuuaaagcagcugcccccucucuuccaguccuuccauccuucccccuccuucucauccuagccagcucgagaugucuucucauugcuagcagucauuggagcugaauuuuuacugggucccguuacugauugcuaauauggcgaccuucauugugagcauuguuaaugaaacugccgagcuguuuuuuacuggccuucuucuagagaaugauaugggucaugaaguagguaaccaagaauagaaaaucaccaucuguaaaaucaagaguagacuguguccuauugacuugaaaauaauaaauuuccauaaagugaaaaauuaccaaucuccagucagcaggaacaacauagccuauaucuggacaaacuagguuugagugcuuauaguguuaucuuuaacauccugauucucucagcuucaccaugaucuuacagaguguuaccuaagaaacagaggcucuaguaggggaaggaaugcuagcaguggcucuugggcaguaaauuuuauagacuacugucacuuagaagcuguggcuugaaaaucucugucgagaguuugaauauaaaauagaggaauuauacuuccuuaagucaguauucugcaucagucucacaagcucucguuuugaauaagucuauaaacggcauuuccaaaucauuuuaacaguuuguggcuuuucguuugaggcuuaaacauaaaguuguuuaaaagucccucuuuuuguuggugguguguuuggagguagaggcagguacucacuguguugcauaggcuggucucaaauucauagacuccggugacccuuccacccuaacuuccccaguaccugagacuguaagcauaccccaccacaucagcuaagagucuugccauuuuaaaggaagauggagaugacauaaacuauuucucaaauuccagggcagguagagaacucauaagagcucacagauguuggcaucuuuacauuucaguauauaugauugauuuuuaucuaagaugguaucuuuaauuaucauagucacauaauuagaaaguacagaaugcuaccacaacaagcaggagcucaaagaaagcacaggaacauugugucucucacuagugaaggacacuaaauuuuaucacagaggugauguuaggccccaggaggggacuuuuuguuugaauccguauuguugaugucugacaugguuacugucugagcucucugccauggauggauuuauacuucggcuuuguagccuuaauggugucuuucucagcucuuaggcuuggccagagucauuacuaauguaaagucuuguguuugaaacauggcuccuuacuguuugaaacauggcuccuuacaagcauaaauucauguuuucagauaaauuucacccuuuauacagggccuguuuugcuuucagugcacccucucaagaggaaaauuuuugcuauuuaaaguguucuuccuuccaggggccccuguggaagugacaguggauaaaaugcuuuaucaauaaggcaguacaauaaggugacucucagagcucagagcacuuggcagcacuuuaaacuagucugaucaaacuuagaaagguggcauccgaaaggauugcucauuuacuguacccucugccacucagcaugcccagggccucacucugcuucucuaggaugcguuuauucacaacaguugcuaguauuggcagaaguagucacucuucauccaguuggcccaagucccauugucagaaauguaaguggauucugauuaaugcaccaagguaaccuguaauccuuuauuggaaucuaaaaccaagaauuguguggagcuuccaucccggcuuugggacacaguuaauuuuacagcagucuuuauugugucaaaauaaauguauuuaauggacuggaaauggcuuucugcaauuagucgcuuuuaaacaaaguacacucauagaaucgagaugcaugccacauggagauguagccaggcuugcugaguucucagauacaguccuuuaucgaaaggagaugcuaucuaagcuuuuguuuguuugauuuuaaacaggaucuuauuuuguagcccuagccuaaaccucacauuuagguuaggcuggccucacauucacagagaucccccugccucagccucccuaagugcagcguuaaagccuguaccacuacaagcagcuaaaugugaauuuucuacugcuuucuccgaugccucugagcauagagccccuggauaacugguguguuuucaucauccuaaacaucaguggagagaugcauguuuaauguguuuaacugacuuacuuccagcuuuggaucuguagcuuucaggcuagauacagagauauccagaggugucuuaggggcugccuuagagagguaggaggggcagagucagaaguggccagaaccccggauaguuucugacagucuucacacuaguuuguagaguccagaagcacuuuugggauaguugucugacuacagugaucucagaugcuggagcacugucacacaggcuguuucuugagcacaaggcaucacgcugaguauucuuccccuugucaaaauguuguugugcggcuuaggucugcugguaauuguccuguuauuauauacauuguaugguuucaauuuuucuuaaagugcaugaaccacaaaucagacuugaagauuuuuuucccuuugccuaaucugggcuguauuuguauagacuaggauuuagcuagaaaguaaggcuuaugacuauaagcacucagugaaauacauguaaagucuggucacaaaaagaccauaauugaaaagaaacuuauuacuccuccugccuccuccauagcaccucuacacauguaacagccuuuguaacuugcacuuucagaauggaauuuucucaguuccaagcugacacugaacucagagucccccugccacagcuuccccagcgcugagacucuagguacauagcacuacgacuggcuucagaggaaacagcagcauccucacucgggaaacaauguacacaacauggaacuaacguucuagccauuuagcaugugagacccaguggccaucaguccauucacugcugcacagccucuuuuacacagguuucacuggauagccuagacugaucuucaaacccacaggcuggccacagccuugagggugcugggaugcaggugugucugacuguguccaguuuaucuccagacuguucgucuuucccaaugcaacuguucacuucccugcacccucuccuagcuucuuccugucuguaugugaaaucauauauaguagucguccuuuuuacuggauagcaccugauagcuauggcuagaucuucauauugcacuuguuauuuaguuaugccuucugcuuuaacuggcaccacgcugaaacuuuggcucuguccaaaauccuucccccuuugucuaguaccagugacagaaccauggcuucuugcacggcaagcuagugcuccaccaccaagucacaggucugucucucugguacgguuuaaaucagcaccaucuaacugaccuuguugauucugccuugggacuuuucauuacauucucagcucaacaguuacugggauccguguaaaaucugagucagacaauauuaguugcuuaaaacugucuagugacugaaagccaagguucucacugugguuuguaugcacugugucucuccgcccguaccaccggccucuucacuacuugucaaacacgugacuucauguugagugucucuguguggagcacaccuccuccagagagcugcuguguuacccucccaucccugaccccacccccaggucuugcucaggucuguucucugugcagccuguguagugccgucuaaagccugggcuucuacauuucccuccuaagcaucccuguuccuuaggucugggguuuugucccuuuguuugcaagaagguaaguuucaugaggaaaugggauuuaaaaaucaaaagucugucuuucuauaaauguuuguugacuacauuaauauauuuuuaauuauuuuuuguuugagucuuucgccugcauguaugucuaugccccaugugcaugucagaugccgggggggugggggugggggucgcagaagagccugucagaucuccuggaacuagaguuacagacaguugagagccccuaugugggaacugggaaucaaagccaguuucucugcaaaagcagcuaguguucuuaacugcugacccaucucuccaaccccuggguuaauacauuuuuggagcuguugacugaguuagucaacagcuccaguggagaagcucugguagccaggguggggcuuaggagaugaaggcauuguuuuuuguguugcuugggaaggugcaggaaccagguguuguggggaggccccaggaaagacagcguggucuuuaucccugcagaaccucuucccuacacaccugcucccuucuuccuuccuggucuagacauacagaaauaagugccuuucccuaaaaacucuguagaggguguggauuuaucagcauggaagcagaauuuugcccacagguaugguuuauuugguuugucccauguaguauuuuuuuguuuauauuuuuguucucacuuugaaaggugcuugcuaaucccuuggcagcauuuaggaugcagacguuucagaugagaauguggaucucuagcgucuuuagaaaacugacaaguucuccucgugagcagccaaguccucacacagcagccagcuuguggaauugagcagagggcucugccauagcuggcauguaugcgcugcucuggugaccugucuugcucgccuccuugcagaucugacaauugcauacgaguacauaugcguugcaguuucucuucucuuuucucccugccaucucugucaguagcccuucucuacagaucccuuucccacccccauacugucuauuguuuugugaucuacuguguuuaaccagggcuuaucuguguggcuguggauuaaaguuugguggauucccgggggaggaggcacaacugaaaucacugacuccuuucccagaaccucugagcagucaguaguuuuaacaacaaugcacaaugccagcccccgugaaucccuccccuuugacaggcccguucuuguuccugaccaaugcaggcaacugcauaaguucaugguugcaguugcuguguaaugccaagaaaacggaauuuuauguccauccacucuuguguucuucccuggauuccuugaggcuuagagauagugauacaaguguccugugguuuugagcugaguucagcuguuccuuuuucucagcgccucgagcagccaagaguuucugcauucuccaccauuuauuggagagagaagcuucccugaagcaguuaucuucccuaaggaaugcuaucuguggauauuaacguagauguuuagaaggcuuugaggccauaaaaauuagccccucaagcuaucaagcuucaauccugacuaucaguacuggacuugaaauauggugcagaaggaaccaggaaucccauuagagcuggugucugugcccugugggucuggcuagugcugcagcaguguagcccacccccccccuaucuuugccagaacucugaguaaaacuuaagcccugccuuuaaagguugaagcuuucauagagccaaguuucuguguaguucuuuuuguuaagugaugcugauauuaaccagaaacagcaauaguuagaaggauaaaauaauugaaauguauuucaucuuuuauacacacacucacaccauuuuagugugucauaauccuccuguugucaggccaugacaugccaguucauguauccacaggaguucaccuaauuggaagauaaaauuaaucacagggcuggaaugauggaaagggggaggaaagacgagguaaauaaauaaauaaauacauaccauucuccuaaggcccaccacaguuaguguccuuggaggaacuaagacucagcauucaaacauaguaaaaauaaccucagaguuuuauaguagucggauuuugaaacauaaaugcuaucuuugauuguauguauguguucauuccaaaauauccagcuuggcauuauuguugugugaugacguguuuucucuucuucuggguggacaacguaugaaacugacuaaaagggagagguagcuccugccugccuucugugccgacauguuggcguuuuucucugagagaguggugcaguuuauuguccuggcuugggcuuuaugugguuuugcuuacgucccccugaguaucauaaugggggaaaaaucuguuuaaagggagacaugaaccgguguuugcguccuguguuuaaagggaggugggugugugugugcagggguguuaugguguugucuccauggauggggaggggccucccucugggucaugcuuacuuggaagcuaaccucagagcaagcaggaggcucuaggaaacagaugcuauccccaccaauggacaccuuuaaucccagcacuugauuggcagagacgugcagagcucugaguucaaggccagacugcucuauacaaccaguucagaacagccuggacuguucacagagaaacccugucucaaaagacagacggcaacaaagauacuaaggaaagaaccauugugccuaaccuaggacccugugccugacugcgcugugggccugaagcagcacaggccuuaccccgugucuccugacauguuucugagggacacaauugucugugcuaaugucauuguuuucugaaaagucuacaggcgugauuccucaaaucacaccucuaucagugugagaagccucucucaaguggcaaaugagcaugcucagcauuguuuauuuauuucucuuccucuaagacccgauuuccuuugcuugagaguaguguauaucucuaagaacuaucuuuacuuaguuguuuuuauaacuuagcaaguagcuagugccaugugcccgaacaaauaacaacacagcaucuccaugcaucucuucucagaaaccucacucaguucucuuuguucuuaaguuugggaaauucagggaccccuuuagcaauuuugugauggcaucuaacuagagacuuucucuucugugggcaccuuuaaaagggagaguuaagagcauuaucugaacggagcacuugagccucguccauccugauaacaugggaaacuuuauauguucaucugaggucaggccagcucuagguccccaagaauuagaauuaguguguagucaaaauuaggacuaugugaccaaucuauauaguuuucagguugccccaagguuccugaagcaccauagagaauaccuagaagcaaguggguaggagcacagagaagagccucugggucccauaucuucugcuugcccuguuccaucuuuucccugagugacuccaccauguucugucuugcacauggguaacugaugggaaaaagagguuuucuugguuuguuccuuugccuuuuuagggaagaggggguguuagggauuuaacucauggccucacaaccuccuagauuuucagcaagugcuuuaccgcugggcucuaacccagcccccuuuaaaccuuggcaaguuacucgggcuggcuuuggaugaauuuauacuccaaucuuucggccccaagcaggaaucucagguauacauccagcagaacaaauuuuuugacuacaguucuagucauuggcccugucuaagagcagcuacacagacuuuaaaucugguuugcuaagacagcaaagacagacccuuccacaagaaucuguauggugauuugaggaguauagaaaaagaacaggaaaucugguaguaaugaguggugguuacccacgcgcuaaccuucccuguaacagaagucucaagugggaguggacacuggccacccgaggagcagggguguuagugucuuuacugucacaugauaguuuuucuucaguuuaccccaagcucccagcaccgcacaguuuuacuugaucaucucacuggucuccuuauccuggccaggcccuggaagcccuuagaaaagcauuguuaccgugugcuuucugcagggguaccaugauuuugaucauuaaagcaaucuguacuuggcugguaugagauaauuaaugguaguuaugucuucuccucaagaauaauguuuuaagguauugauauuuagcagauauugaaagcuguguuucauuuuccuuccucaguacaaaagaaaagauagaaauguggccuuuuauuucagaguauaauuucucugcuguuaggacaucauacaaagcuuauaagaaauaccuaguucuugagcauuguucuagaucuguuuccagaaagcuaagacgacauauuugucucuaguugggcuagcuuucaguuuuuuccucagucagaucagaucuaguuaacauuaccuuucugcuuuauugcuguuuugagcacuccuuaccucuggucucacuaauggacuaauuccccgagaugauacaucgacgugcucucguuucagauugcagccucucguuagcaugucucagguccccccgccuuuuuuuggacauguuuguuuuaugcuguaucaugaauggauuuucucauuucacuucugaaaguguuugucaccuugcaguuagugaaaaagauuugcauccaaagagauuuauucaguggcaccaaucaaauuuuauauuuuuaaaaguaaacaugacuuaaaaaauaguuggcaaguagucaguuuuaauuuuguaaaacucccauuuccacagcaaaauaauaauaauaaauaauaaugaacauuccuauagcaaucuauacaauaaaauuacuauugaaauuauugccaauuuuuggcuauuauacucuuucuuaauuaaauuaaaacuuggaccagaagauagagaaagagcauaauucuaaaacauacagcauaacuuuuuuuucuuuuuguagcauuaaucuuaucacuggucauuuagaggaaccaaugccaaacccuauagaugaaaugacagaagaacaaaaagaauaugaagccaugaaacuugucaacaugcuugauaaacuuuccagguauuguauucccauccauuuuuugcuugguuucuaagaauguucuacuucuuugucucucucacugagaguuaccauagaacagcaacucuggaaauccaugucuguuggaacagaggcaguagcagcuaagugccgccauggcguuucuccaugugccgcucgcuucugggugugcauuccugcagccugccaacacucagugccgaggcagggcccagcuagagguggcugugacauuaaccaacuaacaucccugucuuccaaaggaugcugcaaguuaggcucagugauuuugcugcugcuuguauuuuuguuuccgucuguuuuggauuuuguuugaaaccauggugcgcuuuuucuccuuccccuuuuaaugugcaaguuugcaguauugcuuuuugaguugcugcugaaaccaagaauucuaaaaugucaucuaugcaacaggaagaaguuaaaagaaauagcucuaaugaaggacuuuuuucuuuaaagcaggcacuuuuacuaaauuagggauuccaaaaccaucugccccuccccucuugcuucacaucuccuuccuuuccaaauaauccguauuguagauaacuaaaucaagaucugcuaauccacacuagccuuuugaggaguuauuagaagauggucccugcaggcuuagaugggcugccuuacucuccagucaugcauugagccgcuguucccugugaguuaccugagugagugguucuuuguguuggugacagcacagccaucauguaaaugugaaucucuucugcucaucucauuuuccacacaacacauaaucauccaucaagagaaacaacaauuggaauagaacagccauggcaggggugggucugauggcaaagcaugggaagcuuagcuacacugagaacuggaccgacuguggguuggcagcauuggagcagacagggcuguuuugacacucuagucuuacgcaggcuuucugcaguggcagugcuaacguguagaagcugguuagaagcagggaacuuuauuaucuacagaguagucuagaacuugcuggcugcccuauuccugaguauuugucccuucccaguauuggaguuuacaaccgugcuugcccugcucagaagacauucuccuuaacauuguauacaacaaguucuuucccaggaggaauuaauaagcagucauagagacuguuacuugaacagacuuauauuaagcagaauagcaagcuaugugaauauuuaaagauaaaaucugguagcuggggaaagaguucaauguuaaaguacaggcccuggguucugagcacacuaguguuuuagcacacuauaucauucacauaguauaaauuucuuuuuaugacaauaggaauugcugacagcuaucaugggugcuguauuggugacccauuuuaaccugcaugaaaauacccaaguacaaaacacagaaaaugaggaacagacugcccaagauaaugcaacauaaccuggguacuuacguauucauugcgccaucaccaguuucaggagguacccuuuuaacucaccuaagacugagaggcccuucucuuuuuaaucuuagacagaucuacacauuuuauacauguuuuagaagcuaccaauaaguaaacacuuaaacaccaaugcugaaaugcccaaguugcaccugacuuacccugucucaaggaagauguucauugacuaagaagcacccagcugaaggugguacugauguucgcaugcauaaacagagcuagugugucuuauguuggcuuugaugguuccuauuuugcuguuaaaaaguugaagugaaagugaacuugaagacauuccuaagucguguugacguuuugcauguugugugguggguuuuacacugucugccugccugugugugcuugcuaacauuuggucucacuaaugacagcgacagcuguggcaaggucagcaguaggcauuccagagcaagugugcaaagaacaaagccauucuccaugcgucuuccauguucccugugcuguauuagucauuagucucaagcuucauuucucuuuucacuuuuucuuauuuuugauaaaauaagaaaaaauaagaugccauacaaccaaguagacuuuaaguucaguacuguacaaggaacuaagcagcucccaugugcaggacacugagcuaggagggcaagggcgauuugaaggugagugagacaguuucuagcuuuggaaagcagauacuguagugggagaaauggcuguacaguuuauuccagaauacaaaguagaaauggugacaaucagggucugugcugaacugugugccccaggggaaaggagcaguucauucugugugaaagguucagagagucuucccaggggaaggaagugacuuguggacugcucaucauguugaagaugucacucuaaagagaaauggaaaugaccauuuacuguaggaagagagacuuuauccuuuuaaguuuucagacuucauauacugcgucuuucuucuaagagcucaagcaguguauuaaaccucauugaccaaugcgaaauucaaggaccacagaaaugcccagaacauguccaagcugauggcugcugaaaauccauuuucucuuggugguuuacaaagcugucgcugauucgcucucuccagcuccaugcuaaaacgaggcuaggaacuucauuguccagaacucgaggccuuugcucuguccacuguguuacucugucugucugucggaauguuugccagaacacuucuuagucauccucucagcagucucuccugcacugucgaggaagggcgugugaacagaggauggauuggagguggcguggccaaggcauggacacuagacacuuccuuuuuucauccguaggagagcagaugugaaggaccugcaccaggauggugguuagcaacaguggcccgugccaaagcacuuaccaaagugaugacuaagguuggucaugccaaguccuauuccugagccuguguaggguuuagaugugacaaaaguguaaaauuacuacugugaaacuugaggucacauuuccaucuugcuuucauguagacacgccacuuccauaagggacucaugcccucgguaucuuuaugucagcuagacuugggaagguggugaggagguuagccaucagaagacaucuuacuggauguggauugacuaaguagcauucucagugagucuugauuuguuuaacauaaagaccgugucuuuguuagauguuucuauuccucguguggagauggcagugcaccuggaggaacccuguaaccccuguccuguccuguagagcugguucagugccuuguguccuaugcuucccaagugugugaggaugaaaaugaaaauggcugaccccagauuggaagaucagggguuuuuuguuugguugguuugguuugguuugguuugguuugguuugguuuuauuuucucagguauagaauaaccugcaggagucacagcuuugaaguguaguugucauuuccauuucuuggccaaacuucaucaaaguagaggcuuuaaaggaauagcauaaagaaaugugggccagggcuaacuaacugaaauaagugguaugaauuucuuuaaucuaaaauaaguaugauauuuagcagucaagguuacagaagguauaagguuacagaaaacaucauuugacauaacaugccugccucuccaccuccucucuccuucucaaacuuugaaagcaaaaauaaaaccccugcacucaagcaggggacuagagugguagcugcagguagccagucccgugugcccggcacagcugucucacccagcaacagcacacucacacuggaacacuaccaucagccaugcugaccaagggcaaggacuucuuaauuacaguuguuucuacuccucuugucccuuauuuccuuaguugacaccagacuacucucauuucuagagcuguuuaaugagacacuuguccauuugcuuauccagcaaagucugugcuuuaaguuguaugucaguaaguaaacaaugccaguucugccagcacucuucucauccacgcccuggccacugacugugccucccacucccaccuugccgaugugugggaccuggcaucuuagugcuggcaucaaauaugggauaguacucuugaaucaagagauuacuuuuuuaacucagacaguuaugauucauuuacaucuggaaaguaagagacacaugauuuuuuuucaguguaaauaaauccuagugcucaucuuacaaacauagcaaaaccuauaauugcacaugccuuugaagaguuagucuagaauauacuuuuugggugcauuucagaaauacaacccaccuuuuuuuaagcauuguaagaccuacuguaggcaccaaagaucuuaagguucaaaaaucuuaaucuuaagacagcagcuccuuugggugugcacuguccauugugggaacugcugguccauggcuccugagugcuugaagugugguuacuccaaauaaggacguccucuaaagagaaacggagacuagaaugcaucuuaguaaauuauguaguagauuaugaauuuaaaagaccgauuuucauacugaauuaaacugaagucaauuuuaccuuaauuuuccuuuccuuaguuggacauugacuaugcagcuuacguggcggcuugccucauauuucuaacauagagugcuguucuccaucauuaagguuccaugaaaacucagcuaagggagcagcuuggugcuuuauauacuggcacagccauacaggaacaagaggggauuacuucugagaaggcugaugcuaugcaucuuuaggucguaggggacuaucucaguggccaggcaccuaaguaggaugucaugaacccuuuguauucgcugcugaaaggcacugagugcuugguuaaagcccaagcugaaauggcauuugacaacuagcaaaaggagauaaaaauacugucuguccucagucaccuuucuccucugauugggagcaugugucagagcagguguccaugcuucucagcucgaugugcacacugccucccucgguaaucuuguuaacauggacagcagaguaaaagaguuuucuaaggauguuaccaagaaguaauaaagauugccauuacuuaggcuagaacuaaauguguucuuucuccacgcucccuaaccucauccucuaacauguccuuaagugugcuaucuaaucagaccauagcagaacuuuagaagcuuugcaugcuaucuucuaacagaaaugagaauaauaaaaagcuaacucagugcuucaaaauguaaaaaaugcuuccauauguguacccugucgaucauucagacaaucuuucagcuaaauaggauggggguuauguuauuaaggagugagccaucagagcuuaagugucugacuuaagagcaggcauuaaaaugacacccucuggaacacacuauuuugaaaaauuaccaacaacucugagcaguuugucagucugauuauuuuuaaaugagauguaaguuuuaaguaaguacaaagcaccaaagccccacagugagcauguuuaccuuggcagacugcagauccgaguguggagauccagcccacacuccguuuccucuuccauaccaagaaucggcucauaguuaaguaacugcucgaugaggagacaguaaaaguucuaccauccuucguuauagcuggguuuugucauuguuuuucaaagaauuaaugugguaacuuaacaaauucuuacaugucaucacacugcuaaaucuuaacuuuaaaauggcuccccugggagaaauuuuagaccauucccaaucccauuauaaaauggaaaggcaugguaguaugagcaguacccaugaccuuuuaucuugcucauauuuacacaccucauuuuacuuuccccauggugcccuguccuagaccacaauggugagggcugaguggaagaucucagaauuauuuauuaagaugcaguuggaggaucuuuuguuugcugugggaaagcuaccauuugcauuauuucuccucaguagauaccgugguaaaugauuaaccaguuuaacgaguuguacuaguaagccauucgaugaagagugaagaagcaguguccacaccaaaggccaccacacucccagcauccaacauaguuaugugacuccuguacuaagagugguuaccagcagugagaaagaacccagugcacuuuagaggcuugugacuccucacugcagagccacacccucugggcuaucaggggaucuauccccauaggcauuuuauguucauuaaaauacuucauuuauauacuaaugucucaucccauguuccaaaggugaaaaggaauuaaauaugaaauggcuaauuuaacaugucagggcucuuuuuccagaccaaccucacauuaagaacaggaaucccagugccaaaguaacggcucccaauuauccugucuccgguuuuguuauacacugaacagaagucaacaaagcaagaguguagcagaacaugacuaaauagcagcacccucauuaaaacaagaauuaaucagggugauuaaaggaggcagugcuucauagguuuccccuuucucuucuuuucuaaucauagaacaaaauacgcuacacaaaaggaucggaacuauuauguaguacucaauuagagggagguggauaggucucuaacaugcuguuuugucaaaagagcagacugguguuugcaugauuguuguuucauuacagacccugucauuaauuccaugucaauacugcccuguaguacacagagcagacaagaaagaagagcccuugaaaacaagggaaugauuuuugagucguuaucaagcuaaguggcaagcgggaagcugaaacucguauagguaaauucgaagggacucuugggagaugugcaagugggaaacaaggauguguuuuuaccgacugcgugauugugcccugcuuucacaagugcacuugaauggaaugcuuuguuuauccugcacagcacaugugcugugggcaagaguauucucuggcuuccaggucaagucaggugguacacagacacaucugacccaguccccauugugcaguugggcauguuacugucugagcccugauacugacagucccugcugggggagucacauaggaacuugaagcccuaaaacagugugaccaucucuacaguuccaaggagcuaucacagaguaucacaccaacaggaagauguuaaaauauaucugggaaaaaaauauuauacagaacagaaaauuuuaaguauguuuaaauucuguaagcucccaccccuagauuuaagaaucuuuuguuuuucuuuuuauuauuauuaauuauuauuauuacuauuauuacuauuuugguuuccauuggcagucccaaggguuaggcuguggggcaaaauaggcuuucuuuucuuggacgugcuuuaucuguguccucuugccuggccacacccuuauagacuaugauuccuuaucguuuaguaagaucaaauuucuaaaugauguuucguuccaguugaacauucuuggaggcuuaucucuucccuggccagaugccugaucagaugagaagcccgccaugauacugucacagugccuagaaugggcucuuuauccaguagacaucacuguacuuuuuggugauaacgggggcagucuuaacuguguuaaggccuguauauagcauugaagguaaguaugaagcaguuguugcuaugugaauaucuuaauccugauacacauuucaaacaagauguuuauuggauacccagccaucaauuuuuagagagaaccaucauaaauuuagggccugugguaacucuucauaaaaagacucagcaaagggcaugaugccaucuggauccuguuugugguacuugccauugcuuuaguaaucauuuaaucaccugcuggcagauggcagaaaagauuuguggucaugcuguaugucauugacaggcaggugcugcauugaccauuagguuuagaauaucuugauuaggauagugauuuugagugucuuaaaaaccccaggagcuuuuuaagugauucaaaauuauuaguagccugauacuuauucuuaacauuaguauagaguauuggggaucaucuuguccaccccuuccucauuuuguagcucagaggcaaauggcuugcccaaggacuuguaauagacuaauagaaaauuugaagcuagaaucuagaacuccuaaugucucaggcacaagaagcugagucaguaccaaaaggugguugguugacuuaagcugggccaucagcaucaucugaugacggugacucaucaucaaagcuguauagccuagggaaugcuucuugacacacaguccucugccauucuccauuuaggccacagccaugcacucugcccuuuuggcaaacauuuaccaagcacccacugugugcucuguccuagaugaaaaucacagccugagaagacauggcucucugcccucaagaugagcacagucuugcagagagcaguauauccuuggggagcauuccguggauuuccuauggaucagugauuuccuucuucuguaacaugaucuccuguggauuaauaagccuuucuugauucuauagcaggcuuuccuaaagaucagaaauccuuuccugaaucuauacaucuugaugaugaaaaccaaucugcucucagguuuagccagucuuguucaugacuuagccgugaggagccuccagauaccugacuucuguaagaaggccagcuaaaugcaguucacauacuuaacugcggcucugcucucugcggcaccgugcuagaacacagaggacacuaaaacuaaagcacagagcauacuuuccuuaguaugucagagcagugucauuuguagagaucaaaguuuuuaguagugcuuauuuuuaaugagcauucuuaaauauggaagguggcuuuugaaauaggagacagcgauccccuggacucgaugcagcucgucagccuuagugcccacccgggaucuagcccuccaugccucgcagcacuuuugagcuuucuuuuuccuuuuccucagcugagccaaccugcuugccagcccugcacauaacuaacucuugcuuuugugccucugccugacuaauucugccucugggaugccucucccacuauaacaccgugucuuuucacugccauuaauuacaguguguccccgagucugccuccugcaaggagccuguagcaaugucuuuuccuccugugucccaccugcuugugcauugccauacaauggugagggagcauugcugugguguugauaaauagguucugacucucuguccauagcuuacugacauggacacaaacagcugacaaugaaaugacagaugaccagagcaugcacuaagcugucaguagugagucuccaguagugacucagccagaguccuggauacagaagaccagagaauuagucagagaguaugagaaucaacccaggguuggucacaagcuagcauaugauccauuccugcucucccacaggacaagacaucuccuugaacaaauggcauauacaggugggcuguuaaggcucaggaaggcaggguacugcuugucgaucaucuuaagcuuguugaucugcuguucuguaauucuuucaguauugggguguguguguguguguguguguguguguguguguguguguguuccaaacuguugacugaagcugcuugaggacagggaccauuaccucuccuccccaccaccagucaaucaggaaggggaagcuuucuguaaauguguaaagaacaagaacccagccacuccacacaccauguguagucuguagucugugcuuucaugaccacuuaaugagaugagcguuccugauccaguguuauagaaaauaaaaucagaauuuagagcuuccaguuaaugugcuggaaacucacucacauucgagcauuagaacccaggucuggcuuccagaccucucugugccuaccacuccccuacaguaaacacuugaguccucauacuuacagggcccuuagaucuauacuguugcaguuguugcugccacugcugggcugggacuucuuacgucaucacugggaaguaggcagagccaguauuaucaugacccccauuucacagauagggaaaguaagacucagaggcaugcccaagaucacacagcugguaaguggaggaaucuggacuucagacuuccuaacuuacacucuguuuacucuucacacaacaucacuuugcugucugaauuuauuugcaugaaugcaugacucuggccaaguuucacugaugcccuuccuacagaaaugucaguagauacaagcauugcacggagccgugugggaagggaaauaauccaugccuucugaggagcuuccauuuuaauagaagggugauacagugcuugggaauaguucauaugugagaauuuaaagacgggugaccuuuguucuauaaauuaacucuuguaauuugaucaugaaacugugugaguaauuguucccaauuauagaguuggacuaaaggguaguaauaaagauaacaaacuugauuuggaagaacucuuccugggauugcaagaagguagcuggguagcucacacuggucgcuagccccaguguugacucuucuguuacuguggagguaaaauuggugguagugcuggcagggaugcugugucuuugcuauaccugccucucuggugcuucuccuuaccauccagcccucccauaccucacagccugcaguuaccgacaccuuuaaaccaggccauuggguggguuaaguucuguguuucaguuugguuggcuuggguuuggguuuggguuuuugaccuuuugagccaggcucuuguuuuuacagauguguaucacacuugucaccuuuagaccuagaaucuucuuauccuucaguugccguuuccagcaaguuguccccgugcuuugcaucaguuaucauagucaguaucacaaaauuccgcaucacaggcagaacuagaaaauacgaacucuaaguugugccugggcuagagaauugcugauggcucuccacuggcauuucuauaugcuugccacaaaggcagcugacauucuuuguguccuggaaaagaguacaguuuccuguaucuggcucuguagauagugcuguguccuuaguauccacccuggagccauaggaaugcucuccuacucaccuucuccaggcccuuccacaccugccuuuccccugccucagcaauaguccaucuuucucuccuuuuccauacaccauuauaguguccuccuaaugccuuaccugccugccacugcuccagugacucuagcacaccacucgcagagggugugaaccaguagacauuguacaggguagaugcuaagcuccuuacuuucaaguuaaccuuuaccucuugccccucacuucuucccuaaacacuggucccuuguccagccucacaagaacagagcagaaaaggugagcuaacacagucacacaagaugacgggaccuggugcagucuccuuugccuggcacaggcucucuugucuauggugccuucucugccucccccagggaauguggcccugcuuccucucaggagccucgggguuccauuuguaguucuuucaggaccuuucagccauucauccagggcagcaccugcccuguccuuccucuucugcccagcagguggcaguuccuuucauguaggugcugagcagugggcucagcugccuuccaugcacucagagcagucagcugacaugggacuuacugcagacagugcuggacugggauuugggaaaccugucccaggcccagguccaucacugaguggccuuggguaagucacucugccuccuuuuaaagaggggaguuggacuaaaugaucucugagggcccucuaacuuaaagcugaaugacucugcuccuguugccuacauauaacauguaggagccucaguuuagcuagccaggcagccauccacauuucccaaacagacgcuggccucagaaguuauccucugaggcuagccagagcuacuugcuuuaaccaggcuccuguugcuuuaaccccgucacugaacugaacucaccuccccagguuuugcugggcuaacacagugauauggcugcccuuucccaggagggaagccuucuuuguguugccugaaaagacagucgcaagaagcagaggggaguaagugccauguaccccucaccccacagccaccaacauuacagcugcugugucauguucucgggcagugaugcccauuuccaugagaaaugaguguuaagcggcuccugagccuuugacgguccucaaguguacugcgagccuauugggaguggaaggauuggugcuagcaacucaauagguacauucgucacaaucuccauguaauaaguaaggccuaugaaaagauucaauaagucuuuccuggugcuuuuugauuggcuuaaucaauaauuaaucaucuuagaugaggcuguaacuuguggaguggauacaauuggauuaggugaagagagacaguuggggugcuuugaagagauuaaaauggcugucaaucccauaauuaaacugccacaaacaaaagcaaugguguuuuaaacaaagagaaagagagagagagagggaaggagaacuuggggaaacccgacugguuugaagagaaccaacaaguguuugugaauuggagaugauggcagcgacccaagccugaccaacugauucggcuaaaugaaacgugccuuuaguucugagaugagcaggugaaccgccggagcgucagccucucuaagacaaaacagauccacaagaggaaaauaaaguuaauuauucaaacccagagagaccugcuccuuguccugagcgcauuugggccuugacuucuccuccuuuaauuggcuuagguuuggcuugugugaaugaagccuuucaugucccucuuucuccaugccccuuucaucuuucuauuacaaauacacagagagcucgggagaaaauacuuugguuuuuaaagacuucucuuuuuaaaaggcuguggauuuggaugggggagggugugugugugauguuggugaauacuuuuuuuuuucucuuucuuuuaucucuuuuucuagagaggaguugcuuaaaccaaugggacuaaaaccugacgggacaauaacgccuuuggaggaagcacucagccaguauucugucaucgaagagaccagcucggacacagacugaaagcaucaucaccugcuccacucucaauauggcuuuuaucagcaucuuuucucuguagcuccaggggaaucuuuuucucuaaaacguuuaugcccucgcuuuggcuagaaacacauuaacugguuuacucauugggaauccagcauauuuaagagguaauccuguguuuucugcaacauugaggcauucauacagagcugcaguuaggcagaguugcggggcuagaagcagaagcagacaucccauugcaccaggacagaguacgggacuucacucggcaagcagcccuggucagaucuggcagucuuguugccgaagauucugcguguccuuccacccacccaugucaacugccccuucugagucucuccagcgaccuggggccccugagggcccgaggagcugauaaauaagggcugaggcaagugacuccuuagaucagcacugacugaacgaaagccaggcagcuguucuguaagccuagcccuacccuucauuucaguuuuauacaaauguggaaacacacacacacgcacgcacacacacacauggccccagacuuacaaaccuauuacacucuaaaagugugucauuuagcgaaaacuugagauuacauuucuuccugggaggaguuagaaguaaugguuuaguucaggcagcuacacgugccuauuuaucccucguuccugaacacuacuaguaccguagggcuggaccaccaucuguaccguugcguccacagugugcauucugagguaucacucagggugccaaguacacacucauccuccaggcaacagagaggauggggcuccccgaguagugggaguucuuuuguggccugugcuggggguagggagccaacagcacccguuuguacauaaaggucauucguaugucacauguuuuaaacuggggucucuguguguauuuguguguguguucuaccuuucuaccauaugucaucaguuuaaugguaacuuuauuuauuuaaaaacaaagaaacacaaauaguuacuauuaaacugauuaaggcuguuuauuuuuacuccuagaaauggucauaugaaguagaugugcaaucauguagacagcaggccaaggugaucaguggcuaaaguugaaaagggguugguuucuuucauauauguauguguguguacaugcgcauacauagauauaugcacacauagauuaugugcuugaccacugccuuuuaaaacuuuaaauuaaauaaaacauuggggaugauucaauuuagccaucuguguguguguuucuuuauggauacguggucuaaggagacuauugcacagcuuauguuuuaaagucuuucuccaccugcucccucaccugucauugugcagccucuuuccaggacagagugugcauagauagcauuggugagaauucguuuagcuucaauggucccuggccuuugagcuaccagacagaugccaggaaguucuuaaaauuuacucugaagggaacccuuaaagaguagucaccaucacuaagauuuauauucauuucaaacauguuuggucacuuggacuuugagcccucaccccacacaaaggcagagaagguuaguguguuucaagcaggcacccuaaaaacaguaaaaggcgucagccgggaguggggagccuucagugcccagauuccuccuccagauccaaaugggggccagugugcacagcaaggugagcaggaagaaacaccauccaaggcucagcagauagugugugugacagguggccagagacagcuuuccuaauaguggcccugagcggcucuaaaaggaucaaccaaaagacuuguaagagacucgggaauguccguacaucaaggacucucauccauaacuauuguuuuagccaauggcaccacccaauaagauuuucauuuuauucugccguucauaauuuuaguuaaguagaaaaaaauucagaggagcaggaacuuaguuauuuuguuacuucauucuacaaauucauuucaaaaguauuuuuauaaucucuggucagauagcuuuuccaugagcaucagccuacgaaagcaugcugugcccggugaaacgccaccuugccgccucugcgcaagugcuugcacagugccguagcugugcuccgacgcuuucaacaaguuccuuucaccaugcaucucuugcaucuaggcacuuaauuuuuuuuuuuaaggaguaauucuuuaaaagauggaguagcuucaccaugcacacagagagcacugagcagcgagcuucaugucuucuuuguaaccucaccccaucuccaagcagagccuuuccagagagcugcuuaacuuccuagacccucagcaagccaggguccagcugugggcuugacaccugcaccuucccuguugcauguaggaccacuagccagaggcuuuaagacagcagacaggcugcggaaggugguccuucucagaccauuuuaagcaauaacuauuugagcagcagucucugguguucccaucagggagguaccugcacgagcgggagaagcuuggucaguuagcagauuuuaggugaagaccuggacacccuuaggucagagagcaacagugugggucgguccuccagugagaggggucagccagugaccacggccguuuacauacacuggacuugggaaugcacgcccuaaaacaaggcauuggaacuccucagaggaacaguuuccagaugucuguggcccguuugcauguccagugguuuuuaguggcagucagggcaaaugcuguccuuucucuauaaaugacagguugaaugaagcuuugcaaauggcuggacagcacccuggcacgugagucuugcugcccccaggacuagguaucacucuccuucagcuuucuuuggccccaccuugucuaucagagucauacaugcuucuuguagaauguuuagaaagugcggaaacaguaaaacuagcuauugacccagagcccucccacccccgagagcaucacuguucauguuugguguauuccuuuccuauauuuuuucuaugcauauauaauuuauuuuacuacaagauugggaucaugcuguguuuacagauuuguacccugcuuuccuuaacauugugagcauuuucccauaccaauaaauagucuucaaauguug

SEQ ID NO: 5674 - RNA, 999 nt, Mus musculus
aggacaucgguuguggcggugugguugauuagggugcugcuuucaaucguguggccuuugggaaccccgcguagccacugccgccuccuucuguccucgccauguuccucacucgguccgaguacaacaggggugugaauacuuuuucuccugaaggaagauuauuucaaguggaauacgccauugaggcuaucaagcuugguucuacagccauuggcauccagaccucagaggguguaugucuagcuguggagaagagaauuaccuccccacuaauggagccuagcagcauugagaagauuguagagaucgaugcucauauagguugugccaugagugggcuaauugcugaugcuaaaacuuuaauugauaaagccagaguggagacacagaaccacugguucaccuauaaugagacaaugacagucgagagugugacccaggcuguguccaaucuggcucugcaguuuggagaagaagaugcagauccaggugcuaugucucgucccuuuggaguagcauuguuguuuggaggaguugaugggaaaggaccccaacuguuucacauggacccaucugggaccuuuguacagugugaugcucgagcaauuggcucugcuucugaaggugcccagagcuccuugcaagaaguuuaccauaagucuaugacucugaaggaggccaucaaguccucgcucaucaucuucaagcaagucauggaggagaagcugaauacaaccaacaucgagcuagccacggugcagccuggucagaacuuccacauguucacaaaggaagaacuggaggaggugaucaaggacauuuaagaaggagccauccucgaacuucugugggacacuuucaguucuaauugcccuuagacuuuauuuccagcucuuaugucauggaaaauauccaguauaugugugugugguuuuuuuuuuaugaagucuguacauaacagcaauucugaaauaaaaaaauuaaaaaaaaaagauu

SEQ ID NO: 5675 - RNA, 1032 nt, Mus musculus
cucacucuggaaaucugugaggaucuggugaauuaggguuuucaaguauugagagaggugaguuagaaugucuuagguccccgugacaaucuuuuucuucugucucuuuuauggugauaacauagaguugcauguccagacuccacauaucugcccccuugucaucauauggcuucccuaaggugagcuuuggugaaaagaagcacuugguccuacacugccauggcaguaauuggugaggucuaucaaguucacaucuaugaaucacucuaugaaucuaugaguauauuaaaagguuugaauaucaggauugacaaugucaagguuguggcaguacuuauggcugcuacuaucugccugaauguuuucuuugcaucuucuuccugcagcaggccauccuucauuaucaggucaaacauguuuccuuagggauugcugggaucuguggccucagccuucgccuuguggauauuuucuaacuuacauaaacaauacuuuugaacauuccuagguaaagaggacagugugaccauugguuccaggauaugacguuugccaccugaccuucagagagccccugggaucuuuccccuucccuuggagcuucaucuugcuuaugcuuacauugccacucuugaauaacguuuuuagagcuugaucaguauaauugacuugcucucauucuuugugucucuuucccucccacucucucacucccuuguucugggucccuggugauuaucugcagguuggggcaguggaguaugcucaguaacuagauggacccacuuugauguuacuagaaccuggaagagguuauugauguuagaaugauauagugugacacguguugauauuucugacaggauucuccugacaggcugcucaauguucucuacaguuuuuauggucauggcagccugugguuuucuguggcaggcaagauucucacugccaaaugcacccuggacaauuggaaaaaagaucauauauugauuccugcauugguucuuuccguggaugcuggccauu

SEQ ID NO: 5676 - RNA, 17275 nt, Mus musculus
cgagugacgucagcgagcgcccgcgccugcgcguuguuccccuccgcggagcucaagaguagugucucccagcucccagggcuccaaccugcgccggguucaaaccgaagaucaugaaccgcagccgccaagugaccugcguggccuggguccgccgcggcguggccaaagagacuccagacaaggugaggccuguguauggggagaugccacggcauggccgugggcucggccccgucuggggcagcacgcgcccagcaggagccacgcgaugggaccugccagguuggccgggacuguagccaugugagguguggcuccggugacccgggcgagcagagaccgcgcgccccuucccugcccggagcgggaaccccgaucccaucccugagaugcacgaacacguggacuuuuugugcacugggaaggggcggggguguuugcuuguuacgaguuucuuacggugauccggauaaaacguuauggggcagagagaacaaggugucaguguaacacaguaugaaggaaguuguacaaaagcuggagaccguggcaaaggaagccgguuacucaggcgguuuuguucauuacacaguguuuucugcaagccaagcggagccuggaguuccgggauauguuggagcgauauagggcaaagcccuguucuugacuuucgggaugucagggguuguaaguguccuaaaagaagugaagggguugcuauggguguaauugucugaguagugacaacucgauaugugauagacgugggaguggccucgacaugaauuuacaugcggugagggauggaaauacuccuuauagguguaaauucuaccagagugcagguaguguuuagucacuguuuucucugguguuuugccaacagcaagcaagcaguguauauuuauaggauagggacaacacuugccuuauuaaaaauucuccaaaagaaaauuguuuucauuuuaaaagggccauacacagcuuucgaaguauuaagagagucuuaaaaaucccuaguugucaugccccaaccccaagcaauacaaauaccuuuguguguguguauguguauguauguaugcccauguucauguguuuguguaugugugcgcugucugauugaacccagcguuagucaaucgagauagaguggcuggccaaggcaccagaaauucucgucucuguagucccuagugcugggauuacagguguccccuacacuacacccagcuuuugaguggcuucugggauggaacuuagauccacaugcuugcucaacaaaagcuuuaccgacugaccuccggccuuccccggaguuuuucagucuuuaauuucuggaucuuucucaggcagaauugaaugucauucucagggagauucuuguuaucucaacguuuuuuguuguuguuuuggagaccaggucucacucuguagcccgcuguggccucagacuuauggcaauccucccgugucagccuccuaaauacuagaguuauaggugugagccacugaagaucuggaggcucuuuaguagaaacugagccguugauuuaccuucauguggaguguugccauuauggccaacccacacugcgggcuuaaguaaauaaacaauacccaacuaguguuggccuuuacaagcuuaauacagaaguguuaggucuggucuggucuggucuggucuuuucuccagacaggguuuuuucuguguagcuguucuguaacucacucuguagaccagguagccuugaacucagagagauccgccugccucugccuccccugggauuaaaggcauguguuccaccccaccccccacccccacugccuucuuguuaugugccuuaaagguacugacucacuauuuaggugagggaaugccaguuuugaagagaguggccuuaguuuugaacuucauuagaacaaaagauagccaaaugggaaauguuacuggaaguggggaaaauagagcuggaauucaagguuggaauggguggaggaagauggggguuauuaguucccagaaagaauccauuuacauugggcagugaugcuaggggaaaaaaggcagaggacggauguucuaugguuugauagccagagagggaggugcccuuggagucugagauaguuggaagaaacauggcgaccacaggucugucuauuuuacagaagccagccuauuugaauauugaggaaggcagaggagcagagugagcacggcugcuaacagugguaggugggcggagucugauuuguacaaaggauucguacagauccgauuuguacaagcucugccuccuuaaguuuagagccgacauguaugagauuucuugauggcucuugagguuggaguuaacauuugcuugaagacucaguucaaaggcuucuaaugauguccauaaauaugcgcuaaugcucgaaguguuugcucccuuguagguagagcuaaguaaagaggaagugaaccgucucaucgcugaagcaaaaggaaaguugcaguaagucauuucuaauagauucaaaguguugcugacuguggugaaaucugucaugugccugguuaggaggugccaucagggugacaucuuuucccuuucugucuucacucagagaagaaggugggagugaagaagaggaggcaggcaacccuucagaagauggcaugcagaguggcccgacccaggcaccgccuagggagucccuggaggauggggauccacaagaugaccgcacacuggacgaugacgagcuggcgggguacgacuuagauaauuaugacgaagaggauaacccaggugagagguggcucuagagccugcuaucccaaagcuuuccucucuuuuacucuccccagggucgggucagauaauuuggcucaagauuuggacuuguuuccuaaucuaguuuagaaggaagcucugaucugcuggucuaagguauacauuugagaucuccuuagaccaucuacuuuauugccugugucaggugccaucuauaacuggcuugugagcucucugcgguuacugcacuguugcuggagaaugagaagagggagccugggugccaggagggggaggaggugcagccaaggcauugagacacaguaggaagcccaggugaacuacgauacugagaacacuggcaaggcugcucgauuagcacaggaggcagagugauaaauguaaagaacuggcagaagcugugugguuugguucuuggccuucugguauggucuccaggaaacauuugcuuggaaucugcagggugaggaaaaggcggcaccauugucacucugaucacguuaauaagcucuguaacgugucagucccagcugcucuggaaccuugugggauucuccgaaucagcaacucccgacuacagcaucugaaaaacagaugcgccggcacauaaaccaucagcucaguauggguuuugcuguugucugcagcaaacugaagucaccaccgccacucuguccccuggauuucagugggcgagugguggucugcaggagcaugcuguuccucaugugaaggagagcacacagaaccagagaaggugcuugcuugccuaguugaugugugcucgguguugaugcuuugugccuuuggggugcugcugcucugcuccucuuuccucgugagucuuaccaugcucagcuuuacugccccacccagugauggaggggaauacaguacuguugggcuguuggcgcuguggagucggugcuuuucauaggagcuaggauuugguuugccuuccauuuuggcccuaccaucugcccuccaccagauggaaauaaugccaucauauuauaaguccauuguuuaggucagaacucagagauugucaucuggccacccauucccuagcacaagagccuucaaagggcaaugucagguccaaaccauggcggcugcccuagguccaucagauccgaaccauggcugcugcccuagguucgcucagcacucccuugcaaaggcaguauaaagauucccuuuugggauuugugaaaccuacgcuuguaagugugagagcgcugccugcauagcagccuggccggcugugaagccugccgucuaaguguuuaccuaacaaccugguuugcugaucucgggaacauauucuucaaauuacucacagcugccucuccagcaccuugacuucuaguuguauaaacaagguagaaaaucugaacagagcuggaaugcuuccuaaaaggguuacauucuugacuuaguucuuucauucagagauugugacuuccaagauuuaggaauucauuccagaugucaaauagaacugacuuguaaguuuguacagcuuucucuaccaaauaagagcagcaugguuggugauaaaggacacccaagccaaaaacuagaagacuuggggaaaaaguuuugucaagaugauuuuuaauuuuucuauuuugauggauggauucugauuacagaugcugagaccauuggcgagucucuguugggucuuacggucuauggcaguaaugaccaggauccauaugucaccuugaaagacacgguagguaaauguuuacccacaucaguuuucagauugguccuaaguguugaaaauccucauggaacccccgccucuagccagugacugucuccucccacuuaggaacaauaugagcaugaagauuucuugauuaagccgacugacaaccucaucguuuguggccgugcugaacaagagcagugcaaucuagaggugcacggugaguaacgguugcccacugggaugcuuuuccguguaauguuaaauagugcggcggacacaagccagguuuacagugauggcuguccuaggcaugcgcagucuagaaaugggccccuuggggaagggguucuuggcuuucucuguguaugaguguucugccugaauguaacugggcauucugugugugcuuggugcccaaagaaaccagaaccggguguuagagccuugggacuggaaucuccgacaguugugagcagcugagggcacugggaauuagacccagguccccugcaagagcaacaagugaucuuguccugcauuguuuuguuguuuguuuuuuagcuacuugagauaguguccuucauagaacauucuguuuucuucucuucuucuuuuuuuuuuuuuuuuuuuuuuugacagaguuucucuguggcugucugucuaggaacucauucuguagcccuggcuguccuggaacucacucuguagcucaggcuggcuugaacucagauccuccugccucugccucccaaguccugggauuaaaggcgugcgccgccauugcccggcagagccaccauuuuuuuaaaaagauuuauucauuuuguauguuugccuacacguauguuuuuguaccaggaguguuacuacuucagaacucuuuuugcuacuguuaugaaucacaauguaauuaucugugcuuuccaauggucuuuugauccccagaggguucacaacucauagugaaaccuguaauuauuauuuguccauuuuagcccacacaucauuguguucuguugauauuugcaaauuuuuucuaaaaugaggcuuucaguagcauguauaacaugaaguuguucuaacuccugauguuuuaauguuagcauaggccuauaauccagcauuugggaggugaaacagaauccaugcaaaagaaauguggauaguguuagucucugugagacuggcuuuaugcaugcacaucucagaucgucauaucaucaccaguuuaauuuacaacguaugccgcacauuggugguggccacggguuuuacaggaccgugccuucucagcagauagaacaugacgugaaauuucucaauucccauaucuuuuucauaaucagagaucuggggaaaaaaaauccuuacuuuauuuuauaaguucuuaauaaaaagccgauuaaaggagacagggcagguagaacuugcuucuuggguuuucuuagugugauuuugcuccuuaacuuucuguguccaugaauguugaagagcuguguuugcguugcuguauuugaaagggagucccuugaauguuuggccugcauugugagucuucauaaacucuuggaauauugaauauuuugggcaggcauuuaaauuucuaaggaccauuauuuuccuccaauguuguuuuuguuuguucuuucugacuuaaaaucagcuagaccuuuagcugauaaccucaguccugcuuguaggauguggcuuuuguuuuuaaaguuuuauuuauuuauuuuauguauaugaguagacuacagcugucuucagauacaccagaacaggguauuggaucccauuacaaaugguugugaaccaccaugugguuguuggaauugaacucaggaccucuggaaaaacagucaaugcuuuuaaccccugagcuaauccucuagcccagggugugauuuuuguaaugaaggaagcagaaagaaucauuuauuuggcuggcaguguucauggaaaaugccaggugagaauguauuagacuggacagacacuggcaguaaugacgguggcaucucuuuucagugucaucaccugucuuguuauaauaguguucugcagugggugagaucucucuuacuaaagucacucuuuccaaucuuuuuaguuuacaaucaagaagaggagucuuucuacguccaccaugacauacuccugucugcauacccucugaguguggaauggcugaauuuugauccuagcccagaugcaucuacugguaauugggaaacuuguucuucaugggucagaacugucacugagugugugaagugguacuuacgcaagcccuaguuuaaugucacuuaaucgacguuagauaagccacuacacuaagccaucaaagauaguaucuugaaaacuuuuuugacuauagaucuguuggcucucgugaaagccuaguguaaaaugguaucauguugccagcuggaauuuggguaucaccugucucagaacauucagugagccagguauggugugguaguguaucauuagggagccgggggaggagaaucuugaguuccaugccagccuggacuucauaguggaaccuugucacaagagagaccuuguccuggguaagcagccucucauggugcucagucuugaccugauccucuucccugcagacguccacggaggacagggcaagaaccguugcuucccugugauaaguuucauagcugaggccagaggaucaaaccuuuauuacuaaaaguaacaacucucaagcucagggguggcaugggaacuguuaggccugcaggauuccaagguggaggcugcagagggguugagcagcacuguucaagucacuccacggugcgauguccuagacuggcagaugcggguguuaguuuucuaauggaaagggcaccgucucuuuccauagggaauuacauugcugugggaaacaugacuccugucaucgagguaugggaccuggauauaguggacucucuagaaccagucuucacacugggaagcaagcuuuccaaaaagaagaagaagaaagggaagaagguaaagaaguguggguauuuaaagggacaagcuggguuaagugacuggagaggaagguauaagaacuuguauuguugcaaucagauaguuuugguggaacaggacaggaaguuacaagguuaguguaauuucugauuucaggaaguccauguauuuucagguugcaugaaccuuguuggcagaugauccaggugguaagccuucauguagaauagcuauucuacucagugcugguuuuggacuuuacguuucuguuuaccugcuugcguggugaauucuauuuagauucuaaaagagguuuggggagaagugaagagcaguauugauagguuaugaauugcuauaguuuccuucugaaaaagaauguuuacaaugauaauuauagggugacaguuuacaauagguuuuuuuuuuuaaauuauuaaaauauauuacagaguuccucagcagaaggacauacugaugcuguccuugaccuauccuggaauaagacagucagguaaaaagauggcguucaugugauguggugucugcaguguucucguucauuccugcacugugugucugcugugcuugggucuuuguguccaucuuucccccuuuccugcaguacauaucacuuguggcagcagcugugcuguucagacucauccccaaggccccugacagacugugccauaaguguuguucaccucccuccuccccaccaccggggagugugcaccgcagugccagugcuccccagcugacagcagccucacuugauuucauuuucacccacuuuuucaucuuaaacuauggccaaauacagcauaaaaccaucacugaucccuuuaaguucggggagugagugcauugacguucugcagcugccaccacuacccagucuucccagacugaacucugccuuauaaauaccaacccugccuccuccccuccucucauagcuggccgccucuauuccacucccugccggaauguauuuaaaauguguuuugguuucuguuuucuuucuugguuuuuuucaagacauggucucaguauguaguucuggcuagccuugucuacacucacuguguagacaaggcugcucucaaacucccagagcuccaccugccucugccuuccaggugcuggaguuaaagucgugugggccauuguaucuggcauuguuuuuuuuuaaagauguagucucacuguugcccagguugucucaaaccccgugcucaaguggaauuucugccucagcucccagaacuggagcuguccacgcauuucuuggugauugauguugggcagcagugcucguugaccaguaugugugcgaaguguguuuuucaaauugaauuguaaaaguauguccugaaguaauaccuagcuagacguguguuucccaguauuucugucaugcguggguuugucuucucauucucucuguaaaucauuuuaacauugguaguuguguuauguguuugcuguuacauccaagaugcucccuaacccaaggucaucaggaugacuguuaagguacuguucugggacuuuauaguguuagcucccacacuuaagucugccauccauuuugagauguguggaugcugaaauggaggccaaacuuuuucacaaggauauuccacuguuuuguugugagccacugcaugugggcgcuggguccaccaagccacuuguucauugaaaaugucaucacugccauucccccagcuugaauugucucggcauuauuaaacaucaaaaauaccgggcuggugagauggcucagugguuaagagcacugacugcucuucugaagguccugaguucaagucccagcaaccacauugugccucacaaccauccauaaugagaucugacaccccagcuccaguguacguagauauaauaauaaauaaaucuuuaaaaaaaucaaaaaugccaaucacagggaaauaaaugcaaaguaaaacacagccucaacccaguaggcagcaggcauauaguuccaauucccugggagcugaggcaggaauuuguuugagcacaggguuugagacaaccuggguaaugcagugaggcuacaucucaaacaaaacaggcuggagaaguggcucgguggacccagcgcccacaugcaguggcucacaacaaaaugcauuuucugagauuuacuuuucucuggucagucauuuuguugugauacucuuaacuuuuccauuaauuuuaaaauugggagcuauaugcuuuccaguuuuauuaugggucccugggucaggcauagaaauuuuagaauccgcuugccaguuucugcagauguuaaguaaguaagcuuuugaggagagccuguguggcuaagucuguaaucagcuuguagcucaaccuagaagugcuauucgcaucucaacaauauuaugucuuccaguacagauggagaagggccuuuccacuuugauauucuuucuuuuauuuugauaauguuugguagucuucagaguguaaguuuuaagguuuguuuuuuaaaugccuaauauuuuacuguuuugauguuacaagugaacuuauauuuaaugugcuuuguuuuuuaaaugacuucucucuuuuguuucucuguuucagaaaugugcuugcaagugcaucggcagacagcacuguaguucucugggaucugucuguggggaagucaguagccaggcuuacugcacauacagacaaggugugugacguagugagcaagaggcuuccaaagggaugacagauuacugacuaaaguaaucuggacauucguacauggcuuccugugauugacaaagugcuuuccacagcacagugacggucacgucacagagcccuguguaauagauacaauccugugaucuuauaguaaucagacacaugaaugcccugugacuuguucauggcggcuccuagguggugggugggguugggggugggggguggaguucaguccuaacagcagugaggaaaguuuguagcagauguguaaccauagagcucugcucagggucagguguacuaggaacagcugaacuuugagaccaacccauucuacuuuucuccccuuucuucugagggacauaaguguuccaccacaaagugugaagaaugcuacauuauucuuagaagugcuagccuuuauuugagaauaugguuucccuuuuugaguauuuaguaacugguuucuuggccaggcauagugguauauaccuuuaauuccagcucucaggaggcagaggaaguucaaggccauuaggccagccagcucuauguagcaaguuucagaccaaccaugccuacauagugagucccuccccccccccccccccccacacacacacaaaaagauuguucacugucggaauuucaaaggggaaugcauaggagcacugccaguucugucucaccucaccguagcaguauuacucaaaguggcuggugauaaaucuuuuuuccuuccucccuuuagguucagacucugcaguuucauccauuugaagcacagacucugauuucuggguccuaugacaaguaagaacgcacuucucauacugcauugcauuguucuugaacuaauuuaaaagcacuuggccuaggggaguagcucagaaaggcuguugcccagugugcucaagaccuugagcucugccugcacuaagacaagacggggugccaucugaugcuuacacgcuguaguacugaggcgcuauguguuuaaauugugcgugcugguuuucaaccccaauccuucacucccccuaaaaagaaauaugguuuugucauaauaaccuaauuuuaggaacuaucugguuuuaaaacgauguaugaguuagccgggguuuugugauaaaagcaacccugcacucagugacagucgccuuuuccuuuugagauucuguccauggagucugaguucaguugcucaaaguggcuugguuaggcuaaacagaagacacuugauucuccaaaggcagauauugcaaggccuguggagacuugcuucaggacuaguacacguccucucccuuccuuccccgcuaucccagugucgucccuaugacacgugucagauggccugggagaugugcucugccucugugagcagcauucccacauugcauggcagaagcuauggguauaggagaaaugaacagcuggagcuacuacacagcugcaaggagccugcucacagggcuccccuuucacaggcggaucugaggggagcgauggcgaguaggaucagaccaguuagcagucuuuguuuugauuccuuauccuucagaagaguuuacguuucuaguuuuccuuagaugugauuugugaaaaauuguaggacagaauuguaucccuuaguuccccaggcucagugaccugacuagagcagguucgauccagacuuucauggcucugaguucuuccugggaaagggaaauaagaauuaauugcccuggacuuuggaaauaggauucauccauaagucaagguuuugaccugcagaagaauuaggcucuacuuagagccacaguaccuuccagugacaaaaacaaaauccgccagugagcgucagccagggcuggagagguggcucagcauuaagaacaguuuguuuucucaaaggauccuggucacuuugcagcaccuuaaccccaguuccagggggaucugaugacuguguagacucugugugcacgcacacacccgaugcacauacauuuaugcagguagaacacucucauacauaaauaaauccaaaacagaaaacgaaaaguucagcaggcuagagaggugacucggcuaguaggcucucugcaagaggagcaaguucuccuaaguucacuccuagcaccuacaucacauggcucacagccaacugcagcucucgcccaaaggcuuccaugucuucggaaccacacacacacacaacacagugggacuuuuuuuuuucuuuauuuaaguuuagaaccuuaaaacaagcuuuaaauaauugaauucugaacucacaauggugcucuguuaccauuucacuaaaauaaacguaacccuggcaugcaaugugugcagaucgguggcucuguaugacugcagagaucccagccagaaccaccgccaguggcgguucagugggcagaucgagagagugaccuggaaccacuucucaccgugucauuucuugguaagaauaugcauuguuuuuucuaauuccauuauagagagauuguuagaaaagcauuuucucugcuagugugauguuucugggucuuagaauugaaaaacuaaaguuaacaauacaaaaaaaaaaaaacuuaguuugugaauuagcuaauuuucaacuauuccauugggcuacauuuuuuuucuauuuuuaaaucauuuuacuacuuauaguauuuuugaaauacuaaucauaauaauauucuaaucauaauaauauucuguugucucaagguuuugauacaggaucguguagcccaggcuggccuugaccuugcaaaucuuccuccuucuaccuauuuuugguguuuuuuaauggcuaaaucaguccaaaagaugcuuaauuccuuauguguagauuaaacuugagagaugaggauugccagugauuauuagcacugucuaccaaaugggaagaaaguaaggcuuuucuaaacguucacuaacaucagccaaacagaacucaguccuaguguuacaagggaugccugucucccaccacugcuguauuggugcugcuguguauagagcuuuaggucucucucaucugucuuugcucucugauucuuaagaacauuaacagcuuauuuccaugucacuccaccgcuauggcaauauugagaccugaucugaccaugccauucuuaaguuccuuacugguucccaacauccaucuuccuuccuccagcugccuccuccuccugugugcuccucagcucaccagcacucuggugccagcccgaugcucuucaguuacacacacacacacacacacacacacacaccauguuccccuucugcccuugggcagugacugccauuucuguguuuccacaacuccaacccagcucuuuccugcuucaugagcauagcucauucaaaaguaaguucuuguguucaagucacagauaaacagaucuuaguguaacuuauauacuccuccauugccacauuguaguguuccauaccaucaucuuacccaucuuucccucugcaggccaguacagaugauggcuuugucuauaaccuggaugcacguucagacaagccaaucuuuacacuuaaugcacacaacgaugaaaucucuggugagcacaaaugacgcuucuuuucaaaugcauuaaguuaugacaaaguaaaucuaaaucccaggcaguagcucuugagcuuauccuaucuuccaggucuugaucuuagcagucagaucaaaggcugccuugugacugcuuccgcugacaaauuugugaagaucugggacaucuuaggagauaggccaagucucauucacucuagagacaugaaaauggugagcacccugacauuuuucuguguuucugaccuauccgcuugccuuuuccugggaaucacugcauucaaggauauguugguuaauuuugagcuaguuaaguuuggugggaguuacuaucugaauucuuucugguuuacaaguuuaauagucacuugauaggaccaaggagaaugggaaaaggacauagggaguagccacaucuuaucuguaacucagagcugccucuggacauccuggaaguugaggcacuaaagcuauugggggcucuuuuauuuacuucucgugacuagcucugucuacaucgaaguugauaauauauaggugagccaaacauuuagaauuaguaguagucuuuaacagacagcaaguacugacuaagaacagguauugccuauguugagcacugaguuacaugaauaacauuagcagcacaguagagauugucacagaaguuaaagccaugugugcauucacuuagcuuauugaaaggcaggugggcgggcaggcgggccaugaagcuucuuaguuccucccaggcgcgugcgugcgugucugucuguaugucuguguaugucuguguguauacauauacacagacauacacacacauaucuacacacauacguauacgcacauacaugacuacuugauucaguccuuaucccgaaugaauuaucucacugagggguuuuaccuuucuuauuuuaucuuucuauaugcauaauuuuuaccuauaauaauguuuacuuauaagggaagcuauagagauggcacuuagcugcuaaggcugguagccauguuguaaaaggagaaccaacuccuguaggugaucuggccacacccgcccaucccgcacauaggauaaauguaaugucugcaggugguccucugaccacacacaugcccacccugcacauaggauaaauguaaugucugcggugcuuucagggcugaggauacagcuuggugguagagcaccugccuagaaaucucugcucuccauccugcauacaugcaaagauacuguuuaagaagaaagacuuaauagugaccuauguuauuacuguuacuguuugaaaagaugaauaacguuucuggguguacacagcaaauuagguaaggaauuccuagacgaaugagaccuacaaacacagugccgucgugaccagccucaugguucauccgaaaugcugcgcuuaaucuagcuuugaguaaccgaucaaagguguuuuuagagaguaguggggucagguuagaacucucuaggacagaaaucaaugacucuguccuuuucuccucagggaguucucuuuuguuccuccugcuguccugacuugccauuuguuuaugccuuuggaggacagaaagaagggcuucggguuugggacauaagcacugugucuucagguaagaaccuccaagcgccugcucuuucugaaagcauaaggacuaagaacagggcugggauguuacguacauggcaaaggcauguccagugcguauccuguaauccuuacuuagaaaugcggugggcacagguaagcuguccuucagaguuaaaauguaaauaguucuuuaauuaccuuaagauugaagagcuuccuaggaaagcugaagaaaauguagacaucucaaggaagagccuuccccauuguccaguaccucaguguguuccuuucccagccgcuacaacuuccccugcagaagaguaaccauuuacucucuugagguuguccaguguggucuguaaacagugugucuccacuaaguccucccucccgggaugaggacagauccuaagaucugucuggaaugcugugauuugaauuuauaaguauguauagauuauauauguguggucaugauacaggggggggaaagaaaaccugaagccgagcccugcuccaaggcagauuagagaacaguagaacaagcccgagagaaguacaaaaagaggacuaaggaaagcuaaacucagugcauuaacucaucaggcuuccagguuggcuacuuucucaguauuaaauauguuucaucucacagcagacccuuguuuuauacuguagucugucugugcucuuaccuccuugucucacgguuucuuucaguaaaugaagcauuuggaagacgggagcgacucguuauaggcggcacgaaagguuuaucuguuagcggccccugugggagcaggaguccacagcagacaccaauggaguccugacaaagaucaguuuccugcugugcuuaccuuaacuccguuucaaaagacuggccuaaaaauguccacguauaucuacaaccauagauggaaauucagguccuguugccauccuuucugcagccuugguggcaguccacagccuuugggcugccuucuacuggguacuguacagaguucuugccuuucuugaaaauauaaaguuuuuuaaaaaugauuccuuaacaggccaucugaccuuuggaacucuaggcauaaaauacaugguaacuggagaguuuuugauacgggucuugcuguguuagcaaagcacuggugugguggcucgugcuugucccaguccuggggaggagagagagacaggcagauuccuaggaccaggcugcccagcgaaucucaccuaucuccaucuucccaggcuaggauuaccuauaugcaugguagguucuagaauugaauucaggcccucguguuggcaaaucaaacauuucacuaacugagcagugucccuaacccauugauaaaugugaucccuaaagguauuuucaccuuuugaauguuaaucauauuuugacaacuuuugguuuuaaacuuccauguuuucagggauauuuuguuuaaaaugucaauuauuuuuuaaauggggauuuuguucauacaauuuucuaugaucaaaauauuuuacuaaauagacaacaaacugucaaaguaauacauaaccuuguaaguuuuggucccaguacauucucccaucuauuuccuucaaauaaacuugaacuugucaagcccauaaagccuucuggacuuaagagguccuaaauuagcaaucucacaccaccucacagaaaggcuguccacucccuccucccagacuccaccauuacuaagcugauuucccaaguuucaggauguugguacuuuuugaaguaauagaauaaacuguucuauuugucauugaaauucac

SEQ ID NO: 5677 - RNA, 17879 nt, Mus musculus
ccaccaaguagcuacagguauucuagaccugaauuuuuacuuggaacuaaaauguauguuuuagggggaacaagacaagagagcuaaaugagccauagaaauacaguugaauggauuuuuaaccuguggcuuucugaacuuaugauccugaaaauuuucuucauuggaccuugaacuuucucaucugaaaaaaaaaauggguaucauuacuucaucuaauauuguuauggaagguucgugaaauagcggauacaaagcauguaacugcuguggcacuuacauuguacacagaacuguuguacacagaaagcacugguagugcuagcucuguuuagcacuguauucacugugggggcgggggaaugcuagcuaucuuaguaguauauggacuguggaguugaaguagaugcucauucagugagccuguaauacucggcaagguuuuuaggaauuuugguggauuguguucuaaaauagguacauccucacucugaaggauaaggccaugugcaucaaggaaaagaagggaguuggaaagguagcucaguuaguaaagaccaaggcaagccuggugauguaaguucagucccucaacccuaaagaagaaaagugcuaggcauggugcugcgcacuuguaaucacagugcuggggaggcagagacugacuaaugcauggaacucuggccaaccagcauagccugacugccaagcuuugggccagcaagagacgcucucucauaagaacaagacacccaaggaucaacacuugaccaugggcauccacaugagcacucauuccaaaccuuccaccacugcagucuuaggguuuccauugcugugaagagauaccaugaccaagaccacucuuauaaaggacagcauuucauuguggcuggcuuacagguucugagguucagucucuuauggugggaagcauggcagcauacaggcaggcagggcccuagaggagcugagaguucuacaucuuguuccaaaggcaaacaauagaagacugguucccauguggcuagaaggaaggucucaaagccuacccccaccauggcacacuuacuacaaggccacgccgccuaauagugccacucccugagccaagcauauucauaccaccacaaccaccacugauaaauaguaauugauaaaauauuauaagaaaggcaacaaauuuaauguauuugaaaaguauuuagagauagcuucauagacaagacucaaagcuaggccaugggguuugaauaauaacacauagacauucaggaaacguagcaagaacacaagcaaggaguagagaaguaggugucuaagugucuuauagggauuagugaagugugagacaguguacacacuagagaauuauaaacauuaauuccauguuaacuguuaagcuuugcaguuugauuucauccuguaagacucaaucauuugugccagccugacccuuuacuuuacucuaacagcuauaugaaguguugacuguggcuuugauguuaagcaguucucaugcauguuuacuauuaaggcauuaaauguguuuaagauguguuguuccacacacuaugaucuuaucauucaggggcugagcaaaaguggcccagggcaguuaguuagaagauaaauguguuacaaagugagacagucuuuaaaaaagaaacaaauuuauuuaaagcccaugaugguaacaaaauauaugcucauucacucacguguugggaagggaguggcuaaagcuguguugcuguuguacacaucccauuucacguuucuaaaggcacaugcucucugugugucucacauagcuaugucacuguacucagaagauucucaauaaauacuuuuuuauaaaaauuaauuuaaaggcauuauuuagguguaugugugccugcuugucucuaugugugcaaugugcauacagugcucaaggaggcgagaagaggguuuagauucccuggaacuggagugaacagacaaucgugagcuaccauguggauaaacccaggccaucugcaaagagcauccagugcuauuaacugcugagcuaucuaucuaucuuuccaauuauaucguaauugagcaaauagaugaaugcagaagcauacuuaggguuuuguuuugaauuugaauguucacuucuuucuacaguaaaucugaaugauuuauuuaagagaaaccuaccuggucugacguaugguucuguugcagaugcacugguagcuauggaaaaggccaugaagagagacaagauuauagucaaugaccggcaguuggcuugugcucggauugcauccccagagggacaagacuaucuaaagggaauggcugcagcuggaaacuacgccuggguuaaccgcuccucuaugaccuucuuaacccgucagguaaaggaaaauugcucucuugaguuaaucaggaaguuaauaagcaugguugguuuuagaaaugugcauucuagaugcuagggaggucucuuaggguuuuggugucuuuggccaggagaguacagccagaaugaccuaauuuugccuugagccucagcaagaauggaaaugccauucucugugauugagaaggcucggcaagaauugucugcaggcaagauccggagcagugagcagccugucugccugagguggacucugucgcaagcacuggucuaaagggcagucucugugcuuccuauaaagaugagugacuaguguuuaguacucugaaguccaccauucacuagcugaaagcaguaaacuauguccccaagagcuagaacuggcugcuuauaauggaaacuuccccuauaggcuuuugccaaagucuucaacacaaccccugaugaccuggaccugcaugugaucuaugaugugucgcacaauaucgccaaaguggagcagcacgugguggaugggaaggaacggacgcugcuggugcacaggaagggauccacccgugcuuucccgccucaccacccccucauugcuguggauuaucaaguaugugacccugcauucauguuugagcagugaggucaggaauagagaauucugauacagguucaguaaagcaggaaaaccuguguaaagaaaaucuccuguucccugugacagcagugguuccuauacucugcaucagugacaccccaucucuagugagugcugucuuagugcuacacuaggcaugcuuuacuccccugagcuauauggccuggggguuauuguaaggccgacaaagguucaacugcaguguuucuuucccuuaacucucgggguuuugcagaugaggaaacagaaguccagagagggcaggugccuugcauggaugaaaaugcuaaccauccaucccuccaguuugaguguuuucuguacuacauucugucuguucuugacccuuauaguuuccuucucuuucuuuucccagggagcuagaaaaucccaaguagugcuuuauuauagccacaagagcacugagucacaagagcacugagucacaagagcacugagauuagagguuuagguuucuuguacaguucugcaacacaagaaauuucaggcauaaaaagcaugugccuuucuaaaauuuaauguugguuuuguguacccucagcucacaggacaaccagugcuuauugguggcaccauggggaccuguaguuacguucugacuggcacugaacaaggcaugacugagaccuuuggaacaaccugucauggagcgguaagaagaaugaaaacuugcuaagaaaugcugucaguuuagcuauuugcucuugcugcaagccuggugauccuaguuccagcccagcacgcucgcaucuguaaucccagcacuccugcaacaagacgggaagacuagagagucaccggaagcucacauagcagguguccuggaguucuucacagcagcagaaacuagagacccugccuccaccagguggaaggagagaguccacuucugaccuccacacacacgccauggcuuuuguacauacaugugcucauguccauacacacuaacauaaaaggggaaagaauaagcacauaguagaaugugauaauggugagaauuucauuaucaaggaaaaggcauagaauuccaagggcuuaaacacuacuggagucaaguggacuuuaguucgaaaugcauaaacugguuuauuccuguccuugcuccuuucucauucuagggccgugcuuuguccagagcaaaaucacgucguaacuuagauuuccaagaugucuuagacaaacuggcagacaugggaauugcaauccggguugcuucccccaagcugguuauggaagaggugaguggcguccugaaaguuuuuaccaggaagccuuaagauuuaugccugugggcagagacuggaguuucugguguuacagagaugcgguaggguugguugguugucagugacuucaguuggggcguuuggguuuuauauuuguuuucucacuuacugcuguuuugagaauuccauccacagauaugauuuguuuuugucaugcccacucacccucucccuuucuguuccuccucuuacaaaugucccaccgcucacugucccagaggaggccaucucuagccuacucuggccuugaaacaauccucaggcuccuguauucgaggaucacaagugugagccaccacuccuggcucugauuuugguuuaucucauuuuauuuuauauugcccuuuguuuggagacuaagucuauugccagcuagaucuauguuauaauguuugaaaguagguuguaagggccugguugaaggagaaaacuuacucuuucaaauuguuuccaaccuccacaugugcaguguguaugugccacgcacacacaauagaauuuaauggggaaaaaugcuuuugucuuuuugugguuuguuguuguuguuguuguuguuguuguugcuguuguuguuugcuuuuuaauuguguaucccuggcuguccaggaacucccucuguagaccaggcuaaccucaaacucggaaaauugccugccuuucccucagccuccugagugcugggauaaaggugugugccaacaccuccugcaacggucaaaacuuagaauaaguagaaguaguuuaaggugacccauuguaaccuugauucugcacaguugcaugcuuacauuucaguuuaggacaaauuuggaaaaggagagaagcaauuuggguuuaguucacagaggaaaaauuguauuuaaaugaucugcauguacuuaagagaaacccaguuauccgaccccuccuucauuuugaagagcacuuagguuucccugaugcuguuuugaagguguaguugucaaauuuucuuuguccuuuuaaaaaggcagcuccuucugagguucuuggugucucuuuccucagugcagcagaugagcggcuuggcuucugcucacacagcuucccuugguugcuguaaacugugcuguaaaggcauauucauucuugacgcuucauaacuagaagucucaaguagaaugacugggucaagcuuggcuuuuuuugguuggugguuugguuugguuugguuugguuugguuugguuugguuugguuugguuugguuuugcuguaacuuaauuuuuacauguuuugaggaguaauuugggauuggaggcuggagccauggcucagcugugaagaguauuuguuguucuuucaaaggaccuggguucaauucucaguagccacaugauuuuucacaucuauuuauaacuccgauucaauuaacucugcccucugcaggcaccagacagagacauaaacacuccuacacauaaaauaaguaaaucuaaaauauaaucacagucuaaaagguaggaacuguuuaauuuaaacacugugggaaacacuaaggacaaacggugugugggggccagaggacaguucagugcagucagauuucucaugcuugcaugaguucgagggaucaaaguuggauuaccaggcuugcacauuccccacugagccaccucacuggccuggcgugugcaucccuccucuccgcuagugguaccuggagcauccauauaguugguccacagucuguguucuccuucacuggacuugaaggggaaacaacagggucugggacaaauacugugguucccagucuccucucugggcaccuguguaccacugggagucagggccaugggucuaccuuucccucggggugucugcgcgacaggcagagaggggaggcagauccccuggucuguaugggagugagggcugaguauaccacccauggggguggaagagaaggccuuccuccauggcucauuuaagaugaagccuuuccuauugugauccuuaaugaagagacaauccuugcuuauccauacuggcuuauuugaugguggaugugaaugcauacccuuuauucagggugaaccagggacuaaaccuuuguggaagggaauaccaaggaagggaagcucauuggcugaaggcuuagagcugucuagauaccucacuagcauggagaaaaaaacuccagguguuuaugcuauguggcccagugcuggugguccucgguggggagucaugguuacauguugcagagcagguagagaauggcuccacuccugcuguucugagauucccaugguuugaguucauuuagccuuaccauuucuuaugccuguaugguaccaaggacccacaugccuuacacuggccccugcuuauaaauauacaauaauacauauauuuuugagaaauuagaaaaugcagaugaaaauguaagaccaaguauuuaucucauaucccuuuccagcacugaguuuacucauguuuuuaaccuuugcuuuuuuuuuuuuuuuuuuuucuucuuuucaagacaggguuucucuguguaucccuggcuguccuggaacucaggcuggccucaaacucagagauccgccugccucugccucccaagugcugggauuaaagguguaagccacuacaccgggcuaacuugcuaauuuaaugggcaccugaguauuuauuucaaauaaaacuuaauaguuugaaagauuuccuuuugguggauuuuacaguguucaauuccuucucuguaggcaccagaguccuauaagaaugugacagacgucgugaacaccugccaugaugcugggaucagcaagaaggccauuaaacugagaccaauugcuguuauuaaaggguagauccaagacuaucagagcgucugaggugcccauggacugaaauuccuaagacaugagacucaaggccugacaagauccgaauugcagagcuguugcugugcgugccaccauggcugguggagaggcugcugucacaggguuggaaaauagccuuccaggagaugugucucugaugggagcagggcaaaugagccucuucuuccuuugucccacagggguuugugacugucaauuggggugugggaaggggcccagaaaugcccuguuuggucauacaagucuguaaucaccagagugggcuucuuuaucccaggcccuguuuguagcccagaagguaucauggagaacaugcuauuaaauagguuuuugaauguuuccuuucuucucuuccugugucaguuuugucugcucaucuguggagcuccucuacaacaagcaaaccuagauucccuucucacggagagcaccaaguacccaaaguguuuuaaucaagacaguagacaaggcacagugggguacguugaggaggcuauaugguaugccaaggaauagggcaaaggagaaaauaacucuccacagccuuccugucuuucuuacccaagaaccaggcagagaaccugcagcgcggggccggcugugacucacuggugaggcugccuggccagcuuugaauaaugcuuuacagugacaccauuaaaaaaugguuuucaguuuuauuuaacaauucuaaaaacacuaagugaccacagcuggugauauuaacaguugcuugauguggauaucuugucaucuugugagguuuuguguuguagaugguaacaucuuaaagaagcuuuccauugugucagggaaggcuuagcagccagagcuggaggcggcuggucacacugccuugcauucaggaagcagagaugaauucugguguccagcucauguucuuuucacucaguuuccaguacauggaguggggccauccacuuucagggugggucuucccaucucaccccagucuauacacucccucacaugcauacucagguugucuccuagauaauucuagauucuaucauaaaguaggcuaugcuaacggccacaagugagaaggcugugcguuuucagucaggcacuuuagcauauaugcaugguugggcggucaaaggacaacuuacaaaugucgguucucuuccuauguggguuuuggggaucaaacucagguugucaggcuuggcagcaagugacuaauacccacugagucaucuagccaaccuuagugccaucacugauuccuguguccccgaccuucacccaagucuugucaguucuaucuaauuccuggacaucucuaguccucccccucuucauuuaaaaccuaucucauucuuuacuuaccagcucucaaaguacagcagccaggugcauccucuuuucuucugauaacugagcugcugcuuggagagccaauaccccauuccaacuuucaguucgugugugugagcuaaccauacacaggcucauaccagaacacacaaaucaccucuuccaguuccugacuugaggaaguggcaugugguaaguaaacccuggagguucucuccaucaagagcaaggauacacauuaccaacuccaaaaagggaggaaagggagcacggugaggaaauacuagauuaaacaagacugaaauccauugggcaaacaccaaagucugcaucuccgugucugaugucaaagcgcucuucagaucuucaacuccuuccagguuugaugaccgcaacacacuuguuaguuuuggucugauuccacucccuauuggcagcuuuccuugucagguaucccauuacucuggcaucuccaccauuuggggagucuccaaaacaauccaggugucacccacagcuucucucuaggccugacacaugccuggccucagcaguuuucauuagccauggagggagauucccaaaccuuuuucucguauccuugacucuaaagccagaaccacauggccuaagcugccgagcucuguuugcuggggcuggaaugugcgccccuuguugaaauauauauuuaucacuuuucuguuuuucauaguuuccuucacugccuaagcuuggcuguccuaggacucauucuguagaccaggcuggccucaaacuuagagauccucccgccucugccuucugaguguugugacuaaaggaauggaauguggugguuugaaugaaaauggucuccauagaaucacagcaugcggcauuauuggcagugugguauugugggaguagauguggccuuguuagaagugggauaggagccgagcuuuugauguuucauaagcucaagccaggcccaguaucacucucucuuccugcugcccaccaauccagauguagaacuuucagcuacuucucuaguaccauguuggccugcaugcugccaugcuucucaccaugaugauaacggacuaagccucugaaccuaugagucagccccaacuaaauguccuuuauaagaggucauggaauuuauucccagcaauaaaacccuaacuacgacagugucucguuaaggaaaaaccuuggacuuugcaccaagacagcugaaaagauuuccugaagggaaaaaccccaagauggaauaaugcagacucaccuagaagacuuucauuugaaaagagaaugaaugaacaaaggucuaaggcugucuuagggcuuccauugcugugaagagauaccaugaccacgacaacuuuuauuuaaaggacauuuaauuaauuguggcuggcuuauagguucagagguucaguccauuaucaucaaggcaggaaacauggcagcuuccagaaagacaaugugcuggagaaggagcugagaguucuagaucuugaucuaaagacagccaugaaaagacuggcuuccaggcagcuagaaggaccucaaagcccacccccaaagugauacacauacuccaaaaaggccacaccuucuaguagugccacuccuugggccaagcauauucaaaccaccacaaaggcauucuguucaagugaggcuuuaacugguaaauguuuuuccagacucaaccuggaaaguauagagucaaagcaguuguggucuagaguggucagccuacaucucaaguuggaagcagaacuugguguuauauauaugguacuuuuaauuuuuuuaaauuuagauucauuuauuuuguuggguuuuuuuuuuuuuugaguguuuugccugcauuuguauacacacaccaugugcaugacuggugccuacaaggaucagaagagggcauuggaucccuuagggcugguguaagcugccauguucaugcugugaauggaacucaaguccucuugcaagagcaacaaauggucaaccccaugccaucucgucagugccaugggugaugcuguugaagacacacacacacacacacacacacacacacacgacuuacagagucacagaagcuuauaccaagguuccaggaagccaccgaagccaagcaucauaguacggucacguugcuugugacaugauuuauuguaugggauaugcuucaagcugugaaggugaagccuaagccaaggugaacgcuccaagacccuggagauaacagauaugugaaacauuuaccaguaaaagcugcaggcugaguggaguuggucuaagagagacgccaauguguugcaggcagcagagcuggaaggcaguucuaccaagauugugagagcucagaugaugccaugaggcugcccacaugcugcgcauggggcagaauagucagguguuugcucugcugggcuucaguccugcuuuggucugauuugucccuguuaugcaucccuucuucuccuagaaaaggaauacuuacucuuugccacuggauguuagaaauauauagcguaaaaacugcuuauuuuagcuguguggugguggcacacaccuguaauccuaacacucaggaggcagaggugggugaucucugugagcuugaguuccaggaaagccugggcuacacaaagaaacccuuucucaaaagaccaaaaaggaaccaaacaaaauaggagcucuuaguaagagagugacguaagacucagaagaguuuuuaacaguggugaaacuguuacacuauagagugucuaaaauugaauuuagaguauuuuacauaauaagauggccaugggccaaagcagaaugcuaugguuuguauguaaaaacauccccuaaagggccauguauuugaacacucagucccuagcugauaagguugaacaacuuuugagaaguggggaaucaaugguggaagcagcuccuugggggucaagccgugagauuuacagccuugaaucacuuccugucuuguuucugcuuuacaauuugcaggaaaaaaaaugaaccaucaggugcagccaaacuccccucaccuuggagccacaggcuucugugccuuccccauguauagcccgcuccaaccauaagcccaaauuaacccuucucuccuaagucuccucuguuggguguuucuugaagcaaugagcaaaauaacuagggcagucaguuacucucuaagccccagguucugcaucuuuagaacggaggcuauauauccauccuuucacaguugugaaaaucagcugaggagaguacacagaagggauagccugcucuacaguauaaccucaggaacugcuagcauauggaauaaucugccuucaauuguauuuuuacaaagaaggaggaggaagaagaaaaaggaaaaagaagaaguggaagaggaggaggaggaggaaaaaaauaaaauaaaauaaaaaagaaaagauauaucugaagaugagaaugugcccuggauuguucaauccucauuuguuuaaaccucuuggaacuagaucagaucaucucccaagucccugucuauagcccacauguagaauucugugacuaucuuccaggauuggggaaaugaaaaccaccuucaggaguggcccucucuaggcccgcucugaaagcaaaaaccaguuuggagaguucuguugucuggauggacaccuuucugcugcagcugcgguuucauucuggcugcaguuaaugacagugagaaagccaacaugaaaggaugacugacaggucaucaagcaaaggacacagccaagcagcuaugagauuaaacaccagccuccccacccagagagccuacaaggaaaacacacaugcaacucggugacagcaaucaaagggcuggaagcggccuuaguugucacgggccugccuguaaagggacuauaaagcaacugcaggcccucugcucuaccccaggaggcagucugucugucugccauggaaugaaugauguacgauggccaacagagaaaaguuaaaaggggaugucuaggggcacccuaccuguagccauaacugcaguugaggauucuggggacccacaugucuaaccaaagucucauuuccagggugacaaaugggauuacuauucuuuuugaagacagcaaagauuacuucagguguuuugaagaaaaccugucugaauggaaacuugagaaaguuucuggcaacgguaucccuuuagggccugugugcuucauuaccauggguccuggcauauucuuauaagcuuucccaggccagaugggaccugacuuucaaauuccagguaaggcuuugucucagguagcuuaaacagcaaacaguuacuucucaacucuggaggucaagaguucaagaucaggguuccuucgucuuugcccucagcgagugugugucacagcagcucucaggacaucaucuggaggaacaccugacugccacgaaguauaaccaagggggauuucuaggaucgggaaaaucaaaccaccagggaagaccucaaaggacguggaaaucucucuucuuucauaaacccuuuaucuccagaacauaacaccccacucuauaaacaguaccggggcuugauuuuguucuuuuagaagacacacauguuuuuuuuggcuccaucccagaaaaagggaaaagcaaaauuugaaaguucuccuuccuggggccagugauauggcuuaguggguaaacuuguccuguaagccaaacuacccgaauucaaccccugaaucuacacaaaggugagagaacagaggccacggggcuucuguuaauccagggcaagagcaaggccaccugagcauaaugaagcaaguuugauuuuuauuagaguguucccaagagcuggccagagacugccuccuaaaucagaaagagaacaguccugaguucauuuuuuuagagaccuuuuaaggaguaaaaucaucaagaguacuugcagagcaggcuugcagaagacaaugaagcaauuagaaaguaaagaaaaaaaucuccaaacaaaacaaaacaacaacaacaaaaaacccuaucuacgaccauguggucaccaaguaauuagggaguguuuagggagguuugagcggucccuaauacaaaguuauggauuggggcaggucugguuucaggaaacagacaaauuuauuuuuaacaauacaguauaguggcaccugcuuucaaaaaggagucaggcaguucccacaugugcccugaggcacuugugcccaugugugcuugauggcauacacaccacacauacacacacagugauaaaacacacacuauaacacagaagaaaguucuuauuccaguugguguucuuccuaucagguaucuggguggucccagaaaaaucaugccccacccccaccccaagacuacuacaugauugggacagguuauuucucaauuguucuaaaaaaaaaaaaaagucuccccaaacaaagcaacaggaagguucccaguggugugguggauggcuuucucagcccagcaggaaggcaccaugagaaaugccuccuugggcaggcuucacuucccaugggcaggcuucacugaaggccccauuucuuuuuuuuuuuuuuuuuuuuuuuuuuugguguuuuugagacaggguuucucuguguaguccuggcuguccuggaacucacuuuguagaccaggcuggccucgaacucagaaauccgccugccucugccucccgagugcugggauuaaaggcgugcgccaccacgcccggcugaagcucccauuucuaacaacaggcagacuuacagaucaaaauggaggaggcuggagggauuuaaugaaaaaugaguguguguguggggggcggggggagaggaauagcugaaucaaccugcuuuggccccaggaacuucccaaaacuuuuguuuuguuugggacugggucccaauguguagcccagacuguucucaaacucccaguccucuggccucagccuccugauagcugagauuauaagcaucuaccuccauuccuugguuaagcaucuaccuccacuucuugguuggccccagcucucaggaaaaaggaauaguuuggccgugaaucauccuacagugugucucugccuagccugacacaggagcaucagguuauaaauuauaacuauuagcaauuacauguuuuaagguggauccaacauacuagggauugaguccuguccucuaaagcauugaagguuaaauccuaaaauaagauagucacucuacccuuuagaaacucagauacaugcaugcauguagaauacaugcauaggguauuccuggcuuucuacaccauuugaaaaauaguacaagacuuucuccaaacaacacaacugacuuaacauuuguaccuuacaccuccacaucuccugugaaguagcaggaaagaagauaacaacaccguuauuggcuagcaaauaacaauggaagggagcgcuggacaggagaaagcugcccugggccucaaagccaggcagacuaaggaugcagcucagccaggccuggcaacacugacuuggcucaaggcauaaaaucucuuucaccucauuuuuaaaaaaauauuuauuuuuauuuuauaugaaugcuuugcugguauuauauaaagccaccauuuguguccagugucuaugaaauccuuaaggggacauccaaucuccuaaaacuagaguuacugaugguugugaucuaccaugggggugcuggggaccaaacccagguccucugaaagagcagcaugcacucuuaacuaccaaaccaucuccccagcccccugcuucuuaaaauaaaaaggggguugguuuguuuuuagacggaguuucugucuuucuuucuuucuuuuuuuuuuuuuuuuuuuuuuuugauuuuuguuuuucgagacaggguuucucuguguagcccuggcuguccuggaacucacuucguagaccaggcuggccucgaacucagaaauccgccugccucugccuccugagugcuaggauuaaaggugugugccaccaggcccaucuggacagaguuucaucacguggaacuggcuauguagaccucucuggccuugcauuuagcaagauccuccugccucuauuccccacgugcugggacuaaaggugggcaccaccaugcucagcucaagagaaaggauacacucuguuuuaaauuuuaagcaaaaugcauguguaacacccaggccacaaauauuugagaaucaaacaagacagaauugaaagauuaacagcguucuaauaaggaaaagauaggcgcugaaucacgaggcaggcaggaaggggccuugugaggagauggcgccuagagagugcucaccaaaguccgugcuccuccacuccaucccucucaagccaagcuuccucuaaagaaagggaauucacgagauuagaaggugaguauggcuggggcauagcccagugggagggcacuuaccuagcauguauuaagccugugguucaauugccaccaccacagaagggguagauggguggggucaggagcuuuagaaaucaguuuacagccgggggcgugguggugcacgccuuuaaucccagcacucgggaggcagaggcaggcggguuucugaguucgaggccagccuggucuacaaagugaguuccaggacagucagggcuacacagagaaacccugacucgaaaaaccaaaaaaaaaaaaaaaaaaaaagaaaaaaaagaaagaaaucaguuuaccgucagaugucaacaagcaucuagugguuuuacagaauucauaacuguuuuggugagguagaaggaaugaccauaguuaaauauucaacacgcuagaaagcuuucaaagacaaauggcucggacauguagcaaguucaacccaaccccaucguccauagcucucuccauucagcucaaaugccaaaaggcaccgugcauauuugcuuuccauuugucaagucagugucaaacaccaaaaggcacuaagcauacuugcuuuuuuauuuuuuccaagcaaagguuagacgggaugagaacuguacaggggaacacauagacaaaagggcaagagaaacagugggcagaaaccgggagagaagauggccauucagagcuccuccaaaaagaucauuaacuucgcggcacuuuauuagcugcuaaaguuuccgaucuaccucuugcggacgaagcaagauaggucaagcauuguccuuuuuagcacagcgacguucagguccagcagaugcuccacaaaugucuuauggaguguccuacccucagugagguguugagauuuccagugcauuucccaauuggaaggaaugagugagaauguuccucucgcgugaaggacugucucguguguguguguguguguguguguguguguguguguuucuucucuggcuaagguuucuuaaaguccuuuguguuuuuaaaaucaccgcauagauuugagauggcccuucugugcuucaaaaauacgagaauugaguuuccuuaagcauuuuuaagcugcaaacucggaaccaaugaaggugaaaggggacaaaaaaaaaaaaaaaaaaaaaaaaccaaacucucuaaacauucaauuaccuuucuuuccuagauccagaagcacuuaguuguuuucugguuuuugguuuuguuuuaaagaucuaggcccggagaagcaaccaugaaagcccagugggcuaggaugcugcuagcuacgcuccucagacucgcugcagggcgaggcuccggaggaugcuuuggacucgccaucgcuguugcaguccggccgguggcgcuccagcagcuccugcaguugcuugauguagcugauggcggcgcgcagcgucuccaccuugcugagccgcuggcccgccagcucgcgcggcaggugcuggcggaggcgcgcguagcccucguucacacagcgcacgcgcugccgcucgcgcucguugcguuggcgcaaaaaggcgggcucggcgacgcccccaagcggcagggacgaguacggccgucuccgcgcgcaguccgcggcauccuggcgcaccgagacccugcagggcucccucccgggcagcgcgcccagcggcgcuguacguagcgcggacggcagggcaagcaguccggccgaucugcguuuuuccauucucugcgaaaaagcacgcagaugacucucucaccuugaagacgagacuggaagcugucguagcggagauucugguccauccagacuucccggucugucucuggagaaguuucuagguccagaaguuagguaccugagcacacuuggagugaacuuugcaug

SEQ ID NO: 5678 - RNA, 19199 nt, Mus musculus
agcggagcuggucgcgccugcgcccugagaggcggcgcugcguggagcggguggacugcggggugguuucucuuucuaagcguagccaggagcuaucgcuggccucgccgccaccaugagucguaacuacaacgaugagcuacaguucuuggacaagaucaauaaaaacugcuggaggaucaagaagggcuuugugcccaacaugcaggugaguuggggcagcggccuugggagcugcaggccgcgacuccgccgcgaaccggcggccuccgcccagcgcagggcugcgggguuccaggucucccuccucugcagacugcacgcgccagguccacacacacgaggacagacggacgcagcgugggggcucacgcguguuuuccccacgcaccaucagacacgguguuccuggucuuccgagauuucuguggacuuucccaaguuggcaccgccagccaggaacucuguuucucuugaguccugauauuuaguuaacguuuacagauggcauucuccaaacuuaacuggguuuuaacguaacgacaaucggcaugauucgagcuuuuaauaugcucuuggcggaggacccccgaguugguggguaacuuaucuguacccaucuaggaagacaacccugaauucguaucgaguccacuucucucagccugaaugauguguuucagcugaaggcuugggagccagagaccaggaucugaaacccugggccugcugucgccaccgccguguguacucgaaaguuccgauaaacguugaggaagaaaacacuugugagguuuuggcacauguguuaagugacaccgucucauaaaugccaugagaaugcaauaaagauuugcaguccuuugucuuaguaaaaaguuucugauaggcuucgcuugguggcucgggccuauaaucccuggaggcugggaaauggaagauccauucaggacugguuacacagagaagccuugcaccacuuugcaagguauacuagggagaaaaaguccacagcagugaaacaguauuuuccuuuguuguguggaagaagggaaggcugguugguagagucuugcuaauuuauuaagugacacaugaaaauuguacauuauauccguguguguguguguguguauaauauauauacgcauauauuauauacauauauauuauacacacauacauauuauauauauauauauauaugaugcuuuuuauaaugcguaaguuauauaauagcaaaaucaugauagacauaucgccucagaaauuugugagcaguuuuuccguuuugaagaucguugauuagauuuuacggguuggacauuuccaguuuaaacccagaucuaaaaugcucuaagauccuuuuagauugugacuggaaguuuuccucuuaaaagacgcaacguggcagcuucaugcagaaugaagcacuuugugugguauagacguucaugcagaaugaagcacuaugugugguauagacguucaugcagaaugaagcgcuaugugugguauagacguucaugcagaaugaagcgcuaugugugguauagacguucaugcagaaugaagcgcuaugugugguauagacguucaugcagaaugaagcgcuaugugugguauagacguuuaugcagaaugaagcgcuaugugugguauagacguucaugcagaaugaagcgcuaugugugguauagacguucaugcagaaugaagcacuuugugugguauagacguucaugcagaaugaagcgcuaugugugguauagacguucaugcagaaugaagcgcuaugugugguauagacguucaugcagaaugaagcgcuaugugugguauagacguucaugcagaaugaagcgcuaugugugguauagacguucaugcagaaugaagcgcuaugugugguauagacguucaugcagaaugaagcgcuaugugcaguguauacguucugcccacugggcguguacuugagaaacuuggguucagacaacgcauuuugcuuuucuuuuguaucagguugaaggaguguuuuaugugaaugaugcucuggaaaaacuaauguuugaggaauuaaggaacgccugucgagguggugguaaguacacuagagguagagcuuucccuguucccugaaucaagaggaacucaaccagugugagacauuuuuaaggagugaucuagacuugaaucaaagcaccuauauauuugugaucacauguuggggcacacugcuguguaaagguuuggagcucagggcuuguucucagauaacugcacacucuaauagcacacacugcuguccauccugcacucacugcgugucauuagaucucuauacugauuguucaugucauguuugaaauaacuaaaaagggagauauugucugucucuuguagaauuccaaaaugcagugaguguaagugacuuuuagcuuguccuuggucacagcuucauagugacagagccagaauucaaaucucaaagugccuaauuauucaaaccaguacuuuuuucuuuuuuggggggguggggcacuucucagauacauuuauuaaugccacacuguaaaggguucuuagguaagucuacagcaauguuccauguucccaucuaacacagccugcuuagguuuagcuggguuagcaccguucaucuugaguggaaucagaaguagugauggcccagggcagcugcaggacuggagccuuccagcacuuuacuucuuuuaucagcacuccugauugaauaagggaugaaggucacugaccccauuucuacccagauuuccugguaaaccuggguacaggaggguuucauggggacccacacagucuuaacaagcccuugaagcaucucaguaagagcaaggcuauaggccacaccagguuccacagcuacugggcaaaaagcaaaaccaguagucuuagcugguuacuagcuuuagugagcauuaauucacauggcugcagggcggcuuagagauaaagguguaaugcccuaaagugauacucuaaacuggcagugggauagaaucuuuuagcccuuuucuuuuuuuuuuuuuuuuuuuagauuagcaaaauaaauccuuucuuccuugcuugacuaaguucacuuguguuaaauggcacugcugaaggcuuuggcuguggcccagugaguaaagugccggcuguguaaacaugaagagcugaggugggagcccuggcaccuggguaaaagccagguucaaggaucccucugugaucucagcccuggguggggagggagacaaggcagaucuccagagcuugcugcucaguugauuuaaucaauaauugaggcccagauucaguaagagacccugucucaaaaaauaagguggacggcuagagagagggcuuaaaggaaaagccucaagacauggcugcaguuccuagaacacaaguaaagacaggaggauagagcuggcuccacaaagcugucucugcccucccugcacacauacagugaguagauccuagggaagacuacagacaugcacacacccauuauuuuuuuuaaaaggaacugcaggucguugggcaagcuggacccguccuccaucugccauugcucggguucccuagcucuucccuuugcccuucuuugucacuuagauuaacaccacugcugguuugguguaguucugcuuuggaacagucuugauccccugagacuggaguuagcgauggcuagagauggcugugagcugccauguggaugcugagacuugaaccuggauccuuuguaaaagcagccgguacaccuaaccauugagcagucugucuccacuguuaauauucuuaauagcuagugugaguuacugaaagaguacuuuuuuuuaaagauuuauuuauuuuauguaugugaguacacuguagcugucuucagacacaccaucagagggcaucagaucucauuacacauaguuaugagccaccaugugguggcuggggauugaacucagcaccuucggaagagcagucagugcucuuaaccgcugagccaucucuccagccugaaagaguacguuuuauccuggcagcauaaagguuaagaguuaauguuuccugucccuacuccauuugcagccagcuuccuggcacacagagugcuggcaggcauggccaaguguccugugcuuccugugacugggcuuugucaugaaggucucuccccacuuccaccauccuuccccacucaguaaccauagcuacugacuugucauguaugcaacuacuguugaaaaucaaaugugucauguuucuaagacugagguuuuccccccagguguugguggcuuucugccagccaugaagcagauuggcaauguggcagcccugccuggaauaguucaugugagucagagucaaccuuaaucguuuauauugucuaaaguuuauugaaagaaugaagggcuccaccugacagacacuggugucauuuagacuaugaccuuuaaccauagcaguaaccuuggagcuaagaacugaauccggaaggcaucuuagucucuagaaucuaagcauuugugaaccuuuauggcaagauuuaaaucuugccauugugggcauuagucccuccccaguacaccuuucuagguucuacugugacucuguacaacuggggaggagaugaagagaaagaaaggacaccuaccuagcuaucuagcacugcuggagcacugacaagacaguaaauaguguggaaguagauguuguaaaugggccucuacuaccguagcuucagacuucacacucagaggagagaguugagaauggguccaucugccagacuuucaugaggcuucuuaaugcuacuuaaaaugcuggggggggggggggcugcugauaaaagaugcggcuuguugaccucaccuuauuucaccucuuuucuguuuggcaugccaauccuucacucugccacagauguaugaaauaugcuguauuaauuuuaucaaauacauuucauuuaugaaaucccucguggucuauagcuaagcccuugcaaaaccacaguuugccagugucuugagacaguuugaguagguagcagcaccuuuacuuaaugugugauucuccuauagcgugcuacucagagccuuuucuguggguagucagacuucaugaaaagauguccuuguguauucagcuuugugaauaggagucuguagaugaauggcccuucaaaagagacucagacuugcuggggaucagcuccagcggcaagguccagguccugaggugggguaggaugucaguaaaaauaaagauacugaccaccuguugacuuucaaacaaguggcccugaauaguucaagccaucuuuauuuauauaauuacaguccugcuugccugagcagugacaucauugguuaguuuauuaaagaaaucauaacagcauuauaaaagcucuguuauuacaaaaggcuuccaauaguuuccguuccuccuccuccuccccucccacuggccaaucacccccaaccuuauuuugcacuacaaagcacaauuacagcaagccaaaaauaaaugucuagccaagcauguccuguagacaugagcacauacccagcucguagcaaaugcgguuacacaguuaugcaaggcaagagacaauuaaacguguguggguauaagucccaucaucaaauagcagcccucugucgugauacuuuuuuaauugcagauaaagacgugcucuuuauaccaagaaaccucuucugauaugcaccuuucaguucuugauaccaccuuucuaauaaccauuuucaagucucuauugaucaaacuucccuauuuucuaagucucuguugaucagacauagcuuccucauuuuaagucucuguagaucagacaucuuccucagaacaguuaugcaaacaggacccacugcucuccacaacugccccagacauguaccaaaauacccaggauuaauggucacauuuucuggauugacagaagcagaggguggagagaaggguuuuacuccucaaaagaguauugaggaaaacagaaucaucuacagggcuuuuugcccaugacugacaaagugaaucuagauuuugcuaugcauguagacaacauagaacucaaggagagcuuguagcauauucgauagguacuaagcauagaggccaccaaauuuaccacagguccuugacaagugggaaggggucuccaugggccucgccacggcagagucccaucagugggucacucagaagcuguucccugcugaugcugcauggccacugccacagaaaaggccaggccccucaggcagcucgggugcagagugcagcuuugcugugcuucaugucucuuucucuugcagcggucuaucgggcuuccugauguccauucaggcuauggguuugccauagggaacauggcugccuuugauaugaaugacccugaggccguuguauccccagguaaggucccuuuugccuucugcuguuacggcauggcucucuguguugcauggccuuuuugagacgguggguuugugugcauuucucagucucauuguguucuugaggucuuuuguuccacauuaaacuuaguuauggacauugggcuguuaaaauaucagucaaaccacuuauugaaaacuuuggagacuuuugucagaugucagccaguaucagacacuggcuacaaaagaaacacuucucuggcuucccugugugcacacuuguguauaccacagacaaaagaagauguugagaaaaggggaugcacacuguuggugagacuggauugaggaagccauuguagagaaugguucauggacauucuuuuaaaaaauuaaaaacuauaacuuuauaugacucagccaucccuuuucuggguauauaucuagaggaacugaaaucauuauuucaaagugauaucugcauuaguaugauuacuguagcauuuauucacaauagacaagcuaggggaacaacccaaauguugguuauggaaugaguagguagagguagugagaguggaauauuauucagcuugaagaaaggagagccugcccauuuggaauagcaugggugaccuaugagcaaaauaaucuacacaaacagugacagauagacagcucacucacauagagaauggugcuugucagaguggagggaagguggagagggcugauuugggggauguuggcuaaaggauucagauuacagaugaaagugaauuacaguccuggagaccuaaucuacaguaugguggguagagaaacagugauguacugugugcuugagaucugcuaagacaucuggucuugaguuuucuccccagggaaaaggugugcuugcaaaagugaaagauacguuaacuagcuuaauugugcgaucauuuuaagauauauacgcauaauacuucauauaaaaguuguuccuuaaucaguuaucucaggaaagcuaggagacaucguuuucagaaauacuugaauauaaaauuuuucaauuacuguaaaucucauucuuggauguaaguauacuauagccccuaauguucagauuaggaaagaaggagggcugaaauaucuucuuuuuuaauguauaugauguuucaccugcauauaugucuaugcaccaugugugugccugguaccugggaaggccaaagaggacauagcccaucacuugggacaaugagguugcaagcugccuuguagguguuggggaucagacuagggccucuggaaaaaagccaggacucugcucuuagccacuggaccauuucuacagcuucuggaauaucuuuaaaaguuagagaaagaauaacaauuuagacuagaacaggcaaaaaauuggaaaucauuaggaaaaaaauaaugaagguacacagaagggaaggucacagagguuguguauuugagaagaccaacggaauucgucagagccugaugugagaaagauacagggaggcgugucccuccuuuucaucugugugccauugucuccgcugcugacagaauaccuuaguguguguguuacuugcaugacuuuaguguuggcacacuugacucagcagagggccacuuguaagccuacauuaaaacaugcuugccuuugaacaaugaagauccuuuuaauucuguaugaauacuaaggaauuucaagaaugcucugauuuugcuaauacuucuguauguuguagguggugucggauuugauauuaacugugguguccgcuugcuaagaaccaauuuagaugagagcgauguacagccugugaaggaacaacuugcccaagcuauguuugaccacaucccuguuggggugggaucaaaaggugucauuccaaugaaugccaaguaagagcaccaguucugggaaacggaaaggggguggagggagccacacgcucugggcuuugccucuaauuuagacauuucccagucacuccuuaagaagugcaaauuaguugccuuuuaaaguaucugucccagcccauguucauuagaacagaccuugaacuauacuuguuggaauauaccuguagucuuagcgucugaggaggcugacaugguagaaucauuuuaacucaagaguuggaagccacccugggcagcauauaagacugucuaaaauuaaaaagaaaaggccuguggcuagaaagaugacucagugauuaagaccacuggcugcucuuccagaagcccaggguucaauucaugggaagccacaugucagcucacagccauuuguaacucuagccccagggcaucuggcacucuguucugacuguggaaacugcauguauguggugcacagauauaugguggggcaaaacuuccacauacauagcaguugauuaauuaagaaaaagccauccuuggugucgaauacuuuagaauaagagcacuuuaagcauaaagcacaccgugccugauguuucguccagaugaugaccgcugcuagaagaaagccaagcgagugaaagaagcaguaguuaugucaggcuucagaccaaagaucucucugccuuucagacaggcauuguuccgaguaccauucagagaacccauucaucuccaucuuccauuugaaucaugguacugaguaugugcuuucuuuacuaaguagugcaguaacacaggcuaaauaaaguguuacugucucucaguggacagcgcuacacacugcucgugcacaacaacacaaccauauacuuggcagagauuucacuaccucaaaccugcuguguagccaggcuggcuuugaacuuaggggccccugucuuagcuaacccuucuaaauuuuaggguugcacauguaccuugugguauacuguacacuauacgccacaaauaccccaugcuuaucaagugugagucaaagauguuccuuugacaucugcauuguaugaacuuugcauuuucaguuuuaugcauauauuaaugcagaaacacucuuaacuguuaaccuuuuacacacuuccaccaaaaaagaacaacagcugagggaaaauuaauuuagaagaugcuuauccuuuguuuucauaugacgccuguguugcuccaccgugaaaagcauacauuuaacagugagugacaugaagcaucuuuacaaauacuucagguagaaauuuuguccuaauucauacuguuuguaaaggacugucauuuaggguacuagaaagggaguguuaagcugagaucucuucugggugugcuugugaauccugaaacuugggggaagaugaaggcaucuucgaagugcuuaguauuugugcccuucagcuucacagugcaggugcaguaagccacacaauggguuggugaaaauaaaccuuaaaauggaaccuguguuacuugagaaaauucaaauaccuucauuuuuggcuaaucuuuucauaaauuauuaaaaaagacauuguaaagucgagguagguaguaauaucugauuaagauuauagcuuuuauuuggauauuuaauuguucucaggaacuucagaaucagaggcacaaauauaauuuaaaaaaauauaauuaaaaaguguaucacagacacuggugauauaguagaguguuuacuuagugugcacaaaaacuaagcacagugguguacgugguggagagaggcagaaauuucugaaguuaggaucauucuugacuacagugaguuuaaggccagccugaacuacaugagaaccuguucuggcuuaucuguuuuucaguacaacaaaccaugaaaauaaguggaacuauaaucauuguaaugacacugucacaauuuuaaauaguaaccaugugacugcuuuccucaaaaaaaaaaaaaaaaaaaaggaaagaaaagaaaacuagagggcuuaaacucuagaacaaaaccagguacacaggaagguaguaauugucgcauaguccugugcgcuuugagauguguuucuuccugaguuuugcuguccuuuacuaagaaaugacuuggauuuccuuacucaccccagagacuuggaggaggcauuggagauggggguggacuggucccugagggaaggcuaugccugggcugaagacaaggagcacugugaggaguauggaaggaugcugcaagccgaccccaauaaggucucacccagggcaaagaaaaggggccuuccucagguaacucacuccgcagggcagugugccacuuuagcuuuuguagagggaggaagucugaaccuucuguuuaacaaaacaaacaaaaguuauccuuggagaguuuuuuuauaguacaucaaaaagaacauaaagguguuugcuugugaaucauuuuucugaaagguuaugcagagcuuucaaauauucaugaagaacucugaguuacaagugaaucggagaaaagugggauaugauuaugagguuuauaaaccaugucauaauuuagauuuuuaaaaaucguuagaaaagaauggagguagugagaugcucagugggugggaacacaagccucacucagagcugagcucagucuccggaacacucguaacgguggaaagagaacugacuccaaaaaugugagcccuggccucucuugugcaugcugcugcacacaggcccacacaucauacaacaggagucagacaacagucucugugacuuggcgaguguuuccgguaccuaacaugaaaaaugauguaucaaaaaucauuucaaccugggcuuaucugagaaucaucauucuuccuggaauuuggcccaucucaauguacuuaaaacuuauguauggaauacuuaaagcacaugauauucuagaccuuuagagcaguccauauuauuuuugaaacauguagugauaaauuuagaauuuuuuccuuacauaagacacuguauggcuauuuuguuguugcuuugguuucaccuauuugcuuuuaagauauauguauguauguauguauguuuuuaacuagaauagaaacuguguaaucagacauucuuguauuuacaguuggggacccugggagcaggcaaccauuaugcagaaauccagguuguagaugagauuuucaaugaguaugccgccaagaagaugggcaucgaccauaagggacaggugugugugaugauccacaguggaagcagaggcuugggccaccaaguagcuacagguauucuagaccugaauuuuuacuuggaacuaaaauguauguuuuagggggaacaagacaagagagcuaaaugagccauagaaauacaguugaauggauuuuuaaccuguggcuuucugaacuuaugauccugaaaauuuucuucauuggaccuugaacuuucucaucugaaaaaaaaaauggguaucauuacuucaucuaauauuguuauggaagguucgugaaauagcggauacaaagcauguaacugcuguggcacuuacauuguacacagaacuguuguacacagaaagcacugguagugcuagcucuguuuagcacuguauucacugugggggcgggggaaugcuagcuaucuuaguaguauauggacuguggaguugaaguagaugcucauucagugagccuguaauacucggcaagguuuuuaggaauuuugguggauuguguucuaaaauagguacauccucacucugaaggauaaggccaugugcaucaaggaaaagaagggaguuggaaagguagcucaguuaguaaagaccaaggcaagccuggugauguaaguucagucccucaacccuaaagaagaaaagugcuaggcauggugcugcgcacuuguaaucacagugcuggggaggcagagacugacuaaugcauggaacucuggccaaccagcauagccugacugccaagcuuugggccagcaagagacgcucucucauaagaacaagacacccaaggaucaacacuugaccaugggcauccacaugagcacucauuccaaaccuuccaccacugcagucuuaggguuuccauugcugugaagagauaccaugaccaagaccacucuuauaaaggacagcauuucauuguggcuggcuuacagguucugagguucagucucuuauggugggaagcauggcagcauacaggcaggcagggcccuagaggagcugagaguucuacaucuuguuccaaaggcaaacaauagaagacugguucccauguggcuagaaggaaggucucaaagccuacccccaccauggcacacuuacuacaaggccacgccgccuaauagugccacucccugagccaagcauauucauaccaccacaaccaccacugauaaauaguaauugauaaaauauuauaagaaaggcaacaaauuuaauguauuugaaaaguauuuagagauagcuucauagacaagacucaaagcuaggccaugggguuugaauaauaacacauagacauucaggaaacguagcaagaacacaagcaaggaguagagaaguaggugucuaagugucuuauagggauuagugaagugugagacaguguacacacuagagaauuauaaacauuaauuccauguuaacuguuaagcuuugcaguuugauuucauccuguaagacucaaucauuugugccagccugacccuuuacuuuacucuaacagcuauaugaaguguugacuguggcuuugauguuaagcaguucucaugcauguuuacuauuaaggcauuaaauguguuuaagauguguuguuccacacacuaugaucuuaucauucaggggcugagcaaaaguggcccagggcaguuaguuagaagauaaauguguuacaaagugagacagucuuuaaaaaagaaacaaauuuauuuaaagcccaugaugguaacaaaauauaugcucauucacucacguguugggaagggaguggcuaaagcuguguugcuguuguacacaucccauuucacguuucuaaaggcacaugcucucugugugucucacauagcuaugucacuguacucagaagauucucaauaaauacuuuuuuauaaaaauuaauuuaaaggcauuauuuagguguaugugugccugcuugucucuaugugugcaaugugcauacagugcucaaggaggcgagaagaggguuuagauucccuggaacuggagugaacagacaaucgugagcuaccauguggauaaacccaggccaucugcaaagagcauccagugcuauuaacugcugagcuaucuaucuaucuuuccaauuauaucguaauugagcaaauagaugaaugcagaagcauacuuaggguuuuguuuugaauuugaauguucacuucuuucuacaguaaaucugaaugauuuauuuaagagaaaccuaccuggucugacguaugguucuguugcagaugcacugguagcuauggaaaaggccaugaagagagacaagauuauagucaaugaccggcaguuggcuugugcucggauugcauccccagagggacaagacuaucuaaagggaauggcugcagcuggaaacuacgccuggguuaaccgcuccucuaugaccuucuuaacccgucagguaaaggaaaauugcucucuugaguuaaucaggaaguuaauaagcaugguugguuuuagaaaugugcauucuagaugcuagggaggucucuuaggguuuuggugucuuuggccaggagaguacagccagaaugaccuaauuuugccuugagccucagcaagaauggaaaugccauucucugugauugagaaggcucggcaagaauugucugcaggcaagauccggagcagugagcagccugucugccugagguggacucugucgcaagcacuggucuaaagggcagucucugugcuuccuauaaagaugagugacuaguguuuaguacucugaaguccaccauucacuagcugaaagcaguaaacuauguccccaagagcuagaacuggcugcuuauaauggaaacuuccccuauaggcuuuugccaaagucuucaacacaaccccugaugaccuggaccugcaugugaucuaugaugugucgcacaauaucgccaaaguggagcagcacgugguggaugggaaggaacggacgcugcuggugcacaggaagggauccacccgugcuuucccgccucaccacccccucauugcuguggauuaucaaguaugugacccugcauucauguuugagcagugaggucaggaauagagaauucugauacagguucaguaaagcaggaaaaccuguguaaagaaaaucuccuguucccugugacagcagugguuccuauacucugcaucagugacaccccaucucuagugagugcugucuuagugcuacacuaggcaugcuuuacuccccugagcuauauggccuggggguuauuguaaggccgacaaagguucaacugcaguguuucuuucccuuaacucucgggguuuugcagaugaggaaacagaaguccagagagggcaggugccuugcauggaugaaaaugcuaaccauccaucccuccaguuugaguguuuucuguacuacauucugucuguucuugacccuuauaguuuccuucucuuucuuuucccagggagcuagaaaaucccaaguagugcuuuauuauagccacaagagcacugagucacaagagcacugagucacaagagcacugagauuagagguuuagguuucuuguacaguucugcaacacaagaaauuucaggcauaaaaagcaugugccuuucuaaaauuuaauguugguuuuguguacccucagcucacaggacaaccagugcuuauugguggcaccauggggaccuguaguuacguucugacuggcacugaacaaggcaugacugagaccuuuggaacaaccugucauggagcgguaagaagaaugaaaacuugcuaagaaaugcugucaguuuagcuauuugcucuugcugcaagccuggugauccuaguuccagcccagcacgcucgcaucuguaaucccagcacuccugcaacaagacgggaagacuagagagucaccggaagcucacauagcagguguccuggaguucuucacagcagcagaaacuagagacccugccuccaccagguggaaggagagaguccacuucugaccuccacacacacgccauggcuuuuguacauacaugugcucauguccauacacacuaacauaaaaggggaaagaauaagcacauaguagaaugugauaauggugagaauuucauuaucaaggaaaaggcauagaauuccaagggcuuaaacacuacuggagucaaguggacuuuaguucgaaaugcauaaacugguuuauuccuguccuugcuccuuucucauucuagggccgugcuuuguccagagcaaaaucacgucguaacuuagauuuccaagaugucuuagacaaacuggcagacaugggaauugcaauccggguugcuucccccaagcugguuauggaagaggugaguggcguccugaaaguuuuuaccaggaagccuuaagauuuaugccugugggcagagacuggaguuucugguguuacagagaugcgguaggguugguugguugucagugacuucaguuggggcguuuggguuuuauauuuguuuucucacuuacugcuguuuugagaauuccauccacagauaugauuuguuuuugucaugcccacucacccucucccuuucuguuccuccucuuacaaaugucccaccgcucacugucccagaggaggccaucucuagccuacucuggccuugaaacaauccucaggcuccuguauucgaggaucacaagugugagccaccacuccuggcucugauuuugguuuaucucauuuuauuuuauauugcccuuuguuuggagacuaagucuauugccagcuagaucuauguuauaauguuugaaaguagguuguaagggccugguugaaggagaaaacuuacucuuucaaauuguuuccaaccuccacaugugcaguguguaugugccacgcacacacaauagaauuuaauggggaaaaaugcuuuugucuuuuugugguuuguuguuguuguuguuguuguuguuguugcuguuguuguuugcuuuuuaauuguguaucccuggcuguccaggaacucccucuguagaccaggcuaaccucaaacucggaaaauugccugccuuucccucagccuccugagugcugggauaaaggugugugccaacaccuccugcaacggucaaaacuuagaauaaguagaaguaguuuaaggugacccauuguaaccuugauucugcacaguugcaugcuuacauuucaguuuaggacaaauuuggaaaaggagagaagcaauuuggguuuaguucacagaggaaaaauuguauuuaaaugaucugcauguacuuaagagaaacccaguuauccgaccccuccuucauuuugaagagcacuuagguuucccugaugcuguuuugaagguguaguugucaaauuuucuuuguccuuuuaaaaaggcagcuccuucugagguucuuggugucucuuuccucagugcagcagaugagcggcuuggcuucugcucacacagcuucccuugguugcuguaaacugugcuguaaaggcauauucauucuugacgcuucauaacuagaagucucaaguagaaugacugggucaagcuuggcuuuuuuugguuggugguuugguuugguuugguuugguuugguuugguuugguuugguuugguuugguuuugcuguaacuuaauuuuuacauguuuugaggaguaauuugggauuggaggcuggagccauggcucagcugugaagaguauuuguuguucuuucaaaggaccuggguucaauucucaguagccacaugauuuuucacaucuauuuauaacuccgauucaauuaacucugcccucugcaggcaccagacagagacauaaacacuccuacacauaaaauaaguaaaucuaaaauauaaucacagucuaaaagguaggaacuguuuaauuuaaacacugugggaaacacuaaggacaaacggugugugggggccagaggacaguucagugcagucagauuucucaugcuugcaugaguucgagggaucaaaguuggauuaccaggcuugcacauuccccacugagccaccucacuggccuggcgugugcaucccuccucuccgcuagugguaccuggagcauccauauaguugguccacagucuguguucuccuucacuggacuugaaggggaaacaacagggucugggacaaauacugugguucccagucuccucucugggcaccuguguaccacugggagucagggccaugggucuaccuuucccucggggugucugcgcgacaggcagagaggggaggcagauccccuggucuguaugggagugagggcugaguauaccacccauggggguggaagagaaggccuuccuccauggcucauuuaagaugaagccuuuccuauugugauccuuaaugaagagacaauccuugcuuauccauacuggcuuauuugaugguggaugugaaugcauacccuuuauucagggugaaccagggacuaaaccuuuguggaagggaauaccaaggaagggaagcucauuggcugaaggcuuagagcugucuagauaccucacuagcauggagaaaaaaacuccagguguuuaugcuauguggcccagugcuggugguccucgguggggagucaugguuacauguugcagagcagguagagaauggcuccacuccugcuguucugagauucccaugguuugaguucauuuagccuuaccauuucuuaugccuguaugguaccaaggacccacaugccuuacacuggccccugcuuauaaauauacaauaauacauauauuuuugagaaauuagaaaaugcagaugaaaauguaagaccaaguauuuaucucauaucccuuuccagcacugaguuuacucauguuuuuaaccuuugcuuuuuuuuuuuuuuuuuuuucuucuuuucaagacaggguuucucuguguaucccuggcuguccuggaacucaggcuggccucaaacucagagauccgccugccucugccucccaagugcugggauuaaagguguaagccacuacaccgggcuaacuugcuaauuuaaugggcaccugaguauuuauuucaaauaaaacuuaauaguuugaaagauuuccuuuugguggauuuuacaguguucaauuccuucucuguaggcaccagaguccuauaagaaugugacagacgucgugaacaccugccaugaugcugggaucagcaagaaggccauuaaacugagaccaauugcuguuauuaaaggguagauccaagacuaucagagcgucugaggugcccauggacugaaauuccuaagacaugagacucaaggccugacaagauccgaauugcagagcuguugcugugcgugccaccauggcugguggagaggcugcugucacaggguuggaaaauagccuuccaggagaugugucucugaugggagcagggcaaaugagccucuucuuccuuugucccacagggguuugugacugucaauuggggugugggaaggggcccagaaaugcccuguuuggucauacaagucuguaaucaccagagugggcuucuuuaucccaggcccuguuuguagcccagaagguaucauggagaacaugcuauuaaauagguuuuugaauguuuccuuucuucucu

SEQ ID NO: 5679 - RNA, 1872 nt, Mus musculus
cuuuugcugaacaauugugugcagagcagcgcuauucucaguguuccacugaacccucuuuucagccugugagauggguacugacuguuaagaugcaugcuucauagaugaagauauugaagaccagaaaaaugauggauuuacuccaaaccacauagcaaugagugacgguccaggcuggaccccagcguaaucagauucuaaugcuuccagaguaaagcuuuuucuguacaagcccgagugccuuuuuagcuuugucaccaaaggcagugcaugaauaugaggcgaggaaugugcuuugagcucuuugauuuaugcccuaggaaaacaagucagauagcaaaaggucauguuucugucacuccuccuguuggcuugccaggcagagagaugcuggggccagcagauauggagaagcugccccaggaagauaagggcacuggggcuguucuuggaccaguggcuuuguuguccaauccaggaauauaggaagagggugagugccugaucccauaucaccagguccugcguguccgagcaugacugccauuaucaacgcaugguguguaagcgugcaguguuagauaagucccagguugagaggaaggagcagugugauauuggcugucacacugucccuuggggaccuuccuuuuuguccucugggacuaggugugauggaggaagaugaauucuggaguuccugccugcuauaagcaggaugaccaggaaucugcuguucuuugcugcaggguuuggaguaggaagaguucaacuuagcuggagcagaagcccuuggcaaacaccuuccucaaucuguccccuuuuguuuauuucucaguguggcucaagggcugauugcauuacugguagagaaauaaacccuaaacccagggaaauggccauucugauguguuuuuucuuaaucucauuuuccauugauugauugauguaaugcgcacagggguuucaaggcuuggggaaacugcugccguuagcuuuggcuccugccucuauuagcucaucggggguuacaggcaaugcuaugaagcucaucauuuggccagcucccauccauuucuauacugguccagaguuuucauuaugaagucacagcauuugaguuccaauccaucuuguucucagagagcugcauggcuucaggagaaucuccaccuuagaucuguuugcucuuccggacaaugaaagaaaugaucgugucucucaugcaagacuguugguaaggaugaaacugacuuaacaagacuaaacucuuagugcugggcucaaacucagaugcaacgcaucuacugaggcuuuuaugaagcgcugcaugcucauuucuguucuaccccauuacuccaucagauuggugaaauuuuacaauucucaggucacacaauaagaggcuggucccucaguggcuugauuucucaagccaaagccaggcuauuuuugacucccaugucuagauucuacugaucuguuaggaccuccucaggcaucacgugcucccagcuagcccuuccugauuccccccauacuugguuccuauuuguuguagcuugaauguaguuuggaaugcuuaguuugaacacucuuguguuuggauacuuggcccccagaugguggcaguguuugggaagguuguggaaccuuuaggaggaugagcuuuguuggaggaagugggucacuguggguggagucuugagguuuuagagccugacucuauuuccuguguauucucugcuuucaaaguauggauaugaucagauaggcuucuguucucacucccaugccuuuccugccugcugcuaugucuuccccaccacgguggacugugugagccaaaauaaauccuuugucccuuau

SEQ ID NO: 5680 - RNA, 49137 nt, Mus musculus
aaggaucugaacgguccgggccggcuccgcccugucgccccgcgccccccggccccgcccccuuuuuggagggccgaugagguaaugcggcgcugccauuggucggagggggcggaccccgagcucccgaggggcuggguccccucgcgccccuauaucacucugcagcccuggacucucgcucacagugggcagcgggcagccgccagcgccaagaaucuucuucucccgcuucuccgcuucccgauccuucuccgggaggccacucguuggcuccgcggacucguguuccagcgacccuuggccacuuaguccugucccgccgggcuacuuggaaggcacuuccccggagcucaucguugcccaccgugcacagugcccgguuaaacccagcgagugagcucggacuguagcaucagcgcuagcgcucggcaacuuugaagaaaagagcggcaguccccgcagcggaccacaacagcuaccaugacucccuggcuugggcuugucgugcuccugagcugcuggagccuugggcacuggggcgcggaagcgugcacaugcucucccagccauccccaggaugccuucugcaacuccgacaucgguaagugcuccggaagacucaguuucccugggcggggacucuguguggggagaugcccugcagagggaacccaaccaguggccuaguggucucuggcgggcgagcgugaacgagguccugcuugauaucuagaaaaauuuccccauugccuugaagggaaaagagcuggagaaggagggugagagauucugaaaaguuggaacgcuaacugaaguucugggaccucgacgacacuuuacaaguuguagucugugcggguggaguugcgagagagaaaacuccuagcuucaaagauugcuuaucucccgcgcccuugaacuucauucuuuuccuugagaaacucagccuagcugcaggcucucccggcaagugcuaauggagcuucuugccugccaaguuuggguggcuggaaaaggggggagggggagaugaaaaaaaaacggggagggggggggcggaaacugugggauugcccuccucccugggagaacugcaucagaguguugauagcuggccugaggugacugugggggaaucacuuaucauagagcugugaaaauucacaggaagauauauuuuuucuucccccggaauguuugugaggagggagagagugaguaucaucggagaaagcagauuugucaccaaaagagcaaagcugccaaaggucucaucgcuuguggugauggucucaaagagacugugcugauuagagggacuugauaagaaguagaacccacuauccagaggaguguuggggacauuaguguuuggagggcuccaggggaaguggaagcuggcuacucucuucuccagcuccuuaaagcucucagguccaauguguguuugcugggcaggggugggacaagaggcugcccuuagccaguguggagucaguaaagaauggaguguguguguuuuaaguauggucauaaaggagauggaaaauuuccacugggucuugagugagggauucuacucugcaaguguguuguguugagaggggggcggggggagggguggugaccuggcaggaaagaaaaccaagguuggagaggcacugcuggugggucggccuagggggaaaucugggaggugguuuugguggucaggucaguccacuuggcagcccaggguguuugugugacccugcagucacccuucuugaagguuuccugggacccagagacacccacccuucucugucccugggggagaaccccuggcuuuauggagugcuugcaagcauccuuuuuuggauugcuggagggcugggaaaguuuucucccuucucucauuagggcccccacccagauuccucuuagucuuuccucccaguagccgaugacuuucucuacuaguuccugcugucugcuuuugcucagccuagagccuggugcuggccugugagcuagcagguggaggaaucugggugugcagucuaugguccaagcucuuuucagcuucacagugggucgaggcguguucaguuugguuugguagugugaguagggagagaggguucucaucucuaaccuagagauuagagguuucggccuugacaacaugagcguguucccagugggcacuccugggguccuacugugggucagacugacaaaguuucuuguaauuucuauggguuuauucaagaaacagcuuuuuuuuuuccuuccucuuaauaugcuuccuagaacaaagucaaauuaccaagaaauaugccaaacccagaacagagagagagagagagagagagagagagagagagagagagagagagagagauccuugcucuggcagggauccaggcucacuaacccucaguuuggugcacugcacaagagaugagauaaugcuuuuaaaaaugggaggugugggugugggccugcuggcuuguugaccugcugccgccugacagcagcaggcacccugccuguugccaccaguagauggcucccaacuguccucgggaaacuggagcucggaaagugugcucaagcccgucugccuccuuccucuuccagaaccuucaagcauucucacucuggccagaugccaugcugccaggcaagggcacagcaugccuagcugggccccugguaagcccccaucaccacaccaaaauggccuucccucucccuguuucuuuauccacgggugucucuuuucucuuuuuuuucuccaaaacccaugggacuggcacaaccuucuggaugaggaggaguuaaaagguguuucuauggcaacugcaggcccuguacccuauuaaaguguuuagaagaauaaacuacacagacgcuuaucagauacacuguggggcaaagaaagagacuuggcagcagucgccucaccuggggccuucuccuuccaguccuugcuccuccuucaaaaccuugacugaagaagcagcggggagggcacugggaaugaaagaggcaggcuuggccaggcagacuuuguucuggccaccuuaguucaggaaggaugggaaauguucagagcauucugaaaacuggagugggguggugugugugugugugugugugugugugugugugugugugugugugugugugugugugugugguuuuggcagaggugggaguaguagagaaaacccccuucucucugucuccauucacaaggaguaauuaggcaguggcauuggugggaguggagaggugucagcccugggucugggaggagcagcugacaaccuuggagaauagcccugauaucauugaguuguuuugacagggaccacugccaggggcguguuccuucagcaucagaucugaagugguuuuagcaaagaagccauuuguagacaaacgugaccuaugcccucucacuccuacaggcagacagacacaaagaaaaugaaauuauggaacuuuggagaauugacaaccaccuaguggggaugguggugugcguguacgugcaugugugcauguccauguguaccaaugcuaauaguaucucgagaauccuggccagaggaagacugcuguuaggcaagaggaaagaagggacggaugcauucagacuugcaugggugugcaagcauguuagagguacuaucuuaacuccccagcaaccuuaagugguauugcacccauuucucagaugggaaauacugaggcugaaugagaucaugcaaggccacccaguaguggccaggcaugcauucagucuucaugaugagaccuuucacuaaccucugacaucuugcacugacuucugacauccuaaggcaggcaccugcaccuggaauccaaaugaaagggacagauggcauuuucaucuagauuagaaaagcuuuccuccaaccuuugaaggcagcuaaaggggccagcaguuuuaauuaaguauccuguuuacggaggaagaauugauuauaguuuuauaacggaacaacauuaaaaaaaaaaaaaggaaauucccuauguucuuuagcuacuaaaaccagaaaagacucucaaaauuauuaggucagagugaaacuaauugugugucacuaagaccagcgaacagcaaggcugauagaauccaaacuugcaggaugacuguaggagacaggauucccaggggauccaccugccagugcugagugggagguggaugaguggagcaugaggcaggaaggaagucugcagacugggguccucguggguguagaaggugccccucugacugaucugucccuuucccaguccccugacagacaagacuagaacagggcugggaaguggcuuugcuggcacagcaggagccauugagcucagcugcugacuggcacauuccaacagguucauuaaugaaaaacaaaaaccauuccaguccccuuuggcuuuuaacacuuuagccugugcuauguggacacgaaggccccuucuaaccacuuuugucacauucagcucuuggguggucucuagaggccaugugggaugguggaagagcccuggacagggcacagcugggcucagauccuccccccuccccaaccccagcaucuuguuggcuuuguguuuaggcuuuuauuggguccuuucagccuuuacucuccucgugaugaaaggacacaguaauuuguacuuucagaccuuuuuuuauucaugccuuuaagcuuaaaguuuuacagugauguguuauuuuauguuuauguaucauuuauccuaucuaucuaccuaccuaucuaucuaucuaucuaucuaucuaucuaucuaucuaucuaucuaucuauccauccauccauccauccacccacccauccacccauccauuuauacauguaccucccuaucucuucaucuacccaccucuacaaaaucaaagaaagagcaagucgcuuuggaucgcugcuucaaucaauacuacuucuuucuauucuccaucugcauccuuacaucauuauccgaggaacauucccagaaguuuugcuucauuagaaaguuguaaaguuagaagacugaauacuggagugaccuuggugucguuucuguucaaucauguauaccagggagugauauacauauacauguggguaauuguagucuugcucuccuuaguauuccaugggaugauaauuuuuuuaaaacccaaugcugaguuuuaagauagaaugauuacugugugcuaggcaucauuccaaauaauuaauaugcauuaguucauucaagucucucaacaguccuacgaggcagauguacuauuaucaucuucacugaaaaaagcugcagcucagaaaaauucaguaaguuguucagugcuauaccugguaaguagcagagacuaguauuuacacccauguaucccaccucucuggugucuccagcuagacuauauaacauuuauagugcuauauguggugauauuacuaugacaauauaauauucauuuagaucuaccaucacuuuauuuagauaucuccuauuuauggauagcuaugcuucuaacaacuuucaccuuccuaagagugcuagaacacauggucacuauauuaucuuuugcugcugugcguggagaagccucuauggcaagcguacauuuggaaguauuggugggaaggaaggacacuguauuuucagcuuugcugcaguccaccgccagagcugcauguugacucuguccuuuuuagguuugcaaucagaggaugggagauggaggcaauagcacaguguugugcugcagauacauucaggcuucucucaaauggaaaacaauuuuagacauuuccuugguauucugacgacuucugcuuuuggucagccuuuuuaucuuuuugaaagggaacaaaauuaaggccacuuaggccaaguuaaugggaucacuuucauaccaagagaaggucuuaagugguaggacagccacagcucuugacuuguggcugggcuacuuuaguuagagauggcuguaggcuuuugcuuuuauaauacguagggcgcuuuucauuacuggaaacuuguuuggacuuugguuuuugcaugaacucagguucaaaagugcaugugugaaacugggacauaggcuuuugugccccuaguugggcucagggugacagcaagaagacugaugccuuuguuccuuccugcagugauugcucaucuggauagugcuuggauggaaaaauaaaauggcugcaaggacggcgguaaauagcugagacagagugggccuggcagagaaagacucuggggucuugacauuaggaaaccugcuuuaagaaaugaucccaccauccugacuagaagucuucaguggguuaaugggguaaaguuauaauaaaauggcuuuuguaaggacugauaaugggcccugcccaucucuucauuggucuuuccugcuuuccuggugauccuguuuucugccggcucuugacccaugcaugcuagguccucccaucauacauccucaugaacuucucauuuucugggucucacuugguccuguuuucugcuaucuguaggacaccauuucuacuaaaagucaacuccucugaaauuccaugaggccugcccagagggcaucaucccaaagccagaaccacaagccugcugaggcaccuguuuuguucucugcuuaugugauaauucuagccccaccauacaguggaacaaacacaacagcaucuuccuaaucagaccuaucauugagguugcaauuacuaucacaacggccaugggcugagcuccucacuuguguaaagaugaggcauuccuucucaugugcuacccacucaguagccucagguugaaaaaggaaaacuuccugccuaacaucagacaagaaacagcccagccugaagcuauaucgccaaagacuguguucaggaucauucucuccuguagauuuagggucucuucuccuggagacuaagaaacgcagcucucuagaacagggaagguccuccuucuuuugcaacaaugugcaacuuuggcacauuggucucugacucacacuguuggaacgcucuggggccauucccuuugacagccucucuggucccugcuguccucaauuucauuauaguguuaguuauuuggaguucuuaauggaaccaagccacacgaaaaauccaugauuucuagccuagaucucuaucuucacccuuauugaauccauccuucuugauacugaaaaauauuuuaaaauccacuucuccaucaguggauauugcuucacagcuucauguguggaguaucuauucccaguccuauaaacaaacaguuuaaaacagaaaauugccacaaugcuagcagguucaaguuggacauauuggcugccaugcuaauugauugcagcccaaaggacgcuugggacucuccugagccuacugaaguguuagaagaguguauagaucucuaaguaaggucauggaccuugucacuucgcugacauuauaccugauguguccaggacuaguggagaagcaagaaguuccugggucccauuguguuggauacccuuugaggauguggccuggguguagcagguugaaacaccaucagcauaauagacuaagcuugggucuagcuaauuagcauauagcaggaggccacaagaugucuccgaacuguggugggaccaaugggucuuuggcucauuuacuuaaugaagugugucuggagaugcagaggggccuggagaagucuucugugcgacugagacagccuggcugccaccaaaggaguagucuccacugcacagcacugcccgacaugcaggucugauuuaaugucacauauuucuuaucaccuacccgugucauucacaucugggacacuagggacuuccaguaguacuaggucugugccaccuggcagaagaaagggugaaggagaagaaaaugguuuggcuucagagagccacgguaaaguucagccagugacuaauagcucugggaugaugggaugagggggugaagguguggggauucagggcaaggguagagagggggagccuugagcagagcaagcucuagaagcacagaucuucaacaucacaagguaguuagucucuucaccccaacuucugcacagcuucuguccucccaggaaugcuugucccaggcaggcaaccuggcuaccugaagagaagucuguuggauucggauaucagguccuugugagacccaggcuagggcaaggggaagugacaagggggaaagugugaugguaagguuucaugagcuaagcugcuuggcuaaguaugcacauuaaaaaaaaaagcaggguggugggagggucacuguucccacuugauggcuaucaauacugauacgguaugugugguuggguagcuaucaauacugauauuggugguauggcuggguagcuucacuguagaguagaucccaugccuucugaagaccaaguccagugguauucauggauuagggguugcccuuccccauuuagacucuucuaagcacauuuccuucugauagguggaaagaaguggagauacuagaguagcugaagggaguguucuagaagcuggugauauuaaacuuggauaacaaaucaguuccuccugucuccacccagcuugggacuagagagcccgugcuuccuguguguugaugugacgagaucacuggucuccaguuaugagaucugaggucugccucaaguuuaucaucugacucuggaauuaccuuggugguaugauccuccccaggaauugaucucucaucuggacaagugaaggacugacugugugugucuacucuuuugugcauggauguuacuuauuacgaugggucaguauucugggucagguuuccuuggggagggcuaucuagcagagcucaggauggaacaccuagugccgccaauaacacucuuugaaggaagcuucauuagaaauauggccugcuaagaucagaucaggaucucuguggcugugaacauagugaggauucuacccaaacacaucuaaugagcugagcucaaugaucuaugggaccaccggacuuccuguuggaucacaucugguuuaccuguagacagcagccuugcagacuuagcuuaaggccagaauucggaaucaaggucgcuucagggucugucacugacugcuggacaguuugguaggaagccuucuaagcugcagaaaagacuuucccacuggaagaccagcuuagauguagaccucuaauuaaaagugauauuauuucauacgagucuguuuacuccaagagagaaagucuggaaguuucaggucaaacaugugaucacugagcaagcccacuccacuuuccucuccaauaaggacaaacagacacccaaaggccugagauuugugagaagcucaacacccaaagggcugccugggauacagaucuggauagauagacaugauggggacuaugccucuugugggcagguggcugugggcuccagauccccuuugacucauuaucuuccagcuuggguuucuuuguaauuaauuaguucagggcacaaaucugaugcugacauugucuagccagaaagggaggguuauuguaauaucaagcacgugagacuauuacuacuaucagcuaaacauauaagggucuccagucucuuguuugccacauuuguccccaaauaucuacgugguggcuuugaguaccuccucuucuccuugauaucagggaggcaauagaacugguggcaacugugaugaacuggaaaauccauguccuuugguaaggggacaguguggccagauguuuagguucuuauaauaagcuggaaaccccaacgugcuagggugaaacuuuaguuuuuaaguguuacuacaauguaaaaucacacacacacacacacacacacacacacacacacacacacacacacacacacaagcauacacugauucagcuguguagguuacagguuucuugugaccuuguaucuggugaccucuugaguaaccuuuaaguccucagaucucagaaugaauauggccaguggcucuuuugaagcaaaaugauuuccucacagccuacauucuugguaccauguccuucccaguuucugagcuggugaagaauacagguugugauguuaaccagcuugccucagaucuugacuuuauuacuugcugguuacaugucuugggcaagccagccuaucucauucuugcuuuuccucucuguuacccugcauguauaagaagaccguucgcuucacagggcuguggagggaauucacugagaucauggaaacagccgucuuggcucgcugcuuagccuguaguaagggcuugguaaauaccaacccucgugauuacgacauagucuuauugccucccuuauaugggaacugggucuuacucacuggucugauguuagugugcacauaguaaagucauugugaaugaaugaggggauguuugaaaaaggcagcauccaguccuucuaggcagcaguguccucagcuugggaguggugggaaaaagagauaguaucagguuuugccaugcagcucagugagaaacagcugcuguauuaaagagcagugaucaacuuggaaaacacagcgaaagaggcugggaaauggcucagucagaaaagugcuugaaagcacagauuccagcacccacauuaaaaacaaacaaacaaaaaacgguauuauggucugauucuaaaaccguagaccugaugcagaguacaaaagaauguccaaggcuugcugaucagccaguguagacuaaccucugaguuccagguugaguaagagaacuugucucaaaaaauaagguagggagcgaaugaggaagauauccaacauuuacuuuuggccuucaaacacacacacacacacacacacacacacacacacacacacacacacacaaaugcacaaauacacauacaugcauauacacacauacauauacauacacacacaaacacacacaaacacacaaauauacauacacauaugcagacauacauauacaaacacacacauauacacacauacacauacauauacacaacauacacacacaaacacacauucacacacacauauacacauacauauacacacaggcacauauacacaaacacacauacacacacauauacauacagcccuccacacacauacagacacauacagacccacacacauacacacauucacaugcagguacacacagucacacacacacagacacacacacaggauggaugaaaaccacagugaccauuggagcucaggugcugaggugguaaagaacaccaagggaugguuuggcagauuaacagguuuuacauauccaggcuggagaugccacacacuccuaaaacuuaaugccucaccugacuuccuauuuuguuuuaaaauuuaacccuaaauaguucacauuccuuugagucucacugugagaaguucccaagcaggaagaacuccucguccugcaccauccgaggaaggagcacggggaaccucccacuccguuaaaaauuuucucauaguggucacuuuauaaaaggaacaagcaagaguuaaugcuauacuuaacuaaugcuaaguuaaugccauacguaacuaaugcuaaguuaacgcuaugcuuaacuaauguauucaaaguaugaucauuuugccauguaaucaauuuuaaauuacuuuugacauuuuuccaguuuugcagugaagguuuuaaaaugcauuguguguuuucacagucagugcaugucaguuauaugcggcugcauuccaguuauccuaccauccacccauuguuaagggcugccaugucaugccgcuaaggagaguacaagccaaaaucccguuugaauaugaggcaucuuuucucacuacccuccguauuuagcagcuugccugcagggugugggaaagauggggaugcauuuuuugcuaaccaaagcucagaagcuacuggcucaauuuggccagaagagacuucaggacgugaaagucccaggcgggaagcucauguccugggugaccuuguacaagcuaucugacucaguuuucucauuugacuaacaggaaacuaggucaacagagguggagcaauuuggcuuuagagauacaccuggaauaagaauaauauuugacaauauuaauauauuaauauuauuaauguguuauuauuauuaauauuauaggccaacauauacucauaccuuaucacuucuaacucuuauuauuagaacauugacauccagaagaguuaaguaucaaggcuacagcuguccuaauaacuuuauauuuuuaugcauggaaauucuauuauuggcuauaagcuuacguguuuggaacuaauauuguugucaucguugucccacuuuuuaggugggaauacugaggcuggaaggggcuugcuagguacuuuuguuaguucugaaaauggugagaggaaaaaccaguuccacaacuuggagccaaauuuaaagcaagcuuuaauuaaauaacagcgaggaagaugggccuugaccaggacuauuccuggguucccagggaauguccacaagucauguuucacagaagcuuaaaaaggaaaaacccauaauucacuguauuucccaucagguucaaucaggaucaagccuauguccugauguauagccugcuuacaucuagucaagcacaucugaucuagucgguucaaacuugcuuaugggagugaaaacacguggcuuguuauuuccaagaaccgcagcucccagcauuccaggaaguuaucuuguccuugggcaagugaggcucacaggucaaccuuggcuuuuacauuuggauauacucaugagagguggagaugggcucugaugacaucacauugucuagguuggaugaugucacaugucugucuagauugcaaggcuggguguggaugucugaauggggaggucuaccccacagacugaacccuuagcuaccgacucccauacucaggcuacccuguucuugguucacacauuuucugccccacugugcucuaggguugagaaaaacagguggggaauucugaccuccaaaacuucuugaaggguccaggcaaagcaaacacuucucaccaggcuuggccaauucccaagcuacccaggcucaggaagccuaaaugcugagccaagcccagcagagugggaagcacacuugucuauccugccugcacagcuggggcaguugggugagcucagcauauaagguuggaaggagguaugugucuaauugcagagggggaggugggauggauuaacacuccuuaaauagacaucagaaagcuaagaauagcccugcugccuggaaaucgcuuggugcuccugaccacaggccaucacacuuaguagcugcucaauaaaugugggugaacuacaggaacacucaaauacugaacuggagucauuguacggguauggugccaggaagauggugcucuguguacaaagaacuucugcccaggcuuaucugaguuccaugaaggccagagcacuuugcuaaccaacuucauuuaccaacuuuaguugucauuauaucaacuacuuaaauuuuuuucuuaacagcuuauaguucagacaccaggcaagacauguucagugugcuuuggcccuugauucugcuaugccuccaauuacccuucaagguugaaaacaugagaacggcuuccuggggucaucaaaacuuugggguuuuagugguggcacacaccugcaauccuagcacucaggaggaagaggcaggaggaccaugaauucuagguucuagccugagcuacacagugaguuacaggcuacccugggcugcacaguaagguuucucccugcuucuccaaagacuuuugcuguucuaagagcaguuugcagaauccaguuccuuguagcuuccuagugucccaucagaccuggugcaggcucuguagcucuaggacccuuccugaagcugccucucugucuggcucagaggaguggaggcggccuuugggguagaaauccaacauuucuuguaggucaucuggguagguagugaggacaggcgcagacaagaguuccugagcuguaugaaggcuuaaguugaucuguguuucuuuccuaaggacauuuauaaucuugagaacauuugucuuggagaauuagacaauaauugugugaggauuaagcagccccaaguaaaauaaaacaaccuccaaggagccuaacuuuacccaaaguuauccugaagggaacgggccugcugauugagcagugccucugguguuuugguaagcaauggcugagagaacccgagguggucugcuaggauucagcugccaugaacauggcucagagcacagcaaggcuggacacuucaaccugugaguacuuacauccauguuuauacgcugagaauuuuugugggacccauggggcagcacagugguuuggaaaaggggucagugcuccaagccuggcucuguccccacugcuguguaacucugccugagcuaccucuccuccgaggcaucuuaaugcaguuaguaucaagucuugagcgccugaguguugaccauucugagucuggcuuuuucaacaggcgaaggaagaagcagggcagagcugacaacagcuggggacagcggagagcuuguccacuguauacucuccuagaguuggguccccuacucgccuucucucaggcccuaggcuuccuggcuggccccuagcuccuguacauuaccuuguuagaagacaaaaaucccugagccauucuaggcagaggaacccaugaugaugaugaugauggcauagaacagaaauaggguggggagaggcaagugagcugcagguagcauuggaggucacaugaaacuagccuggacuggggaggaaaaauucccuaucauguggcccagacacacggggcaguuaggcuguagguuccaauccaaugggucacuggcacgauguuucucuuccccgcuuacccauuccuaauuuccugucuccucuuccucugacaggguuauaaauaacccccaggcuggccucuggucugaguauaggugacccaggugaaaaugaggggacuggggacaaggcagaacugaaccuugccuccuuagucaggagguuaagggguuucagauugcucagggggaauuuugcuuucucacuuuuuuccacuacugugugagggagcaaaagcagagaugaucccugcuggcaccgggaggccuggccuccugggcuggugcuggguuacacaggcaaggagcugccucugugcuuguugcaggucucccagccaaagagcuggaaagaggcuuaaagaggaggcaucuuaggacacacagaggacagcgugccagacuugucaggagcugagggcuucugcccccacccuagccuggucuccugugugagacuacacgugcagaagcugugucuaacuucccaucuucuuccucagccacuggcacauugucagucuucugacuacuaaaugagagggggcugucucuaguccagaugcuacccauuuggcuggguguaugugucaaaggcccugauaauauaugaaugaagauuuucugaacuccucuuacguuccagacauaggcaaagcacugacgucuuuaaugaacauauuacuaucacccuaccuuuuagggguucaagcugucucccuacuugguguaggucuggccaccuuccucuacaguuucugguuuccgaacaugcagcgcacacaaagcuuccuugugagagaaggcauugacuuucugccugauuuccacuucuguucaugguccaagggaacugugggccaccgugauuauuuuuugcagaauuucucuucucuccccacaugguuuucuaggaaaaccaucagcuugauucuacccuccccacacgccaccaagucccagagaaaucagggccccgaaagcaucuuuucaugugguaugugauauacagguugcaauuggucugauuugcuuauuuguauggggacaaaucuccaaggucagcuugagauuucucaacucccaccuggaauuucuagcuuccacaauacaccuccugccucacuacaaaaggcucagagggcaucaccagaaccuggcuacuuccaggagccacggagcaccugaaucucaggagagguccagggcuugggacauguucugggguggagaauuccagagucuugcuuacuuaugggaagcccacacccacagauacugguucuuggcaguagaaggaagaugaccgcugaguaugauuauuguguggacaagucaaauacugcuaauuaagguugucagugcugauuccauaggugauaaagguuagggagcaagauguuaaucagcuucaaaguuccugagcuaacuaugaccaauccgagaaauccaaguggcaccauguccuuucaacacaucucagcccuagaaagcauucugcucugaacucaggaucuucccagugcagaugcaggcauguauggaaaugccgccaagucaauucacauguacucacaguaggcauuaauaauagcaaugaugaagaguucugccuagugauucacuaagggaugcaggaagaugaacugagaaugaaggacaguugagacugaaccccaacucugcuuuuuaucaucacgagacuaacgugugcaucugagccuugguucugccagugacaacaaaauaggaaagggucccguuucuaauucaggauuggcuggugggaagguaggugagagauggcagccaugaccggggcccuccauaaaugcugagcugaagcugcaucugagaaguguguccuugacuuccuccuggccauuacagucuucucagugcauugcugguaccgagggagguuacagaaggcuuggcgucacccuagcgaaggcagauuuuaagaauuucuagaggcaaguucaaaaaacaggcaaauggugggcacagaauguaagauucagugcuuugggaucaggccuggcucugaagucacagaaacaagaaauucucaagggaaacacaagcccagagguggcaaacucuuuccuggggucacuagcuacauggggagggaaguaggcaguuuccugagguuagauuccuuccuggacauuugcaacuauuccauauagcgccucuugccagcauaucacaccacccagcccacgucggcggagagacacuuuuacggauccauagagaagaagagccuuaaguggcucuugauacguccuaucuuucacugcccacuucugcaccagcaaaaggaaaaaaaaaaaagcuagauccccucccaucugcccacccccuuccuacuucccagcagauggcucauuacaggugcugauugcuucggggauuuccagaugaugccccuggacuuggcagagcuguacggggaauccacagauaugggucuccccuucacaggcuacugcuaagaaaaguauuauccccacugggaaagucauccugguacuaugcauccggggcucccaaagugugcaugccguuuaacaaauaauuguauuucuagaauuuugguccaaagaaauuacugggcgaugccuaaaugucuccuacagagauauuucuuaaauaauguuauuaaauauuauuaacuuauucauaaaauauuuuacauaguuuuaugaauauuguauauaaauuauaauuaaaaauuauuaacauagugggccaccuuugaguaauaguaccuugguacaugggcccuugggccaauuuugaguaauaguaccuuguuuuuuuauauuaauaaaaggcaggaguguguauauacagaugcuuagaaggaugucugucuuccagaauaucagcacuguuaauucauaggguguguaguuuuggaugacugucauuuggcuuguauguuccagaaaaugacauuucacagcugugacauguccuuuuuacaaucagauaaaagaacaauagaugggaaguuugcuccguagauccuuugcacauggguagagggcuccauggucaguggaagccagcacagccugcuucuucuugggguacucuugaggaucccgggggccucucagauuuuguguuuccugagagccaugauuacucuguagaccuggagucuguguggcuuucucugagguaccugccacaagagauuuccaaauggaauguuccuauaggguuggaggggugcgggcgggcugacgggcagguugccucugcuucucuccuaaaugggccagcucugugacuaugaguuugccaaaagacugucagggaaaucgggcuuuugagugcccucccugucuaagucuagaaguauccagaguccagcggacuggucuaaagcuagcccaggccuagagggggguaguccuggggaagagugaacaccugccaggaggggcagcugguggaggaggggaguaucucaaaaaaaaaaaaaaaccaaaaaacauaaggaaccuuggggguuggguucugggcagacaguauggugacuggcuagggccagagaaaacuuggcaagcucucaaagggcuagugaguggccaccugggggcugggaggguacucagagugaaaagacuugguccuuauagaaucccauucccccuccuccuccacugucacuggcaucuugggcaauucacuccacuccaagaguccuaccucuacaccuguacaggugaaggucacugucauauauauagauguauguguguguguguguguguguguguguguuguugagcagcuuaaauuaagcaguuggguguguagggggaguaagcagaaagggcaccauugcaagacagcuuugugcuggaucaagaacucaccuuaucucagccaucacuagaccccugauuagagcaagcauaccugggaaucacaagcuggggaaacugaucuuuaaaaugcaggauagaugcauauauacauguguauuacacaauacacagcauguauuauaauacgaauauucuuaggaauagcugaguucagauuggucaggacagaaggucugcuuucaucggcugaauagaguauuagcauggcccucuucacaagagacacccacauccauuucccccauucccacuuaaggaccaauguuucaggcagucgccuuugugauugagcaaagagaagagagggcagcuugccuucucucugaaagggauguuuccugugcacucagcauacuaaaacugcccacuacaggcagagguuuuuaugagccgagaggaucaggaaggcagaaaggaacuuuguuugggaagguggccucaugcugugacuuugugaccuaagugaauaggcuccugguggccucuaaucuguccgggacauugccuccaacuuugaaauaaccaagggggucuugcaagauccacaaggaauagcaaacagacaaacaggcuuuccuucaggcuugucaccagcuggccucugugggagagagacagaggcugcagguagggggacuuuggaagcaagugugagcuuaugggaucugaggagcugugucaaauguucuuuuagcuacauggcacccugagaugucuacagagaacccucugaccccugauuggaccaaguauaccugggaaucccaggcaggggcaucagcugaugugagccaaagacccacugacuucgauucggggacuacuaaaugauguguuuaaagaugggagauagcuucuagguccagguaaaacaaucaaguaagaugccaguguacauaaauaugugcacaagccuauaaacauuuauggauggauauucaugaguauacacagacauuaacauacaagauguuuaucacagaucuuuacaaaaccuuccaacaaacaggcucuugggguuggaucauaugaaugaacguguucggauuggaagaacacggaucaccgacaaauggauucugugcaaugcaagaaaacaggaggcaggcugggaaacuggccaggagaguguggaccagugaccggagcaggaaaaacagauaccuucacuccauuuuauaaaauguuggguaaucucaggaucuauguugcagagauaacaggugacuuaaauccuuaucuuuuuguuugauuuaagccagugcauacauacaggucaccugauuaauuacugucuuuuggaauuuuagguaauacaguauuuuagagagaugaaacaaauuuuuuucuuuguuugcuuguuuuguuuguuuuguuuugguuugguuuuuucgguuuuucgagacaggguuucucuguauagcccuggcuguccuggaacucacuuuguagaccaggcuggccucgaauucagaaauccgccugccucugaaauuuccagauugugcuggguucuggaaauauuuacuaagcacuaaggugucugccccuaagccccccagccugucacucaggagguguccaagugagugugugauccaagcacucuuuucuaacuguguuucccuuuccugcacgacagcucuaagacacugcugucacagacacacauucucucucucucuccacuuguaggagccuggagguacaguugugaauccaaggcuccagucuacaggccagcacuccauaccccagugacaagacaagccuggaacccaugaucugggccguacucccuuagggaugcuggggguuucuaggccacuuuauagaggguaggacucugaaacugcagaccccgagcuaaccugaucuccagcucccuguguuuucuuccuagcucuggcgggggguggggggcagcuggggaggcaggcaugugccaggcgcucagcaaaugguuucuccuuggcaucaaccuugccacauugcuggguguuaucuuacuccaguccagcaccaccagcaaaagcagggccaggcgcggccucacccaaagcucccuguuuaaauauguggauucaucuggacagggacagcugcaucaggcaagcagagucugccaccguacccuguuuccuugaaauccguccauacaggaacacggcucucacuagccuggugccaggcccugcaagcuccuacuugcacaaacggauuaucaaacaugugaccaucuguacccugccuaugccucugugcuuuucugggaguuaggagaaaucuccugugagguuuacagugacuuuagacggcgaggagggaaaagguagagacgaugaucauuaauuuccuugcuuucacuccagcccccaacaauccauucuccaaaaaggagccagagcaagcuauugaaaugucagucacgugccagcaauggcuuguucaaagcucucccauggcuucucaacuccuuaacaaguucuagaagguucuaugggaucugaccucugucuucuugacuccuuuuucauggaggagccuugucuacuccaaccauucucuaugcccucccuccagaaccugguauuguuuugggcauauguuugcuuguucugucucuucuaccauaguaaguccuaggaauguagagaucucacuucuuagaagauuccuggaaggcuaaugcugacugaaaugcaugaaauaauaauagaugggguaaguugggacucagauggaucaagugucuugucuuggguccucagcagaggaaggacauagagccaggcucagacuuagcucugugcuucaguaauuuggguaaaaccccagcagaggaauucuaacagggccauuuagggcagaucaccuuccagccagcaagcuuuguugaugggaaacagaugguucagacaucccagacagacacugggauauucugccaccuguuggcugccgcaucagaaagaggucauucauuugccacuugcuaagcugcaugcaccuagggaggaagggccagaaauuaauucuuuuccucuuggggaguuuucuauaccacaaucaguaacauuucaacuuguagccuuuaaaacuacuuguucaaucauuccucaauucacugaggaagcagggaugagaaaugacuuguccauuggugacaccaagcauuugaaguccaggcaguaaaaucaagauuuccucacuucaaucugggaguugcggucuaccugcuccaugcucuuugggcuggaccugggagaaacaacauccucccuucaugcuacacauuucuucuucguguucggugcaccugaauacuagguucagugcuggcuuuagcagaggggaguggugccagcccugagugacauugaacauccugaagaagucggucccuugaagaaauucacacuuguccauuccccuuggggucaggaaggauaaaaacagcaucucaggggcaacuggucuuuacuuucccacugcuccagggguauccuugagggcugaagaagacuaucaauucccuucuuauaauagacuuagacuugccugaaaccugucaagucacaugucacccagucuaccucuccaaguauauugcugaaaugggacagggacaaaauaggaucugcuaaauucagcuaggcaacacuuagaggucugucuagccacacagcugaccccaggcuuaagcacaagaggcaggaacuagauugaacacuaaauuggugcuaccuuugaucugagcauccuuucaugaccaugccugguggugcagagcaugacuuuuccuguugcuuccucaagagugccuguaauuguuaccaaccugucgaccaagcaaagaaacauguccccuuuuugcucagccagcucccauuaugacuaagauaaagugggguugggguacagcccagcccucaggccuucagcuuuucacuugcaccucuaugcaggcuugcuucucauccugggagaugacuggugccagaugcucccguuagccagcaucuucauagcagcaagggcacuggccuccugauucauaaagagugguccugcuuuccaucagacccuaauuggucugggucuggccuucaccucccacagaaugcuggccacuggcuguuccuuccuccagccagaacaaugccuggcucuggccacugacccuggcccaagcaggccugccaagcuauggcucucaaaccuaacuuuguauuaucaagauuggcuucccacacccacacacaauguuguuggaaggcagguuuuuggaaaggcuaagcacacgcacuaacauacuauuuuggauccauccaaaugcuccccacucccaggaaggagcaagaugccaccuggaagacuucaaucacaaguuagcauuuguauccauguuuccucucccuucucuugcugggcuuuucuacacuguccacuuggacagauaccagccaaugucccgagcuucuaccugaccugaaaucaaaaugugcuggccaagaguaaguggggcagccgccauuccaugagggggaaaguuggcagccaggcugugagccugcaaugcccauauggggcugagcuagcucucuccauuuucuuuucucuuuucuuagaauguauugguucacuugcuuacugcuucucuagcuucugcauggccuugggaaggaagcuucuuccaaaguaauuaaugcugcugucucccuuaugaccuauaucucaguacucacaccccuauguggugugauuuugcaucuccauugucuuucuuuaauuuucuuuuuucaauugaaaauagauucuucucucauacaguacaucccaaccacagucgccccucccuccaccccucucagcuccccugucuccccauccucgcuccaucucccuuuuucucccagaccccccucccccauuacucuucagaaaggagcaaaccuccaagagccaaacaggacaaaacaagauacaauaagacaaggcacauggccuucuauggaaguuggacaaggcaaucuaacgggaggaaaagaguuccccaaacaggcagaagggucagagauguauccacucccacaauuacaagucccacaaaaccacuaagcuaacagccauuacauacacagaggaccuggggaagaucuaugaggaccuaguguuugguacuucaguuuuugugagcccauacaagcccugauauuuuccccuguguucuccacacucugacuccuacagucuuuucuucccucuucauggguuaucugaucccugggggggaggaaccugauggagaacuccaauuuagacucucuucacauuaaugucugguuguugaucucugcaccugcuccucccaucuucuccauuuuaaguauucaaaggguaagauagauugccugagagaugauacauagucauagcuacuugggaaguggaagcaggcagaauauaaguucaaggccaguugaggcuguaugacaggaccuggucuugaaaugaauuuuuuuuuaaagagcuggagauacagcucaaugguaaagaauuugccuagcaugggcaagguucuagauugaauucucauuaacacacacacacacacacacacacacacacacacacacacacacacacacagagagagagagagacagagacagagacagagacagagacagacagacaaagagaccagucauagacauuguaauacagauucaacuccccaguuuuagguuaccccuaaguccuuauauacuugacuucaacaaggcaugcaccucgcacaguaagaguggcugcuaaaucucuaaaagaugccuagaagcuaccaguuuuucuccuguucuucuuucuucuucucugucucucugucucuguaucucucucuguccgucugccucugucucugucucucuuacucucaguccucuuacugcaauuagcucuaaauaauuggaaauagauaaagcaaauuuaagggcuucccacuggaaaacaccagagcuagcugccccccacccccaucugugucucccagggcugggaauccugcuccuguuuccugugcccagccuguggagucagcuaggcccaggaccccuuccccccacccccacccccgcgcccccgccagugcauagcucccucuguuccagcguucccagcagacucugcaagguguuuccuguggauccucccgaugugcuccacugguguagugcgaauccaauuagaacauugugagcugcuacccacagccuggacaguguuuuguuuauguuuugcucuuuaaaaaaaaaaugaaagaaagaaagaaaucccaccaagggcauaggggugaggaaaacaagggaaaugaagaaaaaaauaauccccaaagugagaccaauuuaaucgcccuuguauuucauaaauagaaacuucuacggcaaggaugugaguaagccagguccaggcuguugggaagaaaagcugagauccaugugacucuggugccuccacugucccucuaggggcggaggcuguguguggugaagggagccagcuugccuucagagcagcuuucucugagggggcucaaggaccauggcaaauaagucaccuacguuauguuauauuugggaggacagaugauggguaauggugucccuguccaugagguaagcagaaggacccaaaggagacaugaguuuuuagcaucacugcacucagagugaguccuuuucaguugagcuccuagcagcacccuggccagucugugugggucuuacuucucauuaccaaauggucucugccacuuugaauggcagaaggacccagggagcugauuagggacacuccuagcccaagucuacauaaguucaaaccauggagauggggaauaggccaagaaggacccuugagacagggccagacacaccgcagugacgucgaugcucagaaguaugguucuacagagcauagaaugcacggcacaguggauaaugaccgaugagaagaaagucuaacaaggaaaaaagacgccuaaaugagaaauacaaaggacuaauauccuaggcaaggccccgagagaguaaggggcaguggaguauagcuuuuccaacgugauuuucacauagaauggagggaucugucaacauaggcaaaacucacacagaaaaugaauggaaggcaaagugaaacuaguucccaagugccccuacuccaggguucuuccugccacucagugcuuguuguauagugagguucucccuccuauucucagauccugcaguaguaacaggaagacucaguaaaucacaccagaaguugggaagcagaaucuguuuugaaaacacuagaugaugaugaugaugaugaugaugaugacgacgacgacgacgacgacgacgacgacgacgacgaugauaaugaugauaaugaugauuauucaauuuugcugugguaacacuuaagaucuacccucauaacaaauuguccacacucaagauucuaaguagccaagggugauguuuuagguugaauggccauaaguaauaucauccugaauagggaagcuuugaccuuuguccacuuugugcccugguggauacgccucccgcucccagacugucuuccugggaaaucugcauucauucaacucuuaccauggcaacuagagcugaaggauacaaacaagaagagaaugauggggagaccgggaacgagggccacaggcagacaaggggcccucagaaucugugacaaugucuauucugacaauaacuuauggaaaaugcaagcacucuucugauguguguaugcccaccacgucagcuaauuagaagaagguuaccauagagagagauaauacaauaguuaaaaaaaaaccaaaccaaaccaaaacaaaacaaaaaaaccaaaaaccaggaaagccuggcuuaggucacagugccccacaccguacagacuaacucuaggauugucauggcaggaaaguuauucucagugauccugcaaguucugucaguccauugaaaugugcccaacucaccagugguuaagcuggcacaucuggaagguuaaguaaguguggccaaaugaugauggacaggagcuuuagagucaggccaccuggacugacaugcuggguuucccaauuccucauucgaugaucuugggaaaaaucacuuacucccacaagcugcaaugcugucagauggugcuaagucagcacuuacucuaggggucuuaaugaggcucaaacugggacuguccauauaaaguacucagcacugaucaugcgcaguaccugcauguaaguauuggcaccugcuguaauugauaaugguguuaaugagugacaugcucaaagccaguagauuucucguuauugggcaaaguugucaauaggcuccgcugacgcacuuucuggguucauguuaggcuacauguauccauuauuguaaaagaauauuagcauagcauugggaaugugucccucuuugcucuguauuguugcccuugggagcaucuagaagcagugauuaagugugcuucugcaaguagcuuagcucacuucauaacaucacuuccugugcauagguagagucaaaagcuacgggucacuuagguucacugaggcaaaacaccgacuucagcgacggaaaggagcaaugcccuguguugugcguguuuauaggaugccuuuucugaggcaguugcucuagguuaugggacccuaguguccuacaauaaaguucggucagacuuguguccaguuuaucacaucaggccucuuucagaaugcguuugugcuguugacuaauggaaaccagugcacucugcauggcccauaaaaccagaagccauccuagaaccuagaacgaaucuacaugagcucuggaaacuggauccaauuuacaguagagucuuuagacaccgugagggcuugaaggagcugaguccuccugaaagcucucagcagcuguggcacaguggcccuucccugagucuucagccuuggcagucuccuccaauuccucauuucugaugcaucugaccuuuugguugcacauuccauguuuguuaauuguugaguaauagaaaaagggcgagcucuggggcugggugcaucuguauuuaauuucuaguugaugaccucugacaaguuccucaacuccccugagucuuuuuuuuuuuuuuuuucugaauccaauaaaaaaaauacuccgauuaguuuuaaggagcagauauauuaucuguagggggugugucuagcucccuauacuaugugacacaguaccuggcauguguguaguagaccaucaggagguaucugcugaaugcagagaggguuaggugcagauguggguccuauacagauguugaugggauagaugcucuuuucccucuaucacugacacuucuccucuucaauuacacugaccagaccaaggaagaugguucagaaauaaacggugggaguuggcuuuauaauucugucauugccuaccaugaccagaagaggcagcaguuagugggcuuugacuauauuuuguuuaaaguagguggggcuugaagaggcccuuggagcugaucucagaacauuccuucacacccuccaugauagcuguuucugauuaacugucuuagauauuacacacuuagaguuuuucucauaccuguucuaccugaguguccaucaugcccugggcgugggaguugugagcugggugggcugggaccagucacacuuguuuccagugggauccuccuagcuauuuccaccagcuauucacuaccuugcuggcauguagaaacagagcagacauuucugaaugcucaaaccacaguaacaccuccugcuccuccuggugcuuucugggaacagaaucgcagucugcaggucugaugugcagaggggaggucccuuggcuuaauggugguccacuuccuagaccuuucccagaaucccucagcuuuucucgcaaacaaaaucccaauuaggaaaaaaaaaaaaaccaaugcuauggacagccccugagaugcugcccgcuguucugcucucagaaacggcccgaccugaaagcucaaauguucugagaaccguuggagggcacgguauuuuucugggcacugcuucaaaggggcugugguugaagaccgggcugcuauucugguggccacuugugugggauaaaguuucccaugggcccaugggaagggguuggagcccaagagggagggugagggugguccaagcccccuugccaagugugagccaauggcaaagagcaagugggcaguccugaacccugagugaguuugagcuuggcagaagucagugugcacccaagacaccauaucuucucuggccacagcacagaagaccaaccaaacucccaagacaaagccacuccaggaagauaagggguuugaguugcggggagaguaugggaggugcagaggguauauuaaaucuuaacuugaaacuucagcaguggguugcaaagugcaagaagccccuugugggucuuguguaaagagggguaugcaagacccaaaccagcuucuugagguaucccagagcuuuggguggggcgcucccuuaagagcacaguucuaagaguugccuucccuugaagaauugaugcuugccuggaggaucagucccauuacacccaggcaguggguucuguuacucuguauaggcuaagaucucuagucuauagguuuuuaccuucauuuauuccucuaucaauagggccgauccuuuguggcucugagugacuucucagagggcagcuggaguaggaugccaccucuagccgguggaguuguggucccaucuacuuccaucuucuugucucaugggacagaaagaagguuccugaagauaggagccuugcccaccuguuuacugccagaucucuaaggcauggugcuggaucauagcgcucuauagccuucugaguaaacacugagcagcuaauagagcaaccccaagugcuugugggagaagaagaggagaaagaagggaaggggcagaagaaggaaagaggagcacagacagggaaauaugcagaaauccacaggaugggauguggccugaacaagcugaaccugcuuuuccuaccugccaaggcugcugcaaggggaucagcaggggcaggcccggaagagcuuucugugggagcuuuguuuaggcuccugagccugagucucucaucucucauggggucugagugcagcccuuccacagagacagcagguugacugaggccucuuguaacaacauccucugacucacuccuccuggagugccaaucuuccuguuugggaccagggucacuucuuggacacauucacuuucuucuuccuucuucccacuucuuccuuuuccuccuccuuguccuucucuuccuccuccuuccuccuccucuuccuucuucccccucuaguuucuugucuaaauagcuguuaggaaccaggacucuugacucucuacuccaggaggguagaugugaaaacaauccuguauuacuuuccccagccucauucauucacucauucacucauucauucauucauucauucagcaaacacuuuggggagccugcuacaugguacgcuugaugucgagugccgacacuccagguuuuaccugucaucugguuacuagggaugcugcucagugccaaagaacucaucauagaagaaaaauccccagaaggaaaagcagaguauugggacagaagagaguagccuggccugcagagacaggcuuccaaggggaggcugcauuucaguuaaaaggacccugauguguagauacauucaugggaaggagguagaagcccacgaagcaccuuccuggugccuugcaaacuuacgccacagaaauaccaugugcuuccucagauuggaugcccuugcucccagcuaagucaacuuuauauccaggaaccagccaccuuaggacuuuugcccuguccuuggcaaaaugaugcauauaucuuucucccaaauugccaguggcccaggaagcaauuaaggauggcugccuuuaaaagcaagugcauuaauccaaaccucagaaggugccugaggcugacgaccccugccauuugcuucuaagagcuucacaccgaggucaucgcugugacuaggaaagcaggagcaugcuggagguuuuguuuucuguuccuuuggggugaccaaguuccaggcaaucugaccuccuggaccuggaccucucuugccucccuuccauggccccuuuaguucauacacaaacaaugucaacaggggcuguuuccugguuucugacucaagcagacuugcacagugccuacaagacacaaauccuucuucccugcugcuagaggcccaaggacugagaacugagcaccccaggccaggccaggcuuucccagagaccacggagcagaaggaggguaccagucaccaaguaccgagccccgugagcucuuggguggggagguuuuaauggccuucccugagauggaauugggcugaaaugauuugcagcuuucuagauuuucuaagcguguguggaucggguuuauuuuuagccacaggcauucauuucuugccaaaaaaaccugcuuaaauaaaaccaagauuaauauuuuuacuuaacggaaagaguuagucaggacaagcuuugaacuggagccugcuuaucuugacggggggagugcauuuuauaaugucuggccuuggcuucaacaucaacaaaaagggccuuugaaacugacaagggagaagagcccuggggaaccaggauaggauguaggaagugccuauuuggggggaggcagggaaggaggggugucuuccuggaaagugggaagaaggcccugguuuuacaaggagccagcugcaguuuugcuucauucccagccaguuccuugcccuucccccuccucccaaagccugguccaaauuucugcuuccuuaaauucuagaugcaucaaacaaggugucuucugcaggauggguccagaacagauguuucugaugucccuccccacaaacagacuccacggucuugugucaugggagcugugacccugguuccuucgucuguguuugccauucuuuccuaucauuguguuucuccugccuugggacuuagaguucuuuggagccucauuuuucucauuauuccccaagucaggcaccggccucagucaauggugaauggacagauguuugccugaccuaccaacugagaauugcccuuaucccauuuugauggauugaaagcucagaaagaguuggcugucuuccccagucuacacaagagaguuacuuaucugucuuuaagucauccucuuuuuguguggugcuguauauguaaaaaucacacugaacuuaguguauucagcucaaauguauuagaagccugugauguuucagguccuccugguuucucugaguagggcaguuagccagaauaaaaguccuuuuugggagccugcauucuauugagaaaauacaguuaaucaacaaacaaguggccuaaugguggcaggugucagcuagaacacaaugaggcgagaaacaugauggggggacuguggacuuggggagaaggaugcagggagggaacagacauggcagccugaccaggauauagcaaauagacaaugaaaggagcuaugcaggagugaagcaaguguccaacccuagcaacugcgaagggaaagacucugggcuguguguuuggagugguggguacaggaauggagcaagcugccauuccccgagacagagaaggcccucagaggcccaguuauggguguggccuguuaucaggagcucagcguuggauaaguaccucacacagcucagcagacuaucaggggagagcaccauagaaaggcauagaagucauggaaguucuggauugggguuuccaagcaguuggucauugucacuugcaugggcugcauagaaaaccacaguugugaguaaagagaaugauuaaguaggaacacaccauugauuggacugggucucuuggaugguaugggucauucugaaaacuggcuucggugaggugaggagaaaacccaagucaccuuggaggaagagcaccagugagcuugguaaucacuugccacuguuuguaugccgggacgggaaguggccugcaggaggucauccacugacagaacuaaggugccuugugccuucuguuaucucagguuaccaucacggauucccuagauauacguuuugcucugaccuucuggcuugagccauuuuauagggauuuuuagggguugggagaguggcacccacaaggcugagcaccaggggaacccaggggcuucuaggccucuuccaucuucauuccuacugucuuguccucaaauguagauacauccaggguccccaaaggggcaacagguucccaggaaggaccuugaaaaggaagggggaaggaaggugccauguauccucggggaagguuucuguuuuccucuaaugagccacaaagugcuacaaguuugcaagugcuguccagcccccuccccacccuccacccccgaauuucugcucagauccaggcugcaaaguacuuuauacauacacauuguccagugcugggggagaacaauaagcuaaguaaaugauucaccauucauuaucuguugauggugacuguagauucuugcuacuaaucagagagaggggaaaaagggaaggggagaggagacaagacagagggagggaaggagggagaaagggggaaaaugagagagagagagaauaaaugaaugugaagggaagucucaagauuggggacauaucaggcaucccccaucuaaguauaagacuucucuagacccacuaggguugacaaugggugcaggguucaguuaggaacuguucugcaaagauucaauggcagucuucuuucuuggguggggggcuccacaauaguaugcaaagcugcucaguagguacuaauaacagguacagugauucccacuucccagcaucaccccagagggaacacagugaaaugugcacacagcacuuggcacacaagucauggucugucagugacagcugcuaaagauacguccuagcuuuuuuccuucacuguucuugcagaugcaaugcaaagagauccaggaacugcugaccaguggggugggcagcuagauggggcaagggauccuugcucugcccuucuuggacaggcuuacacagaguccugucuacccaugagucucuacaucuuuagggcagaaccagccaugugacucuuaagagaggcuauauggagcgggauggcuauuggugggagccugagauaggggaucuccauuaacuugagggccuuuguuccacagagcagucagaccagcagccccacugcuccuccuuccagccggucaguaggaaaacccauccaucaggucaggcggacaaaggucuguguuugauugauggugguuagauugguggagcagggagagacaugggccagguccagggugucuuguccuucuccaaauccguugauuaacagcagaugugggacuccuagagauacaccaguggucugcuugcccuggaacuauuacuguuuaaagcuugugcggcaggggucccauugcuagcgaaagggggcggggaacgaggacaauaacaaucuuaucggcuuguagagcuguagucugucugccuugguuuugcaaacaguaaccaaccuucccagaauguauuacaagggagaaauguguucuaaagagaugugcuuucaugccuacuuccacagaucucugauauauuugaaaaccacauauauuuauuauggcucugugagcuacuucccaggcacccacagccugcucuuuuccuuuuuguggucuguagauugagcccagagcauucuggguaaggcuuccaucauccuucuacauccccaguuucuagucuagucgguuucuucuuaggaacuuuuaaguugaaacuuuauugacuccuuaauuaaucucuuccugucccuuguagucuccaugcccucagaagcagagaagacagcagagagccuuggaagccucguuggcugagucaggcagggccuccuccagcacuuaggucucuuggugauuugguuuucuggugcucuacuccaccuugucucccucuuaggcugcagucugugggagcaggaaauggggcuuuuauuucuuucuaucgccccuaccaagcauucaugcuuccagacaccagcauaggcuaccugcuggagaacauggggugaagaguguauggccacucucuagcaggaauaaagagaaccugugucuggccugguccauguuaaagcugucauuugaagguggagagagugguuagaugcaccaucagcuccaaguugagaagccaugucuucuguugcuguugaagucuuguagaccgccccuccccuucaaccuucuuguucacugugaccccugccugggccacugauugccucuggggaaaaccuuacugccaaauaguacaaaauaacacgcauccaaguugcacaggacaaacuaaaguaaaugaaguuauaauaauucaggaggcaaauagguggauuuggggccggcaaguaauuuaacucuaucugggagcaaagaaugcuguuuaauuuuagguuaguuucaagagauuuuguuuuuauagagaaaacauugauguggccucuacccugggcucucucugcuuccgcaucuaucucuuuggcccauggauaccaucuugucuggcaggucacacuaggucacuguugggcucucuguagcaacaaagugggacacggauggugcaggaguugcuucgauaucaaggccucaugcacacuuguccuggucaccgccugugugcucccacaucuuucccugugauuuuuuuuuuaacaagguauuuauauauaagcuuucccucacuuccaucccagccaggaaucucuccucuacccuaaucucagggaagguugacaggucuuagccgacagggcugaugggugggcagauaucaaaugagguucugguggugguagcaaugcuacugauagugagcuaagagguacuguguguguguggggggguagaucccaugaugcucuuggucuuuguucucggcucucacagcaacuuucugaggacgccuaucaucacucucauuagaugcauuaggaaacuaaggaccagagagguuucagacauccccuguggccacacagcaccauguggugcuaggaucugacuccugccaaccucaggucuucgugguguuucuccacuauucauaagcacaucacuugcaauccacauaaguggcauugggccaagaaagccagagagaucuaagggggaagagcuguggugaggccacacagcaauggugggaucugaaugcugauguaacucccugagcacaaaaaaaaaccucaguguguuuucucuaaacuguucccagaugaaaagguuccaagcucaggccauuucaggguaagaaaagauuuggcugaccuuaugggcagaagcuuccagaaguacccagacuuacagggcaggcuugcuuaagaaauuuuaugcccaaaucaaggugagcuuguugcaagccagaaaaggccagaugcugccauuuaaaaaaaaaaucccucuuaacccuuucccccuuaggcaaagccuuacucuccaguuuacuuucugggcaaaugaaacaggugaacgcaagucacuuuagucccuugagaaucacuugucauguccagguggaucuguuuucagcccagcagcugggcuaguccaaugugccucuaaggguaggguagaugaaagagucccuggggccucugggaagauguugcucucucugucucugucucucugucucucucugucugucugucucucucucucucucucucucucucucucucucucucucucucucucucucucucucuguguguguguguguguguguaaugcccuuuuacauccauaaaggguauucuauucuauguuuacucaaaaaguggguuggaaugagguguguguuugcuccaugucugaaggaacuugggaacaucaauaacaccuuagagcuagagaguuuggcucaaagccaguaaaaacaccuccauucugcaaaguccuagcaggagagcuucagcugcccacuguguccccccccccccccacccccccgcagcagcuccugccucuuaugaguuccuagaauuaggcgaucuuccccacauacacacacgaugaugccuuaccccuuucaauaccugauugacugcucugagcugcucacuuaaaagaacucuaaagacgacuucggaggggaagggugucuuuuacaaacagucuagcagagacagaagaaguagugccuuaaucaucucagucaaagucucacuagggaguaccagacguugccaauucucugcaugucuggagacaacauacauuguucauguguguguguggggaggcaauugggaaaguaagugaugacugaugcugcugaguaugguagguguguauugagugugcuuguugcaggaauccuucuaucucuggugcuaaggaugaugacucuaauagcaauuaucuaacgaagcuaugucaaaggugaaggguagguuucaccggcuucguuucaccuaauugcuuccguuuagagaauauggacuacugcuaaucuuguuuuagggacaggaagccaguauuaaacuuucuuauguaucuuggauuacaacaguggggcugggauggagaccacucauuaggccccccucagaccuagacuugguugcaaguccuugcuuagugcugugcaugcugggacaaugagaaugcugacuugugaugcaaagagagcugguguucaucacaucauuguggaagagccaggacacaaagagccccugaugagacaggggaucaguaagaaagggaugccccuuccaggcgugguucaggccuuccucaaccccucccucucuuucuugcucuuucuacagugauccgggccaaaguggugggaaagaagcuggugaaggaggggcccuuuggcacucuggucuacacuauuaagcagaugaaggugagugacaucauuacuggccccaggagggauuuggggggggggguugccagaagagucguggccaagggaggccaagugguuggaacuggaauguguguuugcucaguguagaauccuccagggagcuccagggagcugcuaaggcagcaggaagacaugguggcugcuugcuccaaagccugcacagguagaguucuuguuaggaagcugagccuuggaaucaggaaccagacagcaauagcuuuguuacacgaugacuaugaugauugugagaccccaguccaaucacugcucucuucggccugucuaacaccucuaagauccucguauugaaccacaugguccccaagagcccuugugaggcaagccaugcugcaccccagagccagugcaagcacuaaggcuaugugggggguguccauuccuccaguauuuacagagauugaguguugagcacaguaauucucuauuucccagcucugcuuaucuuccuacauuggaguucauuaggaauauuugcuaaacauucacaucagcagacuguuggccagcccauuaagguuucuaauccuucccgggaagucuaccauaaggcuuaccauacacugaaaacccauguccuggucuuguugcuacucuucaaagcccauugacuuuggccuauuugcuuccccaggccacagugaugguaaucgguugguggugugggcuugggcuuagcacccuauacacacucauuauucaggcauccuaacuaguaguguccuuucggagcaggagccaguaguaguagcugcugaaagaauguccuuccuuuugccuaagugguauuaaggacuggugcuucagcuugaauaacucagcuguuccucuaccccugugucuuuuaagugccuggcuauaugcagaucuccguguuugcagccuguaaauccacgaggcaguuugccacuuuaggauuauaguuauaugaggggagaagagacaugcacugacuagucacaacuccaagauaguccauaugaauugccugcccuuguacuaguuggugauccuugcagcuuugaacauugagguggggguguuucugacacauccagaacuuggagaauacuucccaucugaugaaagagauagagacaagacccgcaggucugaaaaauccucagaggaggccaguguucagacccagauuggacuugucuugggagugaggggugacucacuccuggguggagcccagcuauccuagaggcugaccuucaggccucuuuauucccugcugaggucuguggcuagaugcacuaauucuguggaaccuguugcucuggcuucaauucuggaaacagucccaggcucuugguuauguaauguucagagucagcccuggccaauugcccuuggcugccugagcuuggucaugagagcagcucaugucuucagacagccgggaggccagcaguggguggaggugggaagccaguagaguauuuaggaccccaagcccuauuuugcaaccucuggugguggggaaaggagagcuagagcuucugaccauaguggaggccccuccccugcuauggugcagcaaccuccauugucaaacacuuccagguuacuguagagaaaucgcugggagacaggaauuccuaaacuggcuugcuuuccuuccugccuucagggcuugggagcccaguuaccagagaccuugcugucagcagaaugccccugguuguugucacacccacuagugggaguuguuuggaggcuacauaacuuucacccaccagccugccagcagccacucccaggcuagccugcucagacucucuguucacuguucuucagcuggguucaugguaucagggugauaggguguucuauauagucaucucucacuuauuucugauuagguucaaugggaaaugguacagucagagucaugcauuuuaauuaagggcagaugagaaucucaaguugaggcauuagggcaccuucccuaagcauauguggcuuuugaugugcagccugccaaaggcguaacaggaguuucuuggaggcgggaagcuuguacaagcuggugagguggacacgacuccccaaaucgcccugcuauuuggcuuuccucauuagccauagcuaaugucuuucauucauuuugguucccuucccagcccuguguuaugacgcacaaaaccugccaaugccuuuuuaucuagagggaccaucugcuugcaugccagagcagguacagauaggaauuugagucugcccauucaucccaguccucuucagccccucugugcuuagcacugauugggcuguaagaugggaagaaaaggacacgcucgucacaauuauuagaugacuuuaguaagcaacguuuauugagcauauucuaugccccacagugaucugcuaagucuuuguauaaauuagccucaugccacguuugucaaacagccucauauuuaucuucuuaguggugaggccacaaacacuugagaguuauguaacaggcaagaguuuaggacuagaaacuggaaaacuauaggguuuuuacuaccuggucuuggaggacaaggagauuaacaaaguauggagccugcaggcagacuacucauuucugcccacugugggggcuccccucaccugcuuacguugaguucccucagggggacuuaaaggccaggauggguuugcugguaugugaucugacaggugugcaaccugcaaaggguguaucagaaguauauucaacugcugaggcuggcacuggucccuaggaggucuguuacaguggauuaggcuacuccagagggucugauauggaagcugggcaaugcgggagcaggauuggaggaacucggagaacagagaacaugagaaagucagggugucugaccucuaaagacaggcacauggucuuccuuccuucucucaggcaugccuuaagugcacacagaccccacaguguguguguguguguguguguguguguguguguguguguguggugugugugugugugugugugugugugugugacaggaggcuuuaaggacauugugggagcuuauuguaaacccuuacuuagagauuagcugggauugaguuguggggcaaagguggaaguuuccagaaguggccucugucauuugugggggccuuaucuccuauuaggaccaugggaaagcaguuuguuuugccaggggcuauuguuugugcaguguagacaagcuuucaggcaggcugcaagggacagcacgugggggacauuaugucccaguuggucccaggaggaucccagggaaacaugugccggucaugcgcuuugcuuguccuaacugggggcaggacagaucugccgggcaauuggaaugugcugggcccuuuccuuagugguuuguggaagcaaacgagcgccagcaggguuuccuccagcugcaggaccccuugaccuucaggccucaggaagccauugucguccaaugccugagacucuuauggugcaagauucuuaucgagcccuugcugagaccuacuguguugucguccacuaagcacuuaguggaaauauuuaccaaaaccugaaaccgcaugaacaguuuaccuggcgcggaagucagggugucuuguucuuugcaggccauggugauggugcugcacacaucaggaaucuuaacuguguuuccuguggagucagauggguaucacccagcagcaagcacaucaucauucuggucugcucccccauagcggacugaacccccacauucuguuacuuguucuguugcaaagcccccaggguagcagaaggguucagaaggugucuaagccaucaggacaggacacucuguaaacaagcagaggccugccucucuagauugugaacagacagccucgugcccuguagaccaccugacucugcuagccaccugccuguuagaagaugaggacaaacaagaugauaauaacaacagcagcagcaacaaaacaaaacccagcccaucagguuuuacguagcuggguauuugugaggcaccaaugggguacgcuggcugguauuaaugaccugaguaacuaauaaugcaugcuaaggaaucguucuacugcaaagcucuuagcauagggcuagugacaaccagauauucaaggcccuuagagagguaagaaccaggccucagugucccccuccaccuucccucuucccugucucacagaugacaguguggccucaguagaucagggcuuguguagcacacagggacucauucuagagucacagaaugugcucagucucuguuaaagucacauggccaggcauuccagucacguugugacacgagucucgcaaaagcuagagaugcgagaagccccugcugcuguggaagcccugggucuuaagcuucaaaggcugcaaggagagauagagacagaugaccguuaagaccacagacuaugcguuaucuugcuuggacuuugugcccacuguuuaccaacugugugacuauagacaagccucuaagccugucuaagguucaggccugaaccuuguaaagugagaccaaggcucuuuccugcccucuaagguccugggcauccgguggcuagauauuuuagcaguaaccuaccugcagugucacuaacccugggcccauauaacccuguagccgaggcuguucuacuuaucacuggaagguuaccaacaucccugcucugugucugcucuccugccacggugucuuugacacguugucaaggaaacauauugucuugugcuucaaauguuuccaagagguguagccacuccgcucagucauguugcagaugaauuuuacauaguuuaaccuaguaauaaugauauccuuaauuaagaaguuuugcuuuggcgggagggcuuuaccuugagcaaagaaacucagcgccacggcagaagcucagaaaaauaagaacuuaagauaaugccugucccgaguucacucuccucuagccgaauggaauuuacauuagugcccccauuggaaaaaauggaguucucaguacccacucucagggcccuugugagaauccugugaguaagaacguugcuacauacaccagccuaucacugagauggcacuugaaggccagcuggcuggcuggcuggcuggccccuugaacuugcauagagcccugggugcuuuucauaguagaugccuugaaucugugaugugcggauguguagguagaggaguggggugcagcagguggauagaacauacauauagcuggauaggaagacaccauccuggcccagggaaaagacuagauggccuccuucggugguguucaggaaacccuguggugacagguucauagucuaccacuguccggcugcacaggggggaccagagacucuacagaacacuacacagcagcaugcagauuggacacugggcucucucucacgaucauguuucuuuugcccacagauguaccgaggcuucaguaagaugccccacgugcaguacauucacacggaagccucugaaagucuuuguggccucaagcuagaagucaacaaauaccaguaccugcugacagguaagugucugcaggagcacugagacuccuuugcucugggguggucugccgaagcuugagucagugacauccagaggguugcagacaccuggcuccucagguuaagggucuggcuugcuuacgcacuccugccuggcagccuuggcuccauuguacaucugguuguguccugaucucaugguaucucagcuuuaacguagcuagaaauagguugccucuucaacagcucuuggcagucaauccauuagguuugucuuguaugacagucugaucuuuaggcugucguuguaguaaugacaacacacaaaacccuaaggaauucucagaccuuugaggccuucagcagagugcuugcuaucucaagcuccauuaucagucuggaaaacagggccagaauucacgucuaaagguguugaggaaggugucucaaacccagggucagugccugcccccuggcaguugagaggucuaacagaaugccugcccccuugccuccuauucuccuccagggcgcguguaugaaggcaagauguacacaggacugugcaacuuuguggagaggugggaccaccucacacugucccagcgcaagggccucaauuaccgcuaccaccuggguugcaauugcaaggugaguucuaggggagggugccaaucuggaagcuuugguuccugcuagcuggggcagacagccuguuggguggugcaggggugguaaggaaugcugcccuggggcaaggcagccaggaaagcucugaagaacgccuuuguucuguauucgcugccugcauggugccuacuuggcagcugcuggguugagagggcucuucaaccuccccgccccucccugcugcucuucaaggccaaugacagguacaagaacuuucaguggaggguucugccaagcucuugugaguggguucacucugacagcugacucaaccagguccagucccuuccccauacacaaggucacgagagggaaccgaaucgcuuucucccccuaauccucauaauaaccucauguguuccuaaucacuauuauuucacuguagaagaaaucaaggcaucagagaucuuugucuaugauccuggguuauauagcuuguugagucugauuuccaacccagggcaguugaacucuaaaaucuaugccuuuauuguuuacuuauguuuuacuuauaugaguacacugcagccacucuugagacacacacuauaagagugcaucagaucccauuacagaugguugugggccaccaugugguugcugggaauugaauucaggaccucuggaagagcagucaguuuucuuaaccacuaaaccaucucuccagucuugcuuuuguuguuugaacuccuccauuuccuacaacagugguagucgccucuucccacaucuaaucugagacucaaaugcugugugaccuggaaugagcuguuuaaccuuucugagagucucuauucaucuauagaggggauuuagaaguguaccaaaaguuuagagacaguaugucuggugcccaguagacacucaaugggagcuuauagcuaguguuauuaaucugguagcauuaaagggcaggaacccccuggguuugaauucagggagggccugccauggugcaguccccuaacuguggcuugcgugucauuacagaucaaguccugcuacuacuugccuuguuuugugaccuccaagaaugagugucucuggaccgacaugcucuccaauuuuggguacccuggcuaucaguccaaacacuacgccugcauccggcagaaggguggcuacugcagcugguaccgaggaugggcucccccagacaagagcaucagcaacgccacagaccccugaacccagaccuuccccaccucaccuccuucccaucccgccgagcgucccagacacuaacucuucccagaugaugacaaugaaauuagugccuguuuucuugcaaauuuagcacuggggacacuuaaagucucugcugucuauggaguugauuuggaaauaccuuccuggccccgccccuaccccuucuuuuugguuuugacaucacccauuuccaacuggggaucucuggugccaagccagaaagaacgaggcauguauacaccucuucuucaugauauauaaucuauauuuuuuuaggaaaacagaaauugaaaaauuuaucccauuggggcauuuaaagcuacucuucuuucuucuuccucucuugaccacauccuagacccaguuccauauacacuucuucaucccaauacacaggaaacauggauaaggaaguuggcagaaguccaacuguuucccaaucagucaaaggcagcaagcagacagacgccagguauuugaaaggucuucuacacagaggauauacaacuguaugucugggucagacagucugucuaugugugcaugucagagggagagaagagacagacuguaggagugggucucacaguuauccagcccugugauacuuggguugaccccauguuucagauccuggaacaagcauccaagaguaacagaacuuucugagcuggcaaaggcuuaaacaucugccuggguucagcaggcaaccugcccgucuguacaaaaaacucaaagggcugagaugaacgucuuuccucuccugccucccaugagacagucuccuaggaauucuuggggaaguuuggcuggaagcuugccaacuguaaguuggagaaacacacaccugacacuauccacagauauagucaaguagauuuggauagagaauacuauuuccaaaguaguguuuagcucaucuagggggauguguuuauauauacauuugcauauacccacgggggauuaugagcuaauuuuuuuuauaggacacagaauucuauucaaugcuguuaaauaugcaaauaguuuaaucuuuuuuucuuuuguuguuugaugggaaauugugacauuccaaguugacuuuuuuuuauuaucugaauuaaaauuugaaacucugaccacacucaguacccuacugucccuauaacugggguuaucugaccauccaucucccuucuuuguucugcuuucuguucggggugcccuucacuuaauugccuuacuggcuggcugacggcaggggagugugaguguuagguuagggccuucucaugaaaggggcaguugcacaguggaaugacuccucuccuggaucuggggacagcauacacuucuuccccagcucaguaaugggugaagucacuuccggagguggucaccucauagaaugaacaugauugguuacugagggagccaggcucugccguccaaauguaggccuuuuguuguguuguauuuuuguuuuuaaauaaaaguacaguauaaauuuuccuauuaaauaagauuauuuuaaguuuuagugucaacauugcaaugccaauaguaggugagaguguauugcacagaguuggagauaguaagguggugacauuuaacacaguuacucugucuuuuuucagauuauggguauuuauccucuauuaguaucauaucguuuucauuccacuuuagaaacacaguuaccaguugagagagagagagagagagagagagagagagagagagagagagagagagaacaaguucuagucuguccccaccccacacauaccacugcuuuguccagguguuugauagaagagcagggcaggaagacaguucaggagaugggugucaaguuuucucuugguugauuucauucccuugcaucuuuccccugugcugacagggggcagaaggcacaaccauuuccauggugugccgagagaaggagcugaggucagcaagccagugguucuuaagagcugaaccucuggcuuuacuguuggaaguugucuauuucaaccucagaguuuccuaauauggcgcuccugaucuaucuuacucaagugcccucccauauguauaccccaacaucuuuuccaucuuaauccagcaucgggccauucucaaucccugguaaucaccucccuuuuacauggacagacuugaggugaggccuaaguaugaggcaccugaagauaaaaccaaugggcagaaccaauggccccagucggcuuuugaggucuuggugagaaguacuggccacgaaagggucuuguguaaaguuacaucaucggagagcgguuuuugagcuuucaauaagcuauagcuuuguuuauuucaccuguucacuuacuguauaauuuaaaaucauuuauguagcugagacacuuugauacuucaauuauaucgugaauguuuuauuuugcuaaaucaugugccauguguaggcuguuguguguacacugugucuaagagaagaagaaaagaaaaaaaaaagaaagaaacccacaugccauuuuuuuuuucugauucaaauucuacaguagaauggagggcagaauuacugggacacaaucaccacucagcuagaauggagauucaaggaaauggaagguacuagaaacagacuccuccagccuccuccccauagaauccuaagggugggaagaagaagaagaaaaaaagcaaaagcaaaacaaaacagaaaucaaaaguacacucaaguucuuguccuguaucaaauaucccuaggucaucugccacccacuuuccaagaccuuucuccuacucaaccaggaagucaugguuucugcaguccagagccauggcaacugagauucuaagcucucuuugucucauccaggcaacuuuucugucucccaaccaaggaauuccucugcucaggcuccuguugcccaggauagcucucuucuauagccaggauguggagcuuaaggagacuccaauguuuacuuucuccaguccuagcucugccauauaaacacugucucauguugugcuucuuaaacgacaaagaacauagugacuuuuggggauagaucugucugggagauaaugugaguccaggaggcauuacucuucccugccucacaucaaggugccauucagguaguuggcucccagcuacuuaacgauaaaaauaucacuuucguauuuguaucagagaaacuuaaaaaaaaaauaaagucugaugguagaaauccaaugaaaugggagaaggcaggagagagaggucucaguagaucuaagucggcuguuuggguugaggaggagagaacccgaggaaaugaccaugcucuggggacagggguaccuuagauucucugucuauuuuuccucuagcaagccagcugugcugaagcccaguagagaugaagagacaccagccagagaaaacccccucuagaaggaauguauuuguugcuaaauuuuguagcacuguuuacaguuuuccuccauguuauuuaugaauuuuauauuccgugaauguauauugucuuguaauguugcauaguguucacuuuuuauagcuguccuuuauucuaaacaguaaagugguuuuauuucuaucacau

SEQ ID NO: 5681 - RNA, 49137 nt, Mus musculus
augugauagaaauaaaaccacuuuacuguuuagaauaaaggacagcuauaaaaagugaacacuaugcaacauuacaagacaauauacauucacggaauauaaaauucauaaauaacauggaggaaaacuguaaacagugcuacaaaauuuagcaacaaauacauuccuucuagaggggguuuucucuggcuggugucucuucaucucuacugggcuucagcacagcuggcuugcuagaggaaaaauagacagagaaucuaagguaccccuguccccagagcauggucauuuccucggguucucuccuccucaacccaaacagccgacuuagaucuacugagaccucucucuccugccuucucccauuucauuggauuucuaccaucagacuuuauuuuuuuuuuaaguuucucugauacaaauacgaaagugauauuuuuaucguuaaguagcugggagccaacuaccugaauggcaccuugaugugaggcagggaagaguaaugccuccuggacucacauuaucucccagacagaucuauccccaaaagucacuauguucuuugucguuuaagaagcacaacaugagacaguguuuauauggcagagcuaggacuggagaaaguaaacauuggagucuccuuaagcuccacauccuggcuauagaagagagcuauccugggcaacaggagccugagcagaggaauuccuugguugggagacagaaaaguugccuggaugagacaaagagagcuuagaaucucaguugccauggcucuggacugcagaaaccaugacuuccugguugaguaggagaaaggucuuggaaaguggguggcagaugaccuagggauauuugauacaggacaagaacuugaguguacuuuugauuucuguuuuguuuugcuuuugcuuuuuuucuucuucuucuucccacccuuaggauucuauggggaggaggcuggaggagucuguuucuaguaccuuccauuuccuugaaucuccauucuagcugaguggugauugugucccaguaauucugcccuccauucuacuguagaauuugaaucagaaaaaaaaaauggcauguggguuucuuucuuuuuuuuuucuuuucuucuucucuuagacacaguguacacacaacagccuacacauggcacaugauuuagcaaaauaaaacauucacgauauaauugaaguaucaaagugucucagcuacauaaaugauuuuaaauuauacaguaagugaacaggugaaauaaacaaagcuauagcuuauugaaagcucaaaaaccgcucuccgaugauguaacuuuacacaagacccuuucguggccaguacuucucaccaagaccucaaaagccgacuggggccauugguucugcccauugguuuuaucuucaggugccucauacuuaggccucaccucaagucuguccauguaaaagggaggugauuaccagggauugagaauggcccgaugcuggauuaagauggaaaagauguugggguauacauaugggagggcacuugaguaagauagaucaggagcgccauauuaggaaacucugagguugaaauagacaacuuccaacaguaaagccagagguucagcucuuaagaaccacuggcuugcugaccucagcuccuucucucggcacaccauggaaaugguugugccuucugcccccugucagcacaggggaaagaugcaagggaaugaaaucaaccaagagaaaacuugacacccaucuccugaacugucuuccugcccugcucuucuaucaaacaccuggacaaagcagugguaugugugggguggggacagacuagaacuuguucucucucucucucucucucucucucucucucucucucucucucucucucaacugguaacuguguuucuaaaguggaaugaaaacgauaugauacuaauagaggauaaauacccauaaucugaaaaaagacagaguaacuguguuaaaugucaccaccuuacuaucuccaacucugugcaauacacucucaccuacuauuggcauugcaauguugacacuaaaacuuaaaauaaucuuauuuaauaggaaaauuuauacuguacuuuuauuuaaaaacaaaaauacaacacaacaaaaggccuacauuuggacggcagagccuggcucccucaguaaccaaucauguucauucuaugaggugaccaccuccggaagugacuucacccauuacugagcuggggaagaaguguaugcuguccccagauccaggagaggagucauuccacugugcaacugccccuuucaugagaaggcccuaaccuaacacucacacuccccugccgucagccagccaguaaggcaauuaagugaagggcaccccgaacagaaagcagaacaaagaagggagauggauggucagauaaccccaguuauagggacaguaggguacugaguguggucagaguuucaaauuuuaauucagauaauaaaaaaaagucaacuuggaaugucacaauuucccaucaaacaacaaaagaaaaaaagauuaaacuauuugcauauuuaacagcauugaauagaauucuguguccuauaaaaaaaauuagcucauaaucccccguggguauaugcaaauguauauauaaacacaucccccuagaugagcuaaacacuacuuuggaaauaguauucucuauccaaaucuacuugacuauaucuguggauagugucagguguguguuucuccaacuuacaguuggcaagcuuccagccaaacuuccccaagaauuccuaggagacugucucaugggaggcaggagaggaaagacguucaucucagcccuuugaguuuuuuguacagacgggcagguugccugcugaacccaggcagauguuuaagccuuugccagcucagaaaguucuguuacucuuggaugcuuguuccaggaucugaaacauggggucaacccaaguaucacagggcuggauaacugugagacccacuccuacagucugucucuucucucccucugacaugcacacauagacagacugucugacccagacauacaguuguauauccucuguguagaagaccuuucaaauaccuggcgucugucugcuugcugccuuugacugauugggaaacaguuggacuucugccaacuuccuuauccauguuuccuguguauugggaugaagaaguguauauggaacugggucuaggauguggucaagagaggaagaagaaagaagaguagcuuuaaaugccccaaugggauaaauuuuucaauuucuguuuuccuaaaaaaauauagauuauauaucaugaagaagagguguauacaugccucguucuuucuggcuuggcaccagagauccccaguuggaaaugggugaugucaaaaccaaaaagaagggguaggggcggggccaggaagguauuuccaaaucaacuccauagacagcagagacuuuaaguguccccagugcuaaauuugcaagaaaacaggcacuaauuucauugucaucaucugggaagaguuagugucugggacgcucggcgggaugggaaggaggugagguggggaaggucuggguucaggggucuguggcguugcugaugcucuugucugggggagcccauccucgguaccagcugcaguagccacccuucugccggaugcaggcguaguguuuggacugauagccaggguacccaaaauuggagagcaugucgguccagagacacucauucuuggaggucacaaaacaaggcaaguaguagcaggacuugaucuguaaugacacgcaagccacaguuaggggacugcaccauggcaggcccucccugaauucaaacccaggggguuccugcccuuuaaugcuaccagauuaauaacacuagcuauaagcucccauugagugucuacugggcaccagacauacugucucuaaacuuuugguacacuucuaaauccccucuauagaugaauagagacucucagaaagguuaaacagcucauuccaggucacacagcauuugagucucagauuagaugugggaagaggcgacuaccacuguuguaggaaauggaggaguucaaacaacaaaagcaagacuggagagaugguuuagugguuaagaaaacugacugcucuuccagagguccugaauucaauucccagcaaccacaugguggcccacaaccaucuguaaugggaucugaugcacucuuauagugugugucucaagaguggcugcaguguacucauauaaguaaaacauaaguaaacaauaaaggcauagauuuuagaguucaacugcccuggguuggaaaucagacucaacaagcuauauaacccaggaucauagacaaagaucucugaugccuugauuucuucuacagugaaauaauagugauuaggaacacaugagguuauuaugaggauuagggggagaaagcgauucgguucccucucgugaccuuguguauggggaagggacuggaccugguugagucagcugucagagugaacccacucacaagagcuuggcagaacccuccacugaaaguucuuguaccugucauuggccuugaagagcagcagggaggggcggggagguugaagagcccucucaacccagcagcugccaaguaggcaccaugcaggcagcgaauacagaacaaaggcguucuucagagcuuuccuggcugccuugccccagggcagcauuccuuaccaccccugcaccacccaacaggcugucugccccagcuagcaggaaccaaagcuuccagauuggcacccuccccuagaacucaccuugcaauugcaacccaggugguagcgguaauugaggcccuugcgcugggacagugugagguggucccaccucuccacaaaguugcacaguccuguguacaucuugccuucauacacgcgcccuggaggagaauaggaggcaagggggcaggcauucuguuagaccucucaacugccagggggcaggcacugacccuggguuugagacaccuuccucaacaccuuuagacgugaauucuggcccuguuuuccagacugauaauggagcuugagauagcaagcacucugcugaaggccucaaaggucugagaauuccuuaggguuuuguguguugucauuacuacaacgacagccuaaagaucagacugucauacaagacaaaccuaauggauugacugccaagagcuguugaagaggcaaccuauuucuagcuacguuaaagcugagauaccaugagaucaggacacaaccagauguacaauggagccaaggcugccaggcaggagugcguaagcaagccagacccuuaaccugaggagccaggugucugcaacccucuggaugucacugacucaagcuucggcagaccaccccagagcaaaggagucucagugcuccugcagacacuuaccugucagcagguacugguauuuguugacuucuagcuugaggccacaaagacuuucagaggcuuccgugugaauguacugcacguggggcaucuuacugaagccucgguacaucugugggcaaaagaaacaugaucgugagagagagcccaguguccaaucugcaugcugcuguguaguguucuguagagucucugguccccccugugcagccggacagugguagacuaugaaccugucaccacaggguuuccugaacaccaccgaaggaggccaucuagucuuuucccugggccaggauggugucuuccuauccagcuauauguauguucuauccaccugcugcaccccacuccucuaccuacacauccgcacaucacagauucaaggcaucuacuaugaaaagcacccagggcucuaugcaaguucaaggggccagccagccagccagccagcuggccuucaagugccaucucagugauaggcugguguauguagcaacguucuuacucacaggauucucacaagggcccugagaguggguacugagaacuccauuuuuuccaaugggggcacuaauguaaauuccauucggcuagaggagagugaacucgggacaggcauuaucuuaaguucuuauuuuucugagcuucugccguggcgcugaguuucuuugcucaagguaaagcccucccgccaaagcaaaacuucuuaauuaaggauaucauuauuacuagguuaaacuauguaaaauucaucugcaacaugacugagcggaguggcuacaccucuuggaaacauuugaagcacaagacaauauguuuccuugacaacgugucaaagacaccguggcaggagagcagacacagagcagggauguugguaaccuuccagugauaaguagaacagccucggcuacaggguuauaugggcccaggguuagugacacugcagguagguuacugcuaaaauaucuagccaccggaugcccaggaccuuagagggcaggaaagagccuuggucucacuuuacaagguucaggccugaaccuuagacaggcuuagaggcuugucuauagucacacaguugguaaacagugggcacaaaguccaagcaagauaacgcauagucuguggucuuaacggucaucugucucuaucucuccuugcagccuuugaagcuuaagacccagggcuuccacagcagcaggggcuucucgcaucucuagcuuuugcgagacucgugucacaacgugacuggaaugccuggccaugugacuuuaacagagacugagcacauucugugacucuagaaugagucccugugugcuacacaagcccugaucuacugaggccacacugucaucugugagacagggaagagggaagguggagggggacacugaggccugguucuuaccucucuaagggccuugaauaucugguugucacuagcccuaugcuaagagcuuugcaguagaacgauuccuuagcaugcauuauuaguuacucaggucauuaauaccagccagcguaccccauuggugccucacaaauacccagcuacguaaaaccugaugggcuggguuuuguuuuguugcugcugcuguuguuauuaucaucuuguuuguccucaucuucuaacaggcagguggcuagcagagucagguggucuacagggcacgaggcugucuguucacaaucuagagaggcaggccucugcuuguuuacagaguguccuguccugauggcuuagacaccuucugaacccuucugcuacccugggggcuuugcaacagaacaaguaacagaauguggggguucaguccgcuaugggggagcagaccagaaugaugaugugcuugcugcugggugauacccaucugacuccacaggaaacacaguuaagauuccugaugugugcagcaccaucaccauggccugcaaagaacaagacacccugacuuccgcgccagguaaacuguucaugcgguuucagguuuugguaaauauuuccacuaagugcuuaguggacgacaacacaguaggucucagcaagggcucgauaagaaucuugcaccauaagagucucaggcauuggacgacaauggcuuccugaggccugaaggucaagggguccugcagcuggaggaaacccugcuggcgcucguuugcuuccacaaaccacuaaggaaagggcccagcacauuccaauugcccggcagaucuguccugcccccaguuaggacaagcaaagcgcaugaccggcacauguuucccugggauccuccugggaccaacugggacauaaugucccccacgugcugucccuugcagccugccugaaagcuugucuacacugcacaaacaauagccccuggcaaaacaaacugcuuucccaugguccuaauaggagauaaggcccccacaaaugacagaggccacuucuggaaacuuccaccuuugccccacaacucaaucccagcuaaucucuaaguaaggguuuacaauaagcucccacaauguccuuaaagccuccugucacacacacacacacacacacacacacacaccacacacacacacacacacacacacacacacacacacacacacuguggggucugugugcacuuaaggcaugccugagagaaggaaggaagaccaugugccugucuuuagaggucagacacccugacuuucucauguucucuguucuccgaguuccuccaauccugcucccgcauugcccagcuuccauaucagacccucuggaguagccuaauccacuguaacagaccuccuagggaccagugccagccucagcaguugaauauacuucugauacacccuuugcagguugcacaccugucagaucacauaccagcaaacccauccuggccuuuaagucccccugagggaacucaacguaagcaggugaggggagcccccacagugggcagaaaugaguagucugccugcaggcuccauacuuuguuaaucuccuuguccuccaagaccagguaguaaaaacccuauaguuuuccaguuucuaguccuaaacucuugccuguuacauaacucucaaguguuuguggccucaccacuaagaagauaaauaugaggcuguuugacaaacguggcaugaggcuaauuuauacaaagacuuagcagaucacuguggggcauagaauaugcucaauaaacguugcuuacuaaagucaucuaauaauugugacgagcguguccuuuucuucccaucuuacagcccaaucagugcuaagcacagaggggcugaagaggacugggaugaaugggcagacucaaauuccuaucuguaccugcucuggcaugcaagcagauggucccucuagauaaaaaggcauuggcagguuuugugcgucauaacacagggcugggaagggaaccaaaaugaaugaaagacauuagcuauggcuaaugaggaaagccaaauagcagggcgauuuggggagucguguccaccucaccagcuuguacaagcuucccgccuccaagaaacuccuguuacgccuuuggcaggcugcacaucaaaagccacauaugcuuagggaaggugcccuaaugccucaacuugagauucucaucugcccuuaauuaaaaugcaugacucugacuguaccauuucccauugaaccuaaucagaaauaagugagagaugacuauauagaacacccuaucacccugauaccaugaacccagcugaagaacagugaacagagagucugagcaggcuagccugggaguggcugcuggcaggcuggugggugaaaguuauguagccuccaaacaacucccacuagugggugugacaacaaccaggggcauucugcugacagcaaggucucugguaacugggcucccaagcccugaaggcaggaaggaaagcaagccaguuuaggaauuccugucucccagcgauuucucuacaguaaccuggaaguguuugacaauggagguugcugcaccauagcaggggaggggccuccacuauggucagaagcucuagcucuccuuuccccaccaccagagguugcaaaauagggcuugggguccuaaauacucuacuggcuucccaccuccacccacugcuggccucccggcugucugaagacaugagcugcucucaugaccaagcucaggcagccaagggcaauuggccagggcugacucugaacauuacauaaccaagagccugggacuguuuccagaauugaagccagagcaacagguuccacagaauuagugcaucuagccacagaccucagcagggaauaaagaggccugaaggucagccucuaggauagcugggcuccacccaggagugagucaccccucacucccaagacaaguccaaucugggucugaacacuggccuccucugaggauuuuucagaccugcgggucuugucucuaucucuuucaucagaugggaaguauucuccaaguucuggaugugucagaaacacccccaccucaauguucaaagcugcaaggaucaccaacuaguacaagggcaggcaauucauauggacuaucuuggaguugugacuagucagugcaugucucuucuccccucauauaacuauaauccuaaaguggcaaacugccucguggauuuacaggcugcaaacacggagaucugcauauagccaggcacuuaaaagacacagggguagaggaacagcugaguuauucaagcugaagcaccaguccuuaauaccacuuaggcaaaaggaaggacauucuuucagcagcuacuacuacuggcuccugcuccgaaaggacacuacuaguuaggaugccugaauaaugaguguguauagggugcuaagcccaagcccacaccaccaaccgauuaccaucacuguggccuggggaagcaaauaggccaaagucaaugggcuuugaagaguagcaacaagaccaggacauggguuuucaguguaugguaagccuuaugguagacuucccgggaaggauuagaaaccuuaaugggcuggccaacagucugcugaugugaauguuuagcaaauauuccuaaugaacuccaauguaggaagauaagcagagcugggaaauagagaauuacugugcucaacacucaaucucuguaaauacuggaggaauggacaccccccacauagccuuagugcuugcacuggcucuggggugcagcauggcuugccucacaagggcucuuggggaccaugugguucaauacgaggaucuuagagguguuagacaggccgaagagagcagugauuggacuggggucucacaaucaucauagucaucguguaacaaagcuauugcugucugguuccugauuccaaggcucagcuuccuaacaagaacucuaccugugcaggcuuuggagcaagcagccaccaugucuuccugcugccuuagcagcucccuggagcucccuggaggauucuacacugagcaaacacacauuccaguuccaaccacuuggccucccuuggccacgacucuucuggcaacccccccccccaaaucccuccuggggccaguaaugaugucacucaccuucaucugcuuaauaguguagaccagagugccaaagggccccuccuucaccagcuucuuucccaccacuuuggcccggaucacuguagaaagagcaagaaagagagggagggguugaggaaggccugaaccacgccuggaaggggcaucccuuucuuacugauccccugucucaucaggggcucuuuguguccuggcucuuccacaaugaugugaugaacaccagcucucuuugcaucacaagucagcauucucauugucccagcaugcacagcacuaagcaaggacuugcaaccaagucuaggucugaggggggccuaaugaguggucuccaucccagccccacuguuguaauccaagauacauaagaaaguuuaauacuggcuuccugucccuaaaacaagauuagcaguaguccauauucucuaaacggaagcaauuaggugaaacgaagccggugaaaccuacccuucaccuuugacauagcuucguuagauaauugcuauuagagucaucauccuuagcaccagagauagaaggauuccugcaacaagcacacucaauacacaccuaccauacucagcagcaucagucaucacuuacuuucccaauugccuccccacacacacacaugaacaauguauguugucuccagacaugcagagaauuggcaacgucugguacucccuagugagacuuugacugagaugauuaaggcacuacuucuucugucucugcuagacuguuuguaaaagacacccuuccccuccgaagucgucuuuagaguucuuuuaagugagcagcucagagcagucaaucagguauugaaagggguaaggcaucaucguguguguauguggggaagaucgccuaauucuaggaacucauaagaggcaggagcugcugcggggggguggggggggggggggacacagugggcagcugaagcucuccugcuaggacuuugcagaauggagguguuuuuacuggcuuugagccaaacucucuagcucuaagguguuauugauguucccaaguuccuucagacauggagcaaacacacaccucauuccaacccacuuuuugaguaaacauagaauagaauacccuuuauggauguaaaagggcauuacacacacacacacacacacagagagagagagagagagagagagagagagagagagagagagagagagagagagagagacagacagacagagagagacagagagacagagacagagagagcaacaucuucccagaggccccagggacucuuucaucuacccuacccuuagaggcacauuggacuagcccagcugcugggcugaaaacagauccaccuggacaugacaagugauucucaagggacuaaagugacuugcguucaccuguuucauuugcccagaaaguaaacuggagaguaaggcuuugccuaagggggaaaggguuaagagggauuuuuuuuuuaaauggcagcaucuggccuuuucuggcuugcaacaagcucaccuugauuugggcauaaaauuucuuaagcaagccugcccuguaagucuggguacuucuggaagcuucugcccauaaggucagccaaaucuuuucuuacccugaaauggccugagcuuggaaccuuuucaucugggaacaguuuagagaaaacacacugagguuuuuuuuugugcucagggaguuacaucagcauucagaucccaccauugcuguguggccucaccacagcucuucccccuuagaucucucuggcuuucuuggcccaaugccacuuauguggauugcaagugaugugcuuaugaauaguggagaaacaccacgaagaccugagguuggcaggagucagauccuagcaccacauggugcuguguggccacaggggaugucugaaaccucucugguccuuaguuuccuaaugcaucuaaugagagugaugauaggcguccucagaaaguugcugugagagccgagaacaaagaccaagagcaucaugggaucuacccccccacacacacacaguaccucuuagcucacuaucaguagcauugcuaccaccaccagaaccucauuugauaucugcccacccaucagcccugucggcuaagaccugucaaccuucccugagauuaggguagaggagagauuccuggcugggauggaagugagggaaagcuuauauauaaauaccuuguuaaaaaaaaaaucacagggaaagaugugggagcacacaggcggugaccaggacaagugugcaugaggccuugauaucgaagcaacuccugcaccauccgugucccacuuuguugcuacagagagcccaacagugaccuagugugaccugccagacaagaugguauccaugggccaaagagauagaugcggaagcagagagagcccaggguagaggccacaucaauguuuucucuauaaaaacaaaaucucuugaaacuaaccuaaaauuaaacagcauucuuugcucccagauagaguuaaauuacuugccggccccaaauccaccuauuugccuccugaauuauuauaacuucauuuacuuuaguuuguccugugcaacuuggaugcguguuauuuuguacuauuuggcaguaagguuuuccccagaggcaaucaguggcccaggcaggggucacagugaacaagaagguugaaggggaggggcggucuacaagacuucaacagcaacagaagacauggcuucucaacuuggagcugauggugcaucuaaccacucucuccaccuucaaaugacagcuuuaacauggaccaggccagacacagguucucuuuauuccugcuagagaguggccauacacucuucaccccauguucuccagcagguagccuaugcuggugucuggaagcaugaaugcuugguaggggcgauagaaagaaauaaaagccccauuuccugcucccacagacugcagccuaagagggagacaagguggaguagagcaccagaaaaccaaaucaccaagagaccuaagugcuggaggaggcccugccugacucagccaacgaggcuuccaaggcucucugcugucuucucugcuucugagggcauggagacuacaagggacaggaagagauuaauuaaggagucaauaaaguuucaacuuaaaaguuccuaagaagaaaccgacuagacuagaaacuggggauguagaaggaugauggaagccuuacccagaaugcucugggcucaaucuacagaccacaaaaaggaaaagagcaggcugugggugccugggaaguagcucacagagccauaauaaauauaugugguuuucaaauauaucagagaucuguggaaguaggcaugaaagcacaucucuuuagaacacauuucucccuuguaauacauucugggaagguugguuacuguuugcaaaaccaaggcagacagacuacagcucuacaagccgauaagauuguuauuguccucguuccccgcccccuuucgcuagcaaugggaccccugccgcacaagcuuuaaacaguaauaguuccagggcaagcagaccacugguguaucucuaggagucccacaucugcuguuaaucaacggauuuggagaaggacaagacacccuggaccuggcccaugucucucccugcuccaccaaucuaaccaccaucaaucaaacacagaccuuuguccgccugaccugauggauggguuuuccuacugaccggcuggaaggaggagcaguggggcugcuggucugacugcucuguggaacaaaggcccucaaguuaauggagauccccuaucucaggcucccaccaauagccaucccgcuccauauagccucucuuaagagucacauggcugguucugcccuaaagauguagagacucauggguagacaggacucuguguaagccuguccaagaagggcagagcaaggaucccuugccccaucuagcugcccaccccacuggucagcaguuccuggaucucuuugcauugcaucugcaagaacagugaaggaaaaaagcuaggacguaucuuuagcagcugucacugacagaccaugacuugugugccaagugcugugugcacauuucacuguguucccucuggggugaugcugggaagugggaaucacuguaccuguuauuaguaccuacugagcagcuuugcauacuauuguggagccccccacccaagaaagaagacugccauugaaucuuugcagaacaguuccuaacugaacccugcacccauugucaacccuagugggucuagagaagucuuauacuuagaugggggaugccugauauguccccaaucuugagacuucccuucacauucauuuauucucucucucucucauuuucccccuuucucccuccuucccucccucugucuugucuccucuccccuucccuuuuuccccucucucugauuaguagcaagaaucuacagucaccaucaacagauaaugaauggugaaucauuuacuuagcuuauuguucucccccagcacuggacaauguguauguauaaaguacuuugcagccuggaucugagcagaaauucggggguggaggguggggagggggcuggacagcacuugcaaacuuguagcacuuuguggcucauuagaggaaaacagaaaccuuccccgaggauacauggcaccuuccuucccccuuccuuuucaagguccuuccugggaaccuguugccccuuuggggacccuggauguaucuacauuugaggacaagacaguaggaaugaagauggaagaggccuagaagccccuggguuccccuggugcucagccuugugggugccacucucccaaccccuaaaaaucccuauaaaauggcucaagccagaaggucagagcaaaacguauaucuagggaauccgugaugguaaccugagauaacagaaggcacaaggcaccuuaguucugucaguggaugaccuccugcaggccacuucccgucccggcauacaaacaguggcaagugauuaccaagcucacuggugcucuuccuccaaggugacuuggguuuucuccucaccucaccgaagccaguuuucagaaugacccauaccauccaagagacccaguccaaucaaugguguguuccuacuuaaucauucucuuuacucacaacugugguuuucuaugcagcccaugcaagugacaaugaccaacugcuuggaaaccccaauccagaacuuccaugacuucuaugccuuucuauggugcucuccccugauagucugcugagcugugugagguacuuauccaacgcugagcuccugauaacaggccacacccauaacugggccucugagggccuucucugucucggggaauggcagcuugcuccauuccuguacccaccacuccaaacacacagcccagagucuuucccuucgcaguugcuaggguuggacacuugcuucacuccugcauagcuccuuucauugucuauuugcuauauccuggucaggcugccaugucuguucccucccugcauccuucuccccaaguccacaguccccccaucauguuucucgccucauuguguucuagcugacaccugccaccauuaggccacuuguuuguugauuaacuguauuuucucaauagaaugcaggcucccaaaaaggacuuuuauucuggcuaacugcccuacucagagaaaccaggaggaccugaaacaucacaggcuucuaauacauuugagcugaauacacuaaguucagugugauuuuuacauauacagcaccacacaaaaagaggaugacuuaaagacagauaaguaacucucuuguguagacuggggaagacagccaacucuuucugagcuuucaauccaucaaaaugggauaagggcaauucucaguugguaggucaggcaaacaucuguccauucaccauugacugaggccggugccugacuuggggaauaaugagaaaaaugaggcuccaaagaacucuaagucccaaggcaggagaaacacaaugauaggaaagaauggcaaacacagacgaaggaaccagggucacagcucccaugacacaagaccguggagucuguuuguggggagggacaucagaaacaucuguucuggacccauccugcagaagacaccuuguuugaugcaucuagaauuuaaggaagcagaaauuuggaccaggcuuugggaggagggggaagggcaaggaacuggcugggaaugaagcaaaacugcagcuggcuccuuguaaaaccagggccuucuucccacuuuccaggaagacaccccuccuucccugccuccccccaaauaggcacuuccuacauccuauccugguuccccagggcucuucucccuugucaguuucaaaggcccuuuuuguugauguugaagccaaggccagacauuauaaaaugcacuccccccgucaagauaagcaggcuccaguucaaagcuuguccugacuaacucuuuccguuaaguaaaaauauuaaucuugguuuuauuuaagcagguuuuuuuggcaagaaaugaaugccuguggcuaaaaauaaacccgauccacacacgcuuagaaaaucuagaaagcugcaaaucauuucagcccaauuccaucucagggaaggccauuaaaaccuccccacccaagagcucacggggcucgguacuuggugacugguacccuccuucugcuccguggucucugggaaagccuggccuggccuggggugcucaguucucaguccuugggccucuagcagcagggaagaaggauuugugucuuguaggcacugugcaagucugcuugagucagaaaccaggaaacagccccuguugacauuguuuguguaugaacuaaaggggccauggaagggaggcaagagagguccagguccaggaggucagauugccuggaacuuggucaccccaaaggaacagaaaacaaaaccuccagcaugcuccugcuuuccuagucacagcgaugaccucggugugaagcucuuagaagcaaauggcaggggucgucagccucaggcaccuucugagguuuggauuaaugcacuugcuuuuaaaggcagccauccuuaauugcuuccugggccacuggcaauuugggagaaagauauaugcaucauuuugccaaggacagggcaaaaguccuaagguggcugguuccuggauauaaaguugacuuagcugggagcaagggcauccaaucugaggaagcacaugguauuucuguggcguaaguuugcaaggcaccaggaaggugcuucgugggcuucuaccuccuucccaugaauguaucuacacaucaggguccuuuuaacugaaaugcagccuccccuuggaagccugucucugcaggccaggcuacucucuucugucccaauacucugcuuuuccuucuggggauuuuucuucuaugaugaguucuuuggcacugagcagcaucccuaguaaccagaugacagguaaaaccuggagugucggcacucgacaucaagcguaccauguagcaggcuccccaaaguguuugcugaaugaaugaaugaaugaaugagugaaugagugaaugaaugaggcuggggaaaguaauacaggauuguuuucacaucuacccuccuggaguagagagucaagaguccugguuccuaacagcuauuuagacaagaaacuagagggggaagaaggaagaggaggaggaaggaggaggaagagaaggacaaggaggaggaaaaggaagaagugggaagaaggaagaagaaagugaauguguccaagaagugacccuggucccaaacaggaagauuggcacuccaggaggagugagucagaggauguuguuacaagaggccucagucaaccugcugucucuguggaagggcugcacucagaccccaugagagaugagagacucaggcucaggagccuaaacaaagcucccacagaaagcucuuccgggccugccccugcugauccccuugcagcagccuuggcagguaggaaaagcagguucagcuuguucaggccacaucccauccuguggauuucugcauauuucccugucugugcuccucuuuccuucuucugccccuucccuucuuucuccucuucuucucccacaagcacuugggguugcucuauuagcugcucaguguuuacucagaaggcuauagagcgcuaugauccagcaccaugccuuagagaucuggcaguaaacaggugggcaaggcuccuaucuucaggaaccuucuuucugucccaugagacaagaagauggaaguagaugggaccacaacuccaccggcuagagguggcauccuacuccagcugcccucugagaagucacucagagccacaaaggaucggcccuauugauagaggaauaaaugaagguaaaaaccuauagacuagagaucuuagccuauacagaguaacagaacccacugccuggguguaaugggacugauccuccaggcaagcaucaauucuucaagggaaggcaacucuuagaacugugcucuuaagggagcgccccacccaaagcucugggauaccucaagaagcugguuugggucuugcauaccccucuuuacacaagacccacaaggggcuucuugcacuuugcaacccacugcugaaguuucaaguuaagauuuaauauacccucugcaccucccauacucuccccgcaacucaaaccccuuaucuuccuggaguggcuuugucuugggaguuugguuggucuucugugcuguggccagagaagauauggugucuugggugcacacugacuucugccaagcucaaacucacucaggguucaggacugcccacuugcucuuugccauuggcucacacuuggcaagggggcuuggaccacccucacccucccucuugggcuccaaccccuucccaugggcccaugggaaacuuuaucccacacaaguggccaccagaauagcagcccggucuucaaccacagccccuuugaagcagugcccagaaaaauaccgugcccuccaacgguucucagaacauuugagcuuucaggucgggccguuucugagagcagaacagcgggcagcaucucaggggcuguccauagcauugguuuuuuuuuuuuuccuaauugggauuuuguuugcgagaaaagcugagggauucugggaaaggucuaggaaguggaccaccauuaagccaagggaccuccccucugcacaucagaccugcagacugcgauucuguucccagaaagcaccaggaggagcaggagguguuacugugguuugagcauucagaaaugucugcucuguuucuacaugccagcaagguagugaauagcugguggaaauagcuaggaggaucccacuggaaacaagugugacuggucccagcccacccagcucacaacucccacgcccagggcaugauggacacucagguagaacagguaugagaaaaacucuaaguguguaauaucuaagacaguuaaucagaaacagcuaucauggagggugugaaggaauguucugagaucagcuccaagggccucuucaagccccaccuacuuuaaacaaaauauagucaaagcccacuaacugcugccucuucuggucaugguaggcaaugacagaauuauaaagccaacucccaccguuuauuucugaaccaucuuccuuggucuggucaguguaauugaagaggagaagugucagugauagagggaaaagagcaucuaucccaucaacaucuguauaggacccacaucugcaccuaacccucucugcauucagcagauaccuccugauggucuacuacacacaugccagguacugugucacauaguauagggagcuagacacacccccuacagauaauauaucugcuccuuaaaacuaaucggaguauuuuuuuuauuggauucagaaaaaaaaaaaaaaaaagacucaggggaguugaggaacuugucagaggucaucaacuagaaauuaaauacagaugcacccagccccagagcucgcccuuuuucuauuacucaacaauuaacaaacauggaaugugcaaccaaaaggucagaugcaucagaaaugaggaauuggaggagacugccaaggcugaagacucagggaagggccacugugccacagcugcugagagcuuucaggaggacucagcuccuucaagcccucacggugucuaaagacucuacuguaaauuggauccaguuuccagagcucauguagauucguucuagguucuaggauggcuucugguuuuaugggccaugcagagugcacugguuuccauuagucaacagcacaaacgcauucugaaagaggccugaugugauaaacuggacacaagucugaccgaacuuuauuguaggacacuagggucccauaaccuagagcaacugccucagaaaaggcauccuauaaacacgcacaacacagggcauugcuccuuuccgucgcugaagucgguguuuugccucagugaaccuaagugacccguagcuuuugacucuaccuaugcacaggaagugauguuaugaagugagcuaagcuacuugcagaagcacacuuaaucacugcuucuagaugcucccaagggcaacaauacagagcaaagagggacacauucccaaugcuaugcuaauauucuuuuacaauaauggauacauguagccuaacaugaacccagaaagugcgucagcggagccuauugacaacuuugcccaauaacgagaaaucuacuggcuuugagcaugucacucauuaacaccauuaucaauuacagcaggugccaauacuuacaugcagguacugcgcaugaucagugcugaguacuuuauauggacagucccaguuugagccucauuaagaccccuagaguaagugcugacuuagcaccaucugacagcauugcagcuugugggaguaagugauuuuucccaagaucaucgaaugaggaauugggaaacccagcaugucaguccagguggccugacucuaaagcuccuguccaucaucauuuggccacacuuacuuaaccuuccagaugugccagcuuaaccacuggugaguugggcacauuucaauggacugacagaacuugcaggaucacugagaauaacuuuccugccaugacaauccuagaguuagucuguacgguguggggcacugugaccuaagccaggcuuuccugguuuuugguuuuuuuguuuuguuuugguuugguuugguuuuuuuuuaacuauuguauuaucucucucuaugguaaccuucuucuaauuagcugacguggugggcauacacacaucagaagagugcuugcauuuuccauaaguuauugucagaauagacauugucacagauucugagggccccuugucugccuguggcccucguucccggucuccccaucauucucuucuuguuuguauccuucagcucuaguugccaugguaagaguugaaugaaugcagauuucccaggaagacagucugggagcgggaggcguauccaccagggcacaaaguggacaaaggucaaagcuucccuauucaggaugauauuacuuauggccauucaaccuaaaacaucacccuuggcuacuuagaaucuugaguguggacaauuuguuaugaggguagaucuuaaguguuaccacagcaaaauugaauaaucaucauuaucaucauuaucaucgucgucgucgucgucgucgucgucgucgucgucgucaucaucaucaucaucaucaucaucaucuaguguuuucaaaacagauucugcuucccaacuucuggugugauuuacugagucuuccuguuacuacugcaggaucugagaauaggagggagaaccucacuauacaacaagcacugaguggcaggaagaacccuggaguaggggcacuugggaacuaguuucacuuugccuuccauucauuuucugugugaguuuugccuauguugacagaucccuccauucuaugugaaaaucacguuggaaaagcuauacuccacugccccuuacucucucggggccuugccuaggauauuaguccuuuguauuucucauuuaggcgucuuuuuuccuuguuagacuuucuucucaucggucauuauccacugugccgugcauucuaugcucuguagaaccauacuucugagcaucgacgucacugcggugugucuggcccugucucaaggguccuucuuggccuauuccccaucuccaugguuugaacuuauguagacuugggcuaggagugucccuaaucagcucccuggguccuucugccauucaaaguggcagagaccauuugguaaugagaaguaagacccacacagacuggccagggugcugcuaggagcucaacugaaaaggacucacucugagugcagugaugcuaaaaacucaugucuccuuuggguccuucugcuuaccucauggacagggacaccauuacccaucaucuguccucccaaauauaacauaacguaggugacuuauuugccaugguccuugagcccccucagagaaagcugcucugaaggcaagcuggcucccuucaccacacacagccuccgccccuagagggacaguggaggcaccagagucacauggaucucagcuuuucuucccaacagccuggaccuggcuuacucacauccuugccguagaaguuucuauuuaugaaauacaagggcgauuaaauuggucucacuuuggggauuauuuuuuucuucauuucccuuguuuuccucaccccuaugcccuuggugggauuucuuucuuucuuucauuuuuuuuuuaaagagcaaaacauaaacaaaacacuguccaggcuguggguagcagcucacaauguucuaauuggauucgcacuacaccaguggagcacaucgggaggauccacaggaaacaccuugcagagucugcugggaacgcuggaacagagggagcuaugcacuggcgggggcgcggggguggggguggggggaagggguccugggccuagcugacuccacaggcugggcacaggaaacaggagcaggauucccagcccugggagacacagauggggguggggggcagcuagcucugguguuuuccagugggaagcccuuaaauuugcuuuaucuauuuccaauuauuuagagcuaauugcaguaagaggacugagaguaagagagacagagacagaggcagacggacagagagagauacagagacagagagacagagaagaagaaagaagaacaggagaaaaacugguagcuucuaggcaucuuuuagagauuuagcagccacucuuacugugcgaggugcaugccuuguugaagucaaguauauaaggacuuagggguaaccuaaaacuggggaguugaaucuguauuacaaugucuaugacuggucucuuugucugucugucucugucucugucucugucucugucucucucucucucuguguguguguguguguguguguguguguguguguguguguguguguguguuaaugagaauucaaucuagaaccuugcccaugcuaggcaaauucuuuaccauugagcuguaucuccagcucuuuaaaaaaaaauucauuucaagaccagguccugucauacagccucaacuggccuugaacuuauauucugccugcuuccacuucccaaguagcuaugacuauguaucaucucucaggcaaucuaucuuacccuuugaauacuuaaaauggagaagaugggaggagcaggugcagagaucaacaaccagacauuaaugugaagagagucuaaauuggaguucuccaucagguuccucccccccagggaucagauaacccaugaagagggaagaaaagacuguaggagucagaguguggagaacacaggggaaaauaucagggcuuguaugggcucacaaaaacugaaguaccaaacacuagguccucauagaucuuccccagguccucuguguauguaauggcuguuagcuuagugguuuugugggacuuguaauugugggaguggauacaucucugacccuucugccuguuuggggaacucuuuuccucccguuagauugccuuguccaacuuccauagaaggccaugugccuugucuuauuguaucuuguuuuguccuguuuggcucuuggagguuugcuccuuucugaagaguaaugggggaggggggucugggagaaaaagggagauggagcgaggauggggagacaggggagcugagagggguggagggaggggcgacugugguugggauguacuguaugagagaagaaucuauuuucaauugaaaaaagaaaauuaaagaaagacaauggagaugcaaaaucacaccacauaggggugugaguacugagauauaggucauaagggagacagcagcauuaauuacuuuggaagaagcuuccuucccaaggccaugcagaagcuagagaagcaguaagcaagugaaccaauacauucuaagaaaagagaaaagaaaauggagagagcuagcucagccccauaugggcauugcaggcucacagccuggcugccaacuuucccccucauggaauggcggcugccccacuuacucuuggccagcacauuuugauuucaggucagguagaagcucgggacauuggcugguaucuguccaaguggacaguguagaaaagcccagcaagagaagggagaggaaacauggauacaaaugcuaacuugugauugaagucuuccagguggcaucuugcuccuuccugggaguggggagcauuuggauggauccaaaauaguauguuagugcgugugcuuagccuuuccaaaaaccugccuuccaacaacauugugugugggugugggaagccaaucuugauaauacaaaguuagguuugagagccauagcuuggcaggccugcuugggccagggucaguggccagagccaggcauuguucuggcuggaggaaggaacagccaguggccagcauucugugggaggugaaggccagacccagaccaauuagggucugauggaaagcaggaccacucuuuaugaaucaggaggccagugcccuugcugcuaugaagaugcuggcuaacgggagcaucuggcaccagucaucucccaggaugagaagcaagccugcauagaggugcaagugaaaagcugaaggccugagggcugggcuguaccccaaccccacuuuaucuuagucauaaugggagcuggcugagcaaaaaggggacauguuucuuugcuuggucgacagguugguaacaauuacaggcacucuugaggaagcaacaggaaaagucaugcucugcaccaccaggcauggucaugaaaggaugcucagaucaaagguagcaccaauuuaguguucaaucuaguuccugccucuugugcuuaagccuggggucagcuguguggcuagacagaccucuaaguguugccuagcugaauuuagcagauccuauuuugucccugucccauuucagcaauauacuuggagagguagacugggugacaugugacuugacagguuucaggcaagucuaagucuauuauaagaagggaauugauagucuucuucagcccucaaggauaccccuggagcagugggaaaguaaagaccaguugccccugagaugcuguuuuuauccuuccugaccccaaggggaauggacaagugugaauuucuucaagggaccgacuucuucaggauguucaaugucacucagggcuggcaccacuccccucugcuaaagccagcacugaaccuaguauucaggugcaccgaacacgaagaagaaauguguagcaugaagggaggauguuguuucucccagguccagcccaaagagcauggagcagguagaccgcaacucccagauugaagugaggaaaucuugauuuuacugccuggacuucaaaugcuuggugucaccaauggacaagucauuucucaucccugcuuccucagugaauugaggaaugauugaacaaguaguuuuaaaggcuacaaguugaaauguuacugauugugguauagaaaacuccccaagaggaaaagaauuaauuucuggcccuuccucccuaggugcaugcagcuuagcaaguggcaaaugaaugaccucuuucugaugcggcagccaacagguggcagaauaucccagugucugucugggaugucugaaccaucuguuucccaucaacaaagcuugcuggcuggaaggugaucugcccuaaauggcccuguuagaauuccucugcugggguuuuacccaaauuacugaagcacagagcuaagucugagccuggcucuauguccuuccucugcugaggacccaagacaagacacuugauccaucugagucccaacuuaccccaucuauuauuauuucaugcauuucagucagcauuagccuuccaggaaucuucuaagaagugagaucucuacauuccuaggacuuacuaugguagaagagacagaacaagcaaacauaugcccaaaacaauaccagguucuggagggagggcauagagaaugguuggaguagacaaggcuccuccaugaaaaaggagucaagaagacagaggucagaucccauagaaccuucuagaacuuguuaaggaguugagaagccaugggagagcuuugaacaagccauugcuggcacgugacugacauuucaauagcuugcucuggcuccuuuuuggagaauggauuguugggggcuggagugaaagcaaggaaauuaaugaucaucgucucuaccuuuucccuccucgccgucuaaagucacuguaaaccucacaggagauuucuccuaacucccagaaaagcacagaggcauaggcaggguacagauggucacauguuugauaauccguuugugcaaguaggagcuugcagggccuggcaccaggcuagugagagccguguuccuguauggacggauuucaaggaaacaggguacgguggcagacucugcuugccugaugcagcugucccuguccagaugaauccacauauuuaaacagggagcuuugggugaggccgcgccuggcccugcuuuugcugguggugcuggacuggaguaagauaacacccagcaauguggcaagguugaugccaaggagaaaccauuugcugagcgccuggcacaugccugccuccccagcugccccccaccccccgccagagcuaggaagaaaacacagggagcuggagaucagguuagcucggggucugcaguuucagaguccuacccucuauaaaguggccuagaaacccccagcaucccuaagggaguacggcccagaucauggguuccaggcuugucuugucacugggguauggagugcuggccuguagacuggagccuuggauucacaacuguaccuccaggcuccuacaaguggagagagagagagaaugugugucugugacagcagugucuuagagcugucgugcaggaaagggaaacacaguuagaaaagagugcuuggaucacacacucacuuggacaccuccugagugacaggcuggggggcuuaggggcagacaccuuagugcuuaguaaauauuuccagaacccagcacaaucuggaaauuucagaggcaggcggauuucugaauucgaggccagccuggucuacaaagugaguuccaggacagccagggcuauacagagaaacccugucucgaaaaaccgaaaaaaccaaaccaaaacaaaacaaacaaaacaagcaaacaaagaaaaaaauuuguuucaucucucuaaaauacuguauuaccuaaaauuccaaaagacaguaauuaaucaggugaccuguauguaugcacuggcuuaaaucaaacaaaaagauaaggauuuaagucaccuguuaucucugcaacauagauccugagauuacccaacauuuuauaaaauggagugaagguaucuguuuuuccugcuccggucacugguccacacucuccuggccaguuucccagccugccuccuguuuucuugcauugcacagaauccauuugucggugauccguguucuuccaauccgaacacguucauucauaugauccaaccccaagagccuguuuguuggaagguuuuguaaagaucugugauaaacaucuuguauguuaaugucuguguauacucaugaauauccauccauaaauguuuauaggcuugugcacauauuuauguacacuggcaucuuacuugauuguuuuaccuggaccuagaagcuaucucccaucuuuaaacacaucauuuaguaguccccgaaucgaagucagugggucuuuggcucacaucagcugaugccccugccugggauucccagguauacuugguccaaucaggggucagaggguucucuguagacaucucagggugccauguagcuaaaagaacauuugacacagcuccucagaucccauaagcucacacuugcuuccaaagucccccuaccugcagccucugucucucucccacagaggccagcuggugacaagccugaaggaaagccuguuugucuguuugcuauuccuuguggaucuugcaagacccccuugguuauuucaaaguuggaggcaaugucccggacagauuagaggccaccaggagccuauucacuuaggucacaaagucacagcaugaggccaccuucccaaacaaaguuccuuucugccuuccugauccucucggcucauaaaaaccucugccuguagugggcaguuuuaguaugcugagugcacaggaaacaucccuuucagagagaaggcaagcugcccucucuucucuuugcucaaucacaaaggcgacugccugaaacauugguccuuaagugggaaugggggaaauggaugugggugucucuugugaagagggccaugcuaauacucuauucagccgaugaaagcagaccuucuguccugaccaaucugaacucagcuauuccuaagaauauucguauuauaauacaugcuguguauuguguaauacacauguauauaugcaucuauccugcauuuuaaagaucaguuuccccagcuugugauucccagguaugcuugcucuaaucaggggucuagugauggcugagauaaggugaguucuugauccagcacaaagcugucuugcaauggugcccuuucugcuuacucccccuacacacccaacugcuuaauuuaagcugcucaacaacacacacacacacacacacacacacacauacaucuauauauaugacagugaccuucaccuguacagguguagagguaggacucuuggaguggagugaauugcccaagaugccagugacaguggaggaggagggggaaugggauucuauaaggaccaagucuuuucacucugaguacccucccagcccccagguggccacucacuagcccuuugagagcuugccaaguuuucucuggcccuagccagucaccauacugucugcccagaacccaacccccaagguuccuuauguuuuuugguuuuuuuuuuuuuuugagauacuccccuccuccaccagcugccccuccuggcagguguucacucuuccccaggacuaccccccucuaggccugggcuagcuuuagaccaguccgcuggacucuggauacuucuagacuuagacagggagggcacucaaaagcccgauuucccugacagucuuuuggcaaacucauagucacagagcuggcccauuuaggagagaagcagaggcaaccugcccgucagcccgcccgcaccccuccaacccuauaggaacauuccauuuggaaaucucuuguggcagguaccucagagaaagccacacagacuccaggucuacagaguaaucauggcucucaggaaacacaaaaucugagaggcccccgggauccucaagaguaccccaagaagaagcaggcugugcuggcuuccacugaccauggagcccucuacccaugugcaaaggaucuacggagcaaacuucccaucuauuguucuuuuaucugauuguaaaaaggacaugucacagcugugaaaugucauuuucuggaacauacaagccaaaugacagucauccaaaacuacacacccuaugaauuaacagugcugauauucuggaagacagacauccuucuaagcaucuguauauacacacuccugccuuuuauuaauauaaaaaaacaagguacuauuacucaaaauuggcccaagggcccauguaccaagguacuauuacucaaagguggcccacuauguuaauaauuuuuaauuauaauuuauauacaauauucauaaaacuauguaaaauauuuuaugaauaaguuaauaauauuuaauaacauuauuuaagaaauaucucuguaggagacauuuaggcaucgcccaguaauuucuuuggaccaaaauucuagaaauacaauuauuuguuaaacggcaugcacacuuugggagccccggaugcauaguaccaggaugacuuucccaguggggauaauacuuuucuuagcaguagccugugaaggggagacccauaucuguggauuccccguacagcucugccaaguccaggggcaucaucuggaaauccccgaagcaaucagcaccuguaaugagccaucugcugggaaguaggaagggggugggcagaugggaggggaucuagcuuuuuuuuuuuuccuuuugcuggugcagaagugggcagugaaagauaggacguaucaagagccacuuaaggcucuucuucucuauggauccguaaaagugucucuccgccgacgugggcuggguggugugauaugcuggcaagaggcgcuauauggaauaguugcaaauguccaggaaggaaucuaaccucaggaaacugccuacuucccuccccauguagcuagugaccccaggaaagaguuugccaccucugggcuuguguuucccuugagaauuucuuguuucugugacuucagagccaggccugaucccaaagcacugaaucuuacauucugugcccaccauuugccuguuuuuugaacuugccucuagaaauucuuaaaaucugccuucgcuagggugacgccaagccuucuguaaccucccucgguaccagcaaugcacugagaagacuguaauggccaggaggaagucaaggacacacuucucagaugcagcuucagcucagcauuuauggagggccccggucauggcugccaucucucaccuaccuucccaccagccaauccugaauuagaaacgggacccuuuccuauuuuguugucacuggcagaaccaaggcucagaugcacacguuagucucgugaugauaaaaagcagaguugggguucagucucaacuguccuucauucucaguucaucuuccugcaucccuuagugaaucacuaggcagaacucuucaucauugcuauuauuaaugccuacugugaguacaugugaauugacuuggcggcauuuccauacaugccugcaucugcacugggaagauccugaguucagagcagaaugcuuucuagggcugagauguguugaaaggacauggugccacuuggauuucucggauuggucauaguuagcucaggaacuuugaagcugauuaacaucuugcucccuaaccuuuaucaccuauggaaucagcacugacaaccuuaauuagcaguauuugacuuguccacacaauaaucauacucagcggucaucuuccuucuacugccaagaaccaguaucugugggugugggcuucccauaaguaagcaagacucuggaauucuccaccccagaacaugucccaagcccuggaccucuccugagauucaggugcuccguggcuccuggaaguagccagguucuggugaugcccucugagccuuuuguagugaggcaggagguguauuguggaagcuagaaauuccaggugggaguugagaaaucucaagcugaccuuggagauuuguccccauacaaauaagcaaaucagaccaauugcaaccuguauaucacauaccacaugaaaagaugcuuucggggcccugauuucucugggacuugguggcguguggggaggguagaaucaagcugaugguuuuccuagaaaaccauguggggagagaagagaaauucugcaaaaaauaaucacgguggcccacaguucccuuggaccaugaacagaaguggaaaucaggcagaaagucaaugccuucucucacaaggaagcuuugugugcgcugcauguucggaaaccagaaacuguagaggaagguggccagaccuacaccaaguagggagacagcuugaaccccuaaaagguagggugauaguaauauguucauuaaagacgucagugcuuugccuaugucuggaacguaagaggaguucagaaaaucuucauucauauauuaucagggccuuugacacauacacccagccaaauggguagcaucuggacuagagacagcccccucucauuuaguagucagaagacugacaaugugccaguggcugaggaagaagaugggaaguuagacacagcuucugcacguguagucucacacaggagaccaggcuagggugggggcagaagcccucagcuccugacaagucuggcacgcuguccucuguguguccuaagaugccuccucuuuaagccucuuuccagcucuuuggcugggagaccugcaacaagcacagaggcagcuccuugccuguguaacccagcaccagcccaggaggccaggccucccggugccagcagggaucaucucugcuuuugcucccucacacaguaguggaaaaaagugagaaagcaaaauucccccugagcaaucugaaaccccuuaaccuccugacuaaggaggcaagguucaguucugccuuguccccaguccccucauuuucaccugggucaccuauacucagaccagaggccagccuggggguuauuuauaacccugucagaggaagaggagacaggaaauuaggaauggguaagcggggaagagaaacaucgugccagugacccauuggauuggaaccuacagccuaacugccccgugugucugggccacaugauagggaauuuuuccuccccaguccaggcuaguuucaugugaccuccaaugcuaccugcagcucacuugccucuccccacccuauuucuguucuaugccaucaucaucaucaucauggguuccucugccuagaauggcucagggauuuuugucuucuaacaagguaauguacaggagcuaggggccagccaggaagccuagggccugagagaaggcgaguaggggacccaacucuaggagaguauacaguggacaagcucuccgcuguccccagcuguugucagcucugcccugcuucuuccuucgccuguugaaaaagccagacucagaauggucaacacucaggcgcucaagacuugauacuaacugcauuaagaugccucggaggagagguagcucaggcagaguuacacagcaguggggacagagccaggcuuggagcacugaccccuuuuccaaaccacugugcugccccaugggucccacaaaaauucucagcguauaaacauggauguaaguacucacagguugaaguguccagccuugcugugcucugagccauguucauggcagcugaauccuagcagaccaccucggguucucucagccauugcuuaccaaaacaccagaggcacugcucaaucagcaggcccguucccuucaggauaacuuuggguaaaguuaggcuccuuggagguuguuuuauuuuacuuggggcugcuuaauccucacacaauuauugucuaauucuccaagacaaauguucucaagauuauaaauguccuuaggaaagaaacacagaucaacuuaagccuucauacagcucaggaacucuugucugcgccuguccucacuaccuacccagaugaccuacaagaaauguuggauuucuaccccaaaggccgccuccacuccucugagccagacagagaggcagcuucaggaaggguccuagagcuacagagccugcaccaggucugaugggacacuaggaagcuacaaggaacuggauucugcaaacugcucuuagaacagcaaaagucuuuggagaagcagggagaaaccuuacugugcagcccaggguagccuguaacucacuguguagcucaggcuagaaccuagaauucaugguccuccugccucuuccuccugagugcuaggauugcaggugugugccaccacuaaaaccccaaaguuuugaugaccccaggaagccguucucauguuuucaaccuugaaggguaauuggaggcauagcagaaucaagggccaaagcacacugaacaugucuugccuggugucugaacuauaagcuguuaagaaaaaaauuuaaguaguugauauaaugacaacuaaaguugguaaaugaaguugguuagcaaagugcucuggccuucauggaacucagauaagccugggcagaaguucuuuguacacagagcaccaucuuccuggcaccauacccguacaaugacuccaguucaguauuugaguguuccuguaguucacccacauuuauugagcagcuacuaagugugauggccuguggucaggagcaccaagcgauuuccaggcagcagggcuauucuuagcuuucugaugucuauuuaaggaguguuaauccaucccaccucccccucugcaauuagacacauaccuccuuccaaccuuauaugcugagcucacccaacugccccagcugugcaggcaggauagacaagugugcuucccacucugcugggcuuggcucagcauuuaggcuuccugagccuggguagcuugggaauuggccaagccuggugagaaguguuugcuuugccuggacccuucaagaaguuuuggaggucagaauuccccaccuguuuuucucaacccuagagcacaguggggcagaaaaugugugaaccaagaacaggguagccugaguaugggagucgguagcuaaggguucagucugugggguagaccuccccauucagacauccacacccagccuugcaaucuagacagacaugugacaucauccaaccuagacaaugugaugucaucagagcccaucuccaccucucaugaguauauccaaauguaaaagccaagguugaccugugagccucacuugcccaaggacaagauaacuuccuggaaugcugggagcugcgguucuuggaaauaacaagccacguguuuucacucccauaagcaaguuugaaccgacuagaucagaugugcuugacuagauguaagcaggcuauacaucaggacauaggcuugauccugauugaaccugaugggaaauacagugaauuauggguuuuuccuuuuuaagcuucugugaaacaugacuuguggacauucccugggaacccaggaauaguccuggucaaggcccaucuuccucgcuguuauuuaauuaaagcuugcuuuaaauuuggcuccaaguuguggaacugguuuuuccucucaccauuuucagaacuaacaaaaguaccuagcaagccccuuccagccucaguauucccaccuaaaaagugggacaacgaugacaacaauauuaguuccaaacacguaagcuuauagccaauaauagaauuuccaugcauaaaaauauaaaguuauuaggacagcuguagccuugauacuuaacucuucuggaugucaauguucuaauaauaagaguuagaagugauaagguaugaguauauguuggccuauaauauuaauaauaauaacacauuaauaauauuaauauauuaauauugucaaauauuauucuuauuccagguguaucucuaaagccaaauugcuccaccucuguugaccuaguuuccuguuagucaaaugagaaaacugagucagauagcuuguacaaggucacccaggacaugagcuucccgccugggacuuucacguccugaagucucuucuggccaaauugagccaguagcuucugagcuuugguuagcaaaaaaugcauccccaucuuucccacacccugcaggcaagcugcuaaauacggaggguagugagaaaagaugccucauauucaaacgggauuuuggcuuguacucuccuuagcggcaugacauggcagcccuuaacaauggguggaugguaggauaacuggaaugcagccgcauauaacugacaugcacugacugugaaaacacacaaugcauuuuaaaaccuucacugcaaaacuggaaaaaugucaaaaguaauuuaaaauugauuacauggcaaaaugaucauacuuugaauacauuaguuaagcauagcguuaacuuagcauuaguuacguauggcauuaacuuagcauuaguuaaguauagcauuaacucuugcuuguuccuuuuauaaagugaccacuaugagaaaauuuuuaacggagugggagguuccccgugcuccuuccucggauggugcaggacgaggaguucuuccugcuugggaacuucucacagugagacucaaaggaaugugaacuauuuaggguuaaauuuuaaaacaaaauaggaagucaggugaggcauuaaguuuuaggaguguguggcaucuccagccuggauauguaaaaccuguuaaucugccaaaccaucccuugguguucuuuaccaccucagcaccugagcuccaauggucacugugguuuucauccauccugugugugugucugugugugugugacuguguguaccugcaugugaauguguguaugugugugggucuguaugugucuguauguguguggagggcuguauguauauguguguguauguguguuuguguauaugugccuguguguauauguauguguauaugugugugugaauguguguuuguguguguauguuguguauauguauguguauguguguauauguguguguuuguauauguaugucugcauauguguauguauauuuguguguuuguguguguuuguguguguauguauauguauguguguauaugcauguauguguauuugugcauuuguguguguguguguguguguguguguguguguguguguguguguguguuugaaggccaaaaguaaauguuggauaucuuccucauucgcucccuaccuuauuuuuugagacaaguucucuuacucaaccuggaacucagagguuagucuacacuggcugaucagcaagccuuggacauucuuuuguacucugcaucaggucuacgguuuuagaaucagaccauaauaccguuuuuuguuuguuuguuuuuaaugugggugcuggaaucugugcuuucaagcacuuuucugacugagccauuucccagccucuuucgcuguguuuuccaaguugaucacugcucuuuaauacagcagcuguuucucacugagcugcauggcaaaaccugauacuaucucuuuuucccaccacucccaagcugaggacacugcugccuagaaggacuggaugcugccuuuuucaaacauccccucauucauucacaaugacuuuacuaugugcacacuaacaucagaccagugaguaagacccaguucccauauaagggaggcaauaagacuaugucguaaucacgaggguugguauuuaccaagcccuuacuacaggcuaagcagcgagccaagacggcuguuuccaugaucucagugaauucccuccacagcccugugaagcgaacggucuucuuauacaugcaggguaacagagaggaaaagcaagaaugagauaggcuggcuugcccaagacauguaaccagcaaguaauaaagucaagaucugaggcaagcugguuaacaucacaaccuguauucuucaccagcucagaaacugggaaggacaugguaccaagaauguaggcugugaggaaaucauuuugcuucaaaagagccacuggccauauucauucugagaucugaggacuuaaagguuacucaagaggucaccagauacaaggucacaagaaaccuguaaccuacacagcugaaucaguguaugcuugugugugugugugugugugugugugugugugugugugugugugugugugugugauuuuacauuguaguaacacuuaaaaacuaaaguuucacccuagcacguugggguuuccagcuuauuauaagaaccuaaacaucuggccacacuguccccuuaccaaaggacauggauuuuccaguucaucacaguugccaccaguucuauugccucccugauaucaaggagaagaggagguacucaaagccaccacguagauauuuggggacaaauguggcaaacaagagacuggagacccuuauauguuuagcugauaguaguaauagucucacgugcuugauauuacaauaacccucccuuucuggcuagacaaugucagcaucagauuugugcccugaacuaauuaauuacaaagaaacccaagcuggaagauaaugagucaaaggggaucuggagcccacagccaccugcccacaagaggcauaguccccaucaugucuaucuauccagaucuguaucccaggcagcccuuuggguguugagcuucucacaaaucucaggccuuugggugucuguuuguccuuauuggagaggaaaguggagugggcuugcucagugaucacauguuugaccugaaacuuccagacuuucucucuuggaguaaacagacucguaugaaauaauaucacuuuuaauuagaggucuacaucuaagcuggucuuccagugggaaagucuuuucugcagcuuagaaggcuuccuaccaaacuguccagcagucagugacagacccugaagcgaccuugauuccgaauucuggccuuaagcuaagucugcaaggcugcugucuacagguaaaccagaugugauccaacaggaaguccgguggucccauagaucauugagcucagcucauuagauguguuuggguagaauccucacuauguucacagccacagagauccugaucugaucuuagcaggccauauuucuaaugaagcuuccuucaaagaguguuauuggcggcacuagguguuccauccugagcucugcuagauagcccuccccaaggaaaccugacccagaauacugacccaucguaauaaguaacauccaugcacaaaagaguagacacacacagucaguccuucacuuguccagaugagagaucaauuccuggggaggaucauaccaccaagguaauuccagagucagaugauaaacuugaggcagaccucagaucucauaacuggagaccagugaucucgucacaucaacacacaggaagcacgggcucucuagucccaagcuggguggagacaggaggaacugauuuguuauccaaguuuaauaucaccagcuucuagaacacucccuucagcuacucuaguaucuccacuucuuuccaccuaucagaaggaaaugugcuuagaagagucuaaauggggaagggcaaccccuaauccaugaauaccacuggacuuggucuucagaaggcaugggaucuacucuacagugaagcuacccagccauaccaccaauaucaguauugauagcuacccaaccacacauaccguaucaguauugauagccaucaagugggaacagugacccucccaccacccugcuuuuuuuuuuaaugugcauacuuagccaagcagcuuagcucaugaaaccuuaccaucacacuuucccccuugucacuuccccuugcccuagccugggucucacaaggaccugauauccgaauccaacagacuucucuucagguagccagguugccugccugggacaagcauuccugggaggacagaagcugugcagaaguuggggugaagagacuaacuaccuugugauguugaagaucugugcuucuagagcuugcucugcucaaggcucccccucucuacccuugcccugaauccccacaccuucacccccucaucccaucaucccagagcuauuagucacuggcugaacuuuaccguggcucucugaagccaaaccauuuucuucuccuucacccuuucuucugccagguggcacagaccuaguacuacuggaagucccuagugucccagaugugaaugacacggguaggugauaagaaauaugugacauuaaaucagaccugcaugucgggcagugcugugcaguggagacuacuccuuugguggcagccaggcugucucagucgcacagaagacuucuccaggccccucugcaucuccagacacacuucauuaaguaaaugagccaaagacccauuggucccaccacaguucggagacaucuuguggccuccugcuauaugcuaauuagcuagacccaagcuuagucuauuaugcugaugguguuucaaccugcuacacccaggccacauccucaaaggguauccaacacaaugggacccaggaacuucuugcuucuccacuaguccuggacacaucagguauaaugucagcgaagugacaagguccaugaccuuacuuagagaucuauacacucuucuaacacuucaguaggcucaggagagucccaagcguccuuugggcugcaaucaauuagcauggcagccaauauguccaacuugaaccugcuagcauuguggcaauuuucuguuuuaaacuguuuguuuauaggacugggaauagauacuccacacaugaagcugugaagcaauauccacugauggagaaguggauuuuaaaauauuuuucaguaucaagaaggauggauucaauaagggugaagauagagaucuaggcuagaaaucauggauuuuucguguggcuugguuccauuaagaacuccaaauaacuaacacuauaaugaaauugaggacagcagggaccagagaggcugucaaagggaauggccccagagcguuccaacagugugagucagagaccaaugugccaaaguugcacauuguugcaaaagaaggaggaccuucccuguucuagagagcugcguuucuuagucuccaggagaagagacccuaaaucuacaggagagaaugauccugaacacagucuuuggcgauauagcuucaggcugggcuguuucuugucugauguuaggcaggaaguuuuccuuuuucaaccugaggcuacugaguggguagcacaugagaaggaaugccucaucuuuacacaagugaggagcucagcccauggccguugugauaguaauugcaaccucaaugauaggucugauuaggaagaugcuguuguguuuguuccacuguaugguggggcuagaauuaucacauaagcagagaacaaaacaggugccucagcaggcuugugguucuggcuuugggaugaugcccucugggcaggccucauggaauuucagaggaguugacuuuuaguagaaaugguguccuacagauagcagaaaacaggaccaagugagacccagaaaaugagaaguucaugaggauguaugaugggaggaccuagcaugcaugggucaagagccggcagaaaacaggaucaccaggaaagcaggaaagaccaaugaagagaugggcagggcccauuaucaguccuuacaaaagccauuuuauuauaacuuuaccccauuaacccacugaagacuucuagucaggauggugggaucauuucuuaaagcagguuuccuaaugucaagaccccagagucuuucucugccaggcccacucugucucagcuauuuaccgccguccuugcagccauuuuauuuuuccauccaagcacuauccagaugagcaaucacugcaggaaggaacaaaggcaucagucuucuugcugucacccugagcccaacuaggggcacaaaagccuaugucccaguuucacacaugcacuuuugaaccugaguucaugcaaaaaccaaaguccaaacaaguuuccaguaaugaaaagcgcccuacguauuauaaaagcaaaagccuacagccaucucuaacuaaaguagcccagccacaagucaagagcuguggcuguccuaccacuuaagaccuucucuugguaugaaagugaucccauuaacuuggccuaaguggccuuaauuuuguucccuuucaaaaagauaaaaaggcugaccaaaagcagaagucgucagaauaccaaggaaaugucuaaaauuguuuuccauuugagagaagccugaauguaucugcagcacaacacugugcuauugccuccaucucccauccucugauugcaaaccuaaaaaggacagagucaacaugcagcucuggcgguggacugcagcaaagcugaaaauacaguguccuuccuucccaccaauacuuccaaauguacgcuugccauagaggcuucuccacgcacagcagcaaaagauaauauagugaccauguguucuagcacucuuaggaaggugaaaguuguuagaagcauagcuauccauaaauaggagauaucuaaauaaagugaugguagaucuaaaugaauauuauauugucauaguaauaucaccacauauagcacuauaaauguuauauagucuagcuggagacaccagagaggugggauacauggguguaaauacuagucucugcuacuuaccagguauagcacugaacaacuuacugaauuuuucugagcugcagcuuuuuucagugaagaugauaauaguacaucugccucguaggacuguugagagacuugaaugaacuaaugcauauuaauuauuuggaaugaugccuagcacacaguaaucauucuaucuuaaaacucagcauuggguuuuaaaaaaauuaucaucccauggaauacuaaggagagcaagacuacaauuacccacauguauauguauaucacucccugguauacaugauugaacagaaacgacaccaaggucacuccaguauucagucuucuaacuuuacaacuuucuaaugaagcaaaacuucugggaauguuccucggauaaugauguaaggaugcagauggagaauagaaagaaguaguauugauugaagcagcgauccaaagcgacuugcucuuucuuugauuuuguagagguggguagaugaagagauagggagguacauguauaaauggauggguggauggguggguggauggauggauggauggauagauagauagauagauagauagauagauagauagauagauagauagauagguagguagauagauaggauaaaugauacauaaacauaaaauaacacaucacuguaaaacuuuaagcuuaaaggcaugaauaaaaaaaggucugaaaguacaaauuacuguguccuuucaucacgaggagaguaaaggcugaaaggacccaauaaaagccuaaacacaaagccaacaagaugcugggguuggggaggggggaggaucugagcccagcugugcccuguccagggcucuuccaccaucccacauggccucuagagaccacccaagagcugaaugugacaaaagugguuagaaggggccuucguguccacauagcacaggcuaaaguguuaaaagccaaaggggacuggaaugguuuuuguuuuucauuaaugaaccuguuggaaugugccagucagcagcugagcucaauggcuccugcugugccagcaaagccacuucccagcccuguucuagucuugucugucaggggacugggaaagggacagaucagucagaggggcaccuucuacacccacgaggaccccagucugcagacuuccuuccugccucaugcuccacucauccaccucccacucagcacuggcagguggauccccugggaauccugucuccuacagucauccugcaaguuuggauucuaucagccuugcuguucgcuggucuuagugacacacaauuaguuucacucugaccuaauaauuuugagagucuuuucugguuuuaguagcuaaagaacauagggaauuuccuuuuuuuuuuuuuaauguuguuccguuauaaaacuauaaucaauucuuccuccguaaacaggauacuuaauuaaaacugcuggccccuuuagcugccuucaaagguuggaggaaagcuuuucuaaucuagaugaaaaugccaucugucccuuucauuuggauuccaggugcaggugccugccuuaggaugucagaagucagugcaagaugucagagguuagugaaaggucucaucaugaagacugaaugcaugccuggccacuacuggguggccuugcaugaucucauucagccucaguauuucccaucugagaaaugggugcaauaccacuuaagguugcuggggaguuaagauaguaccucuaacaugcuugcacacccaugcaagucugaaugcauccgucccuucuuuccucuugccuaacagcagucuuccucuggccaggauucucgagauacuauuagcauugguacacauggacaugcacacaugcacguacacgcacaccaccauccccacuaggugguugucaauucuccaaaguuccauaauuucauuuucuuugugucugucugccuguaggagugagagggcauaggucacguuugucuacaaauggcuucuuugcuaaaaccacuucagaucugaugcugaaggaacacgccccuggcaguggucccugucaaaacaacucaaugauaucagggcuauucuccaagguugucagcugcuccucccagacccagggcugacaccucuccacucccaccaaugccacugccuaauuacuccuugugaauggagacagagagaaggggguuuucucuacuacucccaccucugccaaaaccacacacacacacacacacacacacacacacacacacacacacacacacacacacacacaccaccccacuccaguuuucagaaugcucugaacauuucccauccuuccugaacuaagguggccagaacaaagucugccuggccaagccugccucuuucauucccagugcccuccccgcugcuucuucagucaagguuuugaaggaggagcaaggacuggaaggagaaggccccaggugaggcgacugcugccaagucucuuucuuugccccacaguguaucugauaagcgucuguguaguuuauucuucuaaacacuuuaauaggguacagggccugcaguugccauagaaacaccuuuuaacuccuccucauccagaagguugugccagucccauggguuuuggagaaaaaaaagagaaaagagacacccguggauaaagaaacagggagagggaaggccauuuugguguggugaugggggcuuaccaggggcccagcuaggcaugcugugcccuugccuggcagcauggcaucuggccagagugagaaugcuugaagguucuggaagaggaaggaggcagacgggcuugagcacacuuuccgagcuccaguuucccgaggacaguugggagccaucuacugguggcaacaggcagggugccugcugcugucaggcggcagcaggucaacaagccagcaggcccacacccacaccucccauuuuuaaaagcauuaucucaucucuugugcagugcaccaaacugaggguuagugagccuggaucccugccagagcaaggaucucucucucucucucucucucucucucucucucucucucucucucucucuguucuggguuuggcauauuucuugguaauuugacuuuguucuaggaagcauauuaagaggaaggaaaaaaaaaagcuguuucuugaauaaacccauagaaauuacaagaaacuuugucagucugacccacaguaggaccccaggagugcccacugggaacacgcucauguugucaaggccgaaaccucuaaucucuagguuagagaugagaacccucucucccuacucacacuaccaaaccaaacugaacacgccucgacccacugugaagcugaaaagagcuuggaccauagacugcacacccagauuccuccaccugcuagcucacaggccagcaccaggcucuaggcugagcaaaagcagacagcaggaacuaguagagaaagucaucggcuacugggaggaaagacuaagaggaaucugggugggggcccuaaugagagaagggagaaaacuuucccagcccuccagcaauccaaaaaaggaugcuugcaagcacuccauaaagccagggguucucccccagggacagagaagggugggugucucugggucccaggaaaccuucaagaagggugacugcagggucacacaaacacccugggcugccaaguggacugaccugaccaccaaaaccaccucccagauuucccccuaggccgacccaccagcagugccucuccaaccuugguuuucuuuccugccaggucaccaccccuccccccgccccccucucaacacaacacacuugcagaguagaaucccucacucaagacccaguggaaauuuuccaucuccuuuaugaccauacuuaaaacacacacacuccauucuuuacugacuccacacuggcuaagggcagccucuugucccaccccugcccagcaaacacacauuggaccugagagcuuuaaggagcuggagaagagaguagccagcuuccacuuccccuggagcccuccaaacacuaauguccccaacacuccucuggauaguggguucuacuucuuaucaagucccucuaaucagcacagucucuuugagaccaucaccacaagcgaugagaccuuuggcagcuuugcucuuuuggugacaaaucugcuuucuccgaugauacucacucucucccuccucacaaacauuccgggggaagaaaaaauauaucuuccugugaauuuucacagcucuaugauaagugauucccccacagucaccucaggccagcuaucaacacucugaugcaguucucccagggaggagggcaaucccacaguuuccgcccccccccuccccguuuuuuuuucaucucccccuccccccuuuuccagccacccaaacuuggcaggcaagaagcuccauuagcacuugccgggagagccugcagcuaggcugaguuucucaaggaaaagaaugaaguucaagggcgcgggagauaagcaaucuuugaagcuaggaguuuucucucucgcaacuccacccgcacagacuacaacuuguaaagugucgucgaggucccagaacuucaguuagcguuccaacuuuucagaaucucucacccuccuucuccagcucuuuucccuucaaggcaauggggaaauuuuucuagauaucaagcaggaccucguucacgcucgcccgccagagaccacuaggccacugguuggguucccucugcagggcaucuccccacacagaguccccgcccagggaaacugagucuuccggagcacuuaccgaugucggaguugcagaaggcauccuggggauggcugggagagcaugugcacgcuuccgcgccccagugcccaaggcuccagcagcucaggagcacgacaagcccaagccagggagucaugguagcuguugugguccgcugcggggacugccgcucuuuucuucaaaguugccgagcgcuagcgcugaugcuacaguccgagcucacucgcuggguuuaaccgggcacugugcacggugggcaacgaugagcuccggggaagugccuuccaaguagcccggcgggacaggacuaaguggccaagggucgcuggaacacgaguccgcggagccaacgaguggccucccggagaaggaucgggaagcggagaagcgggagaagaagauucuuggcgcuggcggcugcccgcugcccacugugagcgagaguccagggcugcagagugauauaggggcgcgaggggacccagccccucgggagcucgggguccgcccccuccgaccaauggcagcgccgcauuaccucaucggcccuccaaaaagggggcggggccggggggcgcggggcgacagggcggagccggcccggaccguucagauccuu

SEQ ID NO: 5682 - RNA, 9661 nt, Mus musculus
cgcuccgucgcugcgucggaccguguacuuugguuccugcccgcuggaggucgguccugguucuaaagcgacccugugaccugucucccugugcgcgugcacuccgcgguacagucucgucugcguauagucgugggaaggaaagaggggcuccagcgucucccugagaggcugagggagcgaggaaccgccgagcccuccuuccccugcucggcgggcccuggcugcagcuagcaggugccccgcucgcuggucgcggggggaggaaguugcggggggcacccgaggcggugucgcgacucagccacccagggucagcggucaggccaucuaaaggcuacccagcccucuaacacugugcccuuuccgucccugccagcucuccaccaugcccgggggcguacccugguccgccuacuugaaaaugcuuuccuccagccuccuggccaugugagccggggcccagguggugcauugguacuaucggccugaccuggugagugcuguagggcgcgugcccauccucggggugagacccucgcguucaguccacuuugcucagucccucuugacuuuuagauuguccccaguguuuggauaacuugugcucucucgcucuuaacacucaagacugugucuaauaguugugagucagccuggucuacagagcaaguuccagggauacacagagaaaccaugucacgggagugagggggaaacacacacacacacacacacacacacacacacacacagcgucaagaaacucaguggaacagaaagugucacgaacuuuccauggaaaugcaguuuugugucucguuucugcaagaguaguugccagcugcacuuuaucgaggaaauaaugccuagaauuugauccugugagguugacuugauucaucucauuacuauugaagaugugcaagcguuguuagcagcagcuaccuguaaguggggagaaagcaacacaaaaccacugucucuaaaauaagugguacuaaggguccuaggccaccucuguuuggcuaguagggaaucuuuacugauagacguagaggccaaaauggcuggcugcuauaggaugcugaaugcuuuccuauuauuuaagggauuuauguccauuaucuaccuugucuuuugcaauuauuccagccaccacuguuaugacugaaagguuuggggagagagcagaagagaggagaccgugguggcugcccaaaguuggcacucagugcugccuuagggagaacagcuaagaugcuuuguuuuagguguccagcauaacucacucauuaggacagcaaaagagacaacuguauucucauaguucuuuaggcugaaccccaggucucauccuaauucaucucuuauugugugccucagcaaaugccacuggguagauauggacaauacacucacauccguccacuucgaucaccacacugugccuacccuagccaagccaccgucaguuucucucuucaguuaagacaguagcuuccugcccaucuucugcccuccacuccugcuuucccugaaacgucucaacagagcuuccaucgcucuuuuuuauccuggagucaggccaugucguucuccucaaaacucaccaguaucuuccugcuuccaaagcaaaagccacggacucuuuaugucccucccauuguccaccaacuaagcuuucuaaccugcugaacacugugucagcuguaccgaugacuuccuugaacugaagacauagucuuugguuugguccucugcccuugugauccuauuagccugaaacaagacuguuuccacauccuccucccuccuccccuccuucccuccucccccucccucucccccucuuccuccccuuccuccuccauguucugaagugacccucugagccaaaagccuguguagaggugcucauuuucuaacaaccagagaaaugcaaucugcagucagaaccacuacucugcuggccauaauaaaacagcaguugucaaggacagggagaaauuggaaacuucauacacuacccuugggaauagaaugucacgcagcugcuuugauauguaacuagucugcuaguuccucaaacagcauauauguuccagcaauucccaguuuaguuuucuccccaacaaacacuaagacaucugucauacuuacuuguuugauucuguacauguuuauaggugggaacaauccagauaccuaaauaccuauggaaaacaugguacaucuuuauaagggaauagcauucagugauccuacaugaaugaacuuugcaaacacuacaugaaaguauugaccaacaaaagaacauaugauauaugaugggcaaauauauauggacagaguuggcuuguggggaccacuugggaauggaauaggaguuucuuuugaagcaguaaaaagauucuacaauuuuauugugauagacucacaguuccaauucuacuguacugaaaaccauuguuuuuguaccuuuguggugcugggaaucaaacucagucauauacauucugcacccauuucccucugccuuucugaaagguagaauuguguguugcucauguaugacuuuuugcacgucacaugauggccacuuugucuuuuggguacauuaacuaccaauaguuauuuccuaugccuggugcauggcagagagugagcaaauauugugggaauggauuuucaaauguugaauucucauuugaaauuauaguugugagucaguuggauuuaucccugugcauccuguaggacuugagauuugccaggacgaucuauucagacagcaagaaauucaguucaaccaggaguccucauaaaaauggccugguacugaguagcaugcacgaggcuuuuguucuuuuuaaagcuuuuuagaucacauugaacuguugucucagaauguggugguauguuuuuuuuuuggggggggggcuuuuuuguuuguuuuuugguguguuguuuuuguuguuuguuguuuuauuuuguuuuuuuguuuuguuuuuguuuguuuuuuuuuuguagacaauaccugaaaucccaccaaagccuggagaacucuaaauggagcuuuugggacugaaagagagacgccacgaaccucauguuucacagcaguagaaacuuaaaaauaacagcugugccaagaauucugugaauaaugucuuaaauauguauuuuaaacuuuauuaaguaaaacuacuucuuaaaacacuuaauuuagggggcucaauggcucagagguuaagagcacugucugcucuuacagagguucugaguucaauucccagcaaccacuuggugguucauaaccaucuaugaguuguacccuguucuggccugcaagcagaaugcuguauacauaacaaaucuuaauauuuuuuuaaagauagucuuacuauacauucuaggcucaccuagaacuugcuauguagaucaggcuggccucuaguucacaggaucuauaggucucuacaaaaaggucuugcuguguguguagcccaugcugacaucaaacuaagaguccuucugcuuccacuucccaaacagugagauuacagguguaaaggaccaugccugguccagugucucuuaagaaccgccuaagagcaucucuagcguuugacuagguaggugacuuucaauaucacaggagaccauuugcaguggcucccucaauuaugauucuucucugaacuugauuauaauggcaaguuguaaauuacauaaaauaaaauaaaaucauuggggguaggggccuggagagauugcucagcaguuaggaacacugacugcucagcaaccacauggaggcucacaaccaucucuaaugagaucugaugcccucuucuggugugucugaaggcagcuaugcuguacuuauauauaaauaaauauuuuuuuaaaaaucagugauaauacuuauagggucuaagauauaacuaaauacugucuguacuaaacuguauaaaaauauuuaaaguucaaguuauuugggauuguguaccuaauggaaauacaacauuggugauuuagcuugucaagauaauuaaacccccaaauuugagaaaguuaaaauugacauuuucuuuguacauagaagcugaguuuaaguaugucccuaaaaauauaauuacuuaacccucagugcaugugacuguagaaugaggccaugaggggggccuaaugcacugugagcauuaaugccaugagagaaaugaaggaaagacacugaagaggcaggggcugggcuauuggaacugaaagcacugaaggccuccacccaaagccugaaaaaggaaggaaggaagaauacuacacacaaggucuucagaacuaauggcacagcuugucaggccuaguuuucaacauaaauaagcuguaggaaaugaacuuguuucaagauuguguccaaccuauaaauauacaaaaguaaacagauuuuuaaagacuuauguguaugaguguauugccuuccuauucauaaaccuagguucuguaagucacagaacugcaucuacacuguaaagauguuuuugugugcccacuguaaugagcaggcuaggacucugaagcggaguuuguuuugagagggucucacuauguaaccuuaucuggccugaacuugccagguagaucagacuggccuucaacuugagaucugcuugccuugcugucaugggcacuaggcacacacacacauauacauacauguagacagacagauguguacaugcaggcaggcaggcaaauaaaaacacaucauuugacagucucucuagucguugaacuggcugugacauacagaucuuuaacccagaggccuguuucccaagugcaccaucaugcucaccuaaaguaaauuuaaaauaaaauuacccuuguaugaaugccuuuaauccuugcacucaggaggcaggcagaucuuucgaguuuuaggccagcuggaguuacauagcauaugagagcauguugcaaaacacuggcugguuacuuuuuauuauaguguagacuuuacugugaggacuucucagucuuaaguucuuuuauaaucuuugaagauauuaaauauucaguuuccccuuccuguacauacaucaccaagucuaggggccacagccacucagauuauguucugaucucuagaagaggaauauuuacauguauuugggauuuguuuagucaaaaccaagagaucugaaacacaccaaaccacaaacaagcuacuuggauuuuuuuuuuuuaaacguuuaaaaagcccaacagacaggaaggaaaauaagucaaguauuagauaauucccaguuuguguuaugaaaauaagcacugaguauuugggaucuuuuuuuauuuuuauacacaugacaagauuuuacaccaauagucaguuaaauaguacaaauuuacauucaggaggaauguuaaaaaaaauucaacuaaaaaaaccacuucuuccugugacccauaaucccaacauuuuacagugcaggggagaaggaggcuuggggaagcauccaaaacaagucucucaaaagaaaugacuucaaaacuucacauucccucuccacacgggauucauagcgagaguauaauuuacaauucauccuucucuguagauuccugugaaaacaaaggucaggcgacauuacaaacuagcagucaacuuuaccguacagaaaaggcucacauucaaacaauuucuacuauuuuguuuguacuugcuuauuggcaagauaauucaaaauccaccaacaagaucaaugccuaaauacaaguaaucaaaacuuuguaacuaccuaaugcuagugagguguagucauuuuuauaccuuuaauccuagcauuugggaggcaagccaggacuaccuagaaaggauaucccaccccccaccucccaaaaaguucaaccaaauguuaccucacagaagcacugggggcaggguaagcaaucugcuugaaaagaucuuguaaacgguuagaaaauaagaaauaaacaccccacccacaaagauuccaaggcugguaucaaaugccaacuucugugucgauuuacuccuuagugacuagauacuagaagucaugcuagacucaugcuaccccaucugcccaucccucucagaccuuuucuguuuccuccucuucuucuucugucccugcauccaucucuucucccucauccugcucugagucuucugcgucuucugaggugucuucaggcucuucuucugguucuuccuccaccuaaaggugacauccacaaccuguaaauggccuccaucuaccucuauuuugaucuaaguguuuaagaucaaaaugggugauuuagcaaguacugcagucaaucugaucugccuuaacagggaaacuagcaagagaggcaaaaggaagaagccaagcugaguggcgguggcgcucgaguucaucccagcacucuguaggcagaggcaggcagauccucgaguucaaggccagccuggucuaaaagugaguuccaggauagccagggcuacacagagacccugugucagggguagcggaugggaaagaaagaagacacaggagauuucuuguuaauuucgcagguggugcuacccuggggggucagccaugcuagaguuaagggcacacaaaccugugcuucagggucaauguuuaaacugaggcgaagcauucuuucuauucuaucuccauacgccuuggugucugguagaagauauccugaccgaaguguugccguuucaaacaaaacuacagcaagauccaugacugucuugucaucuucaucuuccugauagaagguacgcuugguuagcaucggugguaaggcuuacaaagcauuccuuuuaaggccacaagagagcagccccucacugcucaccuuaauccgccgcaacaugucucugaucagugggugucuaggauugauuucgaacguuuucuuuugacuggcauaguaacuguuuacggacaaaaugagcauuagguuaagacaccaauuuuagggucuacaugccuacuguauucuagcuuuaauuacagaaggaaaaaaaagccuccuuugauguggacauagccaugguuaggugaaaaaaugaagaagggacuacuuaaugaugagucaaaguaaucaaguucugcugggugaaugaaguuaugcugguuuaaugucuuguucauccccuuaauaauuuaacuauaccaaugagccacauaguuguggaugccguguaaauauauaaucuccaauaugccuuuaccaguaugggucccuaaaaauucacuuauuuuuaaauuaauuccaauuaaauuuccuguacguucuauacacacccaugcucauuagcaucuuccaaggccagauauaccacacauccaucuagggcuuagggcacugcugagagucaucgaaacaguuugaugcucccaaaggccagaacuacagugucaaugcaguaagugcugaauggucaguaacuuuccugacacugacaguuggguuuuaaauggcguuacaauguuagauagaaaauauacagcaguuuucuuuacguagaaccuaagucuuagaaagccaggcaugguuugccacgccuuuaaccccagcaguagggaaaggcagagauaagagguagaugggucuccguaaguucuaggccagccuggucuacaggguucuaggaaagccagaacucugcagaaacccugucucaaaacaacccaaaacaaaaccaaaccccuagugagucgugauguaaauauggacauuauucguaauuacucuaaagcaaacuaaggaagcucaggaugauucauguagcagaucaagagaauaagagcuggcaucuugguagggacaucccguuucuuacuuuguagagauguccuugcccgucugguaugcuugugccuucaugauccucuccauguugccagaccauccauacugacuggccacaagagcacagggagacucugugaggcgcugcgacaccacagccuuuucuaucuuagaaugagaaacguuagacagaaguaaggaucagcaguaagcagugcuagucaccaucauagagaacagacagaaggacucaggaauccuggagggacacucagucaaucuggauuuucuuucaacuacaaauuuaucuuuaaaccuguaaaaacuuaguacaacaucaguauauagcaacaggaagcuucuuggcagggaugggugccagggucuucagcacagcaaaugagucugucacugagcuacgucuccaggucccugcuguuacacccgagguuacaggugaggcacaugccacugucuacaaucgcuagugguaaugaacaaacugaguauggauuagcaugcugauaauuccuaugugcagacacugaagucugcaaaccccaaauaccuuguccuugagggccuuaucuuucauccaguugagcagagguucaaacuccuucucuguugcuucccgacuuucuuuaguuuucucacucucaucaaacuucaccccuucuuuggcaacauucugaaaccucuucccaucaaacucgggaagagccugaaugcaguauucauccacaggcucugugagauaaaugacuucauagcccuucuucagaagucucucaacaaauggagaagauuccgccuacaagauuaaaagaaguauguguuuucaaguucugccuuggcacauuagcugugugagacaaagacuaaagguaguguccucuggugucugccuaacuaucccagcuacacaauuaacuuauuuccucucccacauuggcuguaugccuccagcucccagggacccuagcagcugcacuucaucuuaccuccuuucugcuugacccagccaugaaguagauuuuguccuguuuuuccuucauucuuuccacauacuggucuaaacuaguaaugucaguugaauggugagaagacuggaaccuaagaaguuuagcaagccguguucgauuugaguggucuucaaucacaccaagcuugauauucgugccgaacuccuuccagaaagugucguuauacuucucaucagcaaucuucuugaucauguccagaguuuuucggacaagcuucuuccuaaucaccuaaagaaaauggaaucugguuaggaagguuuaucucaaaccuuugcuucugagaccaggauagcagcaacugagacagcacaacugccacaccacucagcaagggacaggaagcaccagggcacucccacaucagacuguguuagaauuaacgacaacuguuucuaauauauuccaaugcuagaacucagauauguugacagaaugacuaauauuuucaaauguuuaaaaacaaaaccccaccuagucuucuaaucacuacaauacuggcaaaaagggggcuuauugaaaggccuaguaugugggugacuguggaccagacaacugguagguguguucccuggcuucagcucuguucaaaacgguauuccuuacuauguugggggaauguaucagcucugagacccaauaaucucagaauaaaagaaguuccuuuuugagauaguccuaaguuaggguagccuaaaacugcuaauaaacccucacuuaacuaugaccucauuccuucaagcuauuaagauuauaggcaugcacugaugugu

SEQ ID NO: 5683 - RNA, 9661 nt, Mus musculus
acacaucagugcaugccuauaaucuuaauagcuugaaggaaugaggucauaguuaagugaggguuuauuagcaguuuuaggcuacccuaacuuaggacuaucucaaaaaggaacuucuuuuauucugagauuauugggucucagagcugauacauucccccaacauaguaaggaauaccguuuugaacagagcugaagccagggaacacaccuaccaguugucugguccacagucacccacauacuaggccuuucaauaagcccccuuuuugccaguauuguagugauuagaagacuaggugggguuuuguuuuuaaacauuugaaaauauuagucauucugucaacauaucugaguucuagcauuggaauauauuagaaacaguugucguuaauucuaacacagucugaugugggagugcccuggugcuuccugucccuugcugagugguguggcaguugugcugucucaguugcugcuauccuggucucagaagcaaagguuugagauaaaccuuccuaaccagauuccauuuucuuuaggugauuaggaagaagcuuguccgaaaaacucuggacaugaucaagaagauugcugaugagaaguauaacgacacuuucuggaaggaguucggcacgaauaucaagcuuggugugauugaagaccacucaaaucgaacacggcuugcuaaacuucuuagguuccagucuucucaccauucaacugacauuacuaguuuagaccaguauguggaaagaaugaaggaaaaacaggacaaaaucuacuucauggcugggucaagcagaaaggagguaagaugaagugcagcugcuagggucccugggagcuggaggcauacagccaaugugggagaggaaauaaguuaauuguguagcugggauaguuaggcagacaccagaggacacuaccuuuagucuuugucucacacagcuaaugugccaaggcagaacuugaaaacacauacuucuuuuaaucuuguaggcggaaucuucuccauuuguugagagacuucugaagaagggcuaugaagucauuuaucucacagagccuguggaugaauacugcauucaggcucuucccgaguuugaugggaagagguuucagaauguugccaaagaaggggugaaguuugaugagagugagaaaacuaaagaaagucgggaagcaacagagaaggaguuugaaccucugcucaacuggaugaaagauaaggcccucaaggacaagguauuugggguuugcagacuucagugucugcacauaggaauuaucagcaugcuaauccauacucaguuuguucauuaccacuagcgauuguagacaguggcaugugccucaccuguaaccucggguguaacagcagggaccuggagacguagcucagugacagacucauuugcugugcugaagacccuggcacccaucccugccaagaagcuuccuguugcuauauacugauguuguacuaaguuuuuacagguuuaaagauaaauuuguaguugaaagaaaauccagauugacugagugucccuccaggauuccugaguccuucugucuguucucuaugauggugacuagcacugcuuacugcugauccuuacuucugucuaacguuucucauucuaagauagaaaaggcuguggugucgcagcgccucacagagucucccugugcucuuguggccagucaguauggauggucuggcaacauggagaggaucaugaaggcacaagcauaccagacgggcaaggacaucucuacaaaguaagaaacgggaugucccuaccaagaugccagcucuuauucucuugaucugcuacaugaaucauccugagcuuccuuaguuugcuuuagaguaauuacgaauaauguccauauuuacaucacgacucacuagggguuugguuuuguuuuggguuguuuugagacaggguuucugcagaguucuggcuuuccuagaacccuguagaccaggcuggccuagaacuuacggagacccaucuaccucuuaucucugccuuucccuacugcugggguuaaaggcguggcaaaccaugccuggcuuucuaagacuuagguucuacguaaagaaaacugcuguauauuuucuaucuaacauuguaacgccauuuaaaacccaacugucagugucaggaaaguuacugaccauucagcacuuacugcauugacacuguaguucuggccuuugggagcaucaaacuguuucgaugacucucagcagugcccuaagcccuagauggaugugugguauaucuggccuuggaagaugcuaaugagcauggguguguauagaacguacaggaaauuuaauuggaauuaauuuaaaaauaagugaauuuuuagggacccauacugguaaaggcauauuggagauuauauauuuacacggcauccacaacuauguggcucauugguauaguuaaauuauuaaggggaugaacaagacauuaaaccagcauaacuucauucacccagcagaacuugauuacuuugacucaucauuaaguagucccuucuucauuuuuucaccuaaccauggcuauguccacaucaaaggaggcuuuuuuuuccuucuguaauuaaagcuagaauacaguaggcauguagacccuaaaauuggugucuuaaccuaaugcucauuuuguccguaaacaguuacuaugccagucaaaagaaaacguucgaaaucaauccuagacacccacugaucagagacauguugcggcggauuaaggugagcagugaggggcugcucucuuguggccuuaaaaggaaugcuuuguaagccuuaccaccgaugcuaaccaagcguaccuucuaucaggaagaugaagaugacaagacagucauggaucuugcuguaguuuuguuugaaacggcaacacuucggucaggauaucuucuaccagacaccaaggcguauggagauagaauagaaagaaugcuucgccucaguuuaaacauugacccugaagcacagguuugugugcccuuaacucuagcauggcugaccccccaggguagcaccaccugcgaaauuaacaagaaaucuccugugucuucuuucuuucccauccgcuaccccugacacagggucucuguguagcccuggcuauccuggaacucacuuuuagaccaggcuggccuugaacucgaggaucugccugccucugccuacagagugcugggaugaacucgagcgccaccgccacucagcuuggcuucuuccuuuugccucucuugcuaguuucccuguuaaggcagaucagauugacugcaguacuugcuaaaucacccauuuugaucuuaaacacuuagaucaaaauagagguagauggaggccauuuacagguuguggaugucaccuuuagguggaggaagaaccagaagaagagccugaagacaccucagaagacgcagaagacucagagcaggaugagggagaagagauggaugcagggacagaagaagaagaggaggaaacagaaaaggucugagagggaugggcagaugggguagcaugagucuagcaugacuucuaguaucuagucacuaaggaguaaaucgacacagaaguuggcauuugauaccagccuuggaaucuuugugggugggguguuuauuucuuauuuucuaaccguuuacaagaucuuuucaagcagauugcuuacccugcccccagugcuucugugagguaacauuugguugaacuuuuugggagguggggggugggauauccuuucuagguaguccuggcuugccucccaaaugcuaggauuaaagguauaaaaaugacuacaccucacuagcauuagguaguuacaaaguuuugauuacuuguauuuaggcauugaucuuguugguggauuuugaauuaucuugccaauaagcaaguacaaacaaaauaguagaaauuguuugaaugugagccuuuucuguacgguaaaguugacugcuaguuuguaaugucgccugaccuuuguuuucacaggaaucuacagagaaggaugaauuguaaauuauacucucgcuaugaaucccguguggagagggaaugugaaguuuugaagucauuucuuuugagagacuuguuuuggaugcuuccccaagccuccuucuccccugcacuguaaaauguugggauuaugggucacaggaagaagugguuuuuuuaguugaauuuuuuuuaacauuccuccugaauguaaauuuguacuauuuaacugacuauugguguaaaaucuugucauguguauaaaaauaaaaaaagaucccaaauacucagugcuuauuuucauaacacaaacugggaauuaucuaauacuugacuuauuuuccuuccugucuguugggcuuuuuaaacguuuaaaaaaaaaaaauccaaguagcuuguuugugguuugguguguuucagaucucuugguuuugacuaaacaaaucccaaauacauguaaauauuccucuucuagagaucagaacauaaucugaguggcuguggccccuagacuuggugauguauguacaggaaggggaaacugaauauuuaauaucuucaaagauuauaaaagaacuuaagacugagaaguccucacaguaaagucuacacuauaauaaaaaguaaccagccaguguuuugcaacaugcucucauaugcuauguaacuccagcuggccuaaaacucgaaagaucugccugccuccugagugcaaggauuaaaggcauucauacaaggguaauuuuauuuuaaauuuacuuuaggugagcaugauggugcacuugggaaacaggccucuggguuaaagaucuguaugucacagccaguucaacgacuagagagacugucaaaugauguguuuuuauuugccugccugccugcauguacacaucugucugucuacauguauguauaugugugugugugccuagugcccaugacagcaaggcaagcagaucucaaguugaaggccagucugaucuaccuggcaaguucaggccagauaagguuacauagugagacccucucaaaacaaacuccgcuucagaguccuagccugcucauuacagugggcacacaaaaacaucuuuacaguguagaugcaguucugugacuuacagaaccuagguuuaugaauaggaaggcaauacacucauacacauaagucuuuaaaaaucuguuuacuuuuguauauuuauagguuggacacaaucuugaaacaaguucauuuccuacagcuuauuuauguugaaaacuaggccugacaagcugugccauuaguucugaagaccuuguguguaguauucuuccuuccuuccuuuuucaggcuuuggguggaggccuucagugcuuucaguuccaauagcccagccccugccucuucagugucuuuccuucauuucucucauggcauuaaugcucacagugcauuaggccccccucauggccucauucuacagucacaugcacugaggguuaaguaauuauauuuuuagggacauacuuaaacucagcuucuauguacaaagaaaaugucaauuuuaacuuucucaaauuuggggguuuaauuaucuugacaagcuaaaucaccaauguuguauuuccauuagguacacaaucccaaauaacuugaacuuuaaauauuuuuauacaguuuaguacagacaguauuuaguuauaucuuagacccuauaaguauuaucacugauuuuuaaaaaaauauuuauuuauauauaaguacagcauagcugccuucagacacaccagaagagggcaucagaucucauuagagaugguugugagccuccaugugguugcugagcagucaguguuccuaacugcugagcaaucucuccaggccccuacccccaaugauuuuauuuuauuuuauguaauuuacaacuugccauuauaaucaaguucagagaagaaucauaauugagggagccacugcaaauggucuccugugauauugaaagucaccuaccuagucaaacgcuagagaugcucuuaggcgguucuuaagagacacuggaccaggcaugguccuuuacaccuguaaucucacuguuugggaaguggaagcagaaggacucuuaguuugaugucagcaugggcuacacacacagcaagaccuuuuuguagagaccuauagauccugugaacuagaggccagccugaucuacauagcaaguucuaggugagccuagaauguauaguaagacuaucuuuaaaaaaauauuaagauuuguuauguauacagcauucugcuugcaggccagaacaggguacaacucauagaugguuaugaaccaccaagugguugcugggaauugaacucagaaccucuguaagagcagacagugcucuuaaccucugagccauugagcccccuaaauuaaguguuuuaagaaguaguuuuacuuaauaaaguuuaaaauacauauuuaagacauuauucacagaauucuuggcacagcuguuauuuuuaaguuucuacugcugugaaacaugagguucguggcgucucucuuucagucccaaaagcuccauuuagaguucuccaggcuuuggugggauuucagguauugucuacaaaaaaaaaacaaacaaaaacaaaacaaaaaaacaaaauaaaacaacaaacaacaaaaacaacacaccaaaaaacaaacaaaaaagccccccccccaaaaaaaaaacauaccaccacauucugagacaacaguucaaugugaucuaaaaagcuuuaaaaagaacaaaagccucgugcaugcuacucaguaccaggccauuuuuaugaggacuccugguugaacugaauuucuugcugucugaauagaucguccuggcaaaucucaaguccuacaggaugcacagggauaaauccaacugacucacaacuauaauuucaaaugagaauucaacauuugaaaauccauucccacaauauuugcucacucucugccaugcaccaggcauaggaaauaacuauugguaguuaauguacccaaaagacaaaguggccaucaugugacgugcaaaaagucauacaugagcaacacacaauucuaccuuucagaaaggcagagggaaaugggugcagaauguauaugacugaguuugauucccagcaccacaaagguacaaaaacaaugguuuucaguacaguagaauuggaacugugagucuaucacaauaaaauuguagaaucuuuuuacugcuucaaaagaaacuccuauuccauucccaagugguccccacaagccaacucuguccauauauauuugcccaucauauaucauauguucuuuuguuggucaauacuuucauguaguguuugcaaaguucauucauguaggaucacugaaugcuauucccuuauaaagauguaccauguuuuccauagguauuuagguaucuggauuguucccaccuauaaacauguacagaaucaaacaaguaaguaugacagaugucuuaguguuuguuggggagaaaacuaaacugggaauugcuggaacauauaugcuguuugaggaacuagcagacuaguuacauaucaaagcagcugcgugacauucuauucccaaggguaguguaugaaguuuccaauuucucccuguccuugacaacugcuguuuuauuauggccagcagaguagugguucugacugcagauugcauuucucugguuguuagaaaaugagcaccucuacacaggcuuuuggcucagagggucacuucagaacauggaggaggaaggggaggaagagggggagagggagggggaggagggaaggaggggaggagggaggaggauguggaaacagucuuguuucaggcuaauaggaucacaagggcagaggaccaaaccaaagacuaugucuucaguucaaggaagucaucgguacagcugacacaguguucagcagguuagaaagcuuaguugguggacaaugggagggacauaaagaguccguggcuuuugcuuuggaagcaggaagauacuggugaguuuugaggagaacgacauggccugacuccaggauaaaaaagagcgauggaagcucuguugagacguuucagggaaagcaggaguggagggcagaagaugggcaggaagcuacugucuuaacugaagagagaaacugacgguggcuuggcuaggguaggcacaguguggugaucgaaguggacggaugugaguguauuguccauaucuacccaguggcauuugcugaggcacacaauaagagaugaauuaggaugagaccugggguucagccuaaagaacuaugagaauacaguugucucuuuugcuguccuaaugagugaguuaugcuggacaccuaaaacaaagcaucuuagcuguucucccuaaggcagcacugagugccaacuuugggcagccaccacggucuccucucuucugcucucuccccaaaccuuucagucauaacagugguggcuggaauaauugcaaaagacaagguagauaauggacauaaaucccuuaaauaauaggaaagcauucagcauccuauagcagccagccauuuuggccucuacgucuaucaguaaagauucccuacuagccaaacagagguggccuaggacccuuaguaccacuuauuuuagagacagugguuuuguguugcuuucuccccacuuacagguagcugcugcuaacaacgcuugcacaucuucaauaguaaugagaugaaucaagucaaccucacaggaucaaauucuaggcauuauuuccucgauaaagugcagcuggcaacuacucuugcagaaacgagacacaaaacugcauuuccauggaaaguucgugacacuuucuguuccacugaguuucuugacgcuguguguguguguguguguguguguguguguguguguuucccccucacucccgugacaugguuucucuguguaucccuggaacuugcucuguagaccaggcugacucacaacuauuagacacagucuugaguguuaagagcgagagagcacaaguuauccaaacacuggggacaaucuaaaagucaagagggacugagcaaaguggacugaacgcgagggucucaccccgaggaugggcacgcgcccuacagcacucaccaggucaggccgauaguaccaaugcaccaccugggccccggcucacauggccaggaggcuggaggaaagcauuuucaaguaggcggaccaggguacgcccccgggcaugguggagagcuggcagggacggaaagggcacaguguuagagggcuggguagccuuuagauggccugaccgcugacccuggguggcugagucgcgacaccgccucgggugccccccgcaacuuccuccccccgcgaccagcgagcggggcaccugcuagcugcagccagggcccgccgagcaggggaaggagggcucggcgguuccucgcucccucagccucucagggagacgcuggagccccucuuuccuucccacgacuauacgcagacgagacuguaccgcggagugcacgcgcacagggagacaggucacagggucgcuuuagaaccaggaccgaccuccagcgggcaggaaccaaaguacacgguccgacgcagcgacggagcg

SEQ ID NO: 5684 - RNA, 15332 nt, Mus musculus
acauauacauacauguagacagacagauguguacaugcaggcaggcaggcaaauaaaaacacaucauuugacagucucucuagucguugaacuggcugugacauacagaucuuuaacccagaggccuguuucccaagugcaccaucaugcucaccuaaaguaaauuuaaaauaaaauuacccuuguaugaaugccuuuaauccuugcacucaggaggcaggcagaucuuucgaguuuuaggccagcuggaguuacauagcauaugagagcauguugcaaaacacuggcugguuacuuuuuauuauaguguagacuuuacugugaggacuucucagucuuaaguucuuuuauaaucuuugaagauauuaaauauucaguuuccccuuccuguacauacaucaccaagucuaggggccacagccacucagauuauguucugaucucuagaagaggaauauuuacauguauuugggauuuguuuagucaaaaccaagagaucugaaacacaccaaaccacaaacaagcuacuuggauuuuuuuuuuuuaaacguuuaaaaagcccaacagacaggaaggaaaauaagucaaguauuagauaauucccaguuuguguuaugaaaauaagcacugaguauuugggaucuuuuuuuauuuuuauacacaugacaagauuuuacaccaauagucaguuaaauaguacaaauuuacauucaggaggaauguuaaaaaaaauucaacuaaaaaaaccacuucuuccugugacccauaaucccaacauuuuacagugcaggggagaaggaggcuuggggaagcauccaaaacaagucucucaaaagaaaugacuucaaaacuucacauucccucuccacacgggauucauagcgagaguauaauuuacaauucauccuucucuguagauuccugugaaaacaaaggucaggcgacauuacaaacuagcagucaacuuuaccguacagaaaaggcucacauucaaacaauuucuacuauuuuguuuguacuugcuuauuggcaagauaauucaaaauccaccaacaagaucaaugccuaaauacaaguaaucaaaacuuuguaacuaccuaaugcuagugagguguagucauuuuuauaccuuuaauccuagcauuugggaggcaagccaggacuaccuagaaaggauaucccaccccccaccucccaaaaaguucaaccaaauguuaccucacagaagcacugggggcaggguaagcaaucugcuugaaaagaucuuguaaacgguuagaaaauaagaaauaaacaccccacccacaaagauuccaaggcugguaucaaaugccaacuucugugucgauuuacuccuuagugacuagauacuagaagucaugcuagacucaugcuaccccaucugcccaucccucucagaccuuuucuguuuccuccucuucuucuucugucccugcauccaucucuucucccucauccugcucugagucuucugcgucuucugaggugucuucaggcucuucuucugguucuuccuccaccuaaaggugacauccacaaccuguaaauggccuccaucuaccucuauuuugaucuaaguguuuaagaucaaaaugggugauuuagcaaguacugcagucaaucugaucugccuuaacagggaaacuagcaagagaggcaaaaggaagaagccaagcugaguggcgguggcgcucgaguucaucccagcacucuguaggcagaggcaggcagauccucgaguucaaggccagccuggucuaaaagugaguuccaggauagccagggcuacacagagacccugugucagggguagcggaugggaaagaaagaagacacaggagauuucuuguuaauuucgcagguggugcuacccuggggggucagccaugcuagaguuaagggcacacaaaccugugcuucagggucaauguuuaaacugaggcgaagcauucuuucuauucuaucuccauacgccuuggugucugguagaagauauccugaccgaaguguugccguuucaaacaaaacuacagcaagauccaugacugucuugucaucuucaucuuccugauagaagguacgcuugguuagcaucggugguaaggcuuacaaagcauuccuuuuaaggccacaagagagcagccccucacugcucaccuuaauccgccgcaacaugucucugaucagugggugucuaggauugauuucgaacguuuucuuuugacuggcauaguaacuguuuacggacaaaaugagcauuagguuaagacaccaauuuuagggucuacaugccuacuguauucuagcuuuaauuacagaaggaaaaaaaagccuccuuugauguggacauagccaugguuaggugaaaaaaugaagaagggacuacuuaaugaugagucaaaguaaucaaguucugcugggugaaugaaguuaugcugguuuaaugucuuguucauccccuuaauaauuuaacuauaccaaugagccacauaguuguggaugccguguaaauauauaaucuccaauaugccuuuaccaguaugggucccuaaaaauucacuuauuuuuaaauuaauuccaauuaaauuuccuguacguucuauacacacccaugcucauuagcaucuuccaaggccagauauaccacacauccaucuagggcuuagggcacugcugagagucaucgaaacaguuugaugcucccaaaggccagaacuacagugucaaugcaguaagugcugaauggucaguaacuuuccugacacugacaguuggguuuuaaauggcguuacaauguuagauagaaaauauacagcaguuuucuuuacguagaaccuaagucuuagaaagccaggcaugguuugccacgccuuuaaccccagcaguagggaaaggcagagauaagagguagaugggucuccguaaguucuaggccagccuggucuacaggguucuaggaaagccagaacucugcagaaacccugucucaaaacaacccaaaacaaaaccaaaccccuagugagucgugauguaaauauggacauuauucguaauuacucuaaagcaaacuaaggaagcucaggaugauucauguagcagaucaagagaauaagagcuggcaucuugguagggacaucccguuucuuacuuuguagagauguccuugcccgucugguaugcuugugccuucaugauccucuccauguugccagaccauccauacugacuggccacaagagcacagggagacucugugaggcgcugcgacaccacagccuuuucuaucuuagaaugagaaacguuagacagaaguaaggaucagcaguaagcagugcuagucaccaucauagagaacagacagaaggacucaggaauccuggagggacacucagucaaucuggauuuucuuucaacuacaaauuuaucuuuaaaccuguaaaaacuuaguacaacaucaguauauagcaacaggaagcuucuuggcagggaugggugccagggucuucagcacagcaaaugagucugucacugagcuacgucuccaggucccugcuguuacacccgagguuacaggugaggcacaugccacugucuacaaucgcuagugguaaugaacaaacugaguauggauuagcaugcugauaauuccuaugugcagacacugaagucugcaaaccccaaauaccuuguccuugagggccuuaucuuucauccaguugagcagagguucaaacuccuucucuguugcuucccgacuuucuuuaguuuucucacucucaucaaacuucaccccuucuuuggcaacauucugaaaccucuucccaucaaacucgggaagagccugaaugcaguauucauccacaggcucugugagauaaaugacuucauagcccuucuucagaagucucucaacaaauggagaagauuccgccuacaagauuaaaagaaguauguguuuucaaguucugccuuggcacauuagcugugugagacaaagacuaaagguaguguccucuggugucugccuaacuaucccagcuacacaauuaacuuauuuccucucccacauuggcuguaugccuccagcucccagggacccuagcagcugcacuucaucuuaccuccuuucugcuugacccagccaugaaguagauuuuguccuguuuuuccuucauucuuuccacauacuggucuaaacuaguaaugucaguugaauggugagaagacuggaaccuaagaaguuuagcaagccguguucgauuugaguggucuucaaucacaccaagcuugauauucgugccgaacuccuuccagaaagugucguuauacuucucaucagcaaucuucuugaucauguccagaguuuuucggacaagcuucuuccuaaucaccuaaagaaaauggaaucugguuaggaagguuuaucucaaaccuuugcuucugagaccaggauagcagcaacugagacagcacaacugccacaccacucagcaagggacaggaagcaccagggcacucccacaucagacuguguuagaauuaacgacaacuguuucuaauauauuccaaugcuagaacucagauauguugacagaaugacuaauauuuucaaauguuuaaaaacaaaaccccaccuagucuucuaaucacuacaauacuggcaaaaagggggcuuauugaaaggccuaguaugugggugacuguggaccagacaacugguagguguguucccuggcuucagcucuguucaaaacgguauuccuuacuauguugggggaauguaucagcucugagacccaauaaucucagaauaaaagaaguuccuuuuugagauaguccuaaguuaggguagccuaaaacugcuaauaaacccucacuuaacuaugaccucauuccuucaagcuauuaagauuauaggcaugcacugauguguccagcagaauuucuuugaauaguucaagacuagcccagcccuccugcacuugcuucaacaucuaguugcuagaacugcuuucuuucugacugugcuugcgcaaacucacaaacacagugugguucaaacccagggucauaagcacagcaaauaaauuugacaccgaguuacaucucuauaguuuccuacucuguuacuccuggguaacaccacucucuaaaauugcuaguaguuacaaagaaagcagguguagaguagcuuacugauaauucugacuccaaccaucgggcagaaagccugacuagaaauucucaccuugagcaauuuauguugcugaagagucucacgggaaacauugagggggagaucaucggaauccaccugcagacagcaaaaugcucacugagcaauaaaaacaagucuguaccaaaaaauacaagacuguugcuccacucccagccacucugacagccacgcguacaaucuucagauacuuacaacaccuuugacaaaauuaagguauuugggcaucauaucauggaagucaucugugaugaauacgcggcguacauacagcugagggggaacgaagagagucacugucugcacaucauacuugaaaauuuugaccuuaguucauaauacuuaaaaaaagcccaucuaccuuaauauaaucacucuucuuagauccauauucaucaaacagaccucgaggugcagauguggguacaaacaaaaucgacuugaaggugaccuccccuucugcagugaaguggauauaagccauggggucaucacuuuccuguggaaagugccuugcuugguuauucaggucacaggaaaagcagcucauaggcacuuuaucacaucaaaacauugaacaaaacaguccauuacaaaaucaaaagaaaagguauuggagauaguacugagaagaaaaaacuaauucuaagugcaaagguuguuuuccacaaggacuaccaguaacaucacugucuacagacagugacaccaaaaccauaccaaguucaauacaucuuuuaucuguacgaaauccugcuuagagaaacagcacuagaagcaagcuuagcucuaguuuuauauauucuuaggagucaaaaaaauuccauagaaacagucaguaauaucuuuaaaauguaacuuacaaugucugaugucaugucaacuuucaaggucacaauaaagcuagucaguaacacauguccuauuuuauguugaaaaccaaaugccuguauguauguacguauguauacgugacaauaaucucaaagguucauuuuaaguuugaaugcgacuuugcuuacuaagucaagaaaugaauuucaaucugauaucacugugccuuccauauucuuggaauagacacgugguugugagaaaauuuucugaaucuuuugacugagaaaaauggggauggucaaucauauuuauagccauauaccauauuuaaaugaacuaauuggcagacaacuguguacaacucauuaauaaccuaaacuagagaacucuuaacacacaacauauucuuuuauuuaccuuugaaaaugauuuguagaaagcuuuguauucgucuucuucuacuucuuuggauggucucugccauauugguuugauaucauucauaaguucccaaucccacacaguuuuuucaaccuaaaguuaaaauaauugguaaguuucuuuuaguuuuuauuuuauuuuuuauuuuuuuuuaaaauaaaugggaguaauuuuacuaggaaaauuagagaaccuacaguuuccaaaaaguuuuuuuuuuaaauuagguauuuuccucguuuacauuuucaaugcuaucccaaaggucccccauaaccaccccccuaauccccuaccaaccaaucccccuuuuuggcccuggcguuccccuguacuagggcauauaaaauuugcaaguccaaugggccucucuuugcagcgauggccgacuaggccaucuuuugauacauaugcagcuaaagacaagaguucccagguacugguuaguucauauuguuguuccaccuauaggguugcaguucccuuuagcuccuuggguaauuucucuagcuccuccauugggggccgugugucccauccaauagcugacugugaucauccacuucuguguuugcuaggccccggcauagucucacaagagagagcuauaucuggguccuuucagcaaaaucuugcuaguguaugcaauggugucagcauuuggaagcugauuaugggauggauuccugcauauggcaaucacuagaugguccauucuuuucuuuuaguuuuuaauaguuaaccuaauauggguccuacuaccaagcauguuuaaaagcaggggucgagguaaguucuagcuauauagcccagacucaucucaaaccuagaagcucuuguccuuagccccucaggugcugggauuacaggauaaaggcaaagccuuccacuuagcagucauggccaguauuuaacaaaaaaguaaaguagccaacaucacagacuuacuaauuuucaaccauacuucucucucugcuacccaaaucaguuaauguucugauaauugaucccaacaugguaaagaggauacagaaagcuucuaagauuuuaagucaagauauaaacaaggcagacuuaaacaauacaaaaagucauaagcuuuguacagaggauuugccacuuagaguauuccaaguuaacgcagggcauacaaaaggccuuguuuuuauuaguagggcuauuuggaaaacuagaaaacguuuuuaaaaaaaugaaggcgccauuucaugggugguagugaaugccuaccagggaggcaggaggacaccagagcuacauuaugagacccgguuucagaaguccaaggaaccauccaaaucauaugacaacacaaccccggccggcccagcccagaaugaugcuucacacgcuccucuaacuccaguuccagagaacccagcaucaucuucuggccuccaugaguaccaagcaugcagcagagcagauaccgaugcuaggaaaacacccacacauacaaaguaaaaacaauuuucuuuaaagaaacuuguggguacuuguggguggagcuucauucucacagacccuaacaguguuacuguagagaagccaggcuuacuuucuuaguuuuugguuucuuuucuucuucuuccuccucuacugcagcuucaucaucagauucuucuuucucuucuuuugcugcuucaucuucuuccaagggcuccucaacagucucugucuguggauggagaaaguacaguuacuguuaggccugccuguuuaaucccgcugcccacaaagacagugcaguaaaguaagaccacacccagucucauccccucugcucacacuacagugccuaacaaagugaugcacagacuuaccuugcuacuccacacguagaugggaaaguugaugaacugagaguacuuccugacaagauuuuuaauuguguccaauucaagguaaucagaugcuucuucuuuuaagacaagacugaaaggaaaacaagccguuuacaacagagcucagacuagauugugucuguuaaaugccuuguaacaucaggcagcagcucuguuaacaucugacauucauagaagaacuccccucuaccagaaagcugugagcuaaaucuacaacacauagggcaggaaaagcaggcucuuuccugugcucccuuaauuagacaacaauauuuugaguuggaaaaaaucugauuacguuagguauuuuccuaucaagguaagcaagcagcaaaauucuaaauucuaaagaaaaauuaucuucacuuucauaguuuuauacugucauucuagaaaucgaaucauuaaguauuucuaaauaaaaacaugcuauuaaagaaaaaccaaaauuaccuugaauuaugaaagccauaaaccacaugacuaugaaacaguucagguaagauggcucauuuaguaaagugcuugcugugcagcaagcagaaaggccugagucugacuccgacacccauguaagaagcugggcauggaggugcuugucauccuacugcaggagcccuguagcucgcuggacagccagacuaaccucaacaaggcccagugcaacccucucucaaaaacagaaaaagguggaaaaguuccacccacaaacaggccuguacacagacagacagacagacagacaucagaccccauagcugcagugccauacccugaguacucaacagauacaugugacugguggcugcuuagcaaugccuauuuucuuacccucaccagccaucaaaaacaagccacgguagggucugcaaacacagcagagucaucaaaaaaguaaaagccucaccaggugaggugcaggccuuuaguccuaccacuugggcaaaagcauagaaucugaguugaaagcgagccagagaaacccuuacaauuuaaacauucuugcuacaaauaggauaugguauaggcuuucaaguugaauaggucucugguugaccuuagugauauggagagcaauggaaaacuggaagcugcuacuuagacaaccuagauagaaaugcagucaucugaaggcacagcagacaaagauguuugccgccaaaccugaagaccagaguuauauucuuaggacccacauagcaggagagaacaggcuuaacagguagcuacaaguugucuuuugaucaccacaccccaacccauaauaaacagaacaaaaaaggcaaucuagauucaugagcauagaaccuauucuuaagcuuagucagguuuuuuguuuuguuuuguuuuguuguuuuuguuuuuuaaauuuagacauacucucauuuauuauccauggcuguuuucaagucaaaauagaauaaggacauuuaacaggccaagucccacaagcugaaguauuuauuagcuggucuaguaagcacauuuucugacuugugaucuaggcuaagaauauaugagaaacagagauggacaugacgccacagcaggaacaguguggggaacagauacugagagucagaacuuuucagaugagauuaucaccaccgaggaaauagguaaagaaaaauuguaaagacaggcaccccacauaggagaggcacugagaaagcuugagagcagcaggagagccaaguuuggggaaucaugaagacaauaaaaaacaugcuacuaggagcaguaguaaucaaaucucucuaaaucaccuggacuuuggcaacaggccgucuggugacuuacacaauacaaagacagcagaugacccaagacaccaacagaagggaagcaaagcaaaagauagacuagccuuucauacuguggguccugcaccaguagagaguaccaagcacgggaugaaacuucauagcacugcugaccuggccuacugucgggccuguagguuauuuaugguugucucuaugcucaucauguagauaacuugucacacugcuccuuaaauaauauaauacuauaaguaccuaagauaugacuuagaacauggggggagcauagguuuuauggaaauacagugcauguuauacaagcaauucuucaacuguggacuggacacagagagugacucuguacuuaaagaugcuucacugcagggaggggagcaugggacccaggcaguggaaaagggccuucacauuauuuauuaccugucuuucuccucuccccaacaaacacuugcacacugaaccuuuucauguugaaaaugugaugugugugggcaaaucugacuuuaaaagccaaggaaaaauuuauucuuagucucugaagugauaaaaucaaucaacagaagcuaaaugauagggugggguuaaggggguggggagguguugaagcaggaacgguaagucagucuuuugauaacuuccccugaaaaugcaggcaucucuuagcagucuuuccugcacaucacucugaaaugauuuuucaaacucuaaagaccuugagccccaugugagagcagggccuauaccgauccuguucuccacuguaaccccaacccacauguagaauucaaaugaguaugggugacucgugaugcaggacuugaaagaaggaaaucuuacccaagcaccuaagcuaugaaacuguccugauacaucugccagucaaaugugaggcucugaggauagcagagcuauuacccagaucaccugcuggguuuuccauuugcuuguucucuucgaccuaccccuaccccaaccuguuacuacucauuacaaauccugacuauuucugucacgucuucuuccagccacuccugcaucaccuucagagcuaauaacagaaaagcagaacuaucagcaacugcagccaacugugcagagucccuuaaacugugaccaugccaggccuuccugccuauuccacaguucucugcauaccuuagccuccuucucagaccuaaaaacccacagagcuaccucuuuuguggucucccaucagcuucucccuugauccucacaguauuaauuuuuguuagaaucaguaauacucacguaauuguuguuccacgaccuaguguguuuccucuugggucagcaauuacagagaauucauuggagucugauucccagaugugcuggguaucauuguuguguuucgaugugacaaugaccuuaucugcuacaaggaaggcagaauaaaaaccgacaccaaacuggccaaucaguucagagguugacugaccaucuucuugagcuucugucauuuuguuuaaaaacucgcuuguuccagauuuggcuauggugccgagauuuuuaaccaacuccucucuagucauuccuacacccgugucugugacaugcagcagguuuuucucuuugucacacuaaaagcaagacaagaaccagacaguuagaucuucuucacauucacaugaugccaaaagccagguuccauauaaagaaauauagaaaccagcuuggaccacaucaacuuuagauagugaugcacuacccuacagucuauguuauggcauuuuucaaaaccauaccuaaaaagcauguuuuuuguauuuuuauauaaauccagcauaaguaaaaaaaaaaaaaaaaaaaaaaaaacaaaacaaaaccugguauaaaugucaaagaacagacacuaacccaaauaacauacuuuugaagauaaaccuuaggaaaccucuuauuucacagaaauuaaaagggauuuugggaucugugauuauuaauguucuucacuaaauaguccuagcugucuucaagaaccugguaggacugugcauccauuuacaggccacaugauuauuucugcccagugaaggugcaaguggaaguugagugugacuuucaggcugagccuuuaauuggugugcgacccuuugcaccauggcaaccagagacacuccagauggcugcucagucagccuguggaacgauuuaagcugaggucuuggcuaccuuuuccuaaagggcuagguaguaucuauuuuuggcuuuaggagccauaaggcccuaucaguaauuacugccacucuagacaaaagaauuuguacuauaaaacuagguacagcuguucacuaauaacccuaaugaaaacaagcaaagucaguuugacucaaggcagucugcacacuuccaugcuaacccacugugacuaggaaguuacuguucacaccagaaugaccuacugcggagugccuggguucccaggauucguuuuaaaaaggaaaguuauuuuaagcuuaccuuaaucuugaccguuaacuccucauuuccagcgagugcauuuucaucaguuagggagaugagccuuaucuugucuaaagcaucagaagcauuugaaaucaguucucucaggaaaaucuaaaaagaagccagauuuaaugaguugcgauugaccccuaagcaugguaagauguugguucuuauccacuccucucaguucuccucggaaucgugaagacacucuucaaggaaccaagccuuuuauggugcaagagauggcuuuacucucuucauaaaaaaggagguguggcucuauaacacuaugugacaacuacaagggauaucugaaguggugggaacaggaauaccucucccacccucccucagggguacaguugugugacuucauccgucgguaggucaugaccuuauucugagcugacacgaaagaccaggacaauguccacucccuuccugccccaauauggaccaauaagaauucucauuccgaauuuaauuccuaauuucuaauggaaggauccaaacugcugucccaaccauguaacacuuaccucuuuauuuuuauacaaagaauugaugauaaguuucaucauccuguucacuucagcuuggaaggcgaacuuuucagauuuuucucuaaguucucuuaucugugaugcguuuaacccauccaacugaauagcuucuuccucucuaaggaaaucaaauuagauaagcaaauacucagcuucauuuuucucagucucuagucaggacacagacuggccucugcagaccuucuuguuaaaagagcacucacauaccagcucacucucaucacagaaugggcugugcuuaaugcucggcuggaaauaguuccuaaaauucccagaaaaauacaucuggcuucccucuacugaaaagcaagucaugacuuguguacgcuugcacagugaacacuuuaguaccgucacuaauuccuagaaggccaaaauugaaaauauaccucaccgauugaaaagcccuuuucuuaaaaguuaaaggcauaaaaguucuauuuuucauaguacuaacuucacacagacaaaaccaaucaaguguccugucaggucuuagaaaguuggaagcacaagcugagugggcuacaucaccacugguuuucugguuuuagaugcugaggcuuaucccuagcacuuuccuuccugaaucagcagucacucccaggagcagacugcuaggagcuuuugccugcagauaaaugggcacuccuaagaucuucucugguuauuuuguaucauuagcaacauuuugggcacuggaccuuguaaucugaauggagaaacaccaacagccacucugccccacuaacuugcagagcuuaucaacauagcuucaaaugcaccgaccucugcacaacuucaucaucuguccuugagccuucucggcuuuuacccagguccucuuccacugugccauccacgucgacuucaucaucagcucugacgaacccuggggagaaagguuacaacucuccacacuauugcuuccucuccuucgcauaaaaagccauaucaacgggggcaagaguuaacacaauucaguaaguaaauacaagcuguugagauggaagaauuauguacugacgucaauaaccaaugucaagguaaguuugcacgcuaaaguuuaaauaugaaugcucaagacccccguugacucuggaaggccaggcagccaucacgugugucuauccuaggcagugagagaggcccccgucuacacccacacguguugcgcacagcugagaggaggucucuacacuggccaagccaaaacuugggccucacuuaguuaucacaggucagaaugcaaacaggguuugugcaacuucuguugaggggaacugaaauccggcccaaaggggaagacaugucaaggacagcucuugaagcacaucggaaucagauauugggccaccgccacgacgcuggcccgagggcccacgcucgcgagucgggcguuagaaaacagaaacgcgcuccgggaguagagggcaggggcuggggguccucaggcucugguggccaaaggucggaccugaucacaaaaguccuuagggagggguuccaggaaggcuucccccgggaguagaguccgagagaccgcgccccgucagcgagacuucggggagcgcucuagcaccauccgcaggguauuuauuuaaaugcccggucuccaagucgccuuuucccagaggccucagggaaagcaucaucacccaagucuccuucgagggaacgagauggucccugaaaccccuguaggccacccggcguccccaacccagguucaacgccccaagaacguucgagaagcggccacacaggaaggggagggcgcccacugccgcccggucacucaccgaaggucagcaggacacagcagaggcccaacacccacaggacccucauggugcguggccggcgagucgcaaguccuuuucggucucaggagccgccuccacccccccaaucccgagucuaagcuccucacaccuccagcagcgcgguccgcccacuaagccgcgcgcaggucgggccgcuuuucaccccacugcuugcgggcgggggacgggaaacacgaacucaccaaucg

SEQ ID NO: 5685 - RNA, 15332 nt, Mus musculus
cgauuggugaguucguguuucccgucccccgcccgcaagcaguggggugaaaagcggcccgaccugcgcgcggcuuagugggcggaccgcgcugcuggaggugugaggagcuuagacucgggauuggggggguggaggcggcuccugagaccgaaaaggacuugcgacucgccggccacgcaccaugaggguccuguggguguugggccucugcuguguccugcugaccuucggugagugaccgggcggcagugggcgcccuccccuuccuguguggccgcuucucgaacguucuuggggcguugaaccuggguuggggacgccggguggccuacagggguuucagggaccaucucguucccucgaaggagacuugggugaugaugcuuucccugaggccucugggaaaaggcgacuuggagaccgggcauuuaaauaaauacccugcggauggugcuagagcgcuccccgaagucucgcugacggggcgcggucucucggacucuacucccgggggaagccuuccuggaaccccucccuaaggacuuuugugaucagguccgaccuuuggccaccagagccugaggacccccagccccugcccucuacucccggagcgcguuucuguuuucuaacgcccgacucgcgagcgugggcccucgggccagcgucguggcgguggcccaauaucugauuccgaugugcuucaagagcuguccuugacaugucuuccccuuugggccggauuucaguuccccucaacagaaguugcacaaacccuguuugcauucugaccugugauaacuaagugaggcccaaguuuuggcuuggccaguguagagaccuccucucagcugugcgcaacacguguggguguagacgggggccucucucacugccuaggauagacacacgugauggcugccuggccuuccagagucaacgggggucuugagcauucauauuuaaacuuuagcgugcaaacuuaccuugacauugguuauugacgucaguacauaauucuuccaucucaacagcuuguauuuacuuacugaauuguguuaacucuugcccccguugauauggcuuuuuaugcgaaggagaggaagcaauaguguggagaguuguaaccuuucuccccaggguucgucagagcugaugaugaagucgacguggauggcacaguggaagaggaccuggguaaaagccgagaaggcucaaggacagaugaugaaguugugcagaggucggugcauuugaagcuauguugauaagcucugcaaguuaguggggcagaguggcuguugguguuucuccauucagauuacaagguccagugcccaaaauguugcuaaugauacaaaauaaccagagaagaucuuaggagugcccauuuaucugcaggcaaaagcuccuagcagucugcuccugggagugacugcugauucaggaaggaaagugcuagggauaagccucagcaucuaaaaccagaaaaccaguggugauguagcccacucagcuugugcuuccaacuuucuaagaccugacaggacacuugauugguuuugucugugugaaguuaguacuaugaaaaauagaacuuuuaugccuuuaacuuuuaagaaaagggcuuuucaaucggugagguauauuuucaauuuuggccuucuaggaauuagugacgguacuaaaguguucacugugcaagcguacacaagucaugacuugcuuuucaguagagggaagccagauguauuuuucugggaauuuuaggaacuauuuccagccgagcauuaagcacagcccauucugugaugagagugagcugguaugugagugcucuuuuaacaagaaggucugcagaggccagucuguguccugacuagagacugagaaaaaugaagcugaguauuugcuuaucuaauuugauuuccuuagagaggaagaagcuauucaguuggauggguuaaacgcaucacagauaagagaacuuagagaaaaaucugaaaaguucgccuuccaagcugaagugaacaggaugaugaaacuuaucaucaauucuuuguauaaaaauaaagagguaaguguuacaugguugggacagcaguuuggauccuuccauuagaaauuaggaauuaaauucggaaugagaauucuuauugguccauauuggggcaggaagggaguggacauuguccuggucuuucgugucagcucagaauaaggucaugaccuaccgacggaugaagucacacaacuguaccccugagggagggugggagagguauuccuguucccaccacuucagauaucccuuguaguugucacauaguguuauagagccacaccuccuuuuuuaugaagagaguaaagccaucucuugcaccauaaaaggcuugguuccuugaagagugucuucacgauuccgaggagaacugagaggaguggauaagaaccaacaucuuaccaugcuuaggggucaaucgcaacucauuaaaucuggcuucuuuuuagauuuuccugagagaacugauuucaaaugcuucugaugcuuuagacaagauaaggcucaucucccuaacugaugaaaaugcacucgcuggaaaugaggaguuaacggucaagauuaagguaagcuuaaaauaacuuuccuuuuuaaaacgaauccugggaacccaggcacuccgcaguaggucauucuggugugaacaguaacuuccuagucacaguggguuagcauggaagugugcagacugccuugagucaaacugacuuugcuuguuuucauuaggguuauuagugaacagcuguaccuaguuuuauaguacaaauucuuuugucuagaguggcaguaauuacugauagggccuuauggcuccuaaagccaaaaauagauacuaccuagcccuuuaggaaaagguagccaagaccucagcuuaaaucguuccacaggcugacugagcagccaucuggagugucucugguugccauggugcaaagggucgcacaccaauuaaaggcucagccugaaagucacacucaacuuccacuugcaccuucacugggcagaaauaaucauguggccuguaaauggaugcacaguccuaccagguucuugaagacagcuaggacuauuuagugaagaacauuaauaaucacagaucccaaaaucccuuuuaauuucugugaaauaagagguuuccuaagguuuaucuucaaaaguauguuauuuggguuagugucuguucuuugacauuuauaccagguuuuguuuuguuuuuuuuuuuuuuuuuuuuuuuuuacuuaugcuggauuuauauaaaaauacaaaaaacaugcuuuuuagguaugguuuugaaaaaugccauaacauagacuguaggguagugcaucacuaucuaaaguugaugugguccaagcugguuucuauauuucuuuauauggaaccuggcuuuuggcaucaugugaaugugaagaagaucuaacugucugguucuugucuugcuuuuagugugacaaagagaaaaaccugcugcaugucacagacacggguguaggaaugacuagagaggaguugguuaaaaaucucggcaccauagccaaaucuggaacaagcgaguuuuuaaacaaaaugacagaagcucaagaagauggucagucaaccucugaacugauuggccaguuuggugucgguuuuuauucugccuuccuuguagcagauaaggucauugucacaucgaaacacaacaaugauacccagcacaucugggaaucagacuccaaugaauucucuguaauugcugacccaagaggaaacacacuaggucguggaacaacaauuacgugaguauuacugauucuaacaaaaauuaauacugugaggaucaagggagaagcugaugggagaccacaaaagagguagcucuguggguuuuuaggucugagaaggaggcuaagguaugcagagaacuguggaauaggcaggaaggccuggcauggucacaguuuaagggacucugcacaguuggcugcaguugcugauaguucugcuuuucuguuauuagcucugaaggugaugcaggaguggcuggaagaagacgugacagaaauagucaggauuuguaaugaguaguaacagguugggguagggguaggucgaagagaacaagcaaauggaaaacccagcaggugaucuggguaauagcucugcuauccucagagccucacauuugacuggcagauguaucaggacaguuucauagcuuaggugcuuggguaagauuuccuucuuucaaguccugcaucacgagucacccauacucauuugaauucuacauguggguugggguuacaguggagaacaggaucgguauaggcccugcucucacauggggcucaaggucuuuagaguuugaaaaaucauuucagagugaugugcaggaaagacugcuaagagaugccugcauuuucaggggaaguuaucaaaagacugacuuaccguuccugcuucaacaccuccccacccccuuaaccccacccuaucauuuagcuucuguugauugauuuuaucacuucagagacuaagaauaaauuuuuccuuggcuuuuaaagucagauuugcccacacacaucacauuuucaacaugaaaagguucagugugcaaguguuuguuggggagaggagaaagacagguaauaaauaaugugaaggcccuuuuccacugccugggucccaugcuccccucccugcagugaagcaucuuuaaguacagagucacucucuguguccaguccacaguugaagaauugcuuguauaacaugcacuguauuuccauaaaaccuaugcuccccccauguucuaagucauaucuuagguacuuauaguauuauauuauuuaaggagcagugugacaaguuaucuacaugaugagcauagagacaaccauaaauaaccuacaggcccgacaguaggccaggucagcagugcuaugaaguuucaucccgugcuugguacucucuacuggugcaggacccacaguaugaaaggcuagucuaucuuuugcuuugcuucccuucuguuggugucuugggucaucugcugucuuuguauuguguaagucaccagacggccuguugccaaaguccaggugauuuagagagauuugauuacuacugcuccuaguagcauguuuuuuauugucuucaugauuccccaaacuuggcucuccugcugcucucaagcuuucucagugccucuccuauguggggugccugucuuuacaauuuuucuuuaccuauuuccucgguggugauaaucucaucugaaaaguucugacucucaguaucuguuccccacacuguuccugcuguggcgucauguccaucucuguuucucauauauucuuagccuagaucacaagucagaaaaugugcuuacuagaccagcuaauaaauacuucagcuugugggacuuggccuguuaaauguccuuauucuauuuugacuugaaaacagccauggauaauaaaugagaguaugucuaaauuuaaaaaacaaaaacaacaaaacaaaacaaaacaaaaaaccugacuaagcuuaagaauagguucuaugcucaugaaucuagauugccuuuuuuguucuguuuauuauggguugggguguggugaucaaaagacaacuuguagcuaccuguuaagccuguucucuccugcuauguggguccuaagaauauaacucuggucuucagguuuggcggcaaacaucuuugucugcugugccuucagaugacugcauuucuaucuagguugucuaaguagcagcuuccaguuuuccauugcucuccauaucacuaaggucaaccagagaccuauucaacuugaaagccuauaccauauccuauuuguagcaagaauguuuaaauuguaaggguuucucuggcucgcuuucaacucagauucuaugcuuuugcccaagugguaggacuaaaggccugcaccucaccuggugaggcuuuuacuuuuuugaugacucugcuguguuugcagacccuaccguggcuuguuuuugauggcuggugaggguaagaaaauaggcauugcuaagcagccaccagucacauguaucuguugaguacucaggguauggcacugcagcuauggggucugaugucugucugucugucugucuguguacaggccuguuuguggguggaacuuuuccaccuuuuucuguuuuugagagaggguugcacugggccuuguugagguuagucuggcuguccagcgagcuacagggcuccugcaguaggaugacaagcaccuccaugcccagcuucuuacaugggugucggagucagacucaggccuuucugcuugcugcacagcaagcacuuuacuaaaugagccaucuuaccugaacuguuucauagucaugugguuuauggcuuucauaauucaagguaauuuugguuuuucuuuaauagcauguuuuuauuuagaaauacuuaaugauucgauuucuagaaugacaguauaaaacuaugaaagugaagauaauuuuucuuuagaauuuagaauuuugcugcuugcuuaccuugauaggaaaauaccuaacguaaucagauuuuuuccaacucaaaauauuguugucuaauuaagggagcacaggaaagagccugcuuuuccugcccuauguguuguagauuuagcucacagcuuucugguagaggggaguucuucuaugaaugucagauguuaacagagcugcugccugauguuacaaggcauuuaacagacacaaucuagucugagcucuguuguaaacggcuuguuuuccuuucagucuugucuuaaaagaagaagcaucugauuaccuugaauuggacacaauuaaaaaucuugucaggaaguacucucaguucaucaacuuucccaucuacguguggaguagcaagguaagucugugcaucacuuuguuaggcacuguagugugagcagaggggaugagacuggguguggucuuacuuuacugcacugucuuugugggcagcgggauuaaacaggcaggccuaacaguaacuguacuuucuccauccacagacagagacuguugaggagcccuuggaagaagaugaagcagcaaaagaagagaaagaagaaucugaugaugaagcugcaguagaggaggaagaagaagaaaagaaaccaaaaacuaagaaaguaagccuggcuucucuacaguaacacuguuagggucugugagaaugaagcuccacccacaaguacccacaaguuucuuuaaagaaaauuguuuuuacuuuguauguguggguguuuuccuagcaucgguaucugcucugcugcaugcuugguacucauggaggccagaagaugaugcuggguucucuggaacuggaguuagaggagcgugugaagcaucauucugggcugggccggccgggguuguguugucauaugauuuggaugguuccuuggacuucugaaaccgggucucauaauguagcucugguguccuccugccucccugguaggcauucacuaccacccaugaaauggcgccuucauuuuuuuaaaaacguuuucuaguuuuccaaauagcccuacuaauaaaaacaaggccuuuuguaugcccugcguuaacuuggaauacucuaaguggcaaauccucuguacaaagcuuaugacuuuuuguauuguuuaagucugccuuguuuauaucuugacuuaaaaucuuagaagcuuucuguauccucuuuaccauguugggaucaauuaucagaacauuaacugauuuggguagcagagagagaaguaugguugaaaauuaguaagucugugauguuggcuacuuuacuuuuuuguuaaauacuggccaugacugcuaaguggaaggcuuugccuuuauccuguaaucccagcaccugaggggcuaaggacaagagcuucuagguuugagaugagucugggcuauauagcuagaacuuaccucgaccccugcuuuuaaacaugcuugguaguaggacccauauuagguuaacuauuaaaaacuaaaagaaaagaauggaccaucuagugauugccauaugcaggaauccaucccauaaucagcuuccaaaugcugacaccauugcauacacuagcaagauuuugcugaaaggacccagauauagcucucucuugugagacuaugccggggccuagcaaacacagaaguggaugaucacagucagcuauuggaugggacacacggcccccaauggaggagcuagagaaauuacccaaggagcuaaagggaacugcaacccuauagguggaacaacaauaugaacuaaccaguaccugggaacucuugucuuuagcugcauauguaucaaaagauggccuagucggccaucgcugcaaagagaggcccauuggacuugcaaauuuuauaugcccuaguacaggggaacgccagggccaaaaagggggauugguugguaggggauuaggggggugguuaugggggaccuuugggauagcauugaaaauguaaacgaggaaaauaccuaauuuaaaaaaaaaacuuuuuggaaacuguagguucucuaauuuuccuaguaaaauuacucccauuuauuuuaaaaaaaaauaaaaaauaaaauaaaaacuaaaagaaacuuaccaauuauuuuaacuuuagguugaaaaaacugugugggauugggaacuuaugaaugauaucaaaccaauauggcagagaccauccaaagaaguagaagaagacgaauacaaagcuuucuacaaaucauuuucaaagguaaauaaaagaauauguuguguguuaagaguucucuaguuuagguuauuaaugaguuguacacaguugucugccaauuaguucauuuaaauaugguauauggcuauaaauaugauugaccauccccauuuuucucagucaaaagauucagaaaauuuucucacaaccacgugucuauuccaagaauauggaaggcacagugauaucagauugaaauucauuucuugacuuaguaagcaaagucgcauucaaacuuaaaaugaaccuuugagauuauugucacguauacauacguacauacauacaggcauuugguuuucaacauaaaauaggacauguguuacugacuagcuuuauugugaccuugaaaguugacaugacaucagacauuguaaguuacauuuuaaagauauuacugacuguuucuauggaauuuuuuugacuccuaagaauauauaaaacuagagcuaagcuugcuucuagugcuguuucucuaagcaggauuucguacagauaaaagauguauugaacuugguaugguuuuggugucacugucuguagacagugauguuacugguaguccuuguggaaaacaaccuuugcacuuagaauuaguuuuuucuucucaguacuaucuccaauaccuuuucuuuugauuuuguaauggacuguuuuguucaauguuuugaugugauaaagugccuaugagcugcuuuuccugugaccugaauaaccaagcaaggcacuuuccacaggaaagugaugaccccauggcuuauauccacuucacugcagaaggggaggucaccuucaagucgauuuuguuuguacccacaucugcaccucgaggucuguuugaugaauauggaucuaagaagagugauuauauuaagguagaugggcuuuuuuuaaguauuaugaacuaaggucaaaauuuucaaguaugaugugcagacagugacucucuucguucccccucagcuguauguacgccgcguauucaucacagaugacuuccaugauaugaugcccaaauaccuuaauuuugucaaagguguuguaaguaucugaagauuguacgcguggcugucagaguggcugggaguggagcaacagucuuguauuuuuugguacagacuuguuuuuauugcucagugagcauuuugcugucugcagguggauuccgaugaucucccccucaauguuucccgugagacucuucagcaacauaaauugcucaaggugagaauuucuagucaggcuuucugcccgaugguuggagucagaauuaucaguaagcuacucuacaccugcuuucuuuguaacuacuagcaauuuuagagagugguguuacccaggaguaacagaguaggaaacuauagagauguaacucggugucaaauuuauuugcugugcuuaugacccuggguuugaaccacacuguguuugugaguuugcgcaagcacagucagaaagaaagcaguucuagcaacuagauguugaagcaagugcaggagggcugggcuagucuugaacuauucaaagaaauucugcuggacacaucagugcaugccuauaaucuuaauagcuugaaggaaugaggucauaguuaagugaggguuuauuagcaguuuuaggcuacccuaacuuaggacuaucucaaaaaggaacuucuuuuauucugagauuauugggucucagagcugauacauucccccaacauaguaaggaauaccguuuugaacagagcugaagccagggaacacaccuaccaguugucugguccacagucacccacauacuaggccuuucaauaagcccccuuuuugccaguauuguagugauuagaagacuaggugggguuuuguuuuuaaacauuugaaaauauuagucauucugucaacauaucugaguucuagcauuggaauauauuagaaacaguugucguuaauucuaacacagucugaugugggagugcccuggugcuuccugucccuugcugagugguguggcaguugugcugucucaguugcugcuauccuggucucagaagcaaagguuugagauaaaccuuccuaaccagauuccauuuucuuuaggugauuaggaagaagcuuguccgaaaaacucuggacaugaucaagaagauugcugaugagaaguauaacgacacuuucuggaaggaguucggcacgaauaucaagcuuggugugauugaagaccacucaaaucgaacacggcuugcuaaacuucuuagguuccagucuucucaccauucaacugacauuacuaguuuagaccaguauguggaaagaaugaaggaaaaacaggacaaaaucuacuucauggcugggucaagcagaaaggagguaagaugaagugcagcugcuagggucccugggagcuggaggcauacagccaaugugggagaggaaauaaguuaauuguguagcugggauaguuaggcagacaccagaggacacuaccuuuagucuuugucucacacagcuaaugugccaaggcagaacuugaaaacacauacuucuuuuaaucuuguaggcggaaucuucuccauuuguugagagacuucugaagaagggcuaugaagucauuuaucucacagagccuguggaugaauacugcauucaggcucuucccgaguuugaugggaagagguuucagaauguugccaaagaaggggugaaguuugaugagagugagaaaacuaaagaaagucgggaagcaacagagaaggaguuugaaccucugcucaacuggaugaaagauaaggcccucaaggacaagguauuugggguuugcagacuucagugucugcacauaggaauuaucagcaugcuaauccauacucaguuuguucauuaccacuagcgauuguagacaguggcaugugccucaccuguaaccucggguguaacagcagggaccuggagacguagcucagugacagacucauuugcugugcugaagacccuggcacccaucccugccaagaagcuuccuguugcuauauacugauguuguacuaaguuuuuacagguuuaaagauaaauuuguaguugaaagaaaauccagauugacugagugucccuccaggauuccugaguccuucugucuguucucuaugauggugacuagcacugcuuacugcugauccuuacuucugucuaacguuucucauucuaagauagaaaaggcuguggugucgcagcgccucacagagucucccugugcucuuguggccagucaguauggauggucuggcaacauggagaggaucaugaaggcacaagcauaccagacgggcaaggacaucucuacaaaguaagaaacgggaugucccuaccaagaugccagcucuuauucucuugaucugcuacaugaaucauccugagcuuccuuaguuugcuuuagaguaauuacgaauaauguccauauuuacaucacgacucacuagggguuugguuuuguuuuggguuguuuugagacaggguuucugcagaguucuggcuuuccuagaacccuguagaccaggcuggccuagaacuuacggagacccaucuaccucuuaucucugccuuucccuacugcugggguuaaaggcguggcaaaccaugccuggcuuucuaagacuuagguucuacguaaagaaaacugcuguauauuuucuaucuaacauuguaacgccauuuaaaacccaacugucagugucaggaaaguuacugaccauucagcacuuacugcauugacacuguaguucuggccuuugggagcaucaaacuguuucgaugacucucagcagugcccuaagcccuagauggaugugugguauaucuggccuuggaagaugcuaaugagcauggguguguauagaacguacaggaaauuuaauuggaauuaauuuaaaaauaagugaauuuuuagggacccauacugguaaaggcauauuggagauuauauauuuacacggcauccacaacuauguggcucauugguauaguuaaauuauuaaggggaugaacaagacauuaaaccagcauaacuucauucacccagcagaacuugauuacuuugacucaucauuaaguagucccuucuucauuuuuucaccuaaccauggcuauguccacaucaaaggaggcuuuuuuuuccuucuguaauuaaagcuagaauacaguaggcauguagacccuaaaauuggugucuuaaccuaaugcucauuuuguccguaaacaguuacuaugccagucaaaagaaaacguucgaaaucaauccuagacacccacugaucagagacauguugcggcggauuaaggugagcagugaggggcugcucucuuguggccuuaaaaggaaugcuuuguaagccuuaccaccgaugcuaaccaagcguaccuucuaucaggaagaugaagaugacaagacagucauggaucuugcuguaguuuuguuugaaacggcaacacuucggucaggauaucuucuaccagacaccaaggcguauggagauagaauagaaagaaugcuucgccucaguuuaaacauugacccugaagcacagguuugugugcccuuaacucuagcauggcugaccccccaggguagcaccaccugcgaaauuaacaagaaaucuccugugucuucuuucuuucccauccgcuaccccugacacagggucucuguguagcccuggcuauccuggaacucacuuuuagaccaggcuggccuugaacucgaggaucugccugccucugccuacagagugcugggaugaacucgagcgccaccgccacucagcuuggcuucuuccuuuugccucucuugcuaguuucccuguuaaggcagaucagauugacugcaguacuugcuaaaucacccauuuugaucuuaaacacuuagaucaaaauagagguagauggaggccauuuacagguuguggaugucaccuuuagguggaggaagaaccagaagaagagccugaagacaccucagaagacgcagaagacucagagcaggaugagggagaagagauggaugcagggacagaagaagaagaggaggaaacagaaaaggucugagagggaugggcagaugggguagcaugagucuagcaugacuucuaguaucuagucacuaaggaguaaaucgacacagaaguuggcauuugauaccagccuuggaaucuuugugggugggguguuuauuucuuauuuucuaaccguuuacaagaucuuuucaagcagauugcuuacccugcccccagugcuucugugagguaacauuugguugaacuuuuugggagguggggggugggauauccuuucuagguaguccuggcuugccucccaaaugcuaggauuaaagguauaaaaaugacuacaccucacuagcauuagguaguuacaaaguuuugauuacuuguauuuaggcauugaucuuguugguggauuuugaauuaucuugccaauaagcaaguacaaacaaaauaguagaaauuguuugaaugugagccuuuucuguacgguaaaguugacugcuaguuuguaaugucgccugaccuuuguuuucacaggaaucuacagagaaggaugaauuguaaauuauacucucgcuaugaaucccguguggagagggaaugugaaguuuugaagucauuucuuuugagagacuuguuuuggaugcuuccccaagccuccuucuccccugcacuguaaaauguugggauuaugggucacaggaagaagugguuuuuuuaguugaauuuuuuuuaacauuccuccugaauguaaauuuguacuauuuaacugacuauugguguaaaaucuugucauguguauaaaaauaaaaaaagaucccaaauacucagugcuuauuuucauaacacaaacugggaauuaucuaauacuugacuuauuuuccuuccugucuguugggcuuuuuaaacguuuaaaaaaaaaaaauccaaguagcuuguuugugguuugguguguuucagaucucuugguuuugacuaaacaaaucccaaauacauguaaauauuccucuucuagagaucagaacauaaucugaguggcuguggccccuagacuuggugauguauguacaggaaggggaaacugaauauuuaauaucuucaaagauuauaaaagaacuuaagacugagaaguccucacaguaaagucuacacuauaauaaaaaguaaccagccaguguuuugcaacaugcucucauaugcuauguaacuccagcuggccuaaaacucgaaagaucugccugccuccugagugcaaggauuaaaggcauucauacaaggguaauuuuauuuuaaauuuacuuuaggugagcaugauggugcacuugggaaacaggccucuggguuaaagaucuguaugucacagccaguucaacgacuagagagacugucaaaugauguguuuuuauuugccugccugccugcauguacacaucugucugucuacauguauguauaugu

SEQ ID NO: 5686 - RNA, 1079 nt, Mus musculus
uuuuuuuuuuuuuuuuuuuuuuuuuuuuuuuuuuuuuggccuugguucugcuuuauuguccuuagagcacccuuuggauacaguuuuaaaaaauaaaccacauacauaguaggaacugaguccaggcugaugccccguaucuccagaaaaaucccaacccaagaauguuuauacaaaaugucagaggggaaaaccaugaggcagcauggugcugagcugagggguggccaguuggcagaggagcgggcggucagugacggagcagccaggucacgccuccuucucauaaguccgagugcucaccacacugccaugagugagagucaggaugaguuuccugucaacuagcucccuaguuaguguugucuccugcccauuccacuucugcacauggaugaguuugccuccguccagcgucaccagugacuugaccuuccggucaucugcugucaccucgucgaacucuauucccagcugaaaguugaucucuguguucuugaagguacuuugugucuuuauggugauaguauccccguucuucucgaugaugguaguaggcuuggucaugcuagccaccugccugguggcaaagcccacaccgagugacuucauguagucaucaaaauucuugcaguccacuagcuuccagguaccgacaaaggcguccgccauggugcgaugagugaggaggcgggcaggcacugagaaccgcagcucccggcuggacagccucuuuaaauagcccucgcaucacaugaugaaaguggcccacaccccucgcucccgaaaugugaacaauuuuucuacgguguguuuacaacagucaagaagcaggcuguugaaagcuuuuauucucuccagccacugucugugcaguaggccucugauaucugauuugaagcuugcuuuccucguuuugucuuuucugcaucucagucuccuuucagaacacggaaaccuagauuggaaugcaguuggagagguggaagaauacagggcacauugauuacugugguacuacauugucccucacaguuuucugcucuaccguuugcauuucuaucaggaaaguggauuuu

SEQ ID NO: 5687 - RNA, 1079 nt, Mus musculus
aaaauccacuuuccugauagaaaugcaaacgguagagcagaaaacugugagggacaauguaguaccacaguaaucaaugugcccuguauucuuccaccucuccaacugcauuccaaucuagguuuccguguucugaaaggagacugagaugcagaaaagacaaaacgaggaaagcaagcuucaaaucagauaucagaggccuacugcacagacaguggcuggagagaauaaaagcuuucaacagccugcuucuugacuguuguaaacacaccguagaaaaauuguucacauuucgggagcgaggggugugggccacuuucaucaugugaugcgagggcuauuuaaagaggcuguccagccgggagcugcgguucucagugccugcccgccuccucacucaucgcaccauggcggacgccuuugucgguaccuggaagcuaguggacugcaagaauuuugaugacuacaugaagucacucggugugggcuuugccaccaggcagguggcuagcaugaccaagccuacuaccaucaucgagaagaacggggauacuaucaccauaaagacacaaaguaccuucaagaacacagagaucaacuuucagcugggaauagaguucgacgaggugacagcagaugaccggaaggucaagucacuggugacgcuggacggaggcaaacucauccaugugcagaaguggaaugggcaggagacaacacuaacuagggagcuaguugacaggaaacucauccugacucucacucauggcaguguggugagcacucggacuuaugagaaggaggcgugaccuggcugcuccgucacugaccgcccgcuccucugccaacuggccaccccucagcucagcaccaugcugccucaugguuuuccccucugacauuuuguauaaacauucuuggguugggauuuuucuggagauacggggcaucagccuggacucaguuccuacuauguaugugguuuauuuuuuaaaacuguauccaaagggugcucuaaggacaauaaagcagaaccaaggccaaaaaaaaaaaaaaaaaaaaaaaaaaaaaaaaaaaaa

SEQ ID NO: 5688 - RNA, 1185 nt, Mus musculus
cuguguuccaaaguaagcuuuauuuuuuggcaguggcauaacaaauuuuaauucacaguaaacacuaugaaaauagaaaaaaaauaacaaguucucagaauugacgaaugugucccaauuaucaaagaagauucacaagugccuaaauguauguuacaaauauuacaagcaaaugcuacauuuaaaacacuguaauacuuucuggagccccacacccuggauacuucacuuaaaaggaggcaaacuccuuugcacaucaaagggcaaugauuccaaagcagauagaucauucuccugacagaggaacuacccuuaggaaggugagcuuaccuuaaaccaugguaaugaaauagauguaacaauuuuuuauucuaggaacauaacauaggauaguugaguugacuauuaauaaacagguacuacucccuccccagggcaguuucuuauuccaagauagaacagaaaaagaaaaccacaaugaguuugaagaaaagaguguuuuaaaaggaaaaaaagaggaaggauuuauaagaaauauauaaugagauuuuuuuucuaucaaauacuauaaaacuuguguuuaggaguuaaucccuccccccacuucaaguaaaacuuuuauuuacucaaagguccuauuucuauucuaagaauuugguagccugaagcaaugauccuuuccucuuuggagcaauaacuccuuuccccuuccuccauuuucuuaugcaccaauucucagacuagcagagguucagaccccagccaaaggggaaaggauacaauuaccaccuuccucggaauaaaaaccaaguauacuuccucuguguguuccuucuuccugagcacacccucuugcucaaaaguagauuuggggcuuuuugcuuguuuugccugagguguggguagggauaggugugggggagcaauaauuccaggcccaagcugucuggucuauaauacuauacacuaugcuguugcguuauacuguguggaaaacaggguuugacaucacggaacaguaauacagcaacacagauuccucaguaaugccugaagugcucaccuggacaccugggccagaggaaauccgauauucccaacuguaacacaucuauuaaguuauuccuaccaugaagaaagaguuccuggacuacuaccccuuucuuccuaagccugaaaccugua

SEQ ID NO: 5689 - RNA, 2845 nt, Mus musculus
cagcagucucucacuucuggccagggaacguggaaggcguaccggcugggagccgguuagggagggcgaauuggggggaacgagagagcaauuagaaagaaaggggguucaaccaaauaaucccagaagcaggcucaagcccaggcuggagcaagggagagcgggcgcaagaaagcgcagccccggagcagcuccaccuggcagagugcgcucggcacugacuuuugcggcugcuuuccuuuucccuuuccucuuuuaaaaccgagaaggcgccggcggcggccgcacacgcgagcgccacgcgaggcucccgaagccaaccgcggcgggaggaggggagggaggaggcggcgcagagggaagacgaucgcccaggcaccuuccuccgcugcagccugacaacucugccuccuucugcgcguuucuuccccuuuaacuuuccuccggggcucguuucuccccucuccuuuuucuucgucccccuuugaucgugcuucgcagccccgcuuccuucaagggcucugcgcacccugcguccccaacucguucucccccgcgacaguuuggcccggcauggagagcucuggcaagauggagaguggagccggccagcagccgcagcccccgcagcccuuccugccucccgcagccugcuucuuugcgaccgcggcggcggcggcagcggcggcggccgcggcagcucagagcgcgcagcagcaacagccgcaggcgccgccgcagcaggcgccgcagcugagcccgguggccgacagccagcccucagggggcggucacaagucagcggccaagcaggucaagcgccagcgcucguccucuccggaacugaugcgcugcaaacgccggcucaacuucagcggcuucggcuacagccugccacagcagcagccggccgccguggcgcgccgcaacgagcgcgagcgcaaccgggucaaguuggucaaccuggguuuugccacccuccgggagcauguccccaacggcgcggccaacaagaagaugagcaagguggagacgcugcgcucggcggucgaguacauccgcgcgcugcagcagcugcuggacgagcacgacgcggugagcgcugccuuucaggcgggcguccugucgcccaccaucucccccaacuacuccaacgacuugaacucuauggcggguucuccggucucguccuacuccuccgacgagggauccuacgacccucuuagcccagaggaacaagagcugcuggacuuuaccaacugguucugaggaccugccaggcucuccugggaauggacuuuggaagcagguacgcuucauguggggaugggcagagccuuucuugacuaggucccuuuuucuuuuucgguguggaggggggaguucacggaagguaggggcugucuccaggaacccaggggugagaggagguuacuauguuguuaguuuguccaucucaagugcuaguguguuaacuucagucuuggccccugagaguggcuuugcccaaguuuccaagagcagaaggucgaggugaggcauagagacccugcguauugaguccugggacuuuguccaaagagauguuuuaccugacagauucuccaagccugaauagcuucuaccacaccccuucaaguucacacuaaccucucuuguuucuguuacaggauggcagcagauccugcaucuuuaguguuucucgccaacgacgucaaauggggaggcagaaaaacaaggggaaaaaagaagaagaaaugaaacaaacaaaccagacagccaaccuacaggggcaccuucacuaagaugcaauguucucagcaaacaggggugggcuccaacagugucucugcauuccaacaucauuuccagacacgagaagagugacuggugucugaaccuaagcccgaaucacagauggguuccuuuccuggagcaagagcgucacacacacacacacacacacagacagacacuauauuaacucccaaccacuaacaggcagggcuggaagcgcgcaugugcaagugccuucaccucccacucucugucagagcugucuuagcccccugaaacuggguugaugucuuuccucagucacccccauuccagcgaucuauggacauuugccuccauugaagcaacgucaguucucggacagccuuucccucuccugguggccuccuccccaaaccccacaucgcccucccacggucuuugcuucuguuuucuucauagaaugcuuccaaucuuugugaauuuuuuuauuauaagaaaaaaaucuauuuguaucuauccuaaccaguuuggggauauauuaagauauuuuuguacauaagaaaaagagagagaaaaaauuuauagaaguuuuguacaaaugguuuaaaaauguguauaucuugauacuuuaacauguaaugagauuaccucugcguacuuuagauauguaguucaucuuacaacugccauccccacccccauccccagugugguuuuggaaagaacucuccucauaggugagaucuaaaugccaccagaaugacuucagcaccaaugugucuuacuucacagaaacgugguuaauguauuaaugauguuauuaaaaaaaacuguucaagaagaacaaaaguuuaugcagcuacuguccaaacgcaaaguggcagcccguugguucccauagguugccuuuuggaaguuucuaccauugccuucccccucacacccaccccuuacuguuuuauuacaaacuuacaaaaaaaaguguauaacccuguuuuauacaaacuaguuuuguaauaaaacuuuuuccuuuuuuauauaaaaagaagagagagagagaaugauc

SEQ ID NO: 5690 - RNA, 1615 nt, Mus musculus
agaaaguagcagcuuauuuuauugccuauagaagagccaggugauuccuacuuaaauggucaaagguagccauugaaguucuagcaugauagcaguauucauucgggaggcagugggaccaaaugaccagagaaaaacagcuccuugccucagucugauugcuugacgcuuaauugagggcguguggagaaugcagucuuuauuuggagugguggugugccaggguaagagcaagcacucugucagugaguagggagggagagcagacccugggcagcuugcugucuuuacuucacugguacaccacacagaccuuugaccuguuauaacuucuucaagcacacauucacacgcacucuccuccuccacaugcagccccugaaaggcggcuuuggcuuuuguuuuuucuugccuauagggccgacuuuugacuaacccuccauaguuaauguacggagcuaaccgaagguaagcacugaguuguaggaaggaaaacgagaagaugcccagaaucuugggcacagcguuuucauccugugcuuuuccuguuuauggggaauguauucucuaacacguuuccuugcugagccaaugggacauguaaaggcugcuuuucagccugucuguguggaagauugucugcagaugucaacauuucuguagaacuccaaaaauuaaaccgaagcugcaaaguucaugaagaaaacucucaaauucuaacagcuuaaauaucagguguuuucuucaaggauauuuccacuaacaacaaaauuguauagcaaaauauaucucuggauugauuuuucaaaagcacauuaaaugugacccuaauuaauuugugcugugucuuuaaaguuacuaucagaguacuccaacuuguuccgaucuuuaugcucuugaauucauggccuucauaaaagguugcucugcuucuuauauguuguaguuuaacuaaugcagagguuauugggaaucaagauaaagaugagguaguucucgacacauggcaauucucuaucugggagcauacaagacuuuggauuccgacuggaaucucagggagagagauuuggggcagaguuggaccucacaugaaaagaacuccaagugucuggacugcaauauuggagcccuauggccagcagacauguagaucuccgaagaacuuagguacagauguguggacccucugggcuagaucaacagauguugucucagggcugauaggguucugucucucuagccaaggauuagucccauuuugguaaggcuuggaagaacacggaggcuuccuugaccucggcaggugucccgcagucuuguugcuuucuucuaaggcugcgcaguagcacagagaccauguuaccuuuuauuacuuguagaaaccaucauuucagagagagaaacaacccagccugggaucaugaucaucagccagacaaggaugagucaacuggccacacauuaucaaccaaagagagcuuuagggagaauaacaccuagaauacacagaaauauuaagugcuuacagaaauucauggauaacacacaagcacaagacuugcuagaucuuaccuaacaacgaagauucgcuugcugggcaugcuaugugaug

SEQ ID NO: 5691 - RNA, 440 nt, Mus musculus
caugaaggcugagccuuccugaguagaacaauaguauaauacagacucgagacuccagcucuuccccaugggaaguuaauaagauguuaccuaacugcaaauggaaagcgaguccuuccuagagcccaacugugcccuguucuuggccuugcugccucggaacugugagacaugccuaucugcucagcagcuaugggauucauuccuagcaugaagcuucuguguccccauacugagaugagcugcugaggccucaugugugacccagcucuggucucucuucucucucagucuuccugugcauugggcaucucuaccuggagacgcuguugguuuugcuuggguaccaugaaagcuugcaaguucuuuccacgauacagaguaccauucuguccacaucauaccugccagccccacuuuuuugucuuugcuucuuccca

SEQ ID NO: 5692 - RNA, 75492 nt, Mus musculus
gggcauuccauuucaaaauuucuacuaagugugucuauguguguguguguccagaggauaacuuucaagggcaguucuuuccuucauggugguuuggucaucaaguucagaucaucaagcuugcuugacaaguacucuugcuggcugagagccaucucacuggcucuagacuuucuaacuucuaggucuuuagguauauucgguuaaauaugacaugcugucaauuuuacuuccuuuaagguuagaccaacgaauggaaacauuaaauuacagccguuagucuaagggaaggaucuugguaaaagaaacugagauuaaaaagcugaaauggccaaaagaauaacauaaacagagcuacuuguagagcagaaaguugaguucggaggaaaugaagaagcaagacuaggaugucagcgagagaggcacagacaagaugaaagggaugaagaaaagaugaaagcccaaguaccaacuaggaaagggcagcggaggaccuagugggaguccgaaguaggcagggcugaagauucccggaacucccacaggucccgcccaccucgagcucgcuccgcccccccgacuccucuccccgcccccggucucuuaggugaugcugcagccaagauggcgcuggcggcggccgcggcggccugagcgucaugcuucgggcucucggcggcggcugcggcggcuguggccucggccaggcccucgagucucuucugagagugaucucuccggcgcuucuccuccgggccggugaggcgggaccgaaagaagacugccgcgaagugaggaggcugugaggagcgacaagagagcggcgcuccagcccggcgggcaccauggcugggaucaucaagaaacagauccugaagcaccucuccaggucagcgagcgcucggggccggucccguccgcuggccgccgguucucggguccaggucgcagguucgggcucugccggugccgcuggcgcccccgaccggccuccggagucacgcggagggcggcggggcucggcgggccggggucuccuccuccgccgggggccgcuccugcgccgaggcuggugacguccccggcgucacucaggugcuggguggaugggguugggcugggacccgguccggcucggaagcucccggggcucggagccgagcggcuccguuagccgaggacuggggugugugugugccagugaaacguuaaccuugggauuguucucggugcccccuaccuggcguccccgcuccgcugcacgggagggugugcuuguuugcacaguucggauuuguuuuaggggaaauuaagcaggacuucuccgcuucggccaguucuccguggaagucguuuucagucccgcaucgcguucguucuugcugcagaguuuuccgauuuuguuccgcgacccuugaguucagggaguuaacgucccugguguuuaaaccccagacgugucacucuuuccauuucauaacacaguuuuagucagaaacaugacucaguaaacuggcaguuuguuacugcucuuggcuucuccauauuugucucaagaaacaggcuaaauguaggacccuguuccaaguuggugacagagaauuaaaagcucuugguuaggaucucuuucucuccucuguuauuuguaaguuaaugaaugcuuuuaacugauuaaaggaacguucucagguuuaaugauagacuuguauaguaaacaugucuucauuuucuggauauguguguguguguguguaauacauauauauauauuacaguugagaacauauugaacaaaacaauacuaugauucagcagauauuuuccugacauuauaucuuuauauugaauaaaauuuaauacacacaguauguauacauaaaguaucaaacuauagcaaaguuugugaccguguguuugguucuuaguaucacuaauuagagagagagagagagagugaguguguguguguguguguguguguguguauuuaaacagguuaaguagcucaggcuguccugaaaauaaaucucaggcuacccucaaguucagugucauccugccucaccuuccugagugcugagauuacaggucugugcuaccaugcuuuguuggauuuuuuuuaauuauauagauagugcaauacugagucaucuuauuuugaauaauguuuauuacuuagggugagucugacucaugagauacacuucgcccuugccuauuucaagagccauaagaaaauucagauccauagacacugauuuuauugcccuuuucucucccagggauaaugauacuguaccacucuguaugcccaaaagaaaaucuaauucagucgauaagugccuuagggcauuauccuuuaauucucuuguauaaguccauuugggaagaccucuuaagagcaggcguguaauggcuuacucugccacauagauaacucccacauacuuagaguuaagcccuuaggauuacauuauaaucuuccugauuucuuacaccugugugguaaauaguaaugagcauuucauuuuaaaucagaaaguuucuaaaacauagcauuuucuuucuuuuuaaauggagaaaccauuuguaguuuuuuuuaaagauuauuauauuuuuauuuauuuacuguauacauccaagugugcacauaugugccugauccagucuauguauggaacaucugaggauaacuggugcucaccuaccacaccaugugugaguuggaacucaguuucccaggcuggguuagagugcuggccuagcaugaaagcugcccugaguucagugccuaacaccuuauauaccuuauaaagcggguguggugacagauuccuguagucucagcgcuugggaguuggaagcugucagauuuagauuguccuuggcaguagagccugaggccagccuggaaugguggaauccucugggggagggcguuggaaccuguaccaucagagagaggaaacauuaggaaaaugcccaaguucuuccaggcucuccugcagggacucuuccaggaagaagucugucuagaaaaauagaauggucacacugagugaaaguugagaucuuaagauugaaacuggcaauucuggaggcuggccaggacuuuggacguuggcauauuggaccagugaggaagaggaacuguuuuauaagagacugacauaugcuuuaugcuuuaaguaagcgcugcuugguuugaguauuauaagucaucuuauaagaaacaucucuguuucuugccuaauguuuguuuccuuagugccucuugcuuuaaugagaaguuuguagacuugacugaucugaaucaacuuuggggugugugaagagagacaggaagagguuagaaguguuauauuuuaggggaaaugaaacaugaaaagccuuugaaagaaauuacccagauuuuuuuaggucagcacaggguauguguugaaggugguuauaggggaauccguccccccccccccccgcccccgcaccccguaagaggauaagaaguucuuuaaaacauucauauauaagaaaggaagauggagcaggaacuaccugucauuucaccauuacaccuuuuuaucuguugcucugugucucucuguacauauguguguagguguaugugcagggaaaauguaguugaaguuguugaagaucugaccacacaccugagauagucggaagacaggcagggacaaaagguacacauuuaauuaagcugggaccugcaaagugauaugaaagauccaagcacaaauacuugccucccaucacuuagccucaggacauaguauaugauacacagguuuuucugcagauuaggaguucacuugguagacuguaccucaugggguggagucucuguccuguuugaagcaaugguugucaaccacuggaacuuuguuccuuuggcaaugguuuugauuauugugacuuggaagguugucaccugguagguagaggcuggggauucugcccaacacuaucacgcacacccagcacagaccucuaauaugaaaucacaucuggcccagaugccagcagccgaaaggcugaggaacugguuucaaauauguagauguguaucaaaugauggagcucgauagcuuugcuggcuaugguuauuuugucugcaggcaauagaaaugugucaacuuaaguaaaaaagggaaauauaguugaagcuguugggugggucacagauucagaggaagaucugaccacacacccugagacagguggaagacaggcaaacucuuugaauuucccugggccuucaucuuagagcaaggccugucaauuucagauaguagacuagacaguucuuugcuguagaggauuccucugugcagugugggguguuuaguauuucuaggaauuuccaaaaauucccuaggggauaaaacugcagcugauugugcaacuuuggaguuaggacucuuacucucugaucuuuccugccaaguuuuagauucuugggagagaaaaauuuuauggcccaguucuagcuauucauagauuaguuugucgugacaaagaguggaaggaugucuuaguuaccuuucuauugcugugaagagacaugacagccgaagcaguuuauaaaagaaaucauuuagccggggacuuacauuucuauaggaugagucuguggcugucaagucagggagcaugacaguaggcagucagacagaacacuggagcuuaagugugaggcaaggaaagaaagccaucugggaauaacauggacuuuugaaaccccaaagcccgccccacccauccccagugacucaccucuuccaguaaggccacacuuccuaauccuucccaaauaguuccaccaagugaugaucaagcauugggaguguucacauucaauccaucacagacggcaaagaucuggcuauggagagaauuauuuugaauugagauugcugcucauguuggugucaauaauaggcuuagcuaaauuagauuuucaugggcuucguuugcuguguuaaggaaacugaacuucauaccuggguuguggcugacuacuaauaaguaauuccagcuaacagaagaguauaguuaguauagaagucuuguuuguggagucuggauccaggaacaauaucuaaaggcuaaauauagcauccgcaaauggacuuggaguaacuuauguacuggaaggaugcuguauccuucagaaccuaguaucuguuuguugcucuguguuuggagaaccagauuuggaaagguucuggguccagggcagcuccaaggauggagauaggagagacaaccugaaugucucagugugaguuguuucauaaacuaaggggaaaggacaguuugaaagggugagugcaggcuugugggugaggugccugcugcaccaccaugaggacccucuuucagaucccuaccacccacauagaacccugugcagcagcuucugucuuuaaucccagggcugggaaggcugggagguuuccuggagcuggccugccagucuagcugaaucggugaguucuguguucagugagacagucuaucccaaagguaaaaaggagagcgaagaagauaucagcuguuaaugucuggccuccacaucugugugcauacaugugcauccgucacuuucuuaaguaacuagaucucuauucaaagaccaaguuuucacaugcuuuuuuguuguuuuuguuuuguuuugagucaaggucuugcuguuuagcaaagcuuugcuuggaacuaauauuaaguauucacuguguguguaggauacaugcaugcuguggugugcauguggaaaggcagaggauaacuugggaguuggaucgcuuccuuccauguagguccugggaacggaacucaggucauggguuugguggcaggcauucuuacucacuggaccaucucaucagcccuugucuggggcucuugaucuuccugccuccagcuuccaagugcuauaaauucaggcuugagccuggaccucaggcccacauuuuguaauaaagcuugacaguuuguagggauguguacauuucagaucaugagcgugugcacacagacacagagagagagagacacacacauacacacacacuacauauugaucauuacagaugcaaggaugauuuuaguugauccuguucuguucuaggaagcauaaauagggguuuuagcuuauuucuaaacuacauugcuguaugaaauuugugaguugguuuacuuaaacuaggcaacugagagaaaaccugguuacuuuuuagauuacaaaugaauuuacuuuuauaagauuugagauuauuuaaaaguaauuuugcuuuuucauuuuaauauaaucccuaguaauacauguauguugaucacggggcaugguggcacaggccuuuaaucccagcacuugggaagcagagacagggggauuucagaguucgaggcgagccuggucuacagagugaguuccaggacagccagggcuauacagagaaacccugucuugaaaaacaaaaaacaaaaaacaaaccaaaauauguugacauuagcuguacuagguuuuuuuuuuuuuuuuuuuuuuuuuuuuuuuuuuaacaaauaaguuacuggaugccugcuuuguacuacugagaacauagcaaugagaaaacacgauagaagcccccacacucaugguguuacauuuuaaucagaggauaaagguaauuaauaaauaguaaacaaucaaacauguaacaggguauuaacugcacuuuaaaaaguaacagaaaggcgguuggaagauaggaaugggguucguaguuaguccugauuguuggcggucaggaauguucaacuggaauguauuucacaagaccugaaagugguggugggagccaaugcaaacagcucugauggugguagcuugcuuguuauuuugaaauauguugaggccuccagugaggugaaauagaguggagcagggaagaaaacacaggccacgcuggggagagugcaccucaguggugaggggcuuguuuggccugcuugaaacccuggguuugauccccaccugacaacaaaaacauccagaucguguuaaaguacaaagaaaaguccuucgggggcuggagagauggcucagugguuaagagcacugacugcucuuccagaggcccugaguucaaauccuagcaaccacaugguggaucacuaccaucuguaaugagaucugacacccucuucugugugucuaaagacagcuacaguguacuuacauauaauaacaaauaaaucuuugagccagagugagcagggcuggagugagcgagcggggccccagugagcagagguccugagaucaaguccccgcaaccacaugauggcuuaaaaccaucuguacagccacaguguauucauauauacauaaaauaaauuaauaaaucuuuuuuuuuuuaaagaccuuuggggacaaaggauguggacucuccaauuucagaucuagagugcuugacuaaugugcacaggguccugagggcuaucuagggugccacauuugagauggggagaccuggcaggacaugccuacaguccuagugugugucauauagagaagggaacucagggaguucaaggucauuagaggccagcacaggcucuguagaagacagggucucuuguagccuucaucuacaaccuguuacccaccaggaauuucugucuuuccugugaguccuggacuaaaccuagguccucuggaagagcagcagaugcucuuaaccacugagccaucucuucagccccuaguuucgggcuuuauuucuguauuuacugggaccaaguuuccucauauccaauaucaauguggaaacugguagugacuggcuuuuacacugaaucgagguuggaaaaaaucacuagagguuuuuuuuguuguuuuuuuuuuuaaagcaaaggaucacugucagcugugugagcaacaggacagagaagacgugaaaggcaguggagacagcuaacuaugcaggugaaugaaaauguuaccaggguagauagaugccguggaguugcggagggucagucucuagguguaccugggaggcagagccccauugacugucagacaagauauggauuaagaguugucuugagagugguaauggaggccacugacaagaugggauugccgugaacugcguuggagguggcugcugggggagcaggcugucagaggccggaaguuugguuuugaaugguaauuuguaucuguucauuaugaaguagagaugcccucccuucuuaaauuuaugaccugauuuagaguaugccaccauuuagucuggcaguaacaaugaaagugguuuuuuguuguugaggccauccaauugguucaugauccuccuccccucaauacuucacuuuucuccuacuucuuuuuuuguuuuguuuuguuuuucuaaaauuuauucaucauuuuauuaguuuauguuuuaaauguuaucccucuucccaaucucuccccuccaugaaccucccaccugcucccccuccccauugccucuaagaggguucucucccaccuaccuacacacuccugccucaccacucuagcauccuccuucucuaggguaccaagccuccaaagguccaagggccuccccuccagcgaugccagauaagagaguccucugcuacuaauguagcaggagccaugggucccuccauguguacucucugguuucugguuuagucccugggagcucugagggguuugguuagaugauacuguucuucccaggggguugcaaucuccuucacagcucuuccccugacucuuccauugagguccccaggcucaguccagugguugcugugaguaucuggauuugucuuaggcagguguuggcagaaccucugagaggacaaccauaguaggcuccugucugcaagcacgucuugguaucaggaguagugucaggauuuggugucuguggauggaauggaucccacggugggguggucucuggaugaccuuuccuucggucucugcuccauuuuuguuccuuuccuuuagacagggacaauucuggguuaaaaaguuugaaaucaguggguggccacaucccucuacuggggaccaugucuaucuauuggaggcaaucucuucagguucuaucucccagcuguuguguauuucagcuuacaucauccccauuggguccugggagcugcucacauccuuggugucugggacuuucuagugguuccccaaguuccuaucccccacugcuacuuauuuguauuccuucuccuggcucucuggacuucucuccugucucuuuccauacuuggucuucucccacccccuuuucccucuucuccuccaccccccccccccccccgccccaggguuuauuuucuacccccuucuaaguggauuugaaacacccacaguuuggccuuucuucucauuaagcuuccuauggugaguuuuaucauaguauucugagcuuuuggacuaauauccucuuaucagugaguacauaccaugcaugcccuuuuugggucuguguuaccucacuuaggaugauauuuucuaguuccauccauuugccuacaaaguuugugaaguuuuuuuuuaagaucuauuuauuuuauuuuauaugaguacacuguagcugucuucagacacauaccagaagugugcaaucagaucccauuacagaugguugugagcccccaugugaugcugggaauugaacucaguacucuuaacuacugagccaucucuccugcugaaguuguuuuuaauagcugaguaguaguacauuguguaaauguacgauauuuucuguauccauucuuccguugagggacaucuggguuguuuccagcuucuggcuauuauaaauaaggcuguuuaccucccuuuaggacagauugucucucaggccucaucuuacaagaacauuuccugugagcaguuuuaaugaagcuagucuuuacugaucuucauuuuuaagacucgagugguuuuuauuuuauguguauguaugcaugcaugcaugcauguauauuaaaacaauuguccuuaguucugugguuacauucucuuuauggacagaaucgaaccuggguccucugaaagagcagccaguguuaacaucugauuaucucuccagacccuuuaagacacuuggauaugcaaauauaguucauuacuggaauauucuuugguuuaugaguuauuuuucuucuuugcuccucucuucuuuccucucuccuucuuuaagaugcagaggguucgguaccauauuuuaggcuggccuggaacacacuuuguaucccaaauuggucuugaacacacagcaauuccccugccucugccuccugaguacuggcagugcugaugugaaccaccacgcuaggcuggacuauuuuuuuauaggugaugguuuugcuuuugcuuuuuuuuuguuguuguuguuuguuuguuuguuuguuuguuuguuuuuucgaaacaggguuucucuguguagcccuggcuguccuggaacucacucuguagaccaagcuggccucguacucagaaauccgccugccucugccucccaagugcugguaauguuauauauacuucagaauucagagauaagaacuacaguuuucacugauuugggcaguucaacugaugugguaauuuguauuuguagguugcuaguuuuauauaaugaauuuauuuauuuaauuuuaaguuauucagugcagccuuuacauaagguuuauuccacauagcaaucucauuuuucuuggugcuuuuauaugcauuuaaaaguggagguaccagaggagagucaugacagugguggugagggugaggaaccccuacgugguuaguguguuugcagauguacgcagugucugccugcagaugaucuggugugagguacaacuguucuuguaagcacaucacagcugaauauuucacuccucuuccuuccuucccuuaaauuugcccccuucuguguccccuguguccccauucccuacagcguucccugcuggcugugguggagauuggugugcugugaauugcacaaucagcuaagugaguaccagaagagucuaagaacccuggcagcugacugcuugcuuucuccaggaauagggaccuuuugucccucagguaauacuucucuuccccaguuuucauguccuuucuguaagcacggauugugccccacauaaagaugaccucauuuuuaaagaaguagauagcuacaaguucacaaguucauguaaaucuuccuuuagaaugucugguuuuuuuuuuuuuuuguuuguuuguuuuguuuuuuuuuuuuugacaagguuuggcaacucagaaaguugucaccauccuuuucugauguggcaaggggaguuugauaauuuacagccagguauugggcaaugguaacuagcaucugauguuuuaauguguauggcuucuuagucuaaugugauuacuaacgucuaaagacuuuuuuugaucauaaaaauguuuugguaacuucucauucuccauugaaggccuuaagagaucauuuuguguuuaauaucaauuuugaucuguaucauuuaaauagucauaaucaugggaaugguucuguuugcaguugggcagccuuuucaugguucugucuuaccuucugcgucucauuugaagauuuaucaucaguggugaguuaugccaccugcacauagcuccagcuaauugggauaucagauaauacacacagacacacacacagacacacacacacacacacacacacacacacacacacacacacacacauauguccaaacaaaggacaauuccccccccccccaaaaaaaaacagugacauuauacaacucauuacauagcucagacuaauggaacagucaguaaguguuauauugucaugauggucucguuugccauucuugcuucucuugcuccucuguaggcacuuagaaaucuggaucucacugcaaaauugacaaacuuuuaaaaacguuugaaauucauuuugcuguaguggcaauuaagguguuuguuuauuuguuuguuugcuuauaaaggcauucagggaagacucugaucuuguguauacauucauuaagucgucugggucaggcauucaggaaguauaguccaaccacaaucuggugcauuuucuccauugccccucuuuaacauagcgucugcuggucagugcuuaucuuaugaagaugagcuauuaugauuguauucugguuuuugguuguuaagauguauuuacuuuauauguaagguguuuugcuugcaugucugucucagagcgauguuugugccugguguccauggaagccagaagagaguggcuggucuccuggagcugaggguauacaugguucugaauagucacagggaaugcugggaguugaaccagcaccuuccaaaagaguaaccagcacuguuacccacugaccucuguucagcaccgugagagcacugugugucaguacucauuauuuccaggguuaauucuuuuucauuaccucucuaugcuuugcuucucuucccauuucuggggguagacccuagcaccccauauaugcuaaguaagugcuuuaccaguaagcuguauuccuagcccuuugaguuuuauuucuguuuuugagacaauaucucacuagguuuucuagacaggcagaccuuugaccuuucuuugcauccuaggccaggccuugagcuugcuuagccuccuggguuacaggcuugugccuuagcuccucgccugacucagucaugaguccugcuuaguagaugccuguuacauuuauaaagauuuacuuguuguauuugauguggguguuuuuccuguguguauguguguuuacucugugucccuaguaacuguggacccagaggagcagcagcgaucccugcaaccgagugaagacaguuugaggaucugaaccugggacuuuugcaaaagcagcaagugcugcaucccaccagccugauugcugagguuaucuuguucugaaguuaggacguggcagacugccuggcacacguuggagcaucucugcucucacuacccagauuuaucaguuuucugcaacuaaauguucucuuuuccuucuggucuuacaguucuuuauuuuauccuuagcucuguuaccagagagcuguuuuggagcuaaucuuacuuaagauuuugcuaaaucuuuuaaugguucauguugaaguuuucaagaaaaaguuguuuauaacagauuuuuuuuucccuuaaagaauuuuguuuguuuugcaacaggguuucucuacauacaccuguguauccuggaacucauugugcagaccaagcuggccucaaacucacagaaguccuucugucucugccuccugagugcugggauuaauggugugcaccauuucuucuggccucaaagaauucuuaagauugagcuucagcucauagguugaugaaagucaacuucuuggguuggcaauggggccgagaguccaucagcuugcaugucuuuauuugauucuccucccaucuacauugagccacagucaaucuacugagaccaugagaaacugauucaugggaagaaaggauagucuuguaaaauaaaaguccuuacugcuuguuuuuguuucucaagguauaccuuuuuuuuuucuaaugaaaaugucuuauacuaugguauacuguucuauauuacacuacaucugcauauggccauuguaugugacccuuuauaaaccuugaccuuauuacuuacugccucuguccucugucucauuuuccgaguacaaaguuucucuuaaauaagcaugucucagggaaugcuuucccaaaguugucuuuuuuuuuuuuuucuuguuuuuucgagacaggguuucucuguguagcccuggcuguccuggaacucacucuguagaccaagcuggccuugaacucagaaauccaccugccucugccucccaagugcugggguuaaaggugugcaccaccacuggacagcuaaaguuguauucuuuauuaccagcaauugagcacucuuucccagcccccuuuuccuccuauuuucauuuguauggcauugucuauggcacauaguggcacugucacacacuguggugaugugugucgggcucuucucuaagaaugagcagugacugugucucacuguucaaguugcugcagagucugcuaggcuuuccuaugaaggguaaguguagaauuuugccacaccuuauacuucaacagucuagauaccccaucccgauuuuaauaacuggucccuauuuuuaguguuagaaccauuuucauauuuuuugaaaauaauccugcaagcugaaaaaaauguaucagugcauagaagacagcauagucaguaggucccacccucuugcauagaagacagcguagucaguggguccccacccucugugugcuuuaagugcuuauguugaaaaacugccuauucaaaguuguuuucuuuucuagcacuuacaaagauaaccaugcugagcaaacaaugcaaauugagauugcaaagcacaguggacagagggagauuuuccucagugguguagccacaggcaagaugcccacacuucuguagauagucugucagccgugcuccuguaagcaaccuuuauuaaacucacugggcugccaaaaccaaaaaccaaaacaagacaggaauguagaagagaaacugguugggaaaaggcaggaaagggaaacaagggagguguggggugacuaggaucaaaauaaauuagauacauguaugagaaugucccagugaaacccauuauguauaguuaauauaugcuggccccuggcucuuaacuuaaaaacaauccuuuugcacagugaauugguuuuguccauuuguuggaaaucaauucaguauaaauuuggauguuuugaaagcuguauuguguuuuauugaucaggcuaauuugguuucuguaucuuuuuuauaaacauugaguuuguauaaugcuaccaacuuuguucaucuuuuugaaagcuauuuuaggucuccuguauuucuauaggaauuuuuaaaucagcauguuauuucuaccauccuaaugaaauuuuacuuuuaguuaucuuaaaucuauuuggggagaauugguuucuuagcaauauugagucaugaagccacauaaauuuauuuaaaucucuaauuuauauauguuacauacccucuuaaauguauauagcucaaaauaucauuuucuguggccaugcguugacacaccuauaauccuagcuaccuugccugacaacuugagagggccaacugcugaaauuuauccucugaccuuugcacacaugugcauuugcacacagcuacacacaugcauacaugcacucccuaaggagaguaaagaugaacccuuuaaagagaaggaagcaguuaccuuucagaagagagcgaugggguagaugaaagcaugguucggcugaaaggcauagcuuugggucaacgagaagaacguggaugucucugcagaaaagccucauuugucucuuacucucuacuggagguauacuaauggauguauaaugcauuucacggacugugaaagauacgauuaauuguagauuaaggauuuaauguucuuaggggcuggagagauggcucagcaguuaagaguacuggcugcucuuccagaggacccagguucaauuuccagcacacacaugguagcacacaacugucuauaauuucaguuccagguguucugacacccucauacauacauacauacauacauacauacauacauacaugcagcuagaacaccaauauacauaaaauaaaauauguauaaauuauuaaaaauaauuuaauaauuuaaaaaauaauuaaauagaguauuuaauuuaaauaaucuaucagauuagggaagaaguuuccaaaaauaucccuuuuuguugacuuuaaaaugugguauuguaagcgaggugugguggcacucagaggcagaggaaggcagauuucugugaguuccaggccagccuggucuaugaaggcaguucuagaacucuaggccugccagggucucuuaguaguaagacccuuucuuaagacaaaacaaaaagaccauugguuugaaggcauuuuaucuuucuagaaauaguguuagcaauacaguggggcacagacuucuauaacgacuuauaaugacuucaauaugucugcauauguaauggcuuuccuuuucagugcuggagaaccagacucaugauuuaacuugucauacaagagcucugccacugaaguacacgcucagcuccauguuggcuuugauccuuauaaagacagacagacagucuuaagaguccgucuaggggucgcacuucccuacucacuaugagcuccuguuguggucgguguguguccagcuugggugaacugagaacaguauugagaagaguccuuuggauggcuucuauucuaaaauguugauuuguuucuuucucagucacagcuguuaucaguaauuagcuguagacuaagaauuuaauguugccuccccgaggcuguguagucaaccucuacacaaacaaaguguaauuaaagacgcauuucaaaguguuuuauguguuacuuuccauguugugguguuuccuaguaacgugugcugggcagucacucaagaaguauuugcuugggcuggagagauggcucagcaguuaagagcaugaguugcucuuccagagguucugaguucaauucccagaccacaugguggcucacaaccaucuguaaugggaucugaggcccucuccuggugugucugaagacagcuaaacucuacucauguacauaaaacaaacaagcagggcacacgccuuuaaucccagcacucaggauuaaagcgcucucuugggcaaaugagauuaaggccaucuuccacuaugcagcacuuuccuuuguuuucccuaaaccauuacuuaaugcaguguuauagacauaauuuagacuauaguaauuaugcauugauugcaaaaugugcaauuuaaauaagacacauuugcuuguaaauuuuagugcugaaguuuggauauuuuugcuauacuaagaagcuaguaaauuuguuuucauauauuaugugugauuaaaggagaugcuuguugccgggcaguuguggcgcacccuuuuuaucucagcacuugggaggcagaggcagguggauuucugaguucgaggccagccuggucuacaaagugaguuccaggacagccagggcuacacugagaaacccugucucgaaaaaccaaaaaaccaaaaaaccaaaccaaaccaaacaaaacaaaaaaaacccaaaucuuaaaaaaguauuugcuuauaaauauuaauuuuaaaaaauuuaacaaaaauaaaauaacgaauuugaagugauuuuauuuaaguuuuuagagagagggucucacuauguaguccuuacgaucuauaacuuauuuuguagaucaggcuggcugugacucaaagaucugccugucugccuaccaagugcugggauuaaaggcaugcaccaccacaccagucccacuuuauuuccuguauggcuaaacuuaaucaguuuucaaugcagugauauuuugccuuuucuguguuuaaaacacuuaacaguuugcuaaaauauggacccuacuuaagaacuacaguuuggauaacuacuagaaaaaauuaaacuguuuaacauguauuguuaaauucucuguaaaaucuagacuuucaugcuauauccugaauacaaucacacagaaaugcuuguuucuaauuacuauuagcuauucgauaacauuugcuauuugacaacauauuuucaagauccaggaugagcucuuuguaagaauagugccagggcaugaugaacacgugagcacagcagucagaaacaugccuucugaguaguuaggauauuugagaaaugcacauuuauuggugaucuuagacuggugucauggagggagguauguggaugggaggagguggcucggaggaagggaggcaagcugucagaggguuaggauaaguguauguccugagguuccugcggaggcggaggauaaguguguggauguucugaggguuaggauaagcuuauguacguucugagguuccugcucugcuuugugcuugguuuuccuuuuagagacugaccucaaacuaaccauguagcccaggcuagcuuugcacuucugacccuucugccuccaucuccuaagaguuacaggcauaacccacuagggcaaacuuuccaauagucucuuuagccauagaauuuuacauuguccuucacacacucuauuuaacuuaacaaauagcuaccuccuguugcuuuggcaaauaaauaugugauauuuggagguuuuauguucucauuuaaaauuuuuauuacauuuuauucaguuuuauuuguuuuuguauuggggcaugugugugcauaugugcacauggaggucagagcacagcuugugggagucaguuuucuucuuucacuuugugguuccagggauggaauuccagucuucaaguguagggucaggggcuuuaccuaccgagcccucaccagcccguguuucauguuuucugacuaagucccccugucuaggccauuguugaauucuuuauccuucaccuuagccucucuagugcuggguuacaggcaugcaccgcccuggcgagcuuuguuuuugugaugagacugcaaaaccaauuugaugaaaauggauauaaauauaauuaagauuuauaguauauaauaucagauauaaaaauguaugucuucuaaguuaagguguauucuaugaaguuucaugaagcccaaaacauuuguaaagaaaauuaggguaaauugugauguaauuugugcaguguucauguucuucaaaccuuaugguaguauugaucgugcugacacucacccaguuacuguguguuggggcucauucuagcaugucacauguucuagcaugucacauguucuagcaugucacaugucacauguucuaacuuggacauccucagacuuacucuaccuaggagcuucuguuaccucccuuugcgcguaaggaaauggaggcgugcacgcgcucacuuguccugugguuauaugacgcgcucucuugggcaaaugagauuaaggucaucuuccacuaugcagcacuuuccuuaguuuucccuaaaccauuacuuaaugcaguguuguagacauaauuuagacuauaguaauuaugcguugauuguaaaaugugugauuuaaauaagacacauuugcuuguaaauuuuagugcugaaguuuggauauuuuugcuauacuaagaugcuaguaaauuuguuuucauauauuaugugugauuaaaggagauacuuguugccgggcaguuguggcgcacccuuuuuaucucagcacuugggaggcagaggcagaggcggguggauuucugaguucgaggccagccuggucuucagaguaaguuccaggacagcuuagggauauacagagaaacccugucucgaaaaaccaaaacccaaaccaaccaaccaaacaaacaaacaaacaaaaaaggagaugcuuguuaaaauagaagcuauuuuuacucuuacaggggacccagauucaguucccuguacccaugcguguauuagcuagcucacgcuaucugcaucugcaaaguuccaggggaugcaguaccccauucugacuuaacaggcacaggcacucaugugguacacagacauucauguuggcaaaacacucaugcacauagagaauaaacaaaccuuuaagaaauaugauagccaauaauguacauucauauuaacauuuguuuguuauagugguagaaacaugacucauguauacuuuuaaaaacacuuauuguggagaguggaugugugugugugccgcaguguguguguguguguguguguguguguguguguguugagguuagaggacaacuugugggaguugguucucuccuuccacaaguggguuucaggugauaaacucaggcugucaggcuugguggcaaguacuuuuuaccugccgagcuauuucaccggccauauacuucuauuuuuucuaacuuuauuuucugugcauggcuguuuugcagguauguauaucuggguacggcauauccacaaauguaccuggcacacguggaagccagaagaggguuuuugaucucccagagcugcaguuagagauaguuagauugaucugucauguggagacugagccuagguugucaguaagagcagccagugcucuuaaccacugagccaucucuucagcccgcccauauaguuuuauaauaagccacugugcuugccauaauguugacauaauauugaaauuuuacucuguaauuugaguucucuaaguaauuauuggggcugaagcuagugguucaaacccucgucgagcauaggcgagggacuggguuauagucucaacauugaaaaaaaaagagaaaagaaaaggaaaugaguaagaguugugcugacuuuaucuuuagcauauccugugacucccgucugugcagcuguuucaacuuugacauauuugggccaaacaguuuucuucuuuaucaucaucugcauuccuguuaacacacuuucuuucuuagguuuuuaugguucccuucuucucuuuuaucugccuuccaaauaaauauucacaaguuuaaguuaugguagcuaucaugcucccccccuuuacacuuuaguuuuaaauauuuagugauuauucaguaagcuaaaauaauuuacuugauuucagacuaugauguguucuguuuugagucaaguucaguacugugacccuuuccugguuacuguucgugagaauuacuguccuaucugggagcugcaaauggaaccuuaggaaggagagccccacagcagcacucggucuuccaugcuguaagacuucauuguauucuucugcucaugcagacagggaaacacacaauacacacuuagccaaaguuugcauuccucucuuagucucacagaaauauggcugaaaagucacuuccugaagcaugauauuacgugauugguaagcauuuguauguaagugaaauauauguaaaauaaaccaauauaugcagaauagaaaauguauagcuuauacuauacgauacuuaguaagaaaccagcugcuguguaacugugaaugugauagucgccugcgugucuccaucuacuauaaacuacccagaagagcugaaugaagagcaguauugguauuuacaggcuuagcuucaucgcucagcaguuuugaaguccucuugggaaaguaggaacuugugauaguccucugaucagcagacgaguguuagcauuuguaguugaauagacaguagaggggugcgcgugagaggcucuggaugauuuaccuagcaccuaucuucaagccacacugaagaucaguuagcguguuuauucuccguucuacggaugagccaguugagcuucagagagauguguguggcugaacugauucagaccuguuugugucucauuaucaggccaggcuccuuugucauaaacugaaaccaauaugcugugaauuacauaugcuuugagccuugccaucuucacuuuuugccagacuuuucuuuuuguacuugguuguuucaucugcacggaaguuauaaacacuccuugccucccucucccugcaaggccaaguugucagcuuucaugugugugcuaugaguuguucugguuagucugggucugugcccucccccucuucgcuccucgucccuccuccuccucccuccucccagucuucuuuucucacuuugcuuucagugugguuacagcauuuuaaaauaaauuaauucauuucaauuuauuucaacuuagguuuuccccucuucuuacuuuauuuaaaaaauaaaauguugaagcaggauaucacuaaguagcucaggcuggccccaaacucagugcccagucugagagugcugggacuugagguuuagacaauaaagugcuugcuguguugcauaagccuggagugguaguacacaccugccaucccagcgcaugggaggaggaaacagggauuggaaguccaaggccauauuuugcuacauuguaaguuugaggauaggccgacugcaaaaauuaaaucaaagcaagagaaaaaaggaacacggauaccucugagugccuuguaagcaauuaaaagggaaucaggaagagcucugaguuuauuauauuuucuucuaguucuucaaaaagauaugguccaugugcccugaagaagauagacaucuggccagaaaucauucccuuucuacaugguacagggucaucuucaaggaauuaguuacugaagcauauuuuugauguacauucuucacuuggucuuauagguagaaguguaguugaaguuagcaguuucuaauacaaggcaggcuugaaggguugacauuauuuccugaggggcacauaagcugggcaugcugacgcacacauuuaaucccagcacaggaggcagaggcagguggaucucugugagucugagaccagucugaucuacauagugaguuccaggccagccagagccauauggagagacugucuucauaaaagaagaagcuguguguggggaguggugguuuccuguucuuauaaaggacucagguucaguuccaacacccacaucagaggcucacauccagcuauaacuuuuccaggcaucugcauauacaugguacauuugcccuuaauguauaagggggaacaucuuuguguuccaaaguggaaaaaaaucccaccuauucaaguagggaaguguuguuucugacugugucuaggaugccgagcaucggaugggcuuucugguccacugacauuuccucauguaucugguuuuaggaugaggucuuugaucccuuuggaguuguuugugauaaguaugggucuauuuacauucuuuuacaucaggcauccaguuugaccagcacaauuuguuugauuuccaguguguauuucuggcuucuuuauuaucuaucaucauugguuuuuuuuuuuuguuuguuuguuuguuuguuuuguuuuuuagguauuuuuuuuuuuuuuaagauauuuucuucauuuacauuucuuuaucaucauuguuacagcuugagaaaccagaguaccuguguucaguuccugguccuuuguaugucagugagcauguuacuuaauauuuguaaguuuuuaaaaauuaauuuuauauguaugagguuuuugccuacguguguguguggguguaccuugugcacaccuggugcccagggaggucagaagaggccguuagaucuccuggaccuggaggugcaggugguugugaauugccauguugcugcugggaauugaacaaggguacccgagaagagcagcgucaagccaucucuccagcccauuauuuaguaucuuugggguguguguguuuguuuugcuuuuguuuguuuguuuguuuguuuguuuauuuuuuguucuuuugagacaggguuucucuguguaacagcacuagcucaccuggaaccagcuuuguagacaaggcuggccucaaacucucagagauuugccugccuuugccuccugagugcugggauuaaaggugugcaccaccaugucuggccaauuauuuaauaucuuaaugacucaguuucaucacuuaaaauuuuaagauuacguuuguuuauugugugcaugcaugucugugugcuauagagugaguguggaggugagggcacaauguacagaauuugauucucaucuuccaccaucuggguaccagaaauggaacucagguucucacaaauucuaagcuauccugccagcccaguuucuccacuuuuaggaugaaggguauaauuauacauacuuuagaaaguuauaagccaaaaugaagucuauaaagcacuucagaaguguagcugauaaucagcagccauuguguaaagagucuggaaacacacagaaaagaauguuugucuacuuggagacaucagagaguauuucuuaguuccguuugaccugcauagauuagucgccagucugucagaguaucugacacaggcuacuuagcaaguguuuagcucacaguuuugaaggcucaagguccaaguggcucuagauugauccuuggcuguaucaccagguggcaaaugggagagagcaauggcaggagaauguauugggagcaaacaaguggugauaucuugagccaggagcaggagcgagugggagugagaacaagcuaaagaggccggaguccugacaucccaaaggaccuaagaaccugucacaggagucauaggacagaggacugacucaaccaucaucacccucugggaguuacggaggaaauaguagugggaagguggggcaggaacaggaucagugcggccauuggauaaagaucuacagcaggaagaauuagcucaggggugagggggagcauuaaguaaggagucugucacgcugugauccaauuguccuuaucucaguuucaguucuggauuuuccagguucuagaagacucaguagagaguaguuaucccucaccuccauuuugucaggguugggugguggggauaggaauagggggagagaggcauucucgccagagaaucucuuccugaauucuaucuaaggugacugcaaguucgugacaaagaccagaacuuucuagaugcugcugcaggacacgcagaaccugauguaaaaacugaccuuugaauguccuugcaaaucuugaaaauacuucacuuuuaucuuggugccuuuaguccggaagggagcugagauagaauagguauauuuagggcuaaccaaccuugaauuaccaguuucuaugcagacgcuucuuaaaugauuaacuugccugugugcagauuugagcaggaaucucagcugagauuuggaagagagcagaugcaaaaugaaagcccaggguuuuuccuguuuuuagcuauccauugugacauuugcugggguugggggaguuaggggaguggaaagggaagaagggggagggaggugugagggaagguuaagaggaggugggggggggagagagauuccuauuuucucucucucucucucucucucucucucucucucucucucucuguguguguguguguguauguguguguguguguguguguguguguguguguguagcccugccugccuugaaccucucuccguagaccaggcuguccucaaacucagauccagcugccgcugccuccugcaugccgggauuaaaggcgugugccgccaccaccuggcuuaggucucaccucuuuacugucacaguaucauacuaucuugggaaccaagcaauccuuuaugcacagggcucuuugggggaacauccaucguccagacuacaauacuagaccauaagagggaaguaggaauuugguugguggaggaagagcuaggcauucuggggcuuugggcuggaggagaugggaagaagauuguucucaggaguagcuguguuggucagucuggcaaagcugcucuacgggaugagaugugcuuauguguacagcaagcaggcuuucuuccgaagugauuauucauugguuuguggcgguucuugagguuguguuaaauucuuaacuugaaguauagcaucuuuaugacagugauuggugauuuuggucucccugaacuuugacuuuccuagugcuggcacagaaaacacagcugucaggaccauggcccaggaacauagauuuaguguaccucaaauaccauguuccagugugguaacaguucaugaagccuuuaugguaaaacagcaaagaacaucauaaaucaagacacaucagauacauuggugggaacucaguagggggauuacagcaaaguggacaaagucucuucuguaggccccagauguugucugauaugcuuagucuccggguugguaaaaucagauggucucuguacauucugguggacuuacuuaauaguuagggguguuaagugaaacagcugggcagugagggaauauuuaggggacuuagagagcccaagcugguuuggcucccaauuguaacauuccaguucuccacaaucaccgggcuuuaaaagcauuucuuuauuauaauuauuguguaugcaugguuaagaggcacacucaugccacugugugugugugaacaucagaggacagugcugugaguucucucaccacuuuuggaggauccaggcauugagcucaggucacaaggcugugguaagugccuuaccugcugaguccucuugcagaccccucuaccaccccaccacccccuuuccccugagacaggguuucucugcguagcccuggcuguccuggaacucagucuguagaccaggcuggccucgaaccuggagauccuccugccucugcuucccaggugcugggauuaaaggccuguggcaccgccacccagcucagcaauuacuuuuugaagaguagcucgguaaaauuagaaauuuuuguuugggagaaggaauuguuuucagguuucagaaauaucucuaaaaguauugaaaaauagguuuguaguuuauuauuaucauuauuguuuguaguaccaagcauagaaguucagguuucuuguucugucuggcacacaggguaaaauaauuuuuaaaggauuuuauuuuagggaucuagagaaauggcuucacugcuaagagcacuguugcucuuucugaggauacuaguucaguuucuagcacccacaucaggcagcucccaacugucuguaacuccagcuagagggaucugauaccuccuuuuugugggcucugcagguacacacacacacacacacacacacacacacacacacacacacacucacucuauuauuuacuuaugcuucauuuauguucguacauguguaaaugugaaguguguuaugugaaugcaugcuggauuucuuggagucagagcugcagcgguuggugggcugcauuguagguacugggcucugaacuucaggcuuucugacagagcagcaagugcucucagucacugagccaucuuucccuccacucagcucucguguguacucuuauaaggaauucaguguuauaucaacuuguuuuaacuuuaaaaauaccaauuaaaugucugaagcaacauguugaaaagcagagaugaaauuuaaagugagaauaggaaaggucuuccacaaauauccccuaagagaggcuucauuacacaaacuggauugcaagccaugggaacaaaucagacaggugguaggcaagcuugaccucugagcugugcuguguccuguccuuaauacuuccaaaccuuaggaaaaaugcuuuuuagaaaaagagaucauagucuucauuagaguucagcguuuauucugucaugauuucuugcacuuucaguaaguacuuuuaguuuucugacuuccuguagguaaacuuguaggaggaacaaguggugcuucuagaguuaagucagaguuuuaaaaaguuacccagagaauaucaaaaucaacuucuaaaugggauuguguaauuuccuuccucagaaaaguuaaaaacacuauacgucagaauuuauuucugaaguguuuuggguugguuucuaaggcugggaguagcaggugauccucagaggagugguaugaccucugacccuuguucuuugcguggugacugacaucugugccaugugagcugcuguuagaggguccucucaauuucccuaccuuugugugcuugguuaauagcauagcauugucucuucucucugauagggucuacagugaacaaaaugugguagggacugggcuugcauugugccuggaaagcagugguggauacacaguuuucauccauuugagggagucaggaccagacuucagcuguuuacaggaaugauguacacaucggggcccccaaacuguagacucacuauuagagaguuguggccuggagagcagagaacagcagugacagacacuggacauggguuaaaauaaacucaucucugugguggaguuuagucugcugauguguuucuagaacucuguauuugcuagguugucuguagggugcauuagcugacacuaaaguaauguaaguguggucucuuucagauucacuaaaaacuuaucuccugacaaaauaaaccucagcacccuuaaaggagagggggagcugaagaaccuggagcuggacgaggaggugcugcagaacaugcuggaccugcccaccuggcuggccaucagcaagguguucugcaauaaagccuccaucaggguaagcaaggccuggcugucugcggaggcugccugcucucacaauagauacucggcuucaauagauacucggcuucagaacugcuuauaaagaaacacuguguuccuaguauuuacacagaaaauagcugcaugaaugguuuucaucccuuaugaguauaacugaaguaacauauuaacaacuuacauuuacauuuuguuuaaaacaucuuuauugauaguuuaauaaaauugauuuauuauaaauuaauugcuuuacuuuggcauauauucaaugauagcccgccccagguuuuauugucaaaugaaauguuuuaaauuuuuaauacuuuauuuuaaagacguauauuagaauugucauuuguuauuguagacauuaugcuauuuuagaguuuuaugccuuucauuuaccccuuugcuguuuugagacgguuagggauaucuauuuacuucacuacugucuuuauucuuauuauuuuacugauuuuuguuucaaucuuauaucaguuuuuacaucuuauaacuucuugcugcuaaagaccagguuuaggugagcaguugcaugggagagacaguguguguucuauauagagauagacuuugggcuuccuuuggaaaaggguccuguguccuuugguguucaucauucuuuaauuugugucugugacucaaauaucagcaaagacuuguuuacgaacauugcuucugcgauguaucugguguuugccaucaguggguuuauuuugaauuugcuuuuacggagcuaaaaauaugaugguuggaauucuaaaguuaaaaaacuaaucaacagaaaagugauuauguuuugcugauaauucuuaaauuaugaaaauaaaacguauuuuuaaggacagguuaaaaacauguaacuaggugcuggcgagauggcucaguggguaagagcacccaucugcucuucugaagguccugaguucaaaucccagcaaccacaugguggcucacaaccauccguaaggagaucugacucucucuucuggagugucugaagacagcuacaguguacuuacauauaacaaauaaauaaauauuaaaaaaauaaaaaagacuauuaauaauaauauauuauaaaaacauguaacuaauagaacuugaaauucuauuuucugauauaacauagauaccuugauuucaauaguguuaauaauuuccucaauuuauuauuucacaaucugagagagauguauaguauaaaguauaaguugcuaucuuuuaaaugcaaagauaucugcugauuacuauuucauauaaaguuuuaauaauucauuuuaaagaaauaaauuuauuuguagauuccauggacaaaacugaaaacacagccuaucuguuuggugaguacugaaccucuuucaaaaauaggcauuuagauguguaaaugaacugcucuguaaacauuacuauuuuguuucuuagauuuuccaucuguuuguuuccacuuuauuuuuauugguuuuaguuuuuuuaaagccauuaugugugaaacuugaacuuuaaaauaugagaaauuuaucuuuuaauuuaaauuuaacaaaccacuuucuauguuuuugcuuuuauugguuaaucaaguuuaguacauauuucuguaaugaacuucacuuuuuaaagagaaugggauaaaaaugaaucaguuaacccuuuguuuuauagugugugugugugugugguuguguguguguguguuugugugugugugugugugugugugugugugugugugugugagagagagagagagagagagagagagagagagagagagagagagagauggcaggcauguggaaguuaaaggcaccuugcaggaguuggcucuguccccugccauguuacccuguguuccuguggggaacuuaggguuagguuuaggcuuugcagcaugcacuuuuccugagcucuuuucccagcccuggauuccuaaugccuuguuggucacgcauucuguaauccugggcgugcuguucuaaacugaguccgcgucccugagcguguuaguuucuaccggguuuagccucauuccauaaguauuccuuauaaaaucacguguuuucuuucuggguuuucaagacaagcuuucucuguguguagcaauuccuuagaccaggcuggccugaaaccauaagagaucugccugccucuaguggugucaccacugcccaaccaagauuauucuuguuuuugacuuuaguuauuguugacuaagauacuuucuaaaccagaaauuccuauauuaauuauuuccaccccaaauccugagaaagccuuaaacacaggauacguaacacugcauauuacucuuccguaaccccuugucccacccgcuguacucaucucagucagugcugugccaccaagcuccaccucgugcuccaagcuagaaacuucaaucaaucucuggaaucuaugauugaucuggcuuccucaucucucgccugaaacagugccaccaccuucucggugcccuuccugccuccguucucuuuucuccucugaaaugaaagcauaauuauuaguaaauauuuuuauaaaucagaaaucugguuaguuuccuguaauggguuauauuaacuguaacuugacuaaaauuaccuguucuuugaucuuaagaaauuuauauuuuaacagagguugauugaauacacaaucaaauaagaugacuuuagauaaugauaaaugcuguacuuaaagucgugaauuuguggauacagucacugucacagacauuagaucgaucuucaaggaaaaagcuaucuagagaagaacuuuuccuccuauggagugcuucccucucuuacuccauagugugcucacuguuaugucucauauccuaggucucaagauaagacuuuuagauguaguuccguuccauuaauuaauauauaauuuaucaguaaugcaauaauaugggauuagagauagugcuucauuaaauccaguggccuaaucaguuaauggcugcuucuguauucucauagaauguguauguaauuuucccacuaguagaucagugucucugugcagggcugaaugcuuuguuuucucuuucaggguuuuuauaauuguuagcuuccguccuacauaagcaaaagacauaguacccuucauccuuugacaguucacauacaucucuaauuauugacuuucuuauuagucucuagauaaggugauaauggagaugaguacaugugaagagccacgagccccuaacgguccgucaccgauugcaacugccucaggacagagguaagccacggcguguguggcucuguguggcucuuauagacugcucugcucuguaguaggcauucucaucugcagcaacaggauaggaagauauaaaacccuuuacccucacauacccucuacugaggccaccgcuccauuagacaguccccacauucugugaguggcugauucauucuaaguuccauuccucuugaucaucgaauuguuaaauaguaaugaguaggcaagagcagugcagaagagcguaggcguucuguaaaucagaacuucucuuauuuuucauuacagcagcugucugcuuucauuuuccaugucuucaguuaacugugacuagaggcagucuaaacauacuagauggaaaguucuggaaauaauuaauaaaauuugaaaaucuaugcuauuaugaaugucaugaaagacugaaauuuaacuggauaugcaacucauucauuuguccacuguauucacucuguguaggcugcugcuggauggucagacagccgccugggucucugaucauuugucaggaucacaguguuuuguguucaaguaacuuuuacauagcaguacucauaaaauuauaguauauaugcuguuuauuuaaucuaucaucugggccuauaucuucuuacauuauuacaagaaggguauguuuugccuaagcuauuuugaucuggggauguaacucaguugauggauuauuuaacuuugcauguucgaagcccuggauuuaugcagcacuacucagaaacaaauguggugagauaugacuggaaucccagcccucaggaaguagaggcagaaggauaaagaguucagggucaccuuuggcuaccuauuugagauccuguuucaaaaccaaaaaugucuuaagaacguccauaucucauaaccuuuuuuuccuacaauguguaguuauacuugcuuuuuuauuauuacuuacugcugccucuugugucuaacuuaucaguuaaacuucauauauauguaugaaggaaauaguauuuauuauacaguucgguagaaucuaugauuucaggcgacccuagagucuuggaacauuaauguuucucugcaucucauuuccuaggcauuaaugaacuucggucauuuuuuauuuuuaauauuuuauuuuuuuaagauuuauuuauuuauuuauuauauguaaguacacuguagcugucuucagacauaccagaagaaggcgugagaucucuuuagggaugguugugagccaccaugugguuuuugggauuugaacucaggaccuucagaagagcagucaguucuuuuuaacugcugagccaucucuccagcccccacuucugucauucuuaaaaguuaacugaugucuuuguaaauuacagaaguauaaaauaaucaguuucaaaaaagucacauuccacaaguuaaauuuggauugauaaaaucagaugcuaguaagauagugucguguggacuauuuuauaaagcuuucuggugacagaaaccaucuaggaaaggcuacggcaaguaagugaguuuccuggagauggcccuguuuugcauggcugagaugggugcacucuggagaugcacagccccagagacuuugucccagauugcuucucucugcugaugugccuuuccugccaguauuacauagccuaauuaugccugggcaucggcccacccuauuaggcagauuuccugcugaucaacaugaauuaaugcuagaugaaucaauuacuguauuacauuccugauuugauucaaauaauuuuaagaagaaaguuuaaggagaugguuuuaguugcuuugccagaaagauguaauagaguuagaaucaagaauggaaugugccccuccucauagaauaguaagcaaaagaaugcaaugagcuuuuauaaauuauacuaagaagagaaauacacuugggacacauuugugaucaaggaaagagauucuuacuaggucggguccaaggaugaagccacuggugugugcugugauaaggucaggccaugugaaacuguugcuuugaacugauaaugagcuuacagaauguaacacugauuugaauuuacuauucacauccuucuguaacucuccuuuuguguaacguuuuauuuaugaguuaauuuuauaaagaacuuuugucuagaagguauaaauugcuagagaaaagaaauacaguguggcuuuugggguucugccccacccaccaaaugcauauauuuacauaugucugucugucuauaugcauuuacauacauauguguguaagcuuauguguguguauguguauauguguguguuuguguguguguaugcgugccugacuuuguucuuccuuuuuuuuucuuuuuggcucacgaagaguuaacucugagccucucaccuggccagcucgccagugaggggccacagagaaaagagcccagguaacuaagucuuuuuuuuucuuaauccccugcugcucucagcaggagguaaauugcugaagccuuuggcuugucccucugcugccuucccaggaagccccuuuucaguacugaaaaguugaaaucgauuuuuaagaauuacuuguuuguaggaugcauccccagguggggcagucucuggauggucauuccuucagucucugcuccggacuuugucucuguaacuccuuccauagguauuuuguucccccuucuaagaaggaucgaaguauccacacuuuggucuuccuucuucuugaguuucauguguuuugcaaauuguaucuuggguauucugagcuucagggccaauauccagagcucccugggacuaaaccaccagucaaagaaaacaugguggagcaugguggaacucauggcucuagcugcauauguagcagaggauggccuagucaguuaucagugaagguucuaugccccagaauagcggaaugccagggccaggaagcaggagggagguugagcagggggaggggggaggagauaggggauuuucggaggggaaacuaggaaaggggauagcauuugaaauguaaaaaagaaaauaucuaauaaaaaaagagauuaaaaaaagaagaguuauuuauuuaagaggucggagagaugacucuggaguuaggggcauuggaugcucucgcagaggguccagguuugggugucagcacccacauggcuggucacaaccuucucaaacuucuguuguagcuguauccagcaucuucuucuggucucuguguacuuacauauucgaaggcaaaauacucauacguauaagauaaaaauaaaucuuuuaaaaaaaagacugguaagauugguaagauggcugaucaggugagggccacaggguugcacacuauggauggagaggagcaacucagacuaauccuaacuucccguguguuuguguaauguauaaagugugccucaaugccuaaaagagcugugcugauuggcuguggagcuuagcuuuggaccacaugcaacagugacagggaaaauggcuuucaugguaauucuauaauuucuccauuauauagaaacuuacuuuauaguauggacuaaaauuucauguuggauagagugguuuguuuuuagacuggcuugucugaaagaauuggagaaaagguagaaaccccuguaagauuguugaaggggaacuguguaguaagacugauugccuuggcguucucacguugggaagugugaguuggauauuaagcauuuuguauguggacuugcaugccaucacuagccaguaccucuuacuggcuuuauucucccuaucgugcauuguguuuugcuuugccuuguuuuccagugaguacggcuuugcugagaagguuguugagggaauuacuguuucugucaacucuaucgucaucagaauuggagcgaaagcuuucaaugcuuccuuugagcuuucucagcuccguaucuacagugucaaugcacagugggagcacggagaccugagauuuacucggauucaggauccgcagagaggagagguaagaggcuucuugucuuacuaaaacccauuuuagucagugauaaauaaacagagacaguuucacauuacaucugggaccugugaaauggcucaguggugagggcacuugcugucaaaugaugaccugauacauuccuggaacccacguggugggaggagagaacuaacucccccugaggcacguggaugcccacgcauauguacacauauccacgcaugcacacaauuaguagagcaccgggaggggugcccugcaguuggaguacauggugcuauugcagaaggccugcaugugguucccaggaccuacacucugagccucacagacaccuggaacuccagcgccaggguuaucugacucuuuucuggcgucuacaggcacaugcacacaugguacccuuacauacgcuuagucaugugcaucuaugguugccaggaaucauauucuagcggauuguuuuucuucuggacuuacaaguauccuuugauauuaaccuaaauuauugaauuuuaauguuuuacuauauaaaucuuugaccuuaugaaaauaaugaguccuacuuugugugugugugcauguguguaugugcauguguuucugugugacuguguacuuauuuguaucugugugugugugucugcacaugcauguguguacauguauguaccuguguaugugucuguuucuguauauaugugugcucguguguuggugcacgugcaggcaugcgugcucaccauggcauguggagguaggucagagaaugacuuauuugcguggguuccaggggucaagcugaggucggccaaucccagagagcuccguuagcuccuuugcguuuuacuccaccacuguuuuagugaugauucuggugcuccuuguuggugaugcuguuuucuaaaugaaauuuccaggacucuuacagaugagggcgauucugaauguguguuauugcguuugaugaagcauauaaaaauagcccaaauauuuuuagaauaucacacaaauuaguugggaaugugcauguuuuauuuguuuucauaaauguacacuugucuuauuuugcaugagaaacagcuaaucucuguuuucuccuuagguuuugacauuuaaagaaauaaauuggcagaugauucgaauugaggcagaugcuacccaaaguucacaucuugaaauuaugugugcuccuguucgauuaauaacuaaucagucaaaaauccgagucacccuuaaaagaagaguaaguaagauggucuuuugggcugcugugauagcugauagaguaagcaggagagucaggggugcucugacacggugugcccuguucagacaguguuggcaggugaagggggaugugguggcacucgucgccugugcuuguagaaagcuggcacagauacagcacucuugcucugggaauaggugagugaauagauucuuuuagauucacauguuugcuggauguuuccuguguuagaguuucaugucacgggcugggaguauagcuugugguaggaugcuaacguagcaucagccaggcccugaguucaguccucagaugcagcuaggaaaaaaaaagaugaagaaguugaggcagaggaagaagaaacuucucaacaguggucuuuacuaucaguagcccaaaggucaguaaguuuuuaagauuuuuccgggggcgggggcgggggcggggggcagacaucauggcacacaccuuuagccaccacuugcaaggcagagauccaguuccaguuccauagaaaggcccugucucaaacaaaaaacgacuuugcugguaacuuagauaaaugaagaaaucagcgguaagagggugagagcgugagaguccacuggggcuggaggugagacgaaagaggaggagaggauucuuuuagcaugcucugugcuccgugucgcugcacaguaacgugcgcaucugugguaagcuccgcugaagggggcuuucugugaguugaacagagagagauucccugaaaugugaagugugggugaaauagccgucagguauuugaugaauuguuaauuccucuuucucagguaggaugaguucaguuaguagaagugauuaugaucugugacacuggacauagaaauuauauacauguuguauaaucuguacuucagaagcuugucagucuuucuuguaacaugguuucuagcuuugagaaauauucuauuauauaggaacucaauaaauauuuguuacauuuuuauccuuguuuaucauuuaucuugugggaagugauacccaugccauucagugugugaaggucagaggauguuuuggggguguugggucucuccuuccacuauguggguucugaggauugaucucaggucaucagacuugguggcaagugauuuugccuguugagccagcuugauggcuuaaauacuuauuaaauaaaggcaauauccaaauucacauuuaauccaaccaaaacacuuuaugcuuuaaaaaaauguaaauguguuauaaguucuguucuuggauuaauugucuaaaucauuuuucuuacaguuaaaagacugcaaugucauugcaacaaaguuaguucuaauucuggaugauuuguuauggguuuuaacggauucccaguugaaggcuauggugcaauaugcaaagucucuuagugaagcaauagagaaaucaacggagcaaaggaagagcauggcuccugaaccuacucagguacgcuacagauucacagcauaacgcccguguaacucguuuaaccaauucaaugggugagcuguuauuuucuuuuugugauauugugacauugaaauuaucuccuuuaucuaaaucugaugcaggacaauguuaucugcaguguagaguguuugauggcacugugcauggaggacauaggagucuguugagccacugcuucaucagcuguaccuguuuccuuggggcagagucucucccugagcuugcaaauggaauggcaagcagccccagucauccuggcuuuaugccucacagugcuggggugagaguuggcagcaccccacuguuuacaugagggcuggggacuugaacucaagucuuugugguuguauagucacugcuuuuaugcacugagcgaucuucuagcccaauaaugccuuuuaggaaguuaaaaaccaucaagggagccgggcaugguggcgcaugccuuuaaucccagcacucaggagguagaggcaggcagauuucugaguucaaggccagccuggucuacaaagugaguuccaggacagccagggcuacacagagaaacccugucucgaaaaaaaaacaaaaacaaaaaacaaaacaacaacaacaaaaaaaaaaucaagggaaauagaaaucaggccuggauauuuuaagagaaggcacugaaggcuaacagcacagauagcuguccggagacacugguguugaaagcagagcaucuguuaggauuuucugauggccaguggugggugagcuggguauaagaaaugucaauuuaugugaagaaaacuaauuuuucaguuuuucccaguguuaaauucuaauuacuaauacauaaacaucuuuuuagaagggauguggaaaauuccaguguauaguaucuuugauuauuuuauuaaaaguugaaaaauuucauaacuuguaaaauuuuuguaagauauuauaaaaucaacccugcuucagagggaagaaguacacgagggcagacuggagacgugaaaggagcauagaguccugccugaguuguaggauuggagauuuuuuuuuuguuuuugguuuuuuuuuuauuacauauuuuccucaauuacauuuccaaugcuagcccagaagucccccaugcccuuccccccacuccccuacccacccauccccacuuuuuggcccuggcauuccccuguacuggggcauauaaaguuugcaaguccaaugggccucucuuuccagugauggucgacuaggccaucuuuugauacauaugcagcuagagucaagagcuccgggguacugguuaguucauaauguuguugcaccugcagaguugcagcucucuuuagcuccuuggauacuuucucuagcuccuccauugggggcccugugauccauccaauagcugacugugagcauccacuuauguguuugcuaggccccggcauagucucacaagagacagcuauaucaggguccuuucagcaaacgcuugcuguguaugcaauggugucaucguuuggaggcuaauuaugggauggaucccuggguauggcagucucuagaugguccauccuuuugucucagcuccaaacuuugucucuguaacuccuuccaugggugauuuuuuccaauucuaagaaggggcaaaguguccacacuuuggucuucguucuucuucaguuucauguguuuuacaaauuguaucuuauaucucggguauacuaaguuucugggcuaauauccacuuaucagugaauacauauugugugaguuucuuugugaauguguuaccucacucaggaugaugccuuccagguccauccauuugccuaggaauuucauaaauucaucccuuuuaauagcugaguaguacuccauuguguaaauguaccacauuuuuuuuauccauuccucuguugaggggcaucuggguucuuuccagcuucuggcuauuauaaauaaggcugcuaugaacauaguggagcauguguccuucuuaccgguugggacaucuucuggauauauguggagauguuuuauaaggacugucauaagaccaugucuuuaaaaagugaggagccaagcuagggagauggcuccauggaaacagugcuugcugagccauuguugggauccgaguuuggacccgcagcacccacagaaggccagauguaauguaaucaucucuaguccccacguuccugugggagacaaggaguggggcuccugggccagugugcagaggccuacacagcacacccccaacucuguuucugagacuugcauuuuacggaaacugaguuccacaccguauguucucucuauuucuccugauggccugagaaugugcuuguuuuagauguuacacgaguucuccggugccagggccaugaucacaauaauccuacguaguaagaaaugaagggcacucuuaccagucuucagucugugauggacuuguccagaaagaacaaguacuucugggaacaagacgggaaauuugagcuacuugcugucaaaaaugaaugauucccuugacuacgugacaaaugacuuccauuacuuuguuuugaauccauuuggaggaggagcuaauaugucucaggaggaacuagaaggauuggguuauugcaaguaauauaauauggugagcacauuaugaauccuagcauguaacuuggaguuuaaaguaccaaacuccauuuuaaaaacgaauuccucauauauugaaacaucucugcaucccugggaugaagccugcuugaucauggugaaugaucauuuugauauucucuuggauucaguuugcgagaauguaaguaaggcaaaucuuucuuucuuucuuucuuucuuucuuucuuucuuucuuucuuucuuucuuucuuucuuucuuucuuucuuauuuuauuuacuuauuauaaguaugcuguagcugucuucagacucaccagaagaggguguuagaucucauuauggaugguuguaagccaccaucugguugcugggauuugaacucagggccuucggaagaucagucagugcucuuaccugcugagccaucuugccagccuccucuuuuuuuuuuuuuuuuuuuuuuuaauuugguuguuuucaucucugaguuugacuauuuccugccaucugcuccucuuggguguguuugcuucuuucuguucuagaacuuucaggugugcuguuaagcugcuaguguaugcucucuccagcuugcuugcuugugcucucucucccuuccuuccuuccuuccuuccuuccuuccuuccuuccuuccuuccuuccccucucucucucucucucucucucucucucucucucucucucccucucucucucucucuuucuuucuuucuuucuuucuuuccuguuugugaaauaaaauucuuuuuuuuuaagauuuuauuuauuauuauaaauaaguauacuguagcuguuuucagacacaccagaagagggugucagguuucauuacagaugguugugagccaccaucugguugcugagauuugaacucaggaccuucagaagagcagucagugcucuuaacugcugagccaucuccccagucccuccaguuucuuucuggaggcauucagagcuaugaguuuuccucuuagcacugcuuucauuguguuccauaaguuuggguauguuguaccuucauuuucauuaaauucuaaaaagucuuuaauuuuuuuucacuauuucuucccucaccaaguuaucauugaguagaguuguucagcuuccacguguaugugugcuuucuguugauuuuguuguugaagaccagccuuaguccauggugaugaugugugggacuauuucaauuuucuuguaucuguugaggcuuguuuuguauuugauuacguggucaauuuuggagcagauaccaugaggugcugagaagaagguauauucuuuuguuuuaggauggguuagagcaagagggcagggcuaguccaggagaaguguguacauggaauuuugaaaauagcuugaaagaaauaucaagccagauuggaaagcaauaccuaugucuuccaaaaguuacagauaaggaccugaggguuuuagaaugauaguguauuguuuuguuagccauaaaaagaaauacagaggagaaagcagcuuugacugaagaggcaaggauaaagaaaacuaggaauguaaguauguacagauguguacugaaauuuauugggcuuuuuguaccagcagcugagcuacuggcacaaaauguaucaugcucauuuuccaugaguuuauugcuggaaacaugcagguuugcuugucugugacacucugaggagcgagugggcagugauagugugguuuggacucuuuagagcucuacagucacuucaucugcacagcacgucaagaccccacaggcugccaaugcucccgaccugagugaugcaauugugaaacuguucaaugacuuugaugugaaggaaaccucccaucaucuagugauuucccaucuagaucuacacaucugugaugauauccaugcaaaagaaaaagguaaucuuacaccagacuauuuuggcuuuuguacagaucaaguaugaaacuauuguuuauuacauggaguauauauuguagaauaugaaacauuacuugaaauauuuuauugauaugaaguuuuauuuggcuuuaaaaguuaauacuuaaucauuuuuuuaaaagauuuaauuauuuauuuaauguaugugaguacacuguagcugucuucagaacacuagaagagggcagcagaucucauuacagauggcugugagccaccaugugguugcugggaguugaacucgggacuuuuugaagagcagucagugcucuuaacugcugagacaucucccagcccuaauacuuaauguuaacuuaaugauaacuguuggcuaucaaugcuaacaguaaaauuagguuuaaaaaacuaagauuggccaauaugguggcacacaucuuuauucccagcccuggagaggcagaggcaagcagaagucugaauuccaggucagccugcuacaacuacauaaugaaacccugucugaaaacaacaaagauuuaauacaugacauccuugaauaacuuacaauuaucuauaaaugucauccucuccuucaugaguauuuacaucaugcuuugagcauugugauaucaacuaucauaaaccuaaauucuauugguauuuugccuacaaaugugucugugcacugguguguguuuggucuggaagccagaagaggaugucagaucccauggaacuaaaguuauagaugguugugagcugcugugugggaacugggaauugaacccaccuggaagaauaguaagcgcuucuaaccucugagccaucaauccagcccugaguccauguucuuuauccacauaaagacagcugugucuuugucuuuaacauuguguccccugccccgucuucccagcaguucauacggaagcagauuccugugaguccacgucccuuguuuuuauccuuauuaaggagacucggguaacagggcaggcagaaaacccaggucccacacagugcuugauguuucuguuugucugucacagugucaguggcccacugacugggagaguucaggcaagcuuaacucagggccaggguuuagagccaagcuggagaucuccuuaaaauugugguauuugaccuggguucuucaggccuauaccagaauauccuuuggauuuuacugguuuuaaagcuaagaaacuauuaaggccugcguacauagaauuauucuaguuaucagacaaagcagaaugacagagcccagaaaguacugagcaaaaaccacuuggcuuuaacuucacauuuuguuacugugcuuuaaagucuacagcagaaaaugacaacuauaaaccaaaugucacacagugacagaaaaugaccacagauuccuugacagaccccaaaucuucucuuugcucuccaccccugccacguuacugcuucugcuguugugaaauucuaaauacucugaaacauucaucaguuugcagaaaacuugucugugguaaaaccuaaccaagacguaucuauuacuucacuuauuuuacuuguuuggcagguuuugcuguagaauacuuuuuauuacugagcacuacuuccgaaacuacugaauaugcuauguacauaucauaucacguucauauaaccaaaacagaaaacauuuugaguucugaaacaacucugaccaugucaaggucagaggucaacgucugggagucuuucuacccugagucggggauugagcuccggccaucaggcugcauggcaaguguucuugccugcccagccaccuaccucacugacugcuucagaggugcagaugaggaccgggagcuuugccacguuguagugaugggugggaacugggcuagcagaugacguuggcuuuguguacuugcuagugcuacuuggacucugguuuuccugaugcuuuuuuaaugauaaauucaguguuucuaauacuggcuuuguguuucuccuucucuuuuucucuucccagagucaaauagacgcguuaguggaggugcuaugcaacucucuuucacacagcugaccauagacuauuauccuuaucauaaagcagguguguauaauaauuuauuuaaaauaugcaaaucuugcuuuucaaaugacauagccaauuauuuuuuucaaauuuaauuguuuguauguuuuaacuuauuaagaagaaaagagaucaagauguuauuauuuuucuucuggcagcauugccuuagaaauauacugagguguagauuauuagaaacugcagcuguuaggaacugacugguuuggguuaagguaucacuaaacgauugagaacuugaauaguguguuuggguaauggguuugauccacagcaucucucucucucuccccaccucucuuccccccucccccucucuccccccccccacaugaguugagggggagaaauaaauaaaauuauuuaaauaaauaauuaauacauuuuuguuugguuuguuuucugaggagguuucucugcaguccuggcugucauggaacuaguuuuguagaccaggcuauccucgaacucacagagaaucugccugccgagugcugggauuaaaggcaucugcuguaacacccagcauaaauacauuuuuuacagcuuauaaaaauuuagaauauaguaacauucauuuguauuauuuuauuugugacaaaucaaaucauuagucaauaguuuaaauuuuuaaaugauauuggaacuuuuuuccacuuuucuguauuuucuaaauucaucaguaagauuuuauaggcucuuuaaucaccaaauauguauauauucuuuucucccaaauauccaaaacuauuaaaauaggaugauuuauuuccaaauuaauuugacuaucauaccaaucuuuuaaauuuugguaguauauuauuuuuuguuuuguaauuuacacaaauaagaaaaagaaaaaaaaaaaaaaaccccgggggcugaagagauggcucagcggugaagagcacugacugcuccuccagagguccugagugcaaaucccagcaaucacgugguggcucgcaaccaucuguauggguucugaugccuuauucuggugugucugaagacagcuauagccugggaugcugagcucuccuguaaucaaggccaugucucaaaagaaaagaaaacugacucuugagaaaagugacuguuuuauaaaaagcuguaacagaauagaaaucaugcgugcaguaaagguccucguauucacuuugcaggagauaguugcagucacuggauguauuucagugaugcaacuaaaacaaaaaacggaugggcuaaugaguuguuacaugaauucgaaugcaacguggaaaugcuuaagcaggccaugaaggaccguaauuuagguucaccuccuaaauccccgacacaugccucuccccagcacacacaaacagguauuucaccuaaugacaugccccugauacucaaacggggugggcuggggugggaugggggagaggaagggagggugaggauauauuuuuauaaauauuauuucuaagcauuauuuuaaaauuuuaauaguuguauaggcacauuauauguguguauguuuauguauggguuugugcacaugagugcaaugccuguggaguuagggagggcaugagauccccuggaauugaaguuguaggcagcuaugagcugccuaacauggguacugggaaccaaacuuggguccucuguaagagaacuauguaugggcuuuuagcugccgagucagcucucuacuuuuaagauuaauauaacuaauaauaguaauaaccacuuagaauauuuauauucuuaaguggcuugcuuguuaaucuuuuacuuuaacauucugagggaguggcuuaaaauguaauugaaaauaugauucuuguuuuaaaaaaaucauuauaaaagccugcauucuuauauccauguauauuaccuuguuugagaaauuuagcuuucauuuguuucuaguagcuuucucuaagcagauuaccuaugaaaaguaauuucuuaauaaacuaaaaggaguuuuuguuucucacagagaaagacucaacucugaaagggacuccuaaaacaccuucaguauuaccucaaccgucaaaagcuaagcucaugucuaguucuguuguuguuagacuugcagauuucaauauauaucagguauguauuaaaucuuuucauuguauaagcaacccaauuaacuaauaccaccauuuaucuuuaaagaucuagacugauuuuaugaaaccuaauuauaugggguugaaacuaucaguuugcugacuuuuguuaccuugacugacacaagcugaguggcgcugaggcuucuucaccauacagucuugggguugccuaaaacuacacgcagcuuagugcugugcuuaaagccucacaggucucugaaaucuguuuuguucauuuugauuguaaagaaaaagaauacaaaguagaaugugucguagagacaaugcacagggugcagucugggaaccuagagugccguuuaggcugucaguguagcucagugguagagcuuccuuagcauucagaaggcccuggguucccuagcaccucagugcagcugaggaguacuagggagcacugcuguacuuggagugcugcugccuuguggcggaaccauccuggaguugucugauggcagaugacccaguguuuuucucaaccucuaaccacuaagaggauuauccagugucaccagcucaaaccacagucuucugguuuuccuaacucuaucaguugacauugugaauaggaaauuaugguuucugguuaucucuagggagcaggagcaaagcccagagcacuuggagaccaaauuucucagagcgcagugguguguguggaagaagcugaagcaccuuucuugcugugugcucaacccuuguagauuaacugcugugaacggacgucccugugaugggcucugccucacauguccuguuucacucagucauacuguggucaugcuuuauucagucaucacgguaauacacaacauagccugauaguuuguuccaucuucaggaacaauaccuuauauuugaccugucuuuaaaaauaaaaacauuuagauuccuauaaucauuuauacgguguuagcauuuauugugguaagucuuacugaaaaguuucauuugcguauauguaaagcccugauuauuuucuuauugugcaauagcuauuuuuuuuuuuacaaauuguuuauauaaugcagcucauuuacuugcuguuugcuuuauuuuucuuugugacagacucucacguagcauaggcuagccuugaaucuccuauguagcuauguagcugaggcuagccuugagcuguguuuacuccugccucuaccuccagugagcugggguuauaggcaugcaccacauacuuagcuuuaaaguagacuuuaaauuuuaacauuuaaguaaauccauagggaaaugauucauuguucauagaguggugaagaaacucuuuaucuagaaacauuugaaaaaccacaaaaguaaaaaaugacagaaaguagugauguuuucaucauaauuuuaauaacuuuaacaauuaaaaauaugaauaugcuuuuguuuauuaaguugacaauauuaagaaggauuuguuucuuuaaugugcagagggguuuuaaauuauacaauguaaauucccuuaaaucuuuuuguacaaguaaccagaaaacgacuauuucaagaagaaacauuaucaaaagaaaaaauauucuacuaaugcuccauacaagaaauagauacauguggaguuugcaggauggcugagcagguuaaggugucuguuuccaagccucgguuugauccaugggacccacaugacaaugagagaacugacucuagaaagugcccuccaacugccacauguauguguaccauggcgcgcacagcuacacacacacacacacacacacauacacacacacacacacacacaggaauaauaauaguagaaaaggaauauagacauuuguugaacaaagagacaguuaaagcaauuuccaauccugguaacuuagccuccauacauacauugauaaagcuucccuaguugagaacuagugcacucuuuuugcuacaguggcucucaggugugcaagccucguagcucugguugaccuugaacuuccuuuucuccugacugaaucuuuaaaauccuggauugcaggccugugccaccaugccuggguugugcaguaacgagcuggggauugaacucagaggucuguauaugcuaagugagcgcucugccaacugaguuacauccccagccuaguaugcauacauuacuuuaacuuaauuacaaaugagccauuugacaaaaguaguuuaagauauauuuauauuuuauguauacauauaaauaaaaccaggaccuuaaaaauaauaguccucauggaaaacaauuaagagaucaaaugacuuugagugaacuauuuauauuauacuguguuuuacaucaauuguuucuauaaaauugacacaauuuuccauuauaauuacuuuaaaauuacuauuuguugaaauuaaauacauucacagugugugacugccaccaccaucucucuggcaguucuuuucuguaucacacacuuuaaaucucuuucauauuaauagagaauuauaaaguacagacugagaaacagucugacuuugauuccaaucuguguccugaaucuaccacuuacuuaucuacacuaacuaacugucauuuuaaagacucaaaagaguaaguuuacugaagguaguguaaaaguugaguuuuuaguugauaaagauccaauugguuauagaguuuucugaauggcucauggauauuucauuuuggguauucuuuuuauacauuuauuuauauauuuagugugucacugacacccacaccccugcccacaacacagcauuuuuguagaagucggaggacagcuuguaggacacagucuucuucauuucucaugugacuuucagcgcugaacucaggccagcaggccuggcagcaaguacguuuacccacacggcccucuugcuggcccagaggugauuguaagagcuuggaagugauggcuaugugggcugcagaaauucuuuggcaaguuguuuuuuucgguauuuaagcaaacuuguuuucucaggucucuacagcagaacaaugucgaucuuccccuaaaaguaugauuuccugcaacaaaaaaucucuguaucuuccacaagaaaugucagcuaucuauauagaauucacagaauauuauuauccagaugggaaggauuuuccaaguaagagaguucacuuuguuauuguuuguucacaauuggauuuuuugaugaauauuuuagguauuauuaauuuauguaggaaaauguucuuuucuuuucuuuucuuuuuuuuuuuuuuuuuuuuuccgagacaggguuucucuguguagcccuggcuguccuggaacucacucuguagaccaggcuggccuugaucucagaaauccaccugccucuguuucccaaaugcugggauuaaaggcaugcgccaccacugcccggccagaaaguguacucuuaucgcuguguuuaugacacccauuucauguggacaccuuuguuccuuacacaucugcauauuguuaauaguuguuuguacauccuucuuccuucuacuguggcaucuuugauggcaggaaucuuguggcauuugugauugauuuuauauuugcaguuugugcuucuauccugcuuuuuuugugcuuacuagcuauuuguuaaaugaaguaugaaugaauguuauguagagaguggucauuuucuuuuauaaaauuccauuggcaaagucagauauauaaaaauccauuuuauuaaaaauggaauaauugaaguuucuuuuagcuauaaagaauuuuucuugacuauuauaggcuauuuuggcuucuuaaaguuaaaaugauuguacauuuguuucuuugaauauuuaugccccuuuguuuuguuuuaucugaaaugaagucuuucuuuauauuguaaucuucauaugugcucaugcaugcauguguguauuugugugcgugugcgugugugcacacaugcaggcuacagauguuugugugcauggaggucagagaccaacuucaaguugaugucauucuuuuuuuguuguuuuuaauuuuuuuccuuugauuuaaguuuuauugcauuaugaugagaaaaaaaaccauaauuucaauuuaucugaauuugcuaacauuuaaaaacauauuuugauuaaauagacuuauaucacauucuuacauucuuccuucccuuuuauaccccagcuccucccugugaguccccccaaaaaaccuguaauaccuuucauuuuuuaucauauucuuuaaaauuuguaaaauauuauaauaauaaaaaugaguaguauaaaaguuguucgauauaaaacaacaaucaauugaacagucuuauguagaugcuugucuacagcaauacugaaaauauauuuucucaauauaaauuuuaaacaacucuaaauauauuagcuguaugauauuuuaaaauaauauaucacuauuaguuuuuuuuaaaugaucacaaauagauaaagucuucuguuuguuugcuuuguuuauaguagugcuuaaaauuuuggcucuuacugugguacagacacaaacuaagaacaguuuuuggccauugcuguucacuguaauaaggcuguacuugaaugucccugacaucgcuaauggauuuucuuuuaauccuuuuuuuuuuaaagauguauuuacuauuuauauguaaguacacuguagcuguuuucagacacaccagaagaggacaucagaucucauuacaggugguugugagccaccaugugguugcugggauuugaacuugggaccuucggaagaacaguuaguucucuuaaccacugagccaucacaccagcccccaccaaaggauuuuaccuccauaguagauaagcuaagaguugacaguucugcuaugcuaaggaaugaauuguaagcaugauuuuuggauacagauuuccuguuauggucaaagcuauuugacuugagugauugucaucauucucagcccacagggaacaggguacauucauuuaagaaaugguguguguauuaagauggucuauccaugaagucguucaucaacuguuucagugagccaugguucugcuuggaggguggcacagacguuaggugaggguaagaucugguuuauugacugugaugauuuugaaaagcauucaucucagaauaagaguaauguauaaagcccucuucuucaaaauugauacaauaauuauaagugucaagcaaagccuucagucucacucuuggcuguucucuuacaagccaccacucaaauuaauugucuacauuucuuuuggcuguauaaauaauuuggaaauauguaagcugcucugaaaaccacaguauaguguaaaaacaucaaauaaacaauccuacuaauagaggcugagauaggagaagcaugauuucaagaccauuauguggcacacagcaagacacugucauguacaaacaagcagaaaguguauauggauugaacaguauuucucccauuaccaaauuagagagaccaugggaugacagcugacaaauuucuauuccucauauuuuugaauuuaauagauuaggguauauugguaauauuaauuuucauauuaauagauauuaaggaaaagugauuguuacuuccuguuaauuuucuuguuagagguggaauuauguuuguauggguuuguggaaagaugacuuucuuguuucuucuaggguguaguuucacuccuuguguugguguuucccaucuauuauccucuguagugcuggauugguggaaagauauuguguaaauuugguuuugucauggaauaucuuguuuucucugucuauggugauugagaguuuugcuggguauaguagccugggcuggcauuuguguucucuuagggucuguaugacaucugcccaggaucuucuggcuuucacaguuucuggugagaagucugcuguaauucugauaggcccgccuuuauauguuacuugaccuuuuucccuuacugcuuuuaaaauucuuccuuugucuagugcauuugguguuuugauuauuaugugacaggaguaauuucuuuucugguugagucuauuuggaguucuguaggcuucuuguauguucaugggcaucucuuucuuuagguuagggaaguuuucuucuauaauuuuguugaggauauuuacuggcccucuaaguuagaaaucuucacucucuucuauagcuauuaucuuuagguuuggucuucucauuguguccuggauuuccugguggauauuuuagguuaggaguuuuuugcuuuucgcauuuucuuucacugcugugucaguguuuuuuaggguaucuucugcaccugagauucucucuuccaucucuuguauucuguuggugaugcuugcacuuaugacuccugaucucuuuccuaggguuucuagcuccagggcugucucccuuugugauuucuuuauuguuucuaguuccaguuuuagauccuggaugguuuuguuccuuuccuucgccuguuugauuguuuuccuauaacucuuuaagggacuuuuguguuuccucuuuaaggacuucuagcucuuuaccuguguucuccuguauuucuuuaaggaaauuauuuauguccuucuuaauguucucuaucaucaucaugagaagugauuuuagaucugaaucuugcuuuuucugguguguugggguauccaggauuugcuauggugggagaaauggguucugaugaugccaaguaaccuuggcuuuuguugcuuauguucuuaugcuugccucccuccaucugguuaucucuagugcuaccugcccugccugugucugacuggaaccuguccuuccuaugauccugguugugucagaaauccucagagucaagcuuuuucucugauccuaugauucugggaucuugggagucaagcugccuuugggaccuugagauccuggugagaucaagauccugggauccugggauccucugauucuggguguguuagccugggaguggagcugccucuggguguuguggggcuggcugcagaguuugugcccuaggucugcucagggcgccgacccagacagaccagaaggaacuugugccacuggucuggcggaguucaugcgugccuggggcccaccagucccacuuacuccugguguuggggacagauauuguguccuccucaccucuuauccugggcauauuggagugccugggaguagagcugccucuggguauuacggggcuaucugcagaguuuguguccccuccgaagucauucuuuuuuuucuuuucucucucucucccuuccuuccuuccuuccuuccuuccuuccuuccuuccuuccuuccuuccuuccuuccuuccuuccuuccuuucuuucuuucuuucuuucuuucuuucuuucuuuuuucuuuuuuuuuugguuuuuugagacaggguuugucuguauugcccugacuguccuggaacucacucuguagaccaggcuggccucaaacucagaaauccacuugucucugccucccaagcgcugggauuaaagguguccaccaccaugcccagcuccaaugucauucuuuaugaacuguccacuuugacuguuuuguuugucugucugcuuuguuuuugcuuuggccuuuuuuagauagggucuuacuauuuagucuggccuauccugguacucuuacuuuguagaccagucuagccugacacuuucuguguagaccaagcuggccuugaacucugauaucuaccuaucucuguugccuaaaugcugugacugagggcagggcauguaccaccaugcuugacaguuuguuuuuugagacaagauguuuccagcuuacuaaguauguuaggcaggcuggcugacuggucuaucccagggaauccugccucugucuaccucccuauucugggauuauaggugccauaccuagcuuuuguuacagaauucuaagaacucaagucuucauguuuguaagaauuugucuguuuucuuuaaugcugauuuacuuuuuuaaaaauaauaauuuuauauauaugaauguuuugccugcauguaugucugugccccaccugcauauaguaugcagugaagccagaagaggguaucagauccccuggaacuggaguuacagaugguugugagcugucacauggggacuuggaaucaaguccagguccucugaaagagcagcucacucaucucccuagcucaguuugacauaguaauguaggcuuuuaguuucaguaggaguuuuaugcuccugaaguaauuuuuguuuuuguuuuaaaauaaggcauuuuagaaaucacuuuagagaaaugcauuuugucaugcuauuuuuuuauuuguaccaaauggaugacauggaauccuugggggggggggguuucuuucuuucuuuuuuuuuuuuuuuguuguuguuguuugcuuugcacuauucuucugugugugcauuuaagaguuguuucucucaacuccucuucugacuaagaagguaggguuaagauagucugaaguauauucccagggucucauaagugacagaagagcacaccugaaaugcaggcauggucuguccauauuccuucccacagugguaugcugcucccaagccauccauggcagccauucgccugucaucugaucuuucuugaauguuuccaugguguuguaccuaacuaaaauguuucauucuccaaggauugcuuucuuugggguaaagacuaguuuccaggugccauaacuucaaaaaaaaaaaaaaaugagacagugucuuacucuggcuggcuggcuggccugcucuauugaccagauuggccuucugccucugccuccuaaugcuggguuuaaagugcacaccauugugcauccaucagccaugugggacauggguccacucauaugggcucacuuugccuucauaucuucaagagcucugucuccaaauagucacauucugaggugcugaauuuaaaccguaaacagaagcacuuuagaggcgugggguagaguguacaguucagcucauagaauaagcauaguauucuugaucuuguuuuuaacaugugugccucuuugucguauuugguuuggauccugccccuuccccuuaacauuaggagcccaggacaggcuccuucuagcuuaguuugcacuguuugaagggcugagauggaacuaugcggcaugcuugcccggcaucugugaugccugcuuucacuccucaguaccaccaagcccaagacaagcagaaacugacaccagaacaacaaauaagcagguagguaucccugagcuacauggucaucugaagagccuguuagcaaugccacauggagcccagggcugccccguguggggacgacgucucgucgucuauggcugcugccaucacagucucucuuuagaaauucccuuuauuccugagugugaugcauucucugggcacucuacuuccccuuaaucccaaaggcaaggaccucgacaucacagcuaguuucuaaucacaacuuuuuuguuuuaugucugucucauguauggaaaguuaaauggaauuggacaucccuuauuucuucuauguucugugucuguagcauaaagccuagggguagaccuucaaggaagcuucuuugcuuuuaugaauggaaugaagagaugagugcagguacccaaagucaaacauagaucauccugugcaauguucuuugcaccugaaaacauauguguauaguuacuguguccuuacaaauguccuaggcauguuuaccuaauaaucaugacauuuauaugcauagaagguuguugaucuuagacaaguuuagaucauuaaaauaaaguaugccugugcugguggcuguagaagcuuuggguuuucuuugggaugucuuaguuacugcaucuaaacuuaaugcucugucacuuuugccauuuuguuaacaaugaugugcucuggccauccacccccaccccccagaauggcuuauuccauuccuacuaaauuucaauuggacugaagaagaaacuugcucgcucagcccacauuuuacuuucacacaguacguucuguucuuaugguuuauccuuggaccgguaaccacgccuguccaccuguguccugucuuuaucauccucaaggccccaguaaaucaucucacgucuacuccuuccgucuuucaaguucuucuagccacagggccuucagcuccggacggggaugacuuaggggcaguagcagagguuucagcccaucuauccucugccuacugcauuggccuuaggcuuugggagugcagaccaucaugguggagaggcaugguagagaagaccucauuucuagaaaaaaaggggggggcuggcgagauggcucaguggguaagagcacccgacugcucuuccgaagguccagaguucaaaucccagcaaccacaugguggcucacaaccauccccaacaagaucugacucccucuucuagagugucugaagacagcuacaguguacuuacauauaaucaauaaauaaaucuuuaaaaaaaaaaaaaaaaaaaggggcuuaaggagaaaaaaaccaagccuauauguauucaauuagaaacaugaguugguucuguaggaggcaguaccaauacacugaaaaaauauccauaguuaucagaaacuguaggacgcuucacuugguguaucaaguauuacuggaaaauugggguccuuucucaggauucuuagucuuguagaauaaagaccucaucaagcuguucugaacccuguaguuuuuaugauuaauauacuugcgguuucagaagagauacaaccuguaauuaucagcauuaguuuagugggaggaaaccgaguguauaauaauggauuauccgagacauuucaguuacugcuguacuugaaagcucuguucuaggccauuguuaaagaggagagugggcuguguaugcucuccccucaugggcuuucugccuggcacaccucuuuauaggacacagagugugaugcagauagguagguagguagguagguagguagguagguagguagguagauagauaaauagauagauaaguagguagguagguagguagguagguagguagguagguagguagguagauaaauagauaaguagguagguagauagguagguagguagauagauagauagauagauagauaaauagauaaauagauaaauagauaaauagauagauagaugaguagguagguagauaaguagguagguagguagauagauaggcagauaggcuuuacgggcaggccaugauuucgacaccgugcuuuaagagggugauguuuuauuacucugcuucacugugaaucuaacaggacucccaguuuaugcauuuuauuuacauuauauuuuuuucaguuagugaagcauagaaaaaugucuuaugucuauauuugcuguuagucacauauguagcuucaugugugauauugauuaaggagaaauauuacuuguuaaggcuaucuuuucuauggaaacauaacugucuguucgcugagggagcuuaacacuuuucuuuuuuuucuccacaguuccaucucccaaccuauauagccagcugaaugcucuacaguuuacuguagaugaaaggagcauucugugguuaaaccaguuucugcuggauuuaaaacaaagucuuaaucaguucauggcuguguacaaguugaaugacagcucaaaauccgaugagcauguugacauccgaguugacggcuuaaugcuaaagguaucguggaaacaaguggggcuucaugcuaaagguaucgugccucugccuccuggguuuaaagacauguccaccacacccagcugagagcaaagccauuuuuauagauauaaaacugacuaauuguuauaaucccaggauauaacgugcuguucagacgugaguaagcuuaauuauaaucuuaauuucauggugaaauguaagauugaauuuugauucucagcuauaggaaaucugagaguguuuccucuacuuuuguguauuuaugauuuuaauuuuucugacuucuauucauuugaaaguaagagauagcaguaaaauguaaaucuuuagugagauggugcaguggguaaaaauggggcauguaagccugaauaccugaccuuaguccccaggucccacauuaugggaggaaaacugacuccugcaaguuguccucugacuuccacaaacuuccucugacagcaaauaauaaacaagucacugucacauaaagagguuuuaaaaaucuuuaguccuuuuuguuccuguuauaggguuuauacauuuuuuuucuucuagaaaagguuaaguguacagcaaaguuuuuaaaguguaugaguugcauuuguucauauuauucaauuauuagugucuaaaguuaacaaaacuugcuuuguaaguaaguagccacuaaucuaauuuguauacaaucuuagguuuuuaaaacacauuuuaguaaaaagaauaagauguggacauaacugacaauuuacugaaggguccguuguugauagauuauguguuguagccgcuuuuauaaaacauugugcagcuaauauuccacauuuccuagcauauaaggaaaaaucuucucaacuuagcauaaaggaacauguuguuuaauagugcuugagacagaacuaaacaaugaucauuauauuuucugggcaugagcaguacccagaaaccacuuuggacucuuugcuaggaacacugauucaguucccucuugagaacuaugucauaagucugccuuagucucacugucucagcauacccugccuguucuccagagugcuacgauuacagcugugugcucucuugcagccuggaacaacaagucgggugacaucugucuguacaguugcugucauucuuucagucuccuagaacacuugggcuuaaaaguagcuuaacaaaacuaucgaauaucgcuuuuucacacuuagugcuuuuuuguguguguacucaaacauuuaguaaguaagagauggcucagugguuaagagcacugacugcucuuccagagguccugaguucaaaucccagcaacuacaugguggcucacaaccaucuguagugggaucugaugcccucuucuggggugucuaaagacagcuacaguguacucacauauaauaaauaaaucuuuaaaacaauaaaaauaauaccaagucuuuuguauuuuucaugauguagggauuuguaaacugaacucaauuuuuuuccccuuccaguuugucauuccuucugaagugaaggcagguugccaucaagaucagccucacacggugucuauucagagcucugaaaugauagccaccaacacgaggcacuguccgaacugccgccauucugaucuagaagcuuugugucaagacuuuaaagagugugacuuuuuuagcaaaacuuauacuagauuccccaaauccugugacaguuuuaaucuucuacaucccaucuuccagagacaugcccacgaacaagauaccaaaaugcaugagguuuauaaagggaauauuaucccuaaauugaauaaaaacacucuuaaaacaucugcugccaccgaugugugggcgguguacuuuucccaguuuuggauagacuaugaagggaugaaaagcgggaaggggcggccaguaagcuuuguagaugcuuucccucugucuaucuggauuugccagccaacaagauacgcagagcuacagaaagaguuccagacuugugaucaagugacccuuaauaccucacaaagugaguccagugaucuggcuggccgaaugaagaggaagaaacucuugaaggaguauuacaguacagagucugagccucugacaaauggcggccaaagaccuucaucagacacauuuuuaagguuuuccucuuccucuucagaugcggauguucaugucuugguccguguucauaaacaugucaguaugcagaucaaucacuaccaauaucugcugcugcuuuucauacacgagucucucguucugcuuucggauaccuugcggagggauguggaagcugugauuggaagccccgcuucccagacuucuguuugcguuggaauuuuacuucgcagugcggagcuugcccugcugcuucauccagugaaucccacaagugcucugcgcucuccugcuucugaaagugggagcccauugcuuccugacuuccugccagcagaaaaugggggguuuuugucuucaaagagaaaacaaggugguagugguauacaccgaauuagaaaugcuacucucaaucacaugucagacaacaggucaaugaguguugaccucagccacgccccuuuaaaggauccguugcuuuucaaaucagccagugacacaaaccugcaaaaaggcacuucuuuucuagacuacuuaucagauaaacauuuagggaaaauaagugaagaugaaaguaguggacuuucucacaagaguggcucaggagaaaugaccucagaagggagucacacaaaggauguggcuuccacagacucagauagugucuuaaacuacagagauggcucaacuaggcuuucccuggaugaugacggcaaccauaacccaccuucaaacccuguaacugguaagggaauugacgccauacacuccaucuucagagcugaagacuuccuuccugaagcagcuucccucucugagaacccggagagcaguaaagaggaggcgcccccagccagagcaccuaaaucccagacguccuuaagguaauggugcaguugcaauggaagugguuuuaguucuguuguuucuuuggcuuguuuauuuguuaguuuuguuugggaguagaaaaccucaggacaaaguguggcauugucaggauuaagagucuguguucagaaucugagauagcccuuacuuguaugucuugguauacuucuuagcacuuacuagcuuggggacgcuaugugaugcuaccuuuacuacacgcuggcuuccuugcugggccugugucuugcugugguccggcugggcuaggacuccagcacuccuuuugccucugccuccgcaguucugggauuccaggggcccucccucuccccagcacuacuaagaguggaaggcgaaguccuuucaauaccugggguaauuuuccauugauuuuguuugcugacagugcuaaaucuaaggaacguugcccacccuccccagcuccacucucuguuuccuacaagaacaugaaaaggagcgccucacaggucucccuggauacccuuucccuggacagcaugguauuggaagagcaggcggagagcgauggaagcgacagccacguguugcuggggaaggguaagugaacagaccgcuuacaagaaguacuauguaaguacuuaaaguuguaccccacgcuuauuaaugacaucgaauggacagacagaaugacucaguucugaacgucuggcccuguccuccuagcugugacuugcuaguggcuguccuuuugcuagcaggacuccucgaguuaccccuuggaauuugaucauguuauuuuccaguuuaaucuuaggaaucuucauugcuucaaggcugugaaauuuagaauucuuaauucguuuugaagauguucuuuaugauuugaccucaguuuaguuuuucuucaugucguuuuuccuuccuuuaguucuuuuucaagaaauuauauucaucugucuauaggagaguguggggcaggguagcacacauguuccauggcaugaguagaggucagagggcaaccuguaggaguuguuccucucccuccaccgagugucaaacucaaguugucaggcaugguggccuuuacccacugagccacuuugcuguucccaggucucacuuucuucacugugaagaaugcuucucuguuucacaguauuucuucugggccuggagagcuguuuuauuucuguacaguuuagcaaaaaucauagacaucuuaucccuggacuaugagaaagacugaaauguucuguuaacaugcaccacaguuaccgccacauacaccucucugucuccauaucuggugggauauccacuuacugaacgucccacacucaggggcaugggguagaagccagcugguuacacggcaguaaagaaggagcugaguuggggguauaguuuuugugucuuggacuucauuugaguuuuaguucuuuuauggcauuuuacaauauuaaucugugauagauacaaaacuuaaugaucuuauuccuuuucucauagauagcuugagggaggagaauagucacacgauauucaauucaugugagaggugauuggggcugcuguaggguggggagaagagagagggacucagacuggaucugugcagugugugacgaggggagaugugaggcugacaggcaggaggagguuugccucucaguuccuucugaucaucacugucacuguuaguucacuacaguuagggcuuuaguaucugacuuagucaggguuucuguugcuguaaagaaacaucaugaccaagagcagguuggugacuaaggguuggucuggcucgcacguccagaucguagaccaucccuggaggaagucagggcaggaacucacacagggcaggaaccuggaggcaggagcugauacagaggccauggaauggugcugcuuacuggcuugcuucuuaggacuugcucagccugcuuucauacaggacccaggaccaccagcccagggguggcauggguggcaugacccacaaugccgugggcccucuccuaucagcucuauagguugguccccagccagaucugagggagguguuuucuccucucacgugacuguaauuugugucaaguugacauaaaucuaaucagcacaguauuucuggcauuuaacuauaggaagucauuucucauuugcugagagaccguaauuugacucuguuugcuuagagguauuuaaacaaggcuuugcuugaaagcauucguccauuuuucaauaaauauaaacauugcuggaacauguauaaacagaucuuaguuuauuaauuuaccuguguguuauuucagcaaugaaaaggaacucaaauacaagcugccagagcccagcagagagugugaacacaagugcaaauacgcagacuuguggggaagccucuccagaggcugucagcaccaacucagagggcacgcaggagaaccgcgacgaucugguaccggcccaggguucugugggaagaaaggccgccugucccuuaugcuucaugcaagcaugucugaggagcuccaucuauacgauggccacucacgugcuguacggucugcgcgcggcuucugcuguggacaguuccuuccgcuuagcuauuccugugcuuuucaguugaagucuguucgguuuguauugaagaaaggaggggaguguucugugcauuuuuucugucuccguucccauuuauaucuugaccgauauuuuaguuauuuuuuguguaaacuuuuuaaagcuugucagcucagaaggcauccaguccucacaguaagaguccuccuacagacgagauagacaggaugcuaguuucuuuuaaacuuugccgacacagugaagcuuuaugaaaaaaauguagacacacccuccuuuuaguaaccaucccuucauaaggacaugucacauuauuagucuuuguaagcagauacuuucucuuuauugacagaggacagaagccucuggagcucggcuacaaaggcggaacauccuuuguccaaaauccuugaguccagacguaguuuuggacuuaagaauuugguggauuugggaauuauccaugugugguaucuuggacauggaacuugauucuaaacgcaaaguggauuauguuuccuagcuugcuugcacacagccucuagguaacguuguacagguuccgagaguugcgggaaaccacucggggcuauggagguucuuacucauggcauugcccugucccguggaaaguaguccauuucuaauuuugaacuagagacgcucaagcuauagaaugcaauagccaggcucugcgggcccccaaggguggcuugacugauaagugagaacuguauuugcugagguuaauauuugcuaauuguuuccuuaauuguuuucggaauuccauggaguacuaacuguauuuauacacccauugacagaugucagucgugguguuuagaaucacugguguuaauggagaaauugacauccgaggggaagacacagaagucugucugcaggugaaccaggugacgccaagucaguuaggcaacgucagucugcggcauuaccuugguaaccguccaguugguaagguuaugguucacacagauuguguucuauacguggcucacuaauagucuuguccuugucauuaugacucagcuggagggagaccauauugaauaagaugucagugaauuuuuuuuuuguugcuguguguauagaauucuauaugauagauaauguauagaaauuaauauaguuuggcauaguaccagaaagcacgcugucacuucuuuuuuuguuuguuuuuuguuuuuguuuuuuucaagacaggguuucucuguauagaccuggcuguccuggaacucacucuguagaccaggcuguccucgaacucagaaauccgccugccucugccucccaagugcugggauuaaaggcgugcaccaccacuacccggcuaugcugucacuucuuauccugggagguggaaggaaacauaacaagcagggcucacaggggcucacacagacugguguggccaucgcagccugcaugggccuguccuaggccugcugcauacuugcagugguuguuuaguugggguuuuugugggaacccuaacagugggagugggggugucuuugacucuuccuacugguuaccucaccuagccuugauaggagggguuguaccuagucuuacuguaucuuguuauggcauguucgguugauauccucaggauggcugacucuuuucugaaggagaauggaggagcaguggaucuggggagaggggagauggagaggggaccugggaggaggagaaggaugggggcacugcagucaggauguauuugugagagaagaguaagugaaaauuugaaaaaagacuccaggccuuuuuuagccuuuguaaccaaaauacuuugucuugacugacugaaaacagaaggcgcuggaguuugucuuuaccgucuugccccuucugauguggggucuccuuguggggucuccuugcugugcuguguacuuguuuucuucuguuuauugugacauuaguuggcauaaaauaaagaaguaaaauauuccacuaguuucuauuccuacauaguugauaucaguuuucuuuuacuaguauccuuuuacauuggauauaguauaagacucuguugaaguuuaaaauuuuauuuuuuuauguugguguuuaucuccauucucaaccaacucaaauucuuucuuggaacaaggucaacccauaauuagauguaauuauauaugaauuacauauucuuuacuauaaguguucuucgggaauguuucaaugucgugucuucuuuagacuuucacauuguuuaacacccuaauuuauugaggaagaugaaaagccuuuguaagacucacuucaccacacuuagcugucuucuuauagacauggccagguacucacgugaaguguguauccuaucagaguucaucacgaauauacuccuauuaugaaaaaguagaaaauauagaaacguugccaguaguguauuuaaaaauugcagagaaaaagugaaauuauauuguuuuugauauauuuuauuuauaauauagucauuuaaauuaguaaauauuaaagcuguuucauagauuucuuuaauaugcaguaucuuugauauuuuuuacuauaauacaauggcauauaaugccauauauaauggcaacaauuuuuuuguuauaauauguggcaauguccuuuuuugguaguguuaguuacaaaauuacauuuuuuuauguuuguuucucagguucugaccagaaagcuauaauucauccuaaauccucgccugagauuucucugagguuugaaagugggccaggugcugucgugcacucucugcuugcagaaaaaaauggauuucuccaaugccacauugagaacuuuacuacugaguuccuuaccucuucccuucugaauauucaacacuuucuggaggaugaaacuguugcaacaguaaugccaaugaaaauacaaguuucuaacacaaagauaaacuugaaaguauguuagcaauuaacuuuuuauaaauguucacauuaccuucucuggacuucgauuugugucuaaaucaugguauuccuaaacugugucgucugucagauuuuaugaaaucgagugacuaauauugacagugaaugcuacagagauccuuuuuagaaagggaaaauagugcagacaauuuuucugacauacuaacuaaagguauuuauauaaaucuaugacaucauguucuuucaaguugacuguuucaguauuuucacuuauuuuuauaagagcaugacaguauuuucucuuuaccuguaggaugacaguccccggggcagcacggugucccugcagccgagcccugugacugugcauauugaccgucucgugguggagaggagugaugauggcucuuuccacaucagagguacccuggaaaugacgccacggcacagucacgugcugcuggguuuugucucauuguacuguauggggcuuuucaguagugacgauuggggaaugcuuuugccacguuagucuacagaauccguguaaacccugcagugaugcagcaguaguaagcuucauaccugugcugcagaugugucuggaaugaaaggaagaaagguguuugugauuuuguguucucucucucucucuccccccucuccuccccccucccucccucucucucccucugucucucucucugucugucuguuugugugugugugugugugugucuauacuucaugcugcagugagcaugugaaugucagagggaaaccucagauagugggucauucucacuuuccaucuuguuugcagcagagccucugucccuuaucacauuguacuucaggcugccuggccugcaaggcaggaauucucugucuuugccuuccaccucccauaggaacacuaggaguacacaacuguuuagcuguuaagaaaaagaaagauaugaaauaugcauggaacuggauggagauagaaacaaacacccugugugagguaacggaggcccagggagacgaagccugcgugcaucuucugaauguggaugcuaguuuuuaugcccuggaugugaagguuuguuugagaaucacacagaaguaggguagcuggucagggacuaagggaaggagugguucuucccaggcuaugaagggauaaaggagaacuuagaugggaggguuaauggggaugggaggucaggcuagaggaggggucugggguggagauagcauauacuaaaggcuucuugaaagucaggugaagaguuuacauauagucaccauaggaugagaaagacaguaucccagcuaggcauaaugcguuaccaaauaaaaucccccaaauggguuacaucuugaguucuuggccaauuggguuccacuguccaccuaaauaauacagcauauugcccauacaguauaaccaacuugguuacuuuccacaauuugaagguuagaucuguugcugaagacacugcauauuuguggcauagacaguggagaauuugaacuggugcucaacuguaagcuucagcccuccuaguggcauccauagugcuggagugcgggacacauggccugagugcuggacacaugaccugagugcuggacacauggcccgagugcugaacacauggcccgagugcuguacacaugaccugagugcuggacacauggcccaagugcugggcacauggcccaagugcuguacacauggcccgagugcuggacacauggcccaagugcuggacacaugaccugagugcuggacacaugaccuccuaguggcauccauagugcuggagugcuggacacauggccugagugcuggacacauggccugagugcuggacacaugaccuccuaguggcauccauagugcuggagugcuggacacauggccugagugcuggacacauggccugagugcuggacacaugaccuccuaguggcauccauagugcuggagugcuggacacauggccugagugcuggacacauggccugagugcuggacacauggccugagugcuggauacauggccugagugcuggacacaugaccuccuaguggcauccauagugcuggagugcuggagugcuggacacauggccugagugcuggacacauggccugagugcuggacacaugaccuccuaguggcauccauagugcuggagugcuggacacauggccugagugcuggacacauauccuccuaguggcauccauagugcuggagugcuggacacaugaccugagugcuggacacacaucugucucacccagcugcaaacccugugaauuacaauaaugacauucucgaagauaugcccguuguuacaguaguagcauuaaugauauggcaguaaccagcaaauauuuaauuggauuuaaagccuauugcaugagauggagccuauacgugguacuguuaaugaggcgaagaaccuaagaccggagagaacaugggccuagggguaaacccacuccagcucuacagggcuuaauguccucuucuggcuuccacaggcacuguacacacacacagacacacaugcaggcaaaacacucauguauaaaauaagaauacaacaaaucuuaaaaacuuauauagguuuaaacacagccauaucugauuuuuuaugaagucugcuuuaccuacauucuucuguaauccaggcuagccugggacuuggagucucccaucugccucucuaagguugaguuacagacaugcuaugguugcaccuggcucaaaagaugugcuacgaucuuucuaaauugaaguauucuuuucuuuucucuaaaaauauguuuggugguucuggggagaugacuaauuuugaaaacauuucaaugggauuguuuucuaaauuucauuuuaagacuuuccauauagugauacguuaauaucguuuauuuuuuguuguuuuuuguuuguuuguuuguuuuguuuuguuuugguuuuauaagacaggguuucucuguauagcccuggcuguucuggaacuuacucuguagaccaggcuggucagagauccgccugccucugccucccaagugcugggauuaaaggcgugcaccaccaugcccggcuuacuauuuguuuuuaauucuacaccuuugcugaacaguuacuaguuccaauuguuuguuuguuuauuuguuuguuuguuuauuuauuuauuuauuuauuuacuuagauguauuuauuuuauguaaaccaagguuuuguuuuguuugcgugggcaucugcacaccagaagagggcaucagaucccauagacaguugugagguacuguguggauucuggggauugaacuaaggaccuauggaggaguaacagugcucuuaacugcugagccuccucuccagccguucgguuguuuuuucuaacuccuucucuauucuugugauccuaucaccuguaagugccucacuccuucccuucagcugaggucucuugauuuccuuucccugcccaguugcaauggcuuagaccuucuagggcaguauugagguugugagaacagacauccuuguccuuuggcaaagaggaaaagauaccauuaaguacacaaguguggggugucaccccgagagagugcccauccuguuccgacugucucuauacuuucacuaugguaagguguaggauuuuucaagugccuucuuuucuuuguacuauuuuguuuuuuccaggcagucucuauauaucccuggcuguccuugaacucacauguagaccaggcuguccuagaacucucagacacccaccuucccaagguggaggcaguccaccucugccucccaagugcuggauaaggacaugugccaccaugcccaggccuuaagugccuuuucuacagcuuugcaguuagccuaagguucuuauuacuuuguagauauagacaaucauuucaccuuuuuauuuuuuaauguaagacauccugcauuucauacuacuugccuaggggcaguuuguauuuuaucuguugguauguauauucacuuuacugauauuuuguacaggaugguuaugucucuguuugcaagcaucuugauguuauuuuucaauuucuuggcaugguguuguucuuguugugggaucuuuugaaagaguagcuuuugguuuuacuguguuugucuccccuauuucucuaucacaaaccacuguccucacacuaacaguuacauucucauuuuaaaauuacuuuuucauaauagaacucugaagaugugucaggugacuuggaauuguuguugucugagcauuuuauuuguuuguucagauucucaccuguuuaacacugggacugauuucaaagacggugccagcagugauucaguagugcggacccgggggaugugugacgugaggaugcacagcagugucacccaagccacccagacgagcccagagguuccuuugccuucacagucagccaacuuucucgacauuacaagggaacagguaaggggaaacuuagguugaauucuaaaacacuaacaguuaaaauaccucuaauguaugucaguaaagccuugccguguguaagccguagaugcuagaguuauucauguggagcaagauaagaaaacaauuucuuucuguuuucuugaaguucucucaguguuuuuguccuuccagaaccuuacucauucuuaaacaauuccuuaaaaauguuuacuacagcugggccgugguggugcacgccuuuagucccagcacuuggaaggcagaggcaggcggaucuuugaguucaaggccagccuggucuacagagugaguuccaggacagccagggcuacacagagaaacccugucucaaaaaaccacaaaaaaaaaaaaaaguuuacuauguuucgcuuaacauuaucucguguguuuucaugucauuacauuuacuuuaagcuuacuuuaauggcugaaugaugugaugugauguauuagcauuucugaccacucuguuugacauuccuuuuuuuguuuguuuuuuguuuuuguuuguuuguuuuucgagacaggguuucucuguauagcucuggcuguccuggaacucacuuuguagaccaggcuggccucgaacucagaaaucugccugccucugccucccaagugcugggacugcacuggcccuguuugacauuuuuuaacauucaaguugcuucugauuauuugaaauuauagauaaaaaacauucugccgaguuuuaauucucugugguagggugguagaaggaacucauugaucuguugagggguuugcuagaugacaccucugaccggguacagagacugaacacucuaauugaucucuguaaacacagacuguccuuaguuuuauuguauccucauaugcaguagcucugagacggcaaaacaccugcaauaagucuuagaaaguuuugaccgucuggguuuuuuuuuguuuauuuguuuguuuuuugguuuuuuguuuuguuuuguuuuuuuguuuuccgagacaggguuucucuguauaucccuggcuguccuggaacucacuuuguagaccaggcuggccucgaacucagaaaucugcuugccucugccucccgagugcuaggauuaaaggcgugcgccaccacgcccagcuaguuuugaccgucugaaagaaaaugcccauuggaguauucacagcgugagucuaaagacgaggagaggguuguucugggccaggcugucucuugucuaugagcuaguuguaucaugggacuagugaaagucaccuaagagagugacuuagguaaaagagaaagugggaaaccgugagaucuaauaaaauuugaaaacugaaggggucccaggaggggugaaaaaggaguggguggggagguggcaaauugaaagaacuggcugguauaggcaaaaagauggaggcuuaugacagagaaggaaggucagcgcaucugaagacacagaggccccaguguaguacggugacacaguaucacuuuaaauuuggaacugagaaguuaauuaguauuuucaauuacugggucaaaauguaggaacacgguuacuugcauaguaauugcuucccaguuuucagcucaacuggacccucaccagcacugggugguuuaccaucccaagugaugcuacauaaaauaguugcauuuuugggaagugauuaaaaccucuuguuuuacaaaugucauuucagcucauggaggaaaacgaaugucucaggcagagacuagcucaagcuaaaauggagcucgcggaggcucacucggccagagaugagcuucuccaucaaaugaagaggaugggccuguagcugccguggccgugagaaccggggcuagagcgcuggagaaggacggcuagguuuaacagaaggauguaaccaguuagugggaaguuuuccuuuacaugaaauaaagcgaguggugaaguggcggcuguuccaaacccuguggaggaaaccuugggcgcaagcgguacagucaucuggguggccccgugaaggcugcgcacacuguaacacaguuacaugccuaaugagaaaugucaguuccuaacuucagugucucaucaaaagcauuuuuuacaagaaaaacgaagaccuguugugcucaugcagauugcugaauuuauuucucuguuaauaauuuacuauuauuuacaaaaaaaaaaaaaaaaagauacuuuuagggcuaauguaaaagaaaaguaggcuuacauuuuagauguuauuaaaauuauguacuuaaucuauaauuauuuaauuguuguaaaaaguccaaucagauuaauaaauuauauaauuacugaguuuacaaauggaaaacucuugacccuaccgaacuugugaagcaacuugaaaaugugaaaggaaagucaccuuaagugauggggaggcuucagugaggcacucguguaaaaucaaagcacaaauacagggcacugggcaagugacuuaaagcauuccuguacauuccauuaaaugugugucauuagaaguaaaaaggcaaguuaucuugcgauauuuggcgguauuuguaacuauaaaaauuuuaauuaauacuauuuuaauaauucuuuaucuuuccucuuuaaggagaauguuuucagagaauuuguuuuucacacaugcagaacaauuucauaccauuccuguagcaucauauuacacauguguuugcucauaugaauauauaaagccaguuuugauuagauuucugugauguaugucuguguguguauauaugugugugugcacacacauacacacacagucuuauauaugagucauugguaaauuuugaaaucuauuuucuaugggauaagguugaaaacaccaugagagaaucuuaauuaugaaauaaaguacaugaguauuuuaagaaacagguuuuugaagacaguauauuucugauagaauuaaaguaaguggugucuauuuuaaacuucacauuccucaauagaacuauauccagauaggccaugagacagcuggacuguucuuucuuuaagguacuugggaacccuggcccuugcuaugacacucauggugcuuugcauguuggccggaauuacagccaucccuguaucugaggacuuggcagaaaucacauccuucauuacaucacacguuggagugauuuaaauuuuauugugaacaguauuugccuuccuucuccucacaucauucuuuucgggugacaucauuugauaaaaacaggcacuguuugggagccaacauacagccaagaacaaauuaaaucguuacuauauuaccucagaguauuuacaacaccaugugaaaacuuuguuacucuaagcuguauguagccuuagaugaaguauggaggucuaauuagaguuucagaaugcacaccuugcuaaccuuugaugucugguauggauucagcaagagcagucucacagaggaggacggaugggacaugaacuucugagcugacgcuguuucucaggacugaccuguucuacauaaacauacaaguuuucuauggaacaauguuaaacuguuuaauguuacuagacacugaauguuuucuuuauuccuuuaagauguauuuggccuucccaugaaaucguauaaacaacagagaugauaauaugcugagcauucaauauacuuuguccgauugguu

SEQ ID NO: 5693 - RNA, 4579 nt, Mus musculus
ccaggucucccaguggacuuucuacagcuaugaaaccuacacuguggggcaccaugaugcuuccguuggccauaugaugaggaggagaaguuggcuuuggagugcugggagccuaugaaguugcugagcacccagcgcccccagcccgcccacuggccagcccuuaacacaaugaacaaacugaccuuccauaacaacaaagucaugcaggaccgucgcagaguguguauuuuccuccccaaugacaaguccgugagcauuaucauaaauguuaaaauucugugucaccaguugcugguccaggugugugaccugcucagguuaaaggacagucaccucuuuggucucaguguuauacaaaauaaugaacauguauauauggaauugucacaaaagcuuuauaaguauuguccaaaagaauggaaaagggaggccagcaagggcaucgaccaguuugggccccccaugaucauccacuuccgggugcaguacuacguggagaaugggaagcugaucagugaccgaauugcaagauacuauuauuauuggcaccuacggaaacaggugcugcacucccagugugugcucagagaggaggccuucuuccugcuggcagccuuugcacugcaagcugaccucggcaacuucaaaaggaaacugcaccacggagacuacuuugagccagaggcuuacuucccggcauggguuguuuccaagagggggaaggacuacauccugaaacacaucccaaacaugcacaaggaccaguuugcccugacggccuccgaggccuaccugaaguacaucaaagaagcaguccgacuggacgacgucgccauccauuacuacagaccguacaaggauaaaagggaggcugaaggcucacugacccuaggacugaccaugcgagaaauacagauuuuccagaaucuagaagaagagaaacaauugcucuaugauuuccccuggacaaauguugggaaguugguguuugugggcaagaaguuugagauuuugccagauggccuucccuccgccaggaagcuggucuacuacacagggugucccacgcgcucccggcaucuccugcagcuccugagcaacagccaccgccucuacaugaaccugcagcccguccugcgccaccuccgcaagcaggagaagaaugaagagaaaaagcaguacugggaauccuacaucagcgacaaccuggaccuugacauggacccgcuggaaaagcggucccgagccagugggagcagcgcuggcggcgugaagcauaagcgccugucccgccacuccauggccagccacagcagcucccacaccuccggcaucgaggcagacaccaagccccgggacccagggccggaagacagcuguucaggcagcgccaugcaccggaagcugaagaccugcagcuccaugaccagccacggcagcucccacaccucugggguugagaguggaggcaaagaccgccuggaagaggacucgcaagaugaggaaauagagaugcugguggaugaccccagggaccuggagccgaugccugaagagucccuagaagucagcccagagauguuuaucuacaucacggaagauaugcuccugucgaggaagcugaacggacacucaggguuaauugugaaagaaaucggcuccuccaccuccagcucuuuggaaacgguugucaggacagagcaccgacucccuuccacagacgauaugucgaaaaccaaagacuuccaccgaucgccauagccugagccuugacgacaucagacuguaccagaaagacuuccugcgcaucgcgggccugugucaggacacugcucagagcuacacguucggguguggccaugaacuggaugagagcagucucuacugcaacagcugccuggcucagcagugcgucaacauacaggacucaaucccagugaaaagagccaguaaguacuuuucucuggaccuuacuaacgacgaaaucccagaguucgucgucugagucgccccugcgggcagccgcugucugcuggaggcuguggagucugagggucuuuacacauuauuugugccauaacguuuucaccccaaacuuagcuuuuucuuuauaguauucgagauggaaacaaaagccuugggacaguugcacuuuaaguauuaugcagagguaaaagaaacacagaauguaagaggaagacaaguacccagaugucuagugccccuuuggaaggaagugugcuuuccagcuuuacccagauuucagacugucagacugcaguguguuuguucaucucuuguguuccgguucaaauuuauguuuaucacgugaaagauguuauaggcuuaucuguuugcuuaugaguuuuuuagccacuuccucauuaggcacgguuugagggggaggacaaaggggaguucucucuucuuuuauggagagccauucuuaguacauagccauuguugccugacagagguagguccgaaaugaacacugaaguuggugggagucuuauguucuagccaaagauguguaugugauggaagauggaagccccacucagaguccagaaggcgugugccgggacacugggcuccuucacaaauggacagugcucuguccgcuguuuuguucuuccaugaccuucccaggaagcucugggauuggccugugcuugugacaugguacauuuugcaguuuacaaagcugguguauguuaacaaccauagggaaugucucagaagacauuuguuugguuguauuuccuuuguuggauuuuaaugguggccaacagauggugaugcuaguuucugcuuuaacaagauacccuaacuguauguauguguuauacguaucuagauacgugggacucuguguguuuauguguuugaaguuuagugacucuucauuuggacuucaguauaugucuugcacacauagaauuucuuguuuaauguugaggaugcuuagacacagacaaucaguugauaaauguagaguuaagagugacuuuuccaugugugccuuuggccaagauucucaaccuugauugcauaauagacuuguccagagagcuuuuaaaacaugcccgggucccaccaggccaguuuaaaccagucuucuguggcugggagauugauuuaaaguguaccagguugagacaguaaugcacaguaggauuggagauccaagaguuuuuuuucuauucauuuugaaguaaaaguauacagaagauauuagugauguagaaugggccauuuuuaagacagggccugcuacuguuacaguguauaaugaaaccaagccaggagaaugaguuuggucaacuugauauacauugaagacugcucgcccuucaggagagaacuucauagcacaaugucuuucuaggagauguuuuuaaugauuuaguauuuuacaacauuuguuuaccauauuuugauacuccauuuuugcuaucugccagguuuuauuaaaaagaagacuauguauuauuuucuaaagaaacucauauuuuuguacaaacuuauguuuccaaguaaggaagaaauagauuuagggucaggcagaacauagcaguguuucccccuggcuaggucagugucccagagcccgugguggccacaggcaugcccggucaccaugcugcccucaugugccagcacagccucagcaaggucacauccaguaacucucaccugauacuuuaaugaaggaaaaggaaguucugugcucauaacuuuauuuugcuuuugucgaaugcuuuuagaagaaccaaaguuucagaugccagaauguauaagugucucaguguccacagauaggcgaagggugaagggguucgucaccugauggcuucuuuugcuuccgagucauugcauagucucaucauugcucacagaugcuuaggggccacaccuuggugaaguacgcgcucuccagagcccagauggccguguguccccacagcccuuggcgucucuugcagaugcagagauggaaagguugcuuacuuggcugugugcuuuauaccuuuuuucucuaugcuccagaauccaaucuucaggguucugcccaggcuaucgaucgccauuugcccucuuccaugcagacuuggaaauagucuuaaacgguuuccaaagacaagaucagccaggaaacaguuucucauuucugacccacgggagaaucauagacauauauguauguggagcuccacuuugaagaauugacauucuuguauugggcaauuguuuuccaaaguaaaaggaaaaaaguauaaagccguuacucaugcugcacuugcuagcauguccauggcuggcagacgcaccagugcaucugucaccucccugugucaccugcaucuguauuugcaacggugagcuuuguaucuaaguaagcuguaaacaguccuuucugugaaaggaucaucguaucgggaugauacugaaaguauguuuuuaaaaaaaaaaaaaaaaagcuacggcguuauuuuguaauuauuucuuagagguguuucaugguaugcgcgaccaucaauaaaguuaacuuuuuugccuuuaaaaaaaaaag

SEQ ID NO: 5694 - RNA, 8591 nt, Mus musculus
uguauuugguauuuguaguagauguuuucucucuuuuuuuguuuuuuugguuuuuuuuuguuuguuuugucaagacaaagugcaguccuggcuguccuggaacucacucuguagaccaggcuggccucugccucccaagugcugggauuaaaggcaugcgccaccacugaaagucaaguccuaaaugaacuucagccuugcuuuuacuggaagccuuaaaagcuacucaagacccagcugcccuggaaccaccaugcagaauaauaugcuuaauaugcuggaagggaaccuuucuagcccaggcaaaugaaaagauguaagacccagauagcucaacggauacuucaaaaaguuucaccuaacaauuucaaaccuaauaacccucccuagaacuucaguacagguguacauuuaacaugcagcuaacuaaauguacaacacgaaacuugguucaauguucuuagaaaacagauugguaaugaaagaaagcauuucuauuggaauucuugcagaaacaagcuguaguggcucuuaucuauaaucccaggaagcugaggcaggaggaucaccugaauucuuggauuacccgacacccuccccuuauacacacacacgcgcgcgcgcgcgcacacacacacacacauuauauguguaucuuauguagagauuguuagcucucuccaaauagcaagaacuugaaggcaaaaaucaggaaacauaaacugggccuuuguauuucugaauaaacaagcaggaaccugaacaucugugcagcuuuaaaagcugggcuaaaccucaggaguaugccugaggcugcaucuccagcuucgcucaguugucuagcagccuuucccauaaaaaacuaaauaaauaaaaacaaaacugcaaacugcugacauuccauccagucugguugugugaaaaguaggucaccuuagucuuuuuagcaauccugcuuugguccuuaacuaucauuuuaagaaugagccuaaucugggugcccuuuuacaaacacagaccaauaggcccacuagcauuaaaaagugaacaugagacaaaaauuugcuauacuaaaauuagcuugucaaaaaaauaaaacuacaauucaguguuuauccauauuuaauaaaccauguuuuugaaaacccaagacuauuuccuaaacacaggaguuucuuaagugaggggacaauuuaggaauagcaccaaugguuuacuuaguuuacacuuuuuuccuggggugaauaccuuaauuauucuuuuuguuuuaggacuaaaucuuuuuucaauacuaguuuuuaaaauaacaaacucauagacaucaggaauagauggguuuauuuagcauuaaguuugaaacucuugcuuuaagcaaggguacuacaguaauuauaucaggaacagacauuuccuacacugucaaauauauaaaaguuccuuugcacuuucaacacugaucaacaagcagauucaguccauguuacuuugauguaucuacucaguuaacccaagcuucuucuucagagacucuggcaucucagggggaggagggcgagggagccugaaguagaccuucacagagucguagaugaaccacuguagugcagucagagugccaaucaugaugauucgggcgaagagccccuuccacacaccugguucagagaggagacaugagugcccgagcgccaccuaccuccccacgcgcacagugagcugcugucucaggggagccugacucaccucugaagcccagccucugcaggaccugagacgcggugcugccuuucucuuuauucagcacagagaccacagagucagcagggugggagacgaucgcacagaagacuccagcugggggaaagggaagggaaaaaaaaaucaagauaccuccaaguagaacuccuuccucagccucccagugcuaggauuacgagcauguaccaccacacuggcuuuagcuuauuauccaaaacauuuacauuuagauucacucacucuauaugcaugagugucuucccugcaugcauguaugugcaccacaugcaugccuuguaugcccaaagaucagaaaagggagccauaucuccuggaaguggaguuacagaugcauuuucaagcaugacaguaacaugaauaauaauaaugguaacuauagaaaaagauuuuuuggaaauaauuaagaguauguagaaucuggcagaacauaaaaacaggcagauaaaagugcucccaaaucuuuggaaauuuuccuucacaaaggggccaacaauggaagugauauaauuugcauauaauuucaugauguguucuaaauaauucauaccagggggggaggguaugggguacuuuugggauagcauucuaaauguaauugaggaaaauacguaauaauaaaaaauauuaaaaaaauaauaauucauaccagccaggguguagugauacauaccuccaauccccuaacuugggagacagaggcaaguggauccuggccuacauaguaaguucuaagacagccaggguuauaaagugagacccugaagguagauauauacauggacagacaggucauaccuauguaaccugccacaaaugucacaaccagcugcucugccuuuguacauucacuucggggcuuaggaaccacaaauuuguacaaagcuucaacaguacguucaaagcaggcgaacuucaucaugguguacgggaucugucucauccacagaggagcaacgcccuuguagaaccuaggaaauuagcacacuaacuuaaacaggugccuaaacugauuuagcagagauuuucuuucaccauccacagacguguccgcacaccagucgaguccugacaguaacacaugacagcaucacgcaugucacuuccaucagaaccugaagacuagcaugcagguauauuagucucacaugccaaugacucaagcaccuucgacuauacaaccaacaaaguugcuggacguuucuuggacuggaaccacaagaaacaagaaguuuacagguagaacucaguccaagacccauccacaaagguggaucuaaggaagcauguuggcaucugaaacaugcaaacuguguauagcagaaauguccuaacaagcccauccuccugagucaauagauacuuagacaaguaucauuuucagacagacagacagacaggacuugauuuuagguucuccccagugacucguuuuaggagaauacgcacuuacgcauuuaagccuuccucuuuauacauuuugggaacagcuucccucaagguguuggcauaaccaggcuggguuugaauucgaacuuuagcagcuuccauaggagccagggcaaugucagcgaagaauucagcacuggcagaagaagcuaaauacagugaugugcgccacagguagguguuuuccuaaaagacaauauacagaacagauauaaaccgcugucacguggccaucucaaucuaacuuucuaugacaaugugauuucagagacucuaaaauuacuccucucccccuuucugguuuaagaucuaacuucaucagucuauccuagucuagccuuguuauaugggacaaucuggcuacaaaaaucacaauauacccaaaugcuaggaaacagaugcacauuauacccugccugacuugucugaacuacucuuauuacacaguccaugaauaacacugugucagaauuaaguuuauauugucucucaaccucauaacuaauacaagguauauacucugaauauagaugggacacauacaguaauccuauacuacauaagagaaaccccagacucuucucuuacacuaacacacacaccacccauacuuacuuagaaauaacauaguacauugagaagcuagaaucuuaugaaauacacuuugcuuuucauccugucuuugcuauugcuaaauaugccuuaugaauugagacaugcugcacucuuucuagggccauuucuucagccauaaaacaagguaagcccaacaaaaagcauaacaucuuucucaaacacuugggacacuaaaugucaaaguaaaaucacauaccucaccaaguauguugcuauauaaggcuuugaagacuucauaaaagccgaauuugcagagcccuugcauggaauagccaaucaaaguuggggcccauccuuuagccaaaccacgaacgccaucuucuuucaguguaauggagaauccauuaaauaugccuuuguacuucugaggguccaccuuuaaaaugggaaaaugucaauauaaaagaauuagcuauguuaauuuaguuguguuuuuuuuuauuugccaaguuauuuauaaugaguuuuauaaauuaagauuuaagaauaucuaacaccuuucacaaaaacuuuauucuacuacugugcuuuuuuguuuuaaaauuuaacuacaaaagguauaugaaaguucuuagcuuaauauaagcuaaacaccuauguuuuuaaauuuuuugugugguauauuccuguguauaugcuucugugagcauguauguggaggccagaggucaauguugggaacugcccuuuacuuuggaaucucuucuaccacuguuccugucucuaccagccuagcuggccagcgaccuccggggacccucucuauccgccuuggcagugcuaggauuauacagguuacaggugcaugaccaugcccgacuuuucacacaggugccugagggucucaccuaaguucuucaggcuuacauaacaaacacucuacagacugaacaaucuucccaggcaaacugggaggaguccaggcuagucuccaacucacagugaucuuccugccucugccucccagaggcuagacugcaggcaugagccaucacucccaggcucuauuuaggacuguuucuauaucaaggucuaacuuccuuuaaauuauaauaauucuuggacaguaaaaaacuauguaauuccaaaaagaaaauugcucuuaagauauaaguauguauuccugaucccggaguccuuuacguagaugauacugcacuacgaaccacugugaacaucagauaacccaacuagacacaauuguaagagguacagcaucuccucugagguacagaaucacuuuuacuucagaaauuaaauuuacuccaaaagacacgcauguuucaggacuuacacuugguaucuauuuguuuaacaacacuguggguaagggagcuuaucucacucucugccgguacuagaagggcugguauacaucaccuuccucucucccuccuaauauuucaacuuccuuucucuuuuagguaaggagacuucuaauccuguuugggacaaauaaauuuuuaauguuucauuacuuuuuuucaauuauuaugauauucaaauuauaaaaacacaaaagaggcagugcucacuuucccuauaaagacaacaagaacuuuucugagaaauaaacauguucuuugccucaauauuuagggacaggaaguuaguucacaugagauaacacaagacugacugaccacuuugauacaaaaaauacuuauacagugacuacuugggggucuugaauuaguaggcuuugaaaaagaccucuggccagaacugaaugccagcaguuaagauccacuuauaguaagagcagaacaauuaaccugagcgugguggcgaacgccuuuaaucccagcacucaggaggcagaggcaggcggauuucugaguucaaggccggccuggucuacagaguuccaggacagccagggcuauacagagaaacccugucucgaaaaaacaaaacaaaaagcucagaauuggagcagaagggauggcucagcaguuaaaagcaguagcugcucuucuagagguucuggguucgauucccagcacccacauaauggcucacaaucaucuauaacucgguuucuagugaagcagaugcccucuucuuuggacacuaggcaugugaugcacaaacauacaugcaggcaaagcacccuuacacaugaaguagaaaucuuuugaaaacuaaacaaagcuagaaauguagcucagugguagagggcacuccuagcacacauacuaagaccuugauuccagcauaauuccuauguaacaauaauaagaaaugagaccaucgauuugagagagugggagguggagguaugggagggguuguugggagcaaagggauaagaaguaauauaauuguacuuuaguuuaaaacaacuuugcauuaguaagguaaaucacauacacaagacacagcgggucaguaucagacacuugccugucaaaccugucaaccugagugcuaugcuuggguucccuaugguuuaaguaaagaacucccaaaaguggucuauuuauuuccacaccuacccacccacauaacauauauaacuuacauaaucaaaauguuaucauagcaaauaauaaaauauaaauaaaaccacucaugccaacaauacaaaccugcaugcggcacuuuacuaaguccaggggaacaacagcagugugugucagcccacaacuuaagaccccaccaaagccacacagugcauaauacuucauggagccaaauucacaacuguacucuguaauaagacaagacacaccgugcauuuuaauauggacucguauuagugugcaucaacuuaccuccugggcaauuagguuuccacacagcuuguuaguagcagucuauaucuuacaacucacguuucaacagaacguuuuaguccagcaugcaacacaaaccugcauucugcauuuaaugagaucuagaggaaccaaugcuguauguguugugccacagcuaauaauuccuccgaggccacagaggagaaagaaucugccagauccauauucacagcuauacugcucuguuugauugaagaaaaaagaucaauuauuucuucagagacuaaggaagucgaggggaaggaaaaaaaaaaacuauuuccuuuugguauaguacuaucacuaguaugcagcuuuagccaccagccacaacuagguagaaagaugaguucucauauaauguaaaugacaugaaagucacugucaaaucagaucacuaaaauuauuaguaucugugagauacuauuuucuaaaacuuccugcauugguaauuucaacuaaaggcaguuacuaagagcacccuccaaggacagcccaaaaucaaaaagagcacuuaacaugugcaaagcuugcuaacuuuaacguuugcuccagcuauuaaccaacuacucacuuaugaacuaaguaagucauaccuaguuccugcagucaaaaacauacaaagauuugcuuuagcuuuugaaaucagaggaaaacgauaggagauagugaaaaggaguuuucuaaucacguuuaagacgcaugaagcacaugaaugacugggguguggguggggacuucuguuuuacacacacaauguagguaacguuucucuugaggccuauaauucagcuuucggguuucucuuguacuuauguuccacuaggauuuaaaacauacaguuauugagucacccagcucaaaucccaaaaacauaaacucaaaggaaugcacaccucauauaaucugcaagucaccuccuucaccaaccaguagcacaaaaggaagagauucccaaccccauuaccucauauacaauuaaaugaaaagauaaaacuugggaaaggagaucaaaggagaguuuuccagguaauuuuuaaaaaggcaagucaaauaaacguuauggaguugcaacugugucuggcuagugguuaaaaagagauuuuacccaguauacuuggcugaccaagcgggcucacgggggaagauaaagaaguugguuaccaccucucugccucuacucccuucgggacacggaggucacugaguggcgcugggccugggcccuuccacgcccuugagggagggccaaggauccgacagcggccuagggugucagaguugccaucccagggucagcgagagaccgguccucggguccagggcugaagcguccuuccccgaccuccaguuccugcccaggacucgggaggcagagcaggggggcagcauguaaccagcgcucccacagggcagggugcgaccucaccuuccacggcggcggcggccagguggcgggaacgccggggcggagcugggggacugcggggacccgacaggccaucgugcaccagcugcagguguggcgcguugaagggguucgcccgcgccaggugcgcuacggacgagaacauccuccugcgggggagacagagggcggaggugagagagacccggcgccgggcaaugucaccggagccccgcgagacaugcccggcucugcgcccuugaggaggucacagcuucuuccccagggacgccaagcccggccgggcccacggccaaggcggcggccacaagggacucaaggcuccgcgccgcggcgaggcccggucgcgcucacuugccuaagauggcgaacacccaaccgcucgcugggcaagguugcggcucacagaggccgaauguccucccggcccgaagauccgugcccuucgcgcggcgucaccgugacgcacgcagagcgucacugcgccacgcgccucucauuug

SEQ ID NO: 5695 - RNA, 2149 nt, Mus musculus
uguucguuuguuuucuuuacugucaacucuuaaaacauucuugacugugcucuagucuuccacaacccaaccaccgaacucugagucuuuuaaaaacccaaguccauggguuggagagauggcucagugguuaggcacacugaguucaaguccagcaaccacacaaccaucuguaauggggucaaagacaaagcacacauaaaagagcagucagucucuuaacugcuagaguacccccucagaccccguggguugucuuuuuauccuauggauaaugcauuucuagcauuuugaacguauuuaaagaugcuccggguuaagucucucaagcuucagcauccucacccccugucagaguacuugaggcuuacugcgugccaccggaccggguuccagaacucacugcacuaucaaugcaaagcuuccaaacacaggcaaugugguccacgccagcaccaugaggcuucugcaugcuuggugcccuagugugcaaugcagcugugagauaggcagggacagguacuuaaaagcugggauuaguucaaucagucucuuugggugauagcugccugggcugcaaguaugccacuagccucagcaaccuggcuggauguggccaaucaccagcuggauguccugguggguggguaccaagcacaucacaauagucugaaagcuuuucaaaaccaaggucuacuuuuccucuaaauuuggucuuccuguagaauuccugccaugaccagcucaccuuucagcaggacaaguuuaaccucuagguccagaucuaaccacaucuaccaacuaccucugaaagauugaguuuacauacuauccacugacucaaacgacucugacacccagcuagagcaguguuggugcucuaccaauauuccaagcaugugggggguagaagcaggaggaucuuaaguuugagaccaucucacaaaaguuuguucuaggacaggaguggugguauaugcuuguaauuucaacauucaggaacccaacgcaggaaggagaaugaccuuaaaucuaaagcuagucuagacucuacagucaguacagggucauguacuuuuuuuugacuuacagacaaaagaguucuggaacaagcccagggucuuacuacauauuaagcacacacuauaaucacugaguacauaccuggccuguccacaugaaaaagguauuuaagguggucucacugugcagcccuagcuggucgugaacuuaccaugauucuccuguguacuaggacugcaggcaugggccaauaugcuuguuucgcaagaagucuauucaccagagcagucacuaccgugguuucuuacuacccuuuaacaucuaaaaggcugaggcagucacaauuacggaagguaccacucccugaggccaugaaagcucaaugagagcaagucaagauuucagaccgaugacauaugugucaacagucuuuccugccgagaaucuauuacuaauaaaggaagaaaguauguguuaaaaaaaaaagauagcaaaaaaauuagaaaaaaaaagauguuuggaaguuacaaaacaugaacagaaaauaaguuagcaaaauuaaggaagacuuaaguguucgcagaaagaauaaaaccaaaugugacuacucaagaacaaaacagaguagaagugagcuacuuaccccugaaaggcacauaacuauccaagcuaaagaaggggcagggcagaacaaggagaccuauagcugugcagaaaccccaccaacuuccuaaaccccucuagguguguccucuuucauuugaacaagaaaaauacccacccaccccacagaauugucaaaaguccacacacacgaagggccuagaacagcucuccacacacacagcuaagaauacaaagaauacacugagauucauaaauuuaaauaaagucaccacagagggacacaugaacgacaaagacgcaaacagcacccucaucucacaaacacaggcugcgacauggauugcagucacacugaagaccaacugccgacaguuacauguacauacuuaagaugguaagcaggagccggcgugacaggcacggaggaggcaggucucugugaguuugaagcuagccagugcuacauaaguucuucaaaaaaagaugggugggguggggg

SEQ ID NO: 5696 - RNA, 1491 nt, Mus musculus
uuccguaagaauuccaaguauuuaauguguagcuucacauuacaucaccauguuuugccuuauuuuucaaauacacaaaacaaugcauuuuccccaaaagugaaauaagauguccacauuaaaaaaauaaagccuacaaaaaaguucuggagcuaaaaaaauuauucauauggcacaaugugaucuccaagguccaaaauauugaaaugagauccguguaagcauccugucugcuuuucaaugcagcacuaacuuuacugaggugaaaucacaauuuaguucuucagucaacaaguggacacaaauguuuuucuacaguuauuaaaaacaggagaucaaguugaaugugccgaaaugauuucuucaguuggauauuuuaguaucuugaagaaaauuagugaagggauuuccuugguugguuuccauagcuugauagaccaaaaacaaaaacacggccacaagggcaaacagcaacauuuuuauccacaugggaacggagcgucucuucuuugucuuuucugacuugacaucugccaagggagcauacuucgggacguacuuagaugagaacgacucuuccauccugaagucacugagcucgagcggccggccugcagcaccuuugauuggucugcggcagcuagcacuguucaaagugaaacagaauuccagaugauucaagucaacaaccaaaccuuagugugauuucuaagcacacugcaaaaugcagcagcagaaaaucgucagauaaaagcaggggauugacguaucacaugcuuuucuuuguuuguuuuguuuuuugagacaggguuucuguguacccuuggcuguccuggaacucacucuguagaccaggcuggccucaaacucaaagaucccccugccucugccucccaagugcugggauuaaaggcacgagccaccacugcccagcuauuacaugcuuuuuaguauuuucuuuuguuuuauggugaagaugggagguaagccagggccuugcaucuuuuuauggaucuauagugggcauucuuauuacagagcuccaacuccauuucuaucuuaaaacuuaguuucagacuggagcgaaggcuguuuaaagacgagcacccacagcugucucuccaucuacuguuaaccaccagaaauggugaugcccaccuucaauuauagcacuugggaaacaggugagcaaaucucagucugaggcuagccuggucuacagagccaauuccagaagagccagggcuguuauagagcaaccauguuucgaauacuccaaaaaguuagcuguaucauauuauaaaauaguauuuaggauaaauacucucuaagccugucuuggaggcugaguaguguacugugugccuguaaucgcagcacuugggaagugugucaugagucuaacaucugccuugcauauaggguaaauccaagaucagccuggugacuugagaacuugucucaaaaaagaaaauaaaacuuaacaaaaac

SEQ ID NO: 5697 - RNA, 1491 nt, Mus musculus
guuuuuguuaaguuuuauuuucuuuuuugagacaaguucucaagucaccaggcugaucuuggauuuacccuauaugcaaggcagauguuagacucaugacacacuucccaagugcugcgauuacaggcacacaguacacuacucagccuccaagacaggcuuagagaguauuuauccuaaauacuauuuuauaauaugauacagcuaacuuuuuggaguauucgaaacaugguugcucuauaacagcccuggcucuucuggaauuggcucuguagaccaggcuagccucagacugagauuugcucaccuguuucccaagugcuauaauugaaggugggcaucaccauuucuggugguuaacaguagauggagagacagcugugggugcucgucuuuaaacagccuucgcuccagucugaaacuaaguuuuaagauagaaauggaguuggagcucuguaauaagaaugcccacuauagauccauaaaaagaugcaaggcccuggcuuaccucccaucuucaccauaaaacaaaagaaaauacuaaaaagcauguaauagcugggcagugguggcucgugccuuuaaucccagcacuugggaggcagaggcagggggaucuuugaguuugaggccagccuggucuacagagugaguuccaggacagccaaggguacacagaaacccugucucaaaaaacaaaacaaacaaagaaaagcaugugauacgucaauccccugcuuuuaucugacgauuuucugcugcugcauuuugcagugugcuuagaaaucacacuaagguuugguuguugacuugaaucaucuggaauucuguuucacuuugaacagugcuagcugccgcagaccaaucaaaggugcugcaggccggccgcucgagcucagugacuucaggauggaagagucguucucaucuaaguacgucccgaaguaugcucccuuggcagaugucaagucagaaaagacaaagaagagacgcuccguucccauguggauaaaaauguugcuguuugcccuuguggccguguuuuuguuuuuggucuaucaagcuauggaaaccaaccaaggaaaucccuucacuaauuuucuucaagauacuaaaauauccaacugaagaaaucauuucggcacauucaacuugaucuccuguuuuuaauaacuguagaaaaacauuuguguccacuuguugacugaagaacuaaauugugauuucaccucaguaaaguuagugcugcauugaaaagcagacaggaugcuuacacggaucucauuucaauauuuuggaccuuggagaucacauugugccauaugaauaauuuuuuuagcuccagaacuuuuuuguaggcuuuauuuuuuuaauguggacaucuuauuucacuuuuggggaaaaugcauuguuuuguguauuugaaaaauaaggcaaaacauggugauguaaugugaagcuacacauuaaauacuuggaauucuuacggaa

SEQ ID NO: 5698 - RNA, 380 nt, Mus musculus
caugcccacuguccagaacuuccaaucuuucgacccccuugcugaugcaacuaagggcaaugacuuacuccccgcagggacugaggacuacauucauauaagaauccagcagcgggacggcaggcagacccugaucgcugugcaggguguugcggacaguuaugacaaaaagaaacuugugaaagcuuucaggaagaaaccugccuguaauggacgugugauugaccaucccaaguacagagagguuacucagcuucaaggugaccaaaggaagagcguuugccaguuucuuuuggaggcuggcaucaccaaggcgguucacggauuccacgaugaacccaaacauauggcgaguuucuuaaaugguuuuguucucuaac

SEQ ID NO: 5699 - RNA, 106705 nt, Mus musculus
gcgcugccccaggcgagccgugcaggcggggguggggaagcucccgcagccggucgcuuuucuccgccgccgcugguuggaucguuucaauaaaagucuuuuuuuuuuuuuuuuccuuuuuucuuuucuuuuuuuuuuucuaacccccgcucucgcucgcuccggggaacaggcggaggcgucaagccgcagccuccgagcgagagaaagcaacgcgcacucagacgaacgagagcggcggcugcggucuacccagcgcccggcaguccggcagcccgcgccccgccgccucgcuccgccccggcucgguggccgggaguacugggccguccgcgaggcuccgcggcccgggagccauguugagcggggggcucugccacgcgugaggcggccggcggcccucgcggagcggaaggcgcgagguugggggguggggggaggccugagccugaggcgccucggcgcguccgccaccaccggaccugcauccgcucgcucgcucugcgcgcccgccgguccggagcccgcgguccccgcacuugcuggugaguuggcagcggggcugggcagggaucgugacgccugucagcgggcggcucgaguggggaucuugucggucgcauguccacgcgcggcgugggcugcgggagugcggagcugguugggggaccuggggggaggggcuccaugcgccgccgcugagaguucgcagccgaucgaggcuuccuggggaggcugcuggccccguggggcgccgggaggggaagaggcggaaaguccccccgagacacaaagguccccggggccgggguggaggcgcgggcgcggggcggcgggagugggcgaggacgcggcgcugcgggcuccuuggagacgcgggaggcugcgcgcgggugggugggcagcuccgcgggggaggagcccucucgugggggagcgggucgacacaaagcuccgggcagcccucuugcuggcgggucacaccccugagugucgcuccaaccggaggcggagggacugugggaaacccagagaacccgggaagaggggguuguguguguguguguuccaccguugucuuagccgcaguugcuuuucucgguguuuuuguccgguugcuucugcuccccaucucagcuggguggccccaguuuucuuccccacaucacccccacgcugccaccucgccguccccugugguuccccacucauucucuccccuacuuuucacccacuccuucugggguaagcgguauuuugccuucagcuaggggaacguuugcuaaugacaggaugccugacuuggucugacccugaacugccuugaacucuucucuuuuuuuuuuuuuuccucccacccuuuccuuucugggaucuucugugucacauggccauuaacaauuagcuuuucuucuucaaaaauggcaaaagccuuuagcugaaauccguggcgccuuucccuuauguuaauguggccaucgaagacgacgcaucaguggcccuguuuuaucgccuccugagccaaauugauucucuagacacaagucacaaauuuuguuuugcgucuuggccauuccuugggccagcaaaguguauuucugguagcagagcuucugucacgucacaggcaaugcuugacuaagggagacagcucuugccucccaacuuugcuguuuguuuuuuccuaauccuuuguuggguuucuuuuuaacugcauuugugcaagacuaucaaaguaauggauuugagugacuuggaaauugacguuguuaaccacggaacagaagacgaccucugaucaguugaauugaccuaaaccuuugaaucaagaaacauguguaaacuaaauuuaaggaggaaaaaaaaauugcuagugggaauguuaauugguuuuauuuuguucucuugugaacaccaggaauuggcuuauguauuaaauguggugucaccugguuaaugaagucauuucaguuuuuuuuuuuuguucuuuuaacaucugcauaauuccauaaacagcggguuuaaacaaaagaaaacaauaugacuaaggacgucuuucauuuuaauuuuuauuucuaauguugugagugaacacaggaaugugaagagcgcuguucuuuuaucuggcgagccaucuccuaggccagaagcauuaacucuuugaaugcugcucgucaaagaucuguugcagagccuuugaauugaagcugcuuuaaaauuccaaugcaagggcuggugcgauggcucaguggguaggagcgcccgacugcucuuccaaagguccagaguucaaaucccagcaaccacaugguggcucacaaccauccguaacaagaucugacucccucuuccggugugucugaagacagcuacaguguacuugcauauaauaaauaaauaaaucuuuacaaaaaaaaaaaaaauuccaaugcaagugccagcaagauggcucaguugguacgggugcccgucucagggccugaguucaauccugggaacacaugcaaagacggaggcaagaacagcacaacguuguccucugauuuccacaugcauacaccacacacaucacgaacaucaucaccaccaccaccaacaacaauugauucauaauaaauaauaacaacaauaauauguauuuuaaaguucuuaugcaaacauaggaguuucaacuauuuuuacaguggaaauaagaaugcuaaugaaaauaugaauaagaagaaagucaaaguaagauccauuuauuguaggugcaguaauguuagugcugcuguaaagauauucauauccuacaaugugcuguccuuauugacacuaaaauuuuagauauuucagcuagggauuagucugcauuuucaacuuccucuuucccagucaauguuuuagagacuuuugugaaauuacaggucacuuuauaguaauugaugcuuaauaaauguaucaaaacugugaauauuuuuucuccacacuuauuaguaccuacuuagauaauaaaaauuugugucacuucaagaaaguguaugcccaauaaguguuucuggauugugggucguuuauuuuuuaccucuauuuuucuaaauuuucauauuacuuuugcagucagaaaaaaaauguagaauuagagucuuguuaauaucguaguuuuugcauuccuaaaauaggguuuugucaaauauguaguuuauucccuuuuuuggguucaggcccaaggaaguaacuuuuaguguuaacuguaugacacaguguaaucuguccuguacgaguugguuaucaaaagagcagaagagauaugugcacaguaaggaaagaugaaauuggaggccuuaauucagagugugguagcauuaaugaugcuaauggcuucaauugguucuacaaaaacuagaagacagaaaaucguguccuguucuguagcuuacaccuguggugacuacaagcccuguugacuacagggauuuuaagguauguuuugauacauuuaguuuucagauauugugugguccugcaauugugaugggaaggcgugggguauaagauuauuugcuuggcucuggcaaggcuuguucucaacccucaacucccagcaaaacuguuuccuuuuccuuccuuggugaaauggagcuacagacugaagagcagugggguaccuuauugugaccagcacagagaaggauuguggcaacccaggaggcuguuccaaaggggagaccgggaugccuucugauacuacuaaaaagcugucugaacacagcauuucuuugccuguuuccuuuguuauugucucauaguaggcauuuuauuguuguucuuuguauaauuacaacuucacguucugacauucuucuacauggguuuucuacuuccagaguggauaauuacugaauaaguguauuucucugaugguggagaaaggccauuauauguuaaacucuacuuacagaaauagucucuaggcuauuuuagaaacaaucucuccuuuugugcaugcaaaggaagaguaauuuuggauuauuucgaauuuaaagaguauuuuugcucaagcuuuuuaauauuguauuugaauuauuuuuauaaaacgauuaugacauuuuuaauuuuuagugcugauguaaugguauuuaaaauguguuuuccauaguacuuguaaaugcuagaagacucauuccauagcucacuagcaaauucaaccuguaauguugccaguuucuuugaacuauuuggagagaggacugauuugacgggcuuuuaaggauucuucuugucuuuauggcuuuguuacccuuuugcucacaguauaaucacuugguguuuaguuucgugugugugugugugugugugugugugugugugugugugugugugugugcgugcacgagugcguguguuuacuuuuaacaucuguaaaauauugaccuggaaaaaggaauugugaagagccugaaaaaaacuguuuugggcauaacuuucucacucugccauguuuugcucucucugcuggccaacuuggaaaaucaauaaacauuaagaguaaaucuaauguuuuaugguccacaguaacgugccauccuaaacacuuguuuuuaggagguugauuuacagaucagauccacagugugucaggauagcuugccuagcagagggcacaauuaauauuuaauuacuuuuuuuccuuguaguucauacuguauacugaaugauugcauggccccacaaauucauguguugagacccauaaccuacugguuaaaugguuuggagcuaggcuugagggagcuaauuuggauuuagugaaaaugauuuuauuuuccaaagaaucuucaaaaacacucuuugauaaaccuuaucuuaguccacuucaucuuccguaacaaaacaucacucauugaguggcuuuuuaaaacagcuuuuuccucccuguucuggauuccugaagucugaggucacagugccaaaccgguuaaauuuuggugagggcucucuucuuuguuuguagaugccugucucaacugugguuuucuggccuuuuguuuggugccugcagguggagagggaggaugagagaaaaaaugggagggggugcuggggggggguagaggaagaaaacaugggcuagaggguuuucuucuuauaacuacuauuauaaaggccugcccucuggaccuugcuuaaaucuagucagaucgcccagaucaccuccaaaaaccauuguacccguaggugagagucucaacacgcgaaucugaagccacucaaauguucaguguuuaacggaagcugugagaaagauccucaguugugccuggugcugugcuagacucuauuguuuuguuaaauccucacaggaaaccuauuguauuggguaaaccuuuuuuuccuaauaaggaagcagaggucuuagguuagguaauuucccccagggucccaccacuauagugacccaagauccaguuaacauucaaaaaugccgugcucauagugucucuaccaggaugcaaugcugaacagcuugcuggcuaacauagaagccgcgcuaagucagaggaaagcacaggcagugugugugcaagauugucccacaguccuccccacccuggcuucuuucacggagguuuuaaguacauuugcuuucuuuccaaaaugucuguguucguucacguugauuuuacaugucuuagaaguuuugacuuucuaucauuuaaaugauaaugcuuucauuaugugagcguaugccaucuguguuggccagcuuuauacuccugggacagaggaguguuuccuaaggggaaaagucacccuucaggaggaggccguuguuuugacacuuguuucagagguuucggugguuauuuggcucccugguuucugggccuguggucagacagaacaucauggugaggaacgugcaugugguagagcaaagcagauccgcuugcuccuguugucaggggagcaaagggaggcgggagguggagccugggauggauuguaucccucaugcucaugucuuccaggaccugcuugccuuaccuagaccuuccuccugaaguuuccacugccucccaaccucucucuagguuauuaauuuauaaauaccuuaaucuaucugugagaucaaugccuucaugauccagucaccuuccagacaguccacugucugaaacccuguggcauugagacugcuuuuaacccuugaacuccugggaauauuugggagccaauccaugauaccaucaaagugaaaacuucaacaaauacacacaccaccuauuguuuuguuucguuuuaucuugauauaacuuacuguaagcaagguagaaacuuugcauauguuuaaucagauacccacugagaauagaaugauaauauuuuucauguugaaaauugaucuuuaggauagaaaaaaaaucuauaaauuaguauuguuagcauacauuucguacucaauuuaaagaacagaaaauauuauuuccugaaagguguuuaauuaaggugaaaaggaauccccccccccauaaaggcuaauacugagaaucauuuagcuggucauacuggcacauacuugcagucccagugcugaggagggugaggcaggaggauuacaaacaacuuuaaagccauucugagcuauacagugagauucugucucaaaauuuuuuucccucccucccucccucccucccucccucccucccucccucccccucucucucucuuucuuuccuuucucuuucuguuucagagauucucucaauugaaccugaguuaauguuuucaccuagacuguccgggcaguagacugagcacccugcccugucugcacagucuccagcacuggccuguagacaugggcacgaugcacagcucuucuuguggguucuagaaaccugaacucagagccucgugcuuagggaagccguuggugacagaucugucucuccagcccccugucuuuucauagcguguuuuguuuugucuuucauuuuauguacuuguuacuauauguucaagaauuuucaguuuucuauguguguaaauaaugaagaaaauauucgaagguaucuuuucacuguccccuagauuauguggucauuuuguuuuucucaaagcauauuuuuaaugcugcaguauuuuucauugauggcugacaguuguuuuuagcacauauuauuguucacuaauacaaauaaagguugauaagagcuauauauuugugagaaauuuccaacucacaaacgaaacugagacaauucuuuuuuaaauaaugugggguuuuucauguuuguuguuguuguuuuuuuuuuguuuuguuuuguuguuuuguuuuuuuuuuuguuuguuuuuuuuguuuuuuuuuuaggggccagaaaaguggcagcguugauuagagcuagccggcuuucagcgaugaagaacuauggguguugauauuauaauccugggagacguggagagaacuucucacuuuugaggccaaaaugccauuuccucugacaucuuccuuauucuggucugacaggguuguggccauuauguuauuuggaacguuuaugucuacuguagugcugacuucauucugcuguaggggauguuuaagucucucuccuuccugcucuguuuuccuuuucugugaucucaucuacacacucaguucagcucaguggaguaggggacuagggagcaccgccuugauacauuguucaguucaauggacuggggguugggaagagacuagggaauaccacagugauacauuguucaguucaguggacugggaagacuugccggggugggggugggauuacuagguacuaucacagugauaaguuguuuaguucaguggacugggggacuagguaacgccacacugggauaguaaaauaccaucagaguuguuggccuagaaacaaagaauaauuucagguuuugaauauuggagaauaccauguuggcaguguuugugugagaguaaucuagaaaccgguucuaggccaacuuagagggauaguaauuuggcauuuugagacuuuaauugcauguaagcuguacugacuuguuagagaaaaugaagagaaaaggcuuguggcucucaaaaaaugguugucuuuuagacaaacuagaaauacaaaacugacauauuucuacauaaaauauuucuaaaggucuaaaaacaguggucaguacuaguaauuuuguuuaacugaaaaccuuugauuucugaugagaacuaguuuguuagcuguguauacagugccaggcuugaaugcacuuacgauguacagaguugugucgcaggauugaacaaggcuuuaauauuguuccugcaacagauauauuuguuuuccaauauaauuaaauuaaaaagcauucuacuuuuaaaauuaaggacuauuaaagcugaaucuuaaauuauaccuuuguugguguaggucuguuauaauuaauacauuuauuuuauaaagcaaugguuauagucugguaacaucuugauaaaaauguaacauuuaaaaguaaacuuacacaguuuaugagauuuagagcuuuuuaaauaucugaacuuauuauauagccuugauucauuaauauuucugucauuuuuuuuaggucaaaauuauuacauguauuacuucaaaaauaauggagugagcacuguauuugguaauauaauagagaucugaccuguucagguuaaucagugauuuauaaggacaaaagaaucaaaauaguaugggauuucuaaacuauucauaccucuuggguuuuucuaaaaugccucccugcucuugcccagugugaaaaucacgcuggauguauguauguguguguguguguguguguguguguguguguguguguguguguguguguaauauaggacuaagucaucuaguauacucauuguuguuucuccuccuuccacccuucccccucccucucuauguaucccucccucccucucuauguaucccucccucccucccucccucccucccucccucccucccuuccuuccuuccuuccuuccuucuuuccuuccuucaagacaagguuucucuguguagcccuggcucuccuagaacucugcagaccagcugucucagauuaacagagauccaccugccucugccucccaagugucuggauuaaggccgugcacuaccacaccaggcucauugcagcuucauauccagcagucuaggaauaaagagggcauuuaccucaggcaagcacacuuuggaagaaguguuucuuuagggccaggcaaauuuccuugcagucgauuccccuuccuuagccuugucgguuuccccuuguuuggcaucuaaacauuugagacaguauuuauucuugcuaacgacccuugugugcuacucucaaggcuuucaaaaagcaaaauagaagaauuacucaugaaacuaauuuaaagacaaauugaccuuuccuuuuauucuuugucaugaaaucugcuuggaugcaugcuguuacuguauuccugucaauuaucuuuuguucuaggccaguggauuuaacuugacccgcaaaaauagucuuguugaguagaaacagaaaguccacaguguuugugugugugucugucuucugucugucugucugucuaucugccagccugccugcuuggcuauaucuaccucuaucuugaggguagucuccagcucuuccgggacaacuaaaucaaaauuccuggcucagauuucuaguguucugugaaauuccuggugagucuugaauuuuagcaucaugcuaagggacagagcuacuacuaauauacaaauuaaauuuagaguaaagacaaaaugauauuaaacuuuaucuuucagucuuuuauuuacccaaacccuuccaguugugccaguuuggagagaaagaguuaagaugcuuguuccuguacaaagcuguuuguucuguuuaucuuauucugacuucacggaguggacacuccugcucuuuuaaguuuguuucucacugggucuuucuguggcugucugucuggucuuaauuacuaugcuucugaaaauuaauuuuaaaacguacaguaguguagauagucugaacccccccccccgcccccagugcucaucaacuucagauauccccagcugucuucuuuucacaaauaguuuugcauuuuuaagauaauuuuuauaauguaacauuuuuaagguagcagauaauucuuaaggcuaugauuuuuuuuuuaguuuauacauugauuuaucaaaagagcuuuaaccauuucauaguguuugacaaaugcucacauuucauauuucauuuguucucccccacaacccuauuucuuagggcaucuagauaucuaggagucgcauucucaaaugaaagcuuauuagucuuuuucugguauuaccuacuguaccaguaucaucacugauaagccauauuagugacacugacuguuacaauccaucuugauuagauugagacauauuagaacauugguaaagacacaccagggugucugucugagugucuccagagaugguuagauaaugaaggcugugacccaaugaauagguuuaauccauugauagauuuaggcuauugggcugcaguggaacuacgguaagucguaccauauggaagaagcaggccacugggggcauaauuuugggugcuaugauuugcccugaccacuuccuguuaguguguacucagcuucuggucugccuuggugugagcugcuccauuacccccuuccuguugugaucuaaauaugcugcugaaaccacagauuuaacugguuacucuccuaagcugucuaugucaaguauucugucaaaggcacacagaaaucuaaccuguuaauauauaaagugacuuuuguuuuggcuuauugaguagagcacauggcauguaaguguggggaccugaauaugaauccucagaguccgugugaagccuggcacuguagcuugcuucuuggaucucauuauuacuguggugacguaggagcuacaagcaggggugccaggaggugugcagagcagcuagucugaugucugcuucucccugugucacacaggucaaaggugacuccugagguccuccgaccuccacaugagcaucauggcaccacaccacguauauaaauacaccacacacacuuguucuucauaaauuggcauguaguaagauagccucuguauuugguauagggauggugaaguuuuuucuucuuuaauccuggaauucuuuuuuuuagaaacuacuuuuauuuucuuccaaaguguggcuuuuuuguuuuguuuuguuuuuaaacuggagacaauuauuuuugcuaauccaucuacuuuuuauuucaccuuuuaaaauuauuggugccuuauaucuuccaaucugguauguuaagacacucauuccacauaaucuuuugauguucuuacauagguuuuuuuuuauuguccauuuauaaauggaaggcaaaaaaaaaaaaguguagacugaagggugguaugaauguuuauggaaaaaagacugcaguuucuccucagcuccgaggauguugaucuguaauuuuauuuucaaaacugucuuuuuauuaucaaauuuguacucuaaguaugucugcuaucaguaagaguugcuucaggauuggagcauucuuucuuuuacuuauuuucuagguauaacuauuucaagaauaccucaguaaaacauuagugguuuccuuagggaaaagaagcccuugcugggggcaaaggaacauucgcaugggaccggcuagggagcugguucagucaguacauugccuugcaugcauguaaaaaaagaaagguagcaaugagagaaaggauuuuauguccuuuuuaaaauaugagcugacaucucuucugggccuuuucagaaagauaaauuucaaaaauaugggcugaggacauugguuugguugcuaaagcacuuaaugcaaguucaacccccggaguucacauaagaaaguuggcaugauggcaugcacuuagagugacagggggauuccuggggcucuguaauaagccaggcuaggcugcugggaaacuccagaccugagagagucuccuucuccauagauagauagauagauagauagauagauagauagauagauagauagauagauagauagauagauagauagauaggcagggcaggcaggcauacacacacacaaauacauauacauauacauauacauauacauauauauguaaaaaugucugucuaggccuguugguaagcugcaggacagcaagacacuuggccucaacaauaaacaaacaaauggcaaauguguggauagcacccaagguugucccuacccaagguugucccuggccuccacaggaacaucacucaaguaugaguucacucacucacauaaaauagugucucucuucuacaugacuccugacuuuggugaguaggaaggagugguagcuugugaggguauuauagaugaagucacagagagacaagagagacacaccccagaguauuuguuagguuuuuguugcugugauaaaauacaaagaccaaggcaauguaugaaaggaagacuuuauuugggcuuaugguuccagaagaagaguccguaauggugggaggacgcgcaugguggagaaggccagaugaagaagcugagagaauauaccuucagccacaggcagaaagcagagaagugggggcaaaacgauaaacugugaaagcccaucuccagcgauacaccuccucuagcaaggcugcacuucauaaaggccccauaaccuuccugagcagagccaccagcacaagaccaaauguucagguauccaagccugugggagacagagccaguuuaccgccacacccaggaaggagcguagauuuuauucaauuauugaaguaaacuacauguuaaaccuuguguuuuuguuugacacagguuucuuuguguaguccuugcuuauccuggaacuaagcucuguagaccaggcuggccuugaacucacugagauccuccugcuucugccucugccucccaagugcugggaugaaaggcguggaccaccccucuaccugaacaguaaaauucuugggaagcuuuuaugaacagcggccuacaguccccuugguggcugaaugguuacagcguuguaccguguugcuaugcagaggcagcggcaguggcugcagugcauauugagaaugcuacuuuugcucuaguguccuccaccucagagacgggacgauuauuuuacugucucaggaacacuuggaaaagaguauuaacacugccacuucuuaucuguuacaaguugcuguuaccauuuuuuuggagggagguggagggauaagauaugaacaguagauuuacaaaaauauagaugugauggguucuuuuauuaagcuauaaauggccuacuuuaugauaaagaagacaaacacugcagcucugugcaugauuaccuccuugcuaaugcagaugcccgagcaauacuguucauguaauagugacucaguuaaauuguauacggggguaagcuaauaugccaucuguauguauguauguauguguauauauauauauauauauauauauauauacugcaugucaguauuuuaaauucaacuugaguuugacuugaaauaccucugcuacaaucaaguuuaugaggaauguuuuuagcacgugaucuauacuaauaaauaauuuaugcuggagaucuuugcauauuuagguaauuuuuuuauuacuagccauuccauucuguagcugugcugugauuucauccuuuguacauacagugugauucuuagcuguucccuaagauaagcaacugugaauguguugauguucaaaugccgcuucagagcauugugguccauauagaaaaugcuguucucuaucucugucucugucucugucucucucucucucucucucucacacacacacacaggcacgcacacaaaucagugcaugugucugacaaggaaucccaugucucucuugcccugucaguugaauggcguaagaagcgaugguaccucgguagggaugagcaugcuccgcucacaguagcucucaguuguuaacaccugucuaaucaaaggaaccaggcuuucuugaagaaaugccugacuccuuggacuggggaaagaagugaacauuucaggugaccccauggcaucuuacaguaccagugugugagaaauauuuaaacacccugaguuauuugucagcuuccugcuggaagagugcacacuggccagaauaauaggagaccaaaauaaauuaguauucaguuaaccagaauauaaaguuauauugugauuuauacugauguaaaucucuugugcagaauuccaacuuauaaaugaagccaugcauguguaacagcuucuuacuucuaauuuuguuuuguuuuucaagagaggguuucucccuguaacccuggguguccuagaauucacucuguagaucaggcuggccucuaacuuagagguucaccugccucugccucacaagggcugggaccagaggcgugcacagccaccacagcccgccugauuccuuacuucuuaaguguaaaucacacacagcagcgucuuucuaaagagugcauuguaaggauuugggggaagaauaaguugcauagggcaaaccugagaaacacgaccuuagucagcuucaacaauuauaaauguguugauaauauuuuguggcgagaauguacuucauuuuugugauuuuuuuuuuccauccugcaaaugguaacccuaguuuaauuguaagaaaacaugagucagauuccaguugaggaacauucuaugcaaugcuugauggugcugaucaaguucuuugugucaucauaaacagggaagucagacacugucauacccaggaguaaccugagaauguguguuuguugcagugcaguauaaacuguauaggauccuagaacagaaagagugcauucgauuacaaccaaggaaauggaauuaaauaguggacuucaguuaaugauaauguauuagcguugguucacuagcuaugacagaggugccacuccaguguaagauguggauagcagccaguuguguauggggugcagaacucuuguguucuacguuuguguuuuccugugaguccacagugauucuaaaaagcuuauuuagaaaugauaaauacuugcauuuuuccaauaaagauugccugguugccguuuugugaguucuggaguccugaucugucuuguagcuggguuucuggaauuuacuaguuugguagaugaggacuguuggaauucagauuaccauguuuuucaucuuauuagagauguggaauaguuuauuucauaggcuuauggggcaucgucuccucccccauccaugaaccuuuaagaucuuuaguuuucuucugggucuuuggccuuucccuuuugguucuguucucuagaagaugagcacuuuaugugugaucggagcuucgguugguuuguucguuuuuuaaagauuguuuauggacuuuugaaaaauugaggcuuuuguuuucaugcuaacuuuuuauguuuaguaauauaauuaggaaaucuuacaucacaaccaguuuuuaagugaauucuuuguuuuugcccucugcggugaaguuucuguuuucuuuaaguacauuacuuuuuauuauuuggaaguuugaaaagcacacagaauauaguuugaucauacucaacccaucuaccucuuccccugucaauuuccuguuucucuaugugugugucucuaugucucugucucuuaaauaggccacugaguccaauucccgcugcccauuuaaacacgggugugguccaucuaauggagcaagguggaccuaccagggccacacccuuaaaguaaaugacuagcauugcgaagcuucuguuuacacauuuagauuuuaaguucuaaauacuucaguuaguccuuuaguguccuuggcauuuacaucuuuuauuauuacuauuacaucuguggaucuguggugguggggaaaaaagaggggcauguagggaugucagggggcgcuugggggacuguuauccccguccaucaugagaguccccgggaacuagcucagguuaucagauuuuuacugaagagucaucuuucuagccccuugaagcauuuuaaacguucaugcauuuacucuuuuuuuuuuuuagauucauuuuuaaauuaugugagugggggguggguagggaggguauaugcaggugaaugcagguaccccaggaggccagaggcauugguaccccugaagcuguaguuacaggugguuguaagccacuugacaugggugcuggggacugaacuuggaucaucugcaaaagcaaaauggccauugagucagucucucuacccuguguuuuuugcauucgagauaaggucuaaucaugacaguccuccugccucagcauccuaagugcuauuacaggcauagcauuuacucuuguuggauaggaauugcuaacauucuguagaagacuuaaggggaaagcucucucaguugugaaucacguuuuauaaaugguuuuacagcuucuuucacuguuaaauuguaccauauuuuucuuuuguuguuuacugcuauuggugauuauuuauacauucaauuuuuccguauugugucucucagauucuuuuuccuuaaaugaguaaauuugucucugauguauuuccuaucuuucuuauaaggccucacucauuguauccauugugauauuguuaguauauuugauaauuagggacguaaucaguggaccaauuaacucucuuauuaagacauugaagcuaguugugugguuggaugccgucuaauauagggugauaaucuagcauaaccuucuacaaagguauucaaaauuuccaacagggcuuauaaugaauccaguauugcugaacugaauucuuaauagacauuugggaaguuguccaguagugcuuuaggaauguuuucgccuggagaaugguaccaaaaauaggcuguugauuuuauuacuuaugccaguaaaggagugcccuuguuacagagcugguagugucuguggggggugaugggggcaacaugaugaaaugauuagcaggggcagcgaaacuggauuguugagugucggggaggcugguuuacaauucguauucaaugcuaggcuugauaggaguuagcauaaggaucaugauagaguuuaaguuuugauugacacaggcagcaaggcaaguacuuuggggugagguaaucaaacagcuggaacucgaacaaucaauuacugcuauuuacugaaacugaauagucugauguugguuuauaugaggcuuuuuuuggggaguuccugaaaugaacaaugaaguuauuugaaacucuuaucuucccacuagaaguuuccuggaaaagugaagucauuuuacugcagacagaugacugccggugguucggugguuccuguagccugugacuuuaguguagacaguuuggguuguuagcacccauucugaaccagcacaagcuugaaaauguguuuauaaaaaauccgauuuuuggucccaucuguagaccacucagccuuuugauggcugcuuugaugcugaccuuuuccaucucagcaacgagguccaaccuuaacuugguauuuuugacacucaaguaggcaguugaauaugaguuuguagucaaaaaagaguucagaaucagaggaaaaaauagugaguuauuacauagaugcuuuugaaacaugugccugaauguguuuuucuuagaaggaaacaguaagaaaaauuugugagcuuuaagaguucugguguuguuggucagugguggcgcacaccuuuaauuccagcacucgggaggcagaggcagguggauuucugaguuugaggccagccuggucuacagagugaguuucaggacagucagggcuacacagagaaacccugucucgaaaaaacaaaaacaaaaacaaaaaaagaguucugguauuuaaugguuauacuggugugugcaugugcgugugcguguguggcuagcuaguaguucagagagaaugagagagcacggaacugauagggugguguuuggauguuaggaaaagugcuuuuaaaaucucuuacuuuauguguuuugcugauguuugaccugcacgcaugucuggguacuacaugcaugcagugcucaaagcagacagaagagggcagggucuccuggaacuaauguuagggaugguugugagcuaccaugugggugcugggguuaaaccaugguccccugggagaacugcuaguguucaugacugcugaagcaucucuccgagagucucccccaaaaauguugcuaagaaugaugaagaaggguggggguauagcucaguagugccugcuugucuugcaaacacgaguaccugaguucgauacccagaaccuauguuaaauuaaaaaacaaaaccaaaaacaccagccaggcauggcgugauggugcgccuuugcaauccuaaccuaggaagguggagacaagcugaccucugggauccacugggcacccagucuagucuccuuguuaagaaccagagucggugagagaccguguccacaaacaagguggacagcaccugaaguuguccuauggccuucauauccaccccacauguguguccguguauacauauacacgcaacauggugaaagaggucagacacucaaacagggaaggagaggugaaagugcugucuagguuugcugagggcauuccuucucuuaggcuuuuuuuuuuuuaaagauuuauuuaucuauuuuauguauaugaguacaauguugcuguacagaugguugugagccaucaugugguugcugggaauugaauucaggaccucugcuugcuccggucggcccugcucgcuccagcccugcucacuccggagaaaaucugaagauuuauuuauuauuauacguaaauacacuguagcugucuucagacacaccagaagagggugucagaucucauuacggaugguugugagccaccaugugguugcugggauuugaacucaggacuuugggaagagcagucagugcucuuaaccgcugagccaucucuacggcccaggcuucauuuuuaaggcuaagcaugugaggguguguuggugugcccgugagugugguugcgcacauguacucaguugugguuugggugaaaggucaguaguuggaggcaggggguucugguuugccguugacuugggguugaucaagcagaguugagagcuaacguacagugugaaggcacauuucaguuugcugacuaaaacugcugcuuugacuguccagaaagcugaugugaaaugugcagauggagagaaagcuuaaguagagcagaagucauguaagucucuguuccggcugguuuuguggaucagcuugacacaagcuagagucaacagagaggaaggagucucacuugaggaaaugcuuccaggagauccagccguaaggcauauacuaaauuagugaucaaugggggagggcccagcucauuguggguggugccaucccggcacuggagguccucaguucuauaaagaaagcaggcugagugagccaggggaagcaagccagaguaaacagcacccuccguggccucugcaucagcuccugccuccagguuccugcccugugugaguuccuauccugacuuucacuggugauggacugugaucuggaagugugagcaaaauaaacccuuugcuucccaacuugcuuccugaucaugguguuuuuguggcagcaauagaaguccugagacaugcuaacauagccaugccuugguuagcaugauggggucauauucugagaaauacauugcuaguagguaggaaguuugguuauuguccaggcagccuguuguacauagacaaacuagauaguguagggcaguuauucagcauggcuucccuuuuaugugcuuguguguucacgucugcagugcacacauguuucauggcugagguauauauaaaacuauaacauucaacaccuucuucuacuauauauucccaauguuggagcaucauauguauauauugccauaaaccaauccuuacucgaucucacguucuucugaggugguuguuaguucuuguuuuuaaaggggcagagagcacaguucucucagcauccauccuucuuugcucuccuuaguaucccagugaaggagucaagagucaguugucagguuaggcuuacucuaaaaccugcucucacuucugcugccuaaaauuucuuguaugcucuaaaaccuucaccauuaaugccagaguuguuuacagcuacccuuucaucaugggagggauauguugacgucucagauuucgagggucaacacugaacaggcagugagaaacaauucuaggcucauggagacaguuacuaagcugaauucauuuaauucuacuuaauagaaaguucagucagucagaaguaucuugaucagaguucugauuaauuuaagcauuacuccauccauccauccauccauccuuccaggacaggguguuccuauguuguccagguuacccucauuaucuuguuuccaggcuagccuagagacuucgauauucugcugugcuuccugaauucuggaauuacagguguuaucacuauccuuagccucaaguguugacuguccuaaauauuugcuaguguccucauaggaaacuuuccuuuguauauugaaaaagucuuuauuugggcaucuuuuugcuuuguuuuguacuaaucugacccacuacaucacuucccuguuuaaccuucagaaguuuccuaagaaaguagaauugguaccacaagguacaaauacauuaaaacuggaaacagaggagcagaaugguggcuguugaauuuagcccaacacacacuuucuucauccugucuucucugcucuaggccuugugaggagugcgcccgcuaacugcugucuuguuaugcucucuuccucuccaauuuaagguugguaugugaacuauuucuaauucucugcucagcaaguaauguggacaauuuuagcucaccccgcuccaaaucauacacaaauuuccuggagugaaugucguuguguaguguugagggcaacuggcauagucuuuggaagaacaguccaguuucuuuagaauauuucgagugaucuuuuccuacugaaaagcauuaccagcagacuggagagagccggcaguugcagugcauugccaaggcucccuguugcugaggaagguugaccacuccucagcaguuuauccuacguaggcuuuaauaaaggguuagucuagcaaaaguaacaaaucacuauugugucauaaauuacagagugaccaaacaccaugcacaguuguucaguccacuugugucuuagagacaacagcagaaaguugccuacacagcuuucuuuguucccuucaacugaaaccaacauaaguaucuugaaaauaguuuuucugagauguaccuuuaaaacuuguaaaagaaaacauauaguauuguucauugaaaaauguggauuugcauuuuauuaauuuuuucaauuaagaguuugauagagcaugcuuugagcaacguauccccgccccuaacuccuuccagaguccuccuccuucccuauccaccugaccuuugguucucuucuuuuucucuuuucuugaccgaucaaguccaguuugugcugcccauauauaggaugugagugcggugguaucagggugacucuuugagaaauuugaguguccucucccagccaccuucaguugucaaaaggugccuuggcuagggccaggccuucauauccauuuccccucucaggcugggauuuggucuagcuuggaauuaacaccuuacucucaugguagcuguaauauguccuuuaaaauauguaauuauauaauauugcguaauuuuucuuauuaaaauuaggcccucuuuaauuucuuacuguuagaguuuaggggugauuaaaucuauucuuaaaagaugcuuuuuuuuuuuuuuuugagacagugucucacuuuguagcuuuggcuggcuuagaucucacugugcauuuuaaauuaugcuuaccuguguguguuggcuuguagguaugugaacaggaguauaggagccugcagaggcuggagaugucagaucucuuagagccaccagacagaggcgcuaggaauugaacucaggccacugagugauuucuccagucccuuacgagguaauuaaaaggauaggugauuggcuagauuucauaggaugugcuuacaacauuauaaucauaagcagucucaucagcuuuguagacugacauacuuucgcuugcuuuaaugugauauauacucuaagaacauuuaugcugauuaggaaauagacuauagcgaauuuagacauugcucagugaacggggccugguaucauaggcugguauuaccagcuauuaaggaggcugaagcaggaggaucacaaguucaaagccuaccuagguuuauagaaggacggcaaggccagccuggacaauuuauuaagacucugucuuaaaauaacaagagagcuggagauggauagccuagugccuaccuaaaguauacaagugccgccgcuaccuaccgggaucugggagaaugaagccagucagugaggcggacuaaagucucaugcgcuggccaacuuuauucagagccucagacaaaucuauagucguaggguuaagaagggucaccugggggcuggagagauggcucagcaguugagaacacugacugcucuuccaaaggaccugaguucaaaucccagcaaccacaugguggcucacaaucauuauaacgagaucugacacccucuucuggugugucugaagacagcuacaauguacuuacauauaauaaauaaauauauauauuaauauaaaaagaaagagagagaguauauaaaaagaaagagagagagagaaagagaaagaaagaaaagggaagggccaucugaguaaaguucucucguugucaagcuguaaacaaucacaaggacaagccgcauguggcaaaguaagggauaauauaaacacuuaauugacuaacaacagcaagcaauaaugagggaucugaaauaaacucaguccuaucagaccuggaggagcaugaaaacgcauucuaagcacucagaacucuucucagacaacucaauuccuagacuguguuccaacauagaaggccccagauuugacaaaaagguaccaguacuaccaaaaaaauguauagacagacauguacauaucaugagaaacggucugguugacaaccugauacuuuuuuugguugaguagcuagaggauuuauuuuuaaauguuuccauccuuaaguaguuuaugauauugcaaaagcuuucauuuauaaagcccauuuaaaucuugaugaauaaaucaguccagaagaccaaucuuuggauuugaagauugguuagaaacagcuuuagagaaguggguuuucaauguuuuauuuauugauugauugauuguuuuguuguuaguuggggacuuuauacucuuaaaccauuuuuaaaauuuuuacuaauuaaaaaauucguuuaaaaauuucaugaacuauauuuucccucccccaacucuuuuccagauccuaccuaccuccucccacuucauaaccuuucuguuucuaaaaauaaaaaacaaaaaaguccccccaacgcacaaaagcaaagcaaagcaaaaaaaaaaaaaaaaaaaaaaaaaaggcagaguuccuuuguauuggcuggcuauugcugaacucgccccuugcccugggaugcgguugguaugcccaacaucaacuucuauugaaggaagcugauuuccccucucccugaaaguaucaaguguaaguagccaucaaauucuuacauuaucaugaaaauugcuugacaccccccccccccacacacacacacacaaagauuuccuagucuguucuuuggaaguuuugguuuagagcagugguucucagccuguggguccugaccccucuccagguuguuugauccuuucaacaaggguuaccuaagaccauagaaaacacagacauuuccguuaugauucauaauaguagcaaauuauaguuaugaaguagccuggcuuuuaugguuggggugaccacaacgugaggaacuguauuaaagaguugaagccuuaggaacguugagaaccacugacuuagagcaaaaugacuccggcuggaccuuggguuguacaugcauacggccuucucuuccuuuacuagacauucacuagauucuacuuuuggaauugacugucacugaguaaauacauuucguucuguauaaacuguuugggugugguaaagucuccuagcugucacuauaauuagucucagucacagucuuugacuugggauguauuuccuuguguaaaaugggaagggcaauagcaaccuguggcaguaauuaaaguaaugcacauuuguaccauaucucucuggcaauaauacuaccugaaauauguuacauuuugucacauguauuuugggcuaugugauggcuguccuugguugucaacuugacuacacauacaaccaaaacccccaaauggagggaauaccugugagggauuuuugcuuaauuugaaguaggaagauccgcuuugaggcaggaagacacccuucaaucugggccacgccuucugcuggaagcuuauacgaagccagggaagaagaaagcucuggcugcucccucucacauggacagcaaguccaucccuucacuggcauuagcgcccacuuauuugggauuccagcugagacauccagcuucaugaacagagcaaguaguggauuuuuggacuuuuuguucauaaucagucauuguuggucuuccuaaacagcagccuguaaggcauccuaauaaaucccuuuucuauauguagagagagagauuaugucuguaaguucaguuuuucuagagaccccugacuaauacaugauaauuugguuacauuuacaaaauauacuaagcagugacuacucugugugucuugcuuacaaguuacuucaggagagugauuuuuguucuguuuuauuuaacguuauaucccucuuuugcauuuuugucuaguacuuauauaauccuuccagcaaauaucucucaucuccaaggugcucagaguauauggcuaaugauuagaacaguuaggaaguuguacuguguagaugcauuugaggcugacuucagaguauaaggaauacucguucuaaguaaaaauaaacuuggaaaaaaagcaaagaaaccagcuggugcauucuuuucugcuaauuuuuauauuuauugacuuuuaaauuuaguucauuauuuauuuauuuuuuaaauuuauuuauuuuauuuauaugaguacacuguagcuaucuucagagggcaucagauccuauuacagaugguugugagccaccaugugauugcugggaauugaccucagacccucuggaagagcagccaugcccuuaaccacugagccaucucuccagucugacuuuuucaucuuuuugagacagucucuugcuauauuauauacccgucuuaccuggaagucacuaugagaccaggcuguccuugaacuuacagagagcuaccugcuucugucucucaugugccaccaccaugcaugaacugugcugaguuuuagaacuccuaacagaaagagguuaggaagggcccagccagugcaugcuuguucauugagcaaagguauguguuuauucuauucugugcuggaucauacuguguauggacaagcauuuuuaaaaucucuuggccuucaaacggcuucucagcuaacuuguuguaacuugcucuaggcuuuuaacucuuuacuugguaagugucuuauguauaaaaugaggauaauuuuaaaaauguuaaccauuaauggucgaaugaauuaauauauauaaaugucucaaacauucugggauguaauaccacguggcugcuuuccuguuacagaauacacugaaaagggaauagccguuauuucauugauaguacuaacaucuagcacuccuauagagaucuuuuuuuuaagugacuacagaaaaacuguaagaggagaagcucacuccuucaccucuuugcuguuuaaaucauauuuuaucacuuugacuuacaccaggaaaacugauaaaaggccagaccugacagucuuuaggauguauucuaccuaaaauuauauuugaauuuuuuuuaauuguagguacuuguaagaaaaauggaugacuuugaaagcuucuaaauuuaagcuaaaaauuauuaacguguauuguauaaaauaauaaauuucuuuagaaaaaauuuuguuuauuuugugaguuugggagaguuugcuggaguggugaguguaugcggacaguuuggggcugguugcucuggucggagucucuaauucaggaugucaggcuugagagcaaguuuguuuguuuguuugcuuguuuuugaacacgcugagccauuucuauacaccuauaauggguuucaugaugacauuuucauacacaaauacaguguuccuugaucauccugucccucuucccaguccuuacucaugaacauauuuugguuuuuuuagacaaaguuucucugcauaggccuggcuguccuggaacucacuauguaaaacaggcuggccuugaacucacugagaucugcccgccuccgccuccgccuccgccuccgccuccuaagggcugggauuaaaggugugcaccaccaugccuggccuagauuguuggggcauuuuaauuucccucuugauuuugucauuacccuccagaucacucagacacucuuacuguucuuuucucaagaucuuguagaguuucuacuuucuuacugaucucuguucuccuucccuuacggucugauggcaagaaagcacuacaguuccuuuauaguaagacuuguguuauagccuaagauacgaucuauuuuggagaaaguuccaugggcuccugggaagaauguguacgcuucagcuuuugagugguguauuccacaggugcucugugugugguauaguuuaacugagauuuauuuauuuauuuauuuauuuauuuauuuauuuauuuauuuauuuuuucuuuugccauuuuuuuucacuccggcuugaucugucuuuugaggagagugaacuauugaggucaccuacaugaccguaccuggaccugugucccucugucuguccaguaauuucacuuuauggaguuggguacgcuaauacucagugcaucuguauuugcagucauugugucuuuuuaguggaguauuccuuucauugauauagagugaccuuuguaucuucugacuuaguuggcuuugaacuuggccuaguuggaugguaguauaguuacuugggcuuacuucuaaguuuucauuuacugcaaacauuuccucucugaucacuuucagucuuaguaucuuugccauaggcugagguuuuuuuucccccagacaucaaaggcucuuguuuguaauucaguuagcugcugcuguuguuguuuguuuuuguuuuuuuaaucuuuuaauuggagaguuagacuuuuaaagaccauuuauaguuagaauuguuagacaaaguguacuaauuucuuuguucuucaccuuaacacugggcuggcuuacuuuacuaacaguucuugaucccccccccccccccccccccgaauucaucaauucucccaguacaguuuguuacguccugagcucuccccagggcuggcguggugacugggaauugcuuuacucucagagaaggucuguuugauuuuaaagguuggcucuguuugcuacgguaaccuugggugaugguuuuguuucauggcauggcccacgcucuccuggccuuagggaugucugcugagucaguucuccugauuguuugccuuuacaagucaucugacacgccuuccuuguggcuuucagcauucuuauucuuccuuuguucuauacucuuggcgguuuaacuauagucagacaugggggaugcuuuuguauucggauaucuguuucauuccuggaauuucugacauuuucuguaucuguuucaauguaauuucauugacuagauuuacugcaucgcuagucugcguccuagcucgcugacccucucuacugauucauagguugggccucuuaguacuguccugagagucuuggucuuuaguggccauuucugaccacuugcuuucuuguucucucuuaaugcuuacugucucccucucuuuccccaucuccuucugcuucuguuucccugucccacccucucccucuuccuguuuauacuucaguguuaaaauuccuuggccuuuuguccauccuuggaacucuuucuucuaagaggucuagugucuuggugguugauuagaguuuuggguugacuuauugaacuuuaguuuuaaggauuucauaauugucccuccagaaucuuccucauuguugaauuucucauccacauguuuagauuucucacuuaaaacuuauauucacguuuacuucauggauucauuuaugagucgucuuuaaacugaacuuuagaauccuuagcauuuuaucuguuucacuacucauggauucaguuauuaaagagucaagauucuuuguagaaguaaacuugccuugcuuuuuuuuuuuaauauuuauccuucuguguugugauuuacccauauguugaaauugauaucuuucccauuuuuauacugcagccuugucgugguuuuugaaugagaauggcccuccuaggcacagaguuggaugcuuggucccuaguuaguuguacuguuugggaaagauuaggaaguguggaguuacuggaggaggugugucacugagagugggcuuugaaguuucaaaagcuucugcuaagcccaggcauagucacaguuugucuucucccucuccuucuuccucucccucucugugucucucugucucucugucucuugucucucugugucuccugcuuguggaucagauauaugcucucagcuacugcucuagugccaccauguuuucugccaugauaguccuggacucacccucugaaacuauaagcaagccccuaauuaaaugcuuuccuuuauaaguugccuuggucauggugucuccucacagcaauagaacaguuacuuagacaggucuuagauagcauccuucagaagagcccacaccucaggacucuucagaaaggagaaagcaaaccacuguuacaguaacaaccaagagaaaccgaguacagaaccacgauaaaaauccacuaaagagagcuaucagucuacccagaacugucagaaaaaauggcaaaaauaacugaaaguaagcucugauguuaaaauuuuauuauaaaacugaugugaggaggagcagggaaggacgcagccauacaguuaaguaaaggcagacaaauaacaaggaacgccccugaggaagacagugguaauggagcgcagauacaucaaagcuaaguaggauguagcugggaaagagaaaucuguuuucuucagaggacuuagcccugaguuuaucacuuacacacaccccagggcaggccucaugcucagccagcuguacuugaccgucaccgacccuucuccagguuuuguuguuuuaaagagaguaagaacaugaagcugggugguggggaaauggggacggaaaaguaugauaaaaguauaucaugaaauucucaaaaauaaauaaaaacacgauauacacaacauuuaaauacugagacuguagggaaaagaagacaaguaauuagugacuuuuucuuuaaaauccucuaauauuggaauaagucagggcugggggcugaggaaagggggacagauuggguugucgcuggaguguguuguuuucccuuguucucacuggagauagaaguuggugcuguguggucugagggccaggccauugaggggcuacacccacuguagauaaucuucuuuguguacagugccccacugcaggcccaaaggagcuguuuggccuguuggcaggcagauucucgcucacaccagagacccuccauuuuguauaaugggaguccacacauccagccugugugguggcaagcaugcugcagaguuggugacaugagaagcacaaggucuguccuggauggggagaacugagggucugggcucugcccgcccggaucacugcuuucagacacuguccagcagcaaacuacugugcaggaggaaggaagcuguggaaacugaagaaucugucagauguggccucuacacugccugucccacccagcagcaaacugucaguaaggcaguucuggaggccaagaccauagccaccgccaucuccauuguacuggccuaggcaugggcuuugcuccuuaccacagagggcgggcccaccucauccuccacagccugagaucucugcugcguaaauauuugagcuggcucaagccucaccauuccccaaccauacuucuucuuuugcuacuucucucacccagaugcuguggcugccuuccugacgugggauugucacccuguucaaguguccgcgguagauagucucacagcacuagaccuugugguuguagcguccgugucuucccacugggaacccaggauggagcugggacuguucacagcuuuucugugugccaccucuguuucucugugccuuuucaaugucugcuuaccuccuccugauccccaguggucuuuucuuuccucagaaucuagcccuucucauuuauuuacacagugguaauggggaaaccuugucuuccguugcacuucugaagucuacaacaauauuuaaauuaccucaacuugauucuaacuuuccugagagaaaaacugucuguuaauggcucuagauacuaauaauuucccauaaacuuguaaauaaaguuuuuagagugaaugcaaauuuaaaauuuuuuuuuccucuacuggguucaggaacaaguagacauaguuuaggaaaaaugcuuucaaauuguucugcuuauuucucucauauucguuuaaagguuacagugacuacuguauaaucugcaggcugucugauuaacuugcagggcauuauacauaguucaguccugagacugcuuuugguugucuuugguauacuguucugggucaagugucaggguaggacgccauuaauauuaucucauuccagguccauagcaucuuugagcuuaauucuucugcuuacagaaaaguauaaauaggaguagaaaccuuucuccguguuuugugucacuggggauaugggggaguaagcaguacuugcacagaaggugugagaucgugucauaugucgcacacagcagggcccgagguuaagcuuagcugggaggagaugccuacagcaagaggugcuguuacuggucugugcgaggcugaaaaacagaucaagucuguauggggaaaaggucauguuuuccuucugcuuaaaacaacaacaacaacaaaacgagguuuugaaagcaauuaaagccacagaaaaggagauugacucuuggggagggauuuucaugauucacacacuuuugaggucuucuaucuaacugaguauuguuacuaugacuagaugaaggguucucgucugauauguggguaaauuaaacaauucugauugcacugcuccugaguucuggagaacuuuggggucgugcuuggauuuuuguuuugcaugugcuuggacacccguugacuuguauucucaucaaaagcuauuauaucaaacaacaugauaaagacaaauugauuuuguaauaucaggucagacuuacaguauuuuuauuacuauauuagguaagcaguaaauacuguauuucaaauauaucuguuguaaucauaaaguuuuugagauucauaaguuuguuuuuuuuguuuuuuguuuuuuggaaaggaaguccuuguguggaaucuuaauuauauuaaagaugauggacagacaggcauauuacaacuucagggaauauugaauuugguuccuuuuuuccucuuuauccccuuuuccacuauaucauuuaagauugcaaagaucuuuuaugacuuauucaucagcauugcaguaggaaguuuaaaacaugcuuaguuuucaaugaagacauuuguuacauguuuaacuuuuucacugggggcauuaucuucaaauugaguaagagcuggugagauggcugaggcgugagaugcuugcugucaagccugcuggccugaguguagucucugagccacgugguggaagucaaggauacacagaauuguucucguaccuacacucaugcgcauguaaauacauuaggggaauaaaaauacuucugugagugggguguaguagaagcuccuuuaacagucucugagucaguaugugccuguuucuucuguaagacugcuggcucggacauauuuaaugcuaacccuugaagagauuucugucuaguuggaccuucauuuuuuccuguuaguuguuagucagcuuuacuuaauauauauauacauaauauacauaauauacauauuucuguggccgagucaagcacuaccuaaagcagugaaguguuagugcauacagaguaauuccugugagaaaagucuuggaguuggauguaaggaagacaucugaaagucugcaaagguucuaaucacccaagugaguuuggcauugguuguuuuaugcguguuuucaaguuuucccuucacccuuagaucagcuagaggugggguguaucugucggugugugguuuauuuacaucagggagucuuacuggggaugggcuuucaucuaggaaaggacugguaagcacauuugaauacuuuauuauuccuuuuaaaagguuuaggauuuacacgcgcacacacacacacacacacacacacacacacacacacacacacacacacacacacacaguuuuccugaacuaccaacuagauuauuaggcugguccuaaguuaguuucucacuaaauucuuauuuuuagugacuauaccuucuaucuugcauuuuuaaaaacaaauucuaacaaaaaaauuaauaguaagacugaaguacucuguuugagagcuuuaacauagguuuuagagcagaauuggaauaccacauugauuuuuguaguuaguacaccuuauaguuccaagcacuuaaucaugcugauuuuguuuccuuuuguuuuuucuucuauauuaauuaauuaauuaauuuuuaaaauuagguauuuucuucauuuacauuuccaaugcuaucccaaaagucccccauacccucccccccuccacccacaagaugcauuuugcaaacacaugaaacucaagaagaacgaagaccaaaguguggacacuuugccccuucuuagaauugagaacaaaacacccauggaaggaguuacugagacaaaguuuggagcugagacaaaaggauggaccaucuagagacugccauauccggggauccaucccauaaucagcuuccaaacgcugacaccauugcauacacuagaaagauuuugcugaaaggacccagauauagcugucucuugugagacuaugccggggccuagaaaacauagaaguggaugcucacagucagcuauuggauggaucacagggcccacaauggaggagcuagagaaaguauccaaggagcuaaagggaucugcaacccuauagauagaacaacaauaugaacuaaccaguacccccuggagcuccugucucuagcugcauauguaucagaagauggccuagccggccaucaguggaaagagaggcccguuggucuuccuuuuguuuuuuaaggaccuuggaguuaccuaggaguuagggacguuuauauuccuucccaucagcuucugaauaguuuuaggacugaaggggagcugggcuuccccuuacauucccuucagcugacuuuucuagggcagacuuggacucuuaacugaguauaauggcuuuacacagaaauaucagaauauuucauuuccgagugcauaugaaagcauaaaauacuugcauaacuggaauauaaagggaggcuauuuucuguuuguuuauuuuucuuaguaaguugaggagugggaugcacccuucaggacuaagugguacuggguuggauugcacucagccucugaggcgcagugcccagagagagcuccaaagcuggucugcuggcggccacucugagcagcugacugaccagcugcagggcauguuggucugcucaggauugcuuucaucuuagagcagagcauguuaacacaauggaaaugcagggccacagagacgcuccugaccucaggguaaccuccuuucuuaccuuugaaagagggaguguucuugucacuuuccaguucuagccacaagaugcuugggaauagauagccacauaaaaagaguguggcauuucagcgauuucuuaacacgggcagaucuuacacuggaucuucuaguuuuccuuuaguguaaagggaacauuauucugagccugcucuuacauguugaguaaagagaguucuguucuucccugcucgcucacucgcucuuucucucucccuuucucuuucuuucucucucucuuucucucucucucucucucucucuuucucucucucucucucuuucucuuuuuauacuuagucuaaucuuccuggagcuccuguagaugcagcagggaaaaccgaccuacccugucccuaaaauauugugcaaaggagcagcaacucuuuccugauaacaaacuaguuucuuggugugugugugugugugcuuguguguguguguauggugugugaguguguguguguauauggugucugugugugugugugugguguguguaugguguguguguguguauauggugugugugaguauaugauuugaguguguguguguguguguguguaugguguguguguguaccagaagguucuggagaggaggucucucaugaaagcugaggcuuacagcuuuggucagccugucuggauccuccuccaggguuaaguuucagaugccugcugagcagcuggcuuccuugugggugccggggauccaaguaagagcuucacauuugcucggcagaguugcucgccgagcacuggaccccagcugggguacggauuccucuugucaggcuucucguugauaagucaaggccucuuguucuuauccucugcucacuacaaagguuucauuuaguuuuucuuuguuugcuucuguuuuugagacagaaaagcacucuguaguccaggauagccaaggacuugccauuuaucccagacuagcucugaagucacaccaguccuccugccucagcuuccugacuguggcauuauaggcacgagucacugugcccaacucugagcuuuauuuugcaaacacuuauuuguuccuucucugacuugcccgagaagauagcuauuucaccuacagaacuuucugagucgcucuauugaugagcaacugaauauggugaucaguuuccaagugauaaguuauauaucuacuuucccccauuaauuacuuaauuauaaaauaaccuuaaaucugcccuaauucauuaaguauagcucacauuucuuuagugguuaauaauaaauucaggagcucauaauguaauuacugaauugcgcaauucacuguaccauucaaauugccguuuuacuugguuaaguuuucacgguaccaaagaaaauucuauuacaccaaagaucugugcuugucucuugaaggacauauuuagagaaaaagaagaaaagauuaaaaauaucgugagauaaggaaggaaaagaaauaagauuagaaaacacauauagagguaugcuguaaaugacaaacauugaauauuaacagagaacagcaaccuuucagccagugagaauacaacagugaauaaggcguacauuaaagggaaaaauggccuaaguaugaaaguaaugcaauaccuuucacuaauccucacuaaucuuuuucuuuggggaauguggaauagaugggaauuuaagguuucuauguagaugucaaauuaggacuuacucaguuuuuccauuucugauuuugaauuucugauuuuguuuuauaagcucuauaaaaggcuauuuuuucaaacuuuguuuuuuuuuaaguguuugcccuuauuuagaauuuacauaauuaccucagaacucauaagaaaaauaccaaguguuuuuaacuagguuuuuauagguaaauauuugcaaaccacuacugcaaguacauaaaaaugaagaaauaaaaucaugcacgugguucuggcuauuaaucuguuuuuuuaguagccucugacacaugcuaaauuugugugguggcgagcaggaguccuacagccuggaaacuguuuguucuuugcuccaucccuccuuacauugugccaagagaaaguguagcugggagaaguagggguuggaaggacacucaagagggccuugucuucuuuuccucucacugcguggcagccucagagcuacccuggcaggagcagagcggcaguugguuccacugcauguccauugacccauccucaucaaagcguaguuagcaugagcucgucaugugcuccucagauugcugcauguggcuacugcugagccccuuggcuugagcucuuggcuucuccuguccugcucauuccuuucagagguucaguucauaggcuuuguguuucaaggcucugaguuguaauaauuccagcuacguccucuuuguuucuuucagcucugugcgaucccugcuuccauaauaauccaucucuucucuuuuuccuuuucaauucugcaguuccugguuagcaauuuacauuaaauucuuggggcugaugagauggcucaguagguaacggugccugccacccagucugaugcccugaguucagucucagagauccaaugguggaaggagagaagugacuucugcaaguugucuucugaccuccacacaugugccuguucacauacucacacacacauccacaaguacacaaauguaaugaaaauauagaagaaagacuguugaauuauagaugugaugcuugucuuuuuaucaaagccuuaacucauauacuugucaaaauaauauggcgcuaccaacuugagugccggaaacaauaugaagcugccuucauaucguaguuacugaggcucuccaguauggaggcuucucucucuucuguuauucagccagguaggcucuccugugggcccagaggugucugagcaucucauuuucacgcuucuguuguuugcucuucuguacuucuuacugcaagggugguuuguuugguuuuguuucuucucuaccuaagaucuauauacucaaagagcacaaugaauuuuuuaacuaaugggugugcuuguagauccuugugaagggcagaagguaucuguuaaugggauggaucuaacuuuaacagcugacaucuaaacuuccucagagguugaauccaaauccugaugucauaaguuguauaaaagcccuccagacuccacaucccugaggcuugacugggccuuuccaccuccguggcuccugagaucaaagcugcuccuccuccuuacuggccaguccucaccaguucgaguaagguguuccagagaagagacaaaccagucugcugggacacggucugcugggacacggucuggucugcugggacacggucuggucugcugggacacggucuggucugcugggacacggucugcugggacacggucugcugggacacagucugcugggacacggucugcugggacacggucugcugggacacggucuggucugcugggacacagucugcugggacacggucugcugggacauggucugcugggacacggucuggucugcugggacacggucugcugggacacggucugcugggacauggucugcugggacacggucugcugggacacgguccacuuucucaggguuuugccuguugugcuuuacuuucaaauaagucuucaagcuugcacuuuccguuccucagcacugggcccacacuaacacuguauucuuugcugcauuuaguacuuuuugauucggaacacccuccucccccaagugguuuccaggucucaaaguuauaguaauuacaucuuggcacauacaccuuugcugauuucuccauaacgaucuggauuauagacuuuagugucuuuuguguugacucugcguuaagauggguaccuccaucuaacuaugaauaaaacaaauuuauaauuacuguguuagcuuccugguuuuguugcaggauauuuuaucuaucucagguuuauguuggcucacuguuuuggcgaucucagucuguuacuggcugcccucuucuugguggcuuauggugaggcgcuccauccuggccauagagugaaaacagcagaagaaugguuggugccauccuuugauagcauguccuuagagacucucucuuaucaggccccacauccucucaguucugccccgucccaguagcucaguggcucuuuaauuguuaggccuuuggggaacauuuaacaaccaaacuagagaaauuacuuuucaguuccugcuuuuauuucucuuguuggucuguucuucuuccaacuagauaacuugaaucacauauuuuaggauuuuaggauucagaggagaacuucuuugaacauuuuguaugucugaucaauauaauauauccucacugucauccccagugcuagauaacagaccaacaccuucccuaucccaaguggcuccuaacuaccuguguaacucuacaaaugggggccugauguuugacuucugccagcaugacauggccccucaacagacauaugggaacacacauaauuaaauauaauaaccaaaucaaaucuuaaagcaaaaaaaacaaaacaaaacaaaacaaaaaccccaaaccacuguuaagucaguagccugagauuauaguuguuuagcaggauugaagaacauaagccuguccuuuugaccuugauuauuaaaguauguuuauucccuucagauuuuuaaucuccuauuaauuuuuaauuaugcccaucuauucccaguauuuuauaaacuuauuaccacuguuuuuuuuuugauaauuugcgcagaauuaugguagucacaguucauggcucaugauguacaguuacauguuaugaaaauaucuuuuagucuuuuucagucaauuaaaacauuguguacauuuaucuacuaagucagugguucucaaccuuccuaaugcugugacucuuuaaugguguggugaccccccaguaauaaaauuauuuucauugcuacuuuauugcugugauuuugcuacuauuauaaauaauaaucugcaaguugagaacuucugaucuaagcaauacuuuauuucuaguuuuaugaaagcauuaucaauccaagguuccauuuugauaagagugucaauccugggcagggacacagugucuuaguuuucccuggcaugcuuuuccucaggcuuccccuucucuugcucugacagggcccacagauuaacccuguguucuuggauguguuuccaucacggcuaccuuuugauuuagaccccaccccccacccccgccccacacauacccaagugguuucccgaucuugaaguuauaguaguuaaucagcaguggagugcauuugauccucaguaccaaggaaaaggaggggagcuguaucuuugaguuauggcggaggaauuuacguuuuaucagacaguaguguuucaccaugcacuguacguggugacugauuuuaaacuauaggacguagucaugagaacaaguauuuuaaaaugauucuuuaucuuucaggaaacuccugguuuuaugauuuuaaaauaacauuuuaaaaguuaauuuuuuuuaaacauguacugguguucuuucugcacguauaucuguguacuauaggugugccuaguacccuugaaugguugugaucggcagccaugugggugcugggugggaauugaacucggguccucuggaaguguagccugugcuccuaacuauugagcuaccucuccagcuccuaaagucacuuuuuuuuuuuuucagagucaaagaggauuuggcaaaauagguguagccggaguacauuauuaaauggaaaauuuguuucauuuauaaaugauguuccacuguucucuguccauuuuuucuuuuguuucuaucuguguaucaggguagggcacccccuuaaauaguuacaaucacucuuuugguucugucaggugagaugaugaugaugaucaaaagcaucagaugacuuuucuagauuauucucugaauucacugaaacuaagcagcuguuuaaaacagaaucuccuuuguggagacuuacugucaaccaauugauuaaucaucaugagaacguaucuuaaauuugaagauuuuaaagucagauuuuaauuauauuuaaauuuuaaccuauugacuaguaaacaauauauuugaaaauuugcuuaaagaaaauaauaaacuucuuguagaacuaaaaacauuaucuuuuuaaguucugaggauuugggguugugguuuauugaacuuacugggggcuaugcuuuuagagaaaacugacccuucucccaggagcuaagacuuacccuugacuaggggcagaccuguguucugcuucccucuccccacuggaucuuggucuguuuuaggcucacacggguuuuguguauggcgucucagucaucgguaccauaugcauagcugcuccgcuguguucagaagacacuuuccuucuagucaucuaccucuccugccucuuacugcucuuucugcucccuuucccacagugacugcggaggggaggggaggggaggggaggggaggggaggggaggggaggggaggggaggggaggggaggggaggggaggggaggggaggggaggggagggaagggaaggggaggggaggauggauguucuucaggacuggacgucugcagucucuagucucuuacucccuauaacuuacuuacuuacccugcugcuuguggacauguacugaaaacaggcuucucugaugacaugcuucaaucaaugucuauaaugauaggucauugggaguugauguaauacuguguccccuuagcagaauaguaguaguagauucccucccagagucuauggucguucuagccacagauucuuggccagguauggguuucauguuguggagcaggccuuaaauccaagcugaguggcugguuacuccuaggauauucaugccaggauuggauucaugcacgucuugccaggcugguuguuauuguaauccacacaguucaguccaccgggcaaugcugaugacugugaaacuagccagaaaagaugaugcuuccaggacggcaccagcuugcuuucuccauaugguuggugucuucagcaauuuggucuuaucucaagacuuggaggauaagcaagaacauuggcacuagcuuguaauguuugaaggccuuugggcccugggcuguggggacccauggccugguacacgugugaaggucaaaggacaacuugcuggacuuaguucuuuucuuuuaucacguggucucuggagaucaaauucaggucaucaagcuuggcuugguggcaagugcccuuaccagcugaaccaucucaccagccccaagacauuuuugguuuuuguuacaugguuuuaaugcugggguuuagauacaccuauuuucuuuugucuauuuugagguaacucucgcauguggcauaaggguccaaccuccccgaauuccaugagagugacuaguuuucccagcacaguuguuggaaagacuugucuugaugguugguuugggcucuuaguucuacggcuuagguguauguguuuccucugaugcaaguauuacaguguuugauuacugcaguguuucaccacuuuguaguaacaagaauagcccucuaauuuucuaauacuuuuagagcauuacaauuauccagggcccuuggaaugccauauaaauuuuaggguauguucuguuuuugaaaaaacaccacuggacuuuugauugggaccauauugaauauguagauccuccuugagccauaguuuuaauugauuugucuucuaguccaugaaaauggguuguauuuucauuuacauauaucuuauugagcuuuauucaacaguauuuuuuuaguuuuuagcauauguguuaucucauugcauaacucguaaggauuuaucuuuuuaauacuauuuaaauuacuguauaacuguuuccuuuuuaugugugaguguaugugugugugugugugcuguacaugcacaugugugggcauggguggagccaucuagcuugcuuuuugagagagaaugucucaccaauaaauauaucuuguccuggacuuuucuucauuguauuaauuuguucuuggauguuagagaucuacuuaaauuguacuuuuucaagaguaaguggauauuucuggaauauuuguucauuuuauuagguuacucucugguccauaauucauagaauuuuauguucuuguugauugaaaucaguacuaauacccucauuuuuaaauuguguuuauauauuuguauguggcacuugaacuuguguguggagguaagggcgacccugagggucucuucuuuccuucccugugugugucuggggauaaaaucaaucccuugucucggcagcagguccccuauggacaugagccaucucacucucucacugguguguuuucuaagucaguguaacauuuucaaagaacccaguucuguucuguggugucuccgcucugcucuuacuguggcccucuacuaguuaguuuccacuuuaauuggaucuuugcuuucuaauuccauaaagugucccauuuggauacuaauuugagguuugcuuuugauguagacagugcagcuagaaguuuucuugaugcuuagcucuacacuguaaguuuggguguauuguguuaguguuuucauugguuuuaagguguauucuguggucaguugugaguucuguaguguauuacuuaggauuguuuuguuuuuacauauuuguaaauuuuccuuguuugauaccuaguuucauuuuacuaaauucagaagaagauacacacacacacacacacacacacaccugccaggacuguaucucaggaguagagccccugccucgcauguauauacauaucccuggaucugauacuaaaaaaggaaagccauguuuucagucuguuuuguggucuugaggucuggucugcagugcguugugugaacccuugggaagaguuagugugcacgguaguugaugaagaauccugcacacgccugucaggucaugucuauuaaaugugcagcguuuccaaguucugucucuuuucgugugcuuuucuaacaguuguaaguuggcuguugacauuuucaguuuauuguaauuuuccuuuuacuuugcccuggaagccuuccuuccacucuaguguguguguguguguguguguguguguguguguguguguguguguguguguguuuugguuaggcaguucuguugggagcaaaugccuuaaucucucucuaauuuccaaaguauaguuauguggaauauaguauucuugguuaacauuuucuuuuucuuucuaauauauaaauaugcuguuccuguccucuuaauuucuaauauaucaccagccuuuuaucauguugagaaaccuuuguguagauuaaguagcuucauucugacugcuucaggauuucuuucugugggauuucuauauuuuuaguaaagaagugucccagugugguggucucuuuguauucuuucuaggcuuuggauauucacgucuuugucguuggaauugggaaguuugaggucaacauuaauuuuuuaaaauguauuugucuccaguuuugcuguccuucuagaauuuuuaggauccugguauucauguguguacuugugugacagggucccaaaugucccuugugcucagcuuuuuauuuugcuugcuagaauuuccuucguuguuugacaaaauaaauacuaaauuguacuagcguagauuauggguaaguggauccuucccuguugugucuuauuacucaaaugcacuacaguaagaaguuaugugcgcccucucauggaucuacuuaagcccaccaagguguauuuaaugcucuguguuagcuuguuuucuaucucuaaaguuccuuuucuugaaaaacaggacacccguauuaauaauuucccacuuuccauccuucccccaggccuuggaacuuuuaguuuuguuugcuuguuuguuuguuuuuaugauuuugucuacaguuaugaagauauuuuuacaaccuuguuuucuugccaaauuuauauuuugcauuugcagcauaacuccauuuggacuaaccacuuuggaggugcucauuagccacaucggccuauauuuuggguagccaaacucaguacuauauuaaaauguagcagcuauauauaguugaucuauguuauguguuauuauuuuauacuucuuugucauucuagaacaauaggcaagaucugugaccaguaaacuugaaaaaauguugugucaggguuccacaaugacacuauauaguuggacagacacaagggaccauaugacuacauuagagacaugguggcugaaauauugauaggcauuugaucuggcuugaggguuggcuuugaguggugccuagcaugcaugagguacuggguuugaucuucagcacugaaaugauuuccuguugugacuuagucucaaguauauagaaacacucaucacacaugcaguauucuaagggcuuacagauuuucucucacagaugagguucucugcagacaauguaggguugauguaguacccaagccugcuuaguuauuccucugcugggucuggcacugcuuuaaccuuagaaagaagggcuucuguaaugcuggcucuuuuguuguucuuguuccugucauuugucuucugagaaggccucacucuguagcuccagucuaucugugaggcccauccuguccagggccuagcaucugccaaccucccagcugcuaagacuauagagaaacaaaacgguaguuggaaguaguguauuuuaccuuaaauaagacguagaagcagauguccugaauuaguuacugucgggguagagcuauucgaaaggugcagcuacagaagugaagcugauacuuuuaggaugacagguacaugacauuuaggaugugucuacagcuggcacguuuaggaugugucugcaguuggcauguuuaggaugugucuacaguugucacauuuaggccaugucuuacaguuagcauguuucuuugggauugaguuuagcauacugggcugcuucccauugacaucuuauacugccuuggcuaacgcacaccaaagccuccauuuugccuaugauggaauaacuaagugaacugaaguccugcugaaacuacuaggaaugcugggaggugggggugggggcuugagacaauuuuggaaguauauaagccuguccaaacuugagauucaggagggcagggagggagacgcuguauuucugguguugguaaguuaguuaacaaccuuuaaacuguucucugugggaggaugaagcugaacagggcuuaaaaacgaaaagcaacuagggacagugcagagccucaacugcccugucuuuauuuuuguauauuuuauuuuuaauauuuuacauauuuauauauguaaucauuaccuauuuuacuuaacagcuuccgcugcuguuauucugcguuagauuuacaguuggagucccuugaaggaccuuaccguagaagggacaguaaugugggagugagugcaacucucagugucugagcucaguccccagcagucucuguccuucauuggauugugcucuacugcugaccugcuucugcuuggauauccaguuaggggaauaaguaaagccucuguagaggaagauagccacaucuggaaccucugcauuccuccagcuucaccucgucauucacguagugucugacagucaguaaaauacugcuacccacacagcaagaagagaaaaacgucagccgcagaaacaggucaauagguuagacagacggugggguuagagacaggaacuuuaaaauacggugaugaguauguucaugaaaauagacgcugaagcugagaauuucaccagagaacuggaaucuauagaaaagaaucaaaaggggguucuauaacugaaaaaaugagcagcacagcaagcggguggguggagucacgggcuggacacagcugagaaggauggacgguaaacuggaccguaaguucauagacacucagcacagacucaucccaagcuaugccacgguugcucuuuagacucccuaagccgugugucuuaagacuggaguguggagauaaagagaaacuguauuagauuguaguuguaauacuugacuuuaaauguguguugcuucguguuuuauuauggugaugguuuuuaaauuacaguaaaugccuacuggguagugaucagauacuaaguuaucaguucuaaguuuguauuuguguucuccagacuuugagcaacaaaaccuuucuaugagucacuuguugagcaaaccuaggguaaaccguuaggaugagaaauugagcaaaacacagacggagaacaaccacagcuggguuuauuuuagccucggguuaaggcccuuguuuuuauuuaggauaguuugcaaggugcucuggucaguuugcuuauuacauguagguaggucauaaagagcagacacuaagguaaaugaccgaguuucuuaggggggcaguugccuuguuuuucaguuaguaaggcuccaaugacagggaaaauacugccaguagcauuugacgucguauaaguuguaacaugcauccugauuucagaaauguuuugaauugaaagaaaaagcuaauauuagucucaccucugagucuuuaguucuuuugcuugguauuugaugguucgcugagggaaggucuuugagcauuuuccuaccgugagaaugggauaggccacggaucugacugguucuggauggugguugagaccugugccuggaccaagucagaguaacagucgcucucagaguuugcagggggcaugguccagggacuuucaucccuucugaucucgucguucuuaagggcucacuguugaauuccauaaaaagugugacccucuguugaugacaacuaaauagagcauuaauuagacuauaucuuuuuaagcaaaaaguuuagauucugugauguuugcuggaaaugagaaucccuuaauuccuauuuugaagguaaacucuaaaccuagagugauauuuuucuucagcaauaaaauauuuaaaacuaauguuuuuuguuuguuuguuuguccuuuaccuucagaauuuuucaaaccacauccaacugauaggaugaaaaaguuuaagaggagacugucccucacgcucaggggaagccagacgauugaugagucgcugucagagcuggcugagcagaugaccauagaggagagcaguagcaaggacaacgguaaguagcugggggagacucaguuaccuuaccaauacacucaaggcuccucugcagauaugcugaccauggcaguuuuguuuaucugugguuacuuggaaacaggagacugaccugaaugugcuuggcugauggcauguccuggucuccucccagccugcagcauacuuggucaccuacucccaggagugccuuuauguuuuuacuaguucuccgguucucaugcuauaaauuuauaccaguuguuaaguaacuauugguaaauuaucauuuaaauauuuguauuaaauauccugaguuaauacaggauaguaagguuguaagauuccuguuuguggcuuuauuauauauaggcuaacagcauucuagaucuguauugacugacuuuauagauuacaaggaucaucagaugagggaguugguuguuuucuuauuuuauguaccauaguauguccauuguacugagaacuccuaugauggagacaaagccauuaucuuucauuugacaguucuuuuuacaauacaaaguaguaguguacaaauuuuaauguaacaauuuaaagagguuauuaaauugaacuaaaauguaaacugguaaauguuuuuagaacacuguuauauacucaaagccaaaauaaaccuaggaauguccuagugaucaggaaggagauaaaaacagccaauaauaagccaugguuuucagugucugcggagcucccuugucugagcuuaaaaaucugguucgagaucucuggugguggucaacgcgugcucgcuugcuucauugcaggggaaggcuuguggugugagagacgcaugguugugcagguuagcagucauggucugggaccguggaugcccuaaggcacuguaguacugcuucacccacaguggggggaagucaguuuauccuacgcagguuucauagaccuugccuuucuuccucagacaucauuguuugcugaacacuguccaucuuguuggcagagccaagguggccuugcgucuguucucguggucuaucuugguuuuguaauguuuuccuugauggucuggguuuugacaagagcagagaaaaaugagcucaguaagaaauucaagacaauauuugguuaucauucuauaugcagggcaaaauuuauauuugucucaagucuugaagaugauuuuguaauauuuaauccucuucuaagagaaucugcucgauacauggagcagaacccugcuauucucagauucccauugaauucuugguggcaauaauggcugacuccagcuugcuuauucuugugcuagaaauucugaccaacauguuugccagugauguuuagagauaaaagaggcacgguguccaccaugguaggugguuuuuggagcacauuccucugaguauuugauuaccagacaaacguuuuuauuaaaacugaguaauggaugauacacugacauuuuagaacuaauuaacaauuuaguucuaauuggauguuuucuggaauauuuugguaauuaucuuaaaacaugguuaguuuauaacacauggugagauguuaaaaauauccacuauuuugaaaauaguguaagcugucuauuugugacagaccuuaaaaaagaaagacuuaagagcacugucuuccucaucagagagaccuguaguuguacacagacagaccuuaacuaccauagucaguugaugcucauucucuuuguguaauguggguuucaucaauuauuuucacaggaauuuuaagucuuuuuuuuuuuuuuaaaucauguuaaugccuacuagcuguacugaacacaguuucccccuuggagaguuuguuuguuuuacccauuuuguuuuuagcauaagaacuacauaagcuagguugcacacagagauagagucugugucaaaguacucugcaagaauguaugcagaagagugagcuccaggacagccagggcuacacagggaaacccugucucgaaaaaacaaaaaaaaaaaaccaaaaccaaaaacaaaaaacaaaaauaagaauguauguagagugugcuauuuaaaaauguuacacguaacguaaucaacuuauaaagcaagagcgauuugucuaguuugaaacagugaacauucuagcuuaauaagugaaauaguuuguaauuucucugaguaaacugccucagaccaauuuuugaucugucucuaguucgaucaagagcucuguuauacuugcauacuauauagacauguauacaauaacaaaauggagacguacacacuugcaggauuguaaauaucuuagaaaaacuaaaugggcaugguacuuuuaucuaagguacuauccccccaacuagaauuugagagacuuuuguaauuuuaauaacuguaucccaccuugaaggcuaaaguuaguuagaaauguugugcuguaauuguaauuuacaguacauugugcagcugugaugugugcacggugucugauggaucaaauccagaaaggaagaaucuugaauuuuauguucugaauugguggugagaauguaaaaguaagcuuaaaauuguuaaucuuggccacuuuacacauauuggcccuaacuuggaacagcuauacuuaaauauauauugaaaauuuauaaauggaagaauaagaaaguauuccuaaagugucuucuaugagagauaacucaaaaauuaugucuuuaauuaauuaauuaauuaauuaauuaauguauuuaguuaguuaguuaguuuuuguagcucgagacuuugaugugggggcucacacaugcuaggccagcacuguaucacugagccauagucccagcccugagucuuuagucucuuuaaauugucaaaauuauuuaaaaucgucaaaauugauuuauuucuuugucucuaaaaguugaacauagaauuagcauauagaccagcaguuucauuuuuagggauauucucaauaaaaucagaguagguguucaagcaaagcccugcuaagauucuuccucaucuauagcuaaccgaucaguaaguauuauacuguaagauguuucugcuuggcaaugggucuuugcuuauuuaaagauucuuuauauaacagaauaccauauuugaagugauaaucuuagcuuccauacugagauacacuuaaguuuuucugucuuauucacuaauugacaugcugcucugaaugucuaguaauagagguauagauuagaugccuuuugcuaagaauuacauguguuauauucuacagcauauuuaacccugugugugacacaugguagucauggucagucagcacauagaggccugguuugcaaauaaauuuaagauuagaguaauuugacaggauaccugguggggcauauuaguaacuguuaaccaguuuuggucauuggaccaaccuaaguuguuaagguauuuucuauaaauguguguucauagaaauccguucuaacuauugcacuuugaaugaaaucgccaaagaagugagcuuacauguaaaugaucucuguuacagccuuguguuuuguucuguuuucuuaacccuucucuugugauccugacucuugggacggcuauggaaugauucuuggaugccgugaaccacagagcccauugugaagaauggcaggccgcccacgucucacagcgugcauuccuuccuccaucaguacacaggcuccuucaagaagcccccguugcggagaccccacaguguuauuggaggaagccuugguuccuucauggcaaugcccaggaauggaagcagacuagguaaugugcuuauugcucuguuguguuuaacagucugcuucuaggacaugugcacugagugucauuguaugaacaaagccagccucugucauugucagauuuccucuagucauguagagaccaggugaggacuggaaggguagcagaaagaugagggcugcuaacaccgcagagaaugacguuugcuugucuguucaugcagagugggugcugcuucaguagcuuuucaguuaauuacugcauauuggcaguacaagaaguagauuaucaccugacugcuuauucuuuugccauuaugugcuuuugaaauauccagaaaagauaccugcaaguuuuuauguauuuuaugucuuuuuugguagugguauauuauguuuugauuuagaagucauuuuaaauauagauguuugauugucccauuagauagacuauuuacuacaguuccugaauauuguaucccucuguuuccuuuauuuauugccacaguaggcuacuuccugguucuuuucccuaauuuuaagacugugagccucucuacaguguggcuucaucugugagaaaugugccgauaucccugcuggcacagcacagagaauggugcgcuggagucgucuuaagcugguucaugagagauguggguuacagucgguuauuaaacauagcuacuguuauaguuuauauuguacagguuuagaguuaagcuaaaguaaaaaccaaaguuaaugaguacuccagaguccuuaccuccaguugguuuccugucccggucaucuauucucugagguaauguuauuugcaucaugugucaauagugauaacacuguguaauaaugugccauugcauuuuucuggacagugucaccuguccaguaauacugugccaauaauuugaagucagucaugagggaguauuuauguuuaagaaaucaggucuuggcuuguaauuuuguuggcuguguagucaagagugaguuauguuuuagguuuuauggacuggagucuguugcauauucuuuuucuguguguaguaagccuuuuaaaaugcaagaaacauuuuuaguucaggagcaacguaaaagcaucuguucuugagauucuuggucucgaguuaagaaaggaacacuaaagacguuaguaauguugaucaaauuuaucagugcaucaugcaaguggcagaagcuugacuaagcaagcauccugauacacuucacguuucaucgaagcccuuugucccacuaaggagacagugaagcucugacaugggccuucacuuucucaccucgcuguauucggaaggaggcagaaacagcugugcuuguuacccuggcugcucuccuggcugaguccaguggaacucaguguuuauuccuaucugggacgauaccuuugcuuggcauccuuguagggcaggacuggucgguucuguuugcuuacugguugcuuguuaguucuggggaacuaaacccgcugccucauuaaggcuugcuucagaagugcugagucacugagcuuacaaggcguucccaguuuguccaggcaggucuugaacuugugcacuggcucucagcaggguugugauacguuagagagcacaaacuuagcuuuguaguagacacucagcaaguagugcuuggaacuccagacagcuucuugcuggccucugcuccauccugcugccuuaguuccagaguuacaggugugccaccacgucuggcuuucuacugguggguagcagauuuguaaauauuuuaaagacuguucuaugaguuagcucuauuuucuuguugacacaucuaaugagagaauagucauaagaagcaaaagaccagguuucuaguccagcugugugccuaagcuacauggucuaaaaguagguuaauuuuuaaagucucuaucuccuggaaucuggaaaauaggcaaaguuacaguaauuucaagaacucugucaagucuguaauuuuauucaauucuuggcaauaucuugaauuacuuuccuuauagaauuuuucauacuuugaaaauguggagagaugucuuuuccugccucucucucccuagugcuugugccacagugcugauaccauaguuugcucuguauugcuaugagaaacaccaugaucaaaagcaauuuguugagaggguauuuuuuucuuuuucuuuuguucuuguuuuuugacuuaaacauuccugucacaguccaucauugaaggggaaacgaagggaggaaaaacaagggaggaaccuggagacagcaacugaagcagagaccauggcagacgcugcuuccuuccuugcuacacauggcuugcucagcuugcuuucucauacagcugagggccgccuggaaugguaccauccacagucgguuggguccucacauagcaauuauuaaccaaaaaaggucaacacauguuuugccuacagagcagucugcuagagucauuuucucaacugacuuucccaggugacucuaacuugagucaaguuggcaaaaaacuaaucaguacaguuaaccccuugucaccuugacagacacaucauuauuaaacccuaaccuuuccuuuaguguuuuccccaagaaagcauacuaauauaacuauuauguaacucuaaaacauaauauaucuuuaaaaguuccauaguuuuaaaaacuauucaaacaccuuuuaaaaauucagucuuuaaaguaucuuaaaacuccaaagucucucaauuugagcuucuguaaaaaaauuuuuuuuuaaguuaaacaguucuugucccaagagggaaaaggcauggcacaguuccaauaagaucagaggaaauccauccucuaacaguguaaaucaaagcucauagcuaaauguucagccucugggacucauucacucucaguccuugggcucccauggucgccaguggcuccaccuuuccuuuggugcaguccacagcauaagcagcuaaugucacaggcucagguugauacuguuccacacaugccauccuuagugguuuucccgcagugcuggacuguccaguauuucggagucuccacuguaacuuggcuguacagucagcagggcaucagcuagcugcucuucagggacucacauugugccgagccucagcaucucugcaggaguccuucaauccuggggucuacaccacagcugaggggacacauccaccagugggcucuccuggccucuuagagugccaagccucagcuacgccuucaauccugcagcuuucaugcugcccaaaccaguaacacaugggagacguuuacacaucaccgagacugggugccagcuugagacgaagcuuuggcucccucugguccacagcuuauuguggugacccugaggaaaugcuucccagaagaucucaccucaguggagcugaggucucuucauagucacagcugccuuucacucucagcugaccagaagccacagacuguccaucagagucuaagagaagccugauagagugucugcuuccuuccggcccugcaugagccaggccuccaccaucuguguugcucccagcaucuuaccuccagcauguuuccacugagcagccuguuaagcugccagcacuaauggcacuuccagcucaaaaguuucaagcauugcuacaaucuuuucccaaaacaacacagucaggucugucacaacaguagcccacaaugcuggugcugauuuuucuauuaguuugcuuucuauugcuguaaggaacaacauaaucaacuuggggagaaaccccuuggcuuacacaucuuugucacaguacgucuuugagggaaacuugggcaggaacucaagcagggcaggaaccuggagccaggaacugaggcagagaccauggagaggaaccuuacuuacuggcuugcucagccugcuuucuuauacaaauaaggacccauaauagcuggguucuuucaugucaaucauuaauggagaaaauucccacaagcuugccuguaggcagucugauggugucguuuucucaguugacuuuuccuucuucucagaugacucuagcuugugucagguugacccaaaacaaccagcacagcuggccugagauuuaucuuucugguaaggcauuuauguucugaucugguaacugcuuacaugccuguggaucucgagcauagacgacuuucaacacugugauuuguguuuguugauaucucuauuuuacuuguaaugauaaugaaguguacuguuuaguaagaucugaccuuuaaagguaaacagugccuccuuuucugauauagauauuguucaugaaaaucugaagaugggaucagauggugagagugaccaagcuucugggacaucaucugaugaaguccagucaccuacagguguuugccucagaaaucguauacauagacggaucucaauggagguaaccaguuaagaaaguggaaacgcaaccauugugugaauauuuguguuuguaaaggaacaugcaaugcuuguuugaagcaucaugaaggcaaauggaacucacacaagagcuguuucuuugccuuggugagcuguggucugaauguuguuguuuuuuuuuucccuaauuaucccaaggcaaguauacauuaauuacaguucacauucugcagaaaaccuuuccuuuuuuuuuguuuuuugagacaggguuucucuguguagcccuggcuguccuggaacucacucuguagaccaggcuggccucgaacucagaaauccaccugccucugccucccaagugcugggauuaaaggugugugccaccacugcccggcuagaaaaccuuuucuuaaucacaccuuuacggugcucaucugagcacuucauauaguuuauauauggaugcuuuaagggguauaaaugaacuagaacuagcuuguuuucuuacuuggcuaguuucuccuuuaugguacauuguaucuauauauucauaugauacauuuaucauaaauauaaaagaagaacuggggacuggagagauggcuuagcaguucagagcaucauugcuccugcagaagagcccagguuccguucucaguggguccaggggcccugacgcuccccucugaccucugagggugcugaacagaaauggcucacauauacacaaguugacaaaaaaauucaugcacauaaagaaauacugaaaacaacccaagcaauucauuucuuuaaagaugucugucacaguuuuauggacagaaguuuuguuaugacuauuacuauuucagcauacccuguaaguuaaaagcuuucugcaaagauauuaaacaugcuuuaagauaaaauuuuagggggcuagagagaugguucagcacuugccagcaagccuggcaaucugagcucagucucuggagcccgugugguggaaggagagaacugacucugcagacugucuuccaguucuguaagagaucacacccacccuguugcagacugcuuaugucugcauggagaagaauuucaaaguaaaguuccacuugaauuugguaaagaaacgguugcgucuuuuuaaacuauuuauaucaaaccauaucgucugccuuugauuaugauaaguauucuugccuuaaguaacuuuggaacugcaagccagcuucagugguuuaucacuaaagaauaauguggggggcuggagagauggcucagcgguuaagagcacugacugcucuuccagggguccuguguucaauucucagcaaccacaugguggcucacaaccaccuguaaugggaugugaugcccucuucuggcgugucugaagagagcaacaguguacucauaugcauaaaauaaguaaauaaaucuuaaaaaaaaaaaaaaaggaauaaugugccugggcccucaucuucccaagucuaaugcccugcucccuuaucugcauaggacuugaauaagcggcugucgcugccugcagacaucaggauaccugauggcuaccuggagaagcugcagaucagcagcccacccuuugaccagcccaugagccgcaggucccgcagagcuuccuuaguaaguuuuuggccuugacugugccgugaggauggcuugcuugcucuuccuccuuguccuuuagucuuuucccuucauuccuccucucucucccuugcuccuucccuuucuuuucuuccuuccucuccuuuuuguccuuucaugacuuuuaaacccagagguuugcacguaccaggcaaguacucugccauuugguuguaccccagcccugaaguuaauuuuuauauguaaauuuuaaaucacucacuuaguuguagcacauuauugucuacauuuugucauucuucauacuuaaagaguguacuggaacagcacuugaguuguaucuuacuuuugaauguaucugcuggcuggaugugcaccaugcaugccagaugugcagcugggugggaaugcuagaggcgcagcagagugcccagaccuggcuuuagcucaguguguuuguggugcugucauccuguguggccagaugaauaaaugaaugcuuuagacacucuccugcuacuuuucucuuuacuuaauacuccucauuccucaccuuacucauaauuccugcccucggauaacaaagguaguuuuacacacauggucauacugucucaguuauacucuuuucguacuaugauuuuauauuugagccuucuuauucauaagcauguucacguuguuucugaaguauuuaauacuuuauuuucauugacagaggguuuugcuagucugaaauuaaccuguaaaucaggcuggucugacauaccacuuugcuuagccuccuuaagggcugggauuacaaaccuauucuacaauaccugaaucuguuuccuacauacucucacucaaucuuugaacuuuauguauuaugaauauauguuauaaaaugugcuuauacaaauaugcaaaaaguuuguauauuauauaaagcugcuguaauauuuuaaaaagucuaaaagcugcuguucuguuauaaaaucacagcaugcauguacguaugcaaauguacuucuguaguuuccucauguuguucaguguuaagucugagcccaucuguuuuguuguauguagucacagucugcucucauuguauggugcacaguuguauaacuguaguauccuuucugaguguuagacuuuaucauccucguguccguggucuccaagcuuggucuuaggcucugucaugucggcuucgucaccauuccuauauggcuuuguuuauguuacuagagacaaaguaaaagcucccauagugccugcuaccuaacuuacaaguuacacuguuagagguuggcuuacuauaaguuauaauuuaucuuauauauaauguuuuaauauuuguaugccuuuguuguaaggguugccugaacggggauuugcuuagucugugaaaaguuauuucuugaaguaaugaagucacaaaauaaauuaugcucuuagagugaauuaccauaaaaaucuuuauuuauauaaugaccaaguuauggagucuugauaguguuuuaaaauguaaggcuucuagagccauuucuaagucucuaugaugccuguuacuuuucucuaucccuaaaauaauccaggguagacugagugcacauuguuaacucaggaaaacagggauggcgccugucuucuccuugugcucagcaccuggcguugucccgagcaaauguggaguaaauaugcuuugucguuuguccucagaaugauuucuguaggagaguguugacaagcugccgacuguuguuaaucugucauguucaacagaugcaugugcaggcuaaguuuucuaaaaauuacacuuaaaaguucauuaacugcuauuuggauguaaucauugagucuacuaaguucaaaauucugugaggggcuugggcuugugugucugauucucugaaccagaaucuaucugacagccacuucacccauguaagacauucugucugaauuuccuaacuaacuauguggauggaacucaguaauacuguuuauuuucauagacuaacuacuuguucaaacauaacuuuaauaauuacaauuuacuauucgcuuucucuucuagauauguguuuauuuuuaauuggcauauucugcauauuuaugggguacggugucauuucaauacuuguguacagagugcuuugauuagaguaagcagcauauauaucaccaacuauuuauuucuuugugaggauauuuauauuagauauuugacauauacaauuauuguugacuauaguuacuuuguguguauauauacauuuaaaugugcauguguguuuguaaacuugugcauaugaacauguauuugugugugagguauauacuaauaauguucucuaaagagcgacucuguaauaucaauuucugauacaucuguuauaucuuauuccauauguacuugguauuauaguaauuucuaaaauauuuauauagcuuucauuuuguugacaguacauuauauaguccuuauagcagacaucaauauuuuugucauaaucacuacuggaccaaguguucccagaguaugguagaauucguucacuauaacaagaugagugaauuaagaagucacuguuccugagaggaaaaaguuuagcuuauacuuaacauuuucccaucugccuuccauuguugauaauuguuguuagaauauaggugcuuauuguuuuguucauauuacuuugaauuuauucucaauguaguguuguucucucuguaaaaaagaacaagaaaaacucacugccauuuaaaugaaaauaucuaaauucuaaagauacccacguauaaaaaauuuucauauaguuucuaugaccuugguaauuagcuuuuuacuuaacuuuuacauaaaaaauaguccagaauccagcugucaugggucagauaccuucuauaaugacaguaucuuauauaauccuuaaauguuuauugcauuuucuaaguugaaauuuaaagcuuccauuguauuuggaauguauuucuguuguaauuuuacccaacuuuuucaucaucauuaauacugagucauacauaagguagauagaacgguucuaaaacuugaguuuucuaaauuuuuuuccauaaaaauaccauauacauauagaaaaauaggagaaaaaaccacuaaaucaucaguaauaccaccugugaauaaaagcuuuaguuugcugaaacuacacuaaauaguguuguaguaugguuuuagcaugacaugugugaucauaauauaacacauacaacucugagaacaguucuuggggagacuuugcagacucguuaggguuuaaacgccggugauacuuaaaaguccuggagguuuaaauguucauuagcagaaaaucagccggcucuuguaaagacuauuuuaauuguaaacucugauguuuuaacaucaaaugcauuuuagaacuugacaaguguucaacaauuucauacuuguuagaguuagaagauaaagaaguagaguuuuaagaauaggcgcuaaauuccgaauuguuugcuuucagucagaaauuggguuugggaaaauggaaaccuacaucaaauuggaaaagcucggagagguaaguauacucuuuauuuuaaaagcaaggcauuuucuuauuaucuaaacucaauuaggccaugauucuugucaucuuagaaaaauaaaggcuguagauauuacgugaaagacuauauaccaaauucugaaaugaccgacauuaccuaaaagacuauauacugaauucuggaaugaccacuauuaccuaaaagacuauauaccgaauucugaaaugaucgcuauuaccuaaaagauuauauaccugacucugaaaugaccgcugugagcuaaaagacuauauacugaauucuggaaugaccacuauuaucuaaaagauuauauaccaaauucugaaaugaccacuguuaccuaaaagaguauauaccugacucugaaaugaccgcuauuacuuaaaagaaugaauauauauauacugaauuuugcaaugaccacuauuaccuaaaagauuauauaccugucucugaaaugacaauuaccuaacagacuauauaccgaauuuugagaugacugcuauuaccuaaaagaguauauacugaauucugagauaaccacuauuaccuaagagauuauauaccaaauucugaaaugaccgcuguuaccuaaaauaugauauaccaaauucugcaaugaccacuauuaccuaagagauuauuuaccgaauucugaaaugaccgcuauuaccuaaaagaguauauaccugacucugaaaugaccgcuauuacuuaaaaguauauauauauauauacuuaaaaguauauauauauauauauauauauauauauauauauauauauacugaauucugcaaugaccacuauuaccuaaaagauuauauaccugucucugaaaugacuauuaccuaacagacuauauaccgaauuuugagaugacugcuauuaccuaaaagaguauauacugaauucugagauaaccgcuauuaccuaagagauuauauaccaaauucugaaaugaccgcuguuaccuaaaauauaauauaccaaauuuugcaaugaccacuauuaccuaagagauuauuuaccgaauucugaaaugacugcuauuaccuaaaagaauauacaccugacucugaaaugaccgcuauuacuuaaaagaauauauauauauacugaauucuacaaugaccacuauuaccuaaaagauuauauaccugucucugaaaugacuauuaccuaacagacuauauacugaauuuugagaugaccacuauuaccuaaaagacuauauaccgaauucugaaaugacugcuauugccuaaaagaguauauaccugacucugaaaugaccgcuauuacuuaaaagaauauauauguguauauauauauauauauauauguauguauguauguaugcugaauucugcaaugaccacuauuaccuaaaagauuauauaccugucucugaaaugacuauuaccuaacagacuauauacugaauuuugagaugaccgcuauuaccuaaagacuauauaccaaauuuugagaugacugcuauuaccuaagagauuauauucugaauucugaaaugaccacuguuaccuaaaauaucauauaccaaauuuugcagugaccacuauuaccuaagagauuauuuaccgaauucugaaaugaccgcuauuaccuaaaagaguauauaccugucucugaaaugacuauuaccuaaaagacuauauaccgaauuuugagauggccacuauuaccuaaaagacuauauaccgaauuuugagaugaccacuauuaccuaacagacuauauaccgaauuuugagaugaccgcuauuaccuaaagacuauauaccgaauuuugagaugacugcuauuaccuaagagauuauauucugaauucugaaaugaccgcuguuaccuaaaauaucauauaccaaauucugcaaugaccacuauuaccuacgagauuauuuaccgaauucugaaauggccgcuauuaccuaaaagaguauauaccugacucugaaaugacugcuaguaccuaaaaguauauagcugacucugaaauggccacuauuacuuaaaagaauauauauauauauauauauauauauauauacugaauucugcaaugaccacuauuaccuaaaagauuauauaccugucucugaaaugacaauuaccuaacagacuauauacugaauuuugagaugacugcuauuaccuaaaagacuauauacugaauucugagaugaccgcuauuaccuaagagauuauauaccaaauucugaaaugaccgcugucaccuaaaauaucauauaccaaauuuugcaaugaccacuauuaccuaagagauuguuuacugaagucugaaaugaccacuauuaccuaaaauaucauauaccaaauucugcaaugaccuauauuaccuaaaagacuauauaucucacucugaaaugaucgcacaacuagauggaauaaaucuucuugguccuugaaaccuugcaucagguaagaugaaauuaauauuuuugguagauuuguaaucuuuugaugaaguacaaaugcugugcucugugaguaauggaauagggucuauuguuuacucauggauucuggcggcauggaauuuguaugaguucagagaacuagcuguagagauaaagacgcuucaccaaaguugagaaaauuuuuaaagcucuggcuuucuugagcuugcuucuucggccuguacuccuguuaauuuuuaaauugccugcgauccacaguaagaaagggcaggaaaauagcaggcaagccuuaagggagcuuuuagaggagagcuaaggugcacagauuuugaggagcgugaaggucuggaucaaguuuuugugauugaacauuaucauuacaucuucauugaaaaugcucagucuccugugguuuuuauguaucauuaccuaagugcccuugauaugaaauccacugguccagcuguucauuugaaauaacacaagaauaaaggagauguggaaccaccaugguaugguggggauguggauggugugugcagggaacuaagucauugcuguaagaaaaaccaaauaggaugauuuuuuuauaagacauacuuuaauaugcuuagaaguuagaaacugagguuuacucugcucuguauacuuuuuuugagcagagacucaccauguagccccagcugcccuguaacucacuacguuggcuagguuggcuuccgagucccucugucccccaagugcucgaaguaaaagcaugcaguaccguguuagcagcugucacaucuuaaaaauguucuucaaaauauauucuauaggguacauaugcaacaguauauaaaggaagaaguaaacugacagaaaauuugguggcauuaaaagagauccgcuuggaacacgaagaaggugcacccuguacagcuauaagagaagguacaguguuuacauagaacuuuugguccaagucacauuaagaggacuguuuguaaaaagugcucagauagaaacacaaucaauggcuggaagucauucuuuggcucuugcaaaugguaguuuuuaaaaccaaaguacucaacagaaagggaucagucaauuguguuauuguauaacucacaguaaaauauuuacgaagccauuaaaaucucugacagauaaauauugaccuagaaaaaguucuauauuguuauggagagaccauggugacuauaaauuagcuacaucaauaaauuuuacuaaauauaagaaacaaauagcauauauacaugaccauguuggguuuuguuuuuuguuuauuugguuuuuccagacagaguuucucuuuauagcucuggcuguccuggaacucacuuuguagaccaggcuggccucgaacucagaaauccgccugccucugccucccgaguuuuuuuaaauugaaaauguacacagcgcauacaauauauucugauuaugguccccaccccacccccuaucuccuaccaguuccucccuacuucuucacucacccaaauccacaugugcuuuucugucucauuaaaauaccaguagauauagaaauaauaagaugagauagaaacaaacggaggaaagauggagccaaagaaaaagcacaaagaacacggagugaaagguacccugugcucuguaucacagucagugucagagcuuccaacagcgggcaggaagucaggagaugccgcuuggaauaucgggaggguuucaggaaauacagugugagacccacagcacacaaccagaggagucagaaccucgcugccuccauugucaguccugcuguaaccuuugggcuuuaucuuacccacagucagcugugguuuaaagcuucugggccccauagacugccuaccacagacuaacaccccucccccucuuguuguuuuuccaguuucacuguuaaaggauuuaaaacaugcaaauauaguaaccuugcacgacaucguucacacagacaaaucuuugacucuggucuuugaguaccugguaaguauuuaauacaauuuagcauucuauuuugcuuuaauauaauagaaaguuagaccuucuaacagccucagggacauuguuguuuaacuguuggcguuuaaaugcgguguaaugaauucuguauguuucuuugaaaagcaacuuaguuauaaaaauuaaaugccccaagggagaggggaggucugaugggguagggguggggguggggacauccucuugguaugggacgaggaacagucagagggcagacugggacugggcaggggugggggggauaaagacuggacuguaaaaaaaaaagacuaaagaauaaaaauaauaauaaaaauauuaaacaccauuaggcugggcagauggcucuguggguagagguguuuaccaccaugacugacagcuuguucuguaccuggggcuuccauagacuagagucagcucccuggaguuguccuuggacccccacaugcaugccauggcacauaugagugcaccccaacauauaaauaaauacuuaaaaaaagaaaaaagcucucaagguaaccagccaugccgucccaaaaccaugucacgugcuaaagugcggcaucuuuucaggacaaagaccugaagcaauacauggaugacugugggaacaucaugagcaugcacaaugucaagguauguuguccaugcacuucugagccugugucagcacagcuggacuggaucgcccagcacauagacuggccucauaagccguucccaucggcgugguuagguuacuaccaucuaagcauauuuagucagcaccuguugacuguauuacagcuguuaaaaaaccagacccuuuggaguggugcuuugcuuuaaaggucuuuuacacuuuugacaacaauuuauucucuuauguaggguggauauccaagucuguucuggauaaaaagccccuaaaaaaaauacaaauguuggguacacccugugaaagacccuuugaaggauaaacgccacucauguauugaaagaaguauuuaaaauagccaguuggacaaggucagaaacuuauagguaauagagaucugugugaucagaagaaaaucgauaagcuuucuuagcguuaguuaucuaagaauuggaguaacuggagaaguuugcuaaggcagcuaauaucggaugaaacucaaaaguuacuuaacaugaaagcauuuaacauagcugaauuuucacaauagauaucuuugaccuaacuggcauacccuauuuuuuuuaucaaagauuuauuuaugcaaaauuaauaguuccuggaaaccuauuuuggaagaaggcagugugucaugugugguugagacauuucuaauucuguagguaguaaauuuaacuuuuucuuuaaauaguaauuugguagaaauagagggaagccaguuuguuacuaacagagugcucugaagacaggcauugcuaagaccaggguuuugaauagauuuucauacauucuaugaguuuuuuaaaaaauauuucaucauauuuuauaaaauguuaugaauagcauuuauauauuuuuguuuugcuaauuuugcuuucucuacuuagaacaauaauuuggaaagagcauagaguuuagcugucauaauuugauaaagguuugcaaagucccugcuuuuuaaguuagguccaagugguggcuguaagguggaacgcguuuuauugucuggcuguugaaauuacacuuaacguuuuccaaggauagaaugugacagauacugagauaauaauucuggaguucucagaacauagcaaugccaacucuggaaacugcuucugagaauucauucaggccucuccacauccuccgccgugaccuaaagacacucggcaucuucuguaugcagccucucuuuuucuaaccacaaagacucaaaacgcuuuccuucuucuaaaauacacagaagcccuuagccauuaaccuuacaggagucccuuucucgucguucagaguacaauagugccugggccccuuucugagucacaguggaguuugaagagugaguaggaggcgcucaaagucaagugcccaggaggugggugaggagccgcuuacuuuuauagcaaauggcuugccagagcuaaacagcacuuuucucuucugauagccuggcucuucugaaaaaccaucaaauaugaugcccuuuuaaggugaugcugcugcagaucagggaaguguuuguguacgugugugugcguguguguguuuuggaaggagaaaucagugacaggguuugcuugguuguuacaacagaauuuuauaaucaaacuauaggccuccaaccaaugaacugcuguuauucaaaguuuuauuuguaguguuuauuuuccugguucucauuggguuaaaaacuaguugauguuuuaaauugaacaaugaacaaucaaauucagaaaauagcugcaagaggaaaagaugucauuuuaauuggcuuuaauugcuugguuuuucuuuauagcaagacccguuccauuaucuguaagacugcuuuucauuuguuucuguagcuguuccuguaccaaauucuccguggucuggcauauugccauagaagaaaaguguugcaccgggacuugaaaccacagaaccuccucauuaaugagagaggagaacuaaagcuggcugacuuugguauggagagauaagauauucauuauuacuuccagguggcuaagcgagaagaccaccguugucacagagugucgucaauuuucuguguguuuugacguguucucuguagcucggagaugugugauggaauuuaggugaaugguuuauuagugaggaacacgcacguguuuccuagcaugcugagaccucuagaacuucuaagacuuuccauggcgucuaaagauaaauucacacucagaauuacuguucuccuugcuuuuuccugguugcaccgaggacucaacaccaaguaagcaguagagucgcugguuccuugguguauuuggggguauuuagggcagggcauguguagucuucacugcugacauguuuaggggacaagugucaguuauaccugggauacuugauacugcaguaaaguuuauuuuccuagacuauaagucauuacaauauuucuugugauaaaaugaagaauaagcauaaaacacauugagcucacacagaaacaacaguaaucuaaagagaaagauuacuagggguccuuuccuuccuuccuuucuuucuuuuuuaaagaaacaccauuuuuccuaggaaauuugggaccaauagacugauuauuuagucuuuaacauuugguuuucuuaaaaaugaauuauugcccuucaggccugaguuaggcagcuuuguugauauuucauggguguggcuucccugacauuucagggagguguccucucagcagauuuccuguuccucccgcuuuuucacucuuucugucccucuuuggaguuguccccugagccuuaggugcaggagccgugucauagauggaccaguugggguggggccaugugcaggguccuccuucuucucuuggucucuaugagauucauucuugucauauguaugugagcgauuacaaauuugauaauuugagccgggcgugguggcgcacgccuuuaaucccagcacuugggaggcagagacaggcggauuucugaguucgaggccagccuggucuacaaagugaguuccaggacagccaagacuauacagagaaacccugucucgaaaaaccaaaaaccaaacaaacaaacaagcaaaaaaaaaaaaaaaaaaaaaauuugauaauuugaugugcuguccucuauauaccaugcauaucaaagaaaaugauauccaguugcccuuuauuaacaugaaauuuaaaauaagugauaggaguauaagauuuuuuuuuugccuuggaaaauaacuuuuuauuaagauauuauugcagacagcuuaugacuggugagcacuugagguucgcaucguuucuguuuuugagucagggucucacugugcaccuacauuguccccaacaucaugaucauccugccccagucucuugaauuccaugauuauaggacagagucgcugcaccugaccgugccuuguuuuuaaucuguaaauaaacaccuuuccauuuucucaguguuggcuuacagauacgguaaaugucaguagcccauguaaauagaagcacuuggcuucuuaaguuugacgcguuuaugccagaucccgaaagcuggaagcugccucugaaaggcgcccccauaugcugaccacagcugacugcuuuuauuaucugcucggugacuucacuagccgcugguuaaccuuuuagcugaucugauuuuaugcgaccugaaaauaaaacgcaguaauguguacuucgcuuuuaggaaguaaacuucuauauugaaagaacguuuuuagaguagcuuugauuuugaguuauauacuuagaauuugaauuauucuaauaagcuauguuaguaacaaguuaaaaacucauucuuacugaaugcuggauuugcccuggcuauucauggacauuuguuuauuuaguauguuguuguuuguuugaaagggauuugcuguuggcuaccugagauugaagcagaugcuacagguuaauuuuguaugcuuguauagaucccgucucuacuuccugagcaucauuaugucauucccuuacacuugccccugcacccacucccucgcuuugccaagcugcuuuuugugcagcuugcguggaaucaugcaaagggugugucaaagaccaugggaaauuuuuaucugaaaguacuuugaaucuaguauuucaugcuuuuagccuccagaaagcaaaucucacaacacagucaucauuuucugauucuuggcuuguuguuguguuguuguuguuguugcauagcaaauauauauauggcuucaaguaaugaauguuguuuacuuuugauuauuucugcuguuaguugagccucccccacccguacuccuccuugauggugcugggaucacagugagagacuugaguaagauaggcaagcacugucucugaacuacagcccuaccuucuuuacuuacucuugauuccuuugaaaaugucaauauuauagucaguaaaauucacaaaaaagcaaggucaccgugguauagugacucaaaaaaccaaggaagaggaaucagagcuacccuacaucuugcuaauuacuaaaauguguggaaaaauaauucguugggcaugacuguaucaagcuggaaugcuaggguaaugauuuguaauuaaaauaaugucagcauuacauuauuuuaaugaaguguugaauuacuacuguguaugacauuuuucuucuucaauuuuuuuucacaagauacauaaagccuuacauaacagcaaucuuagcauaaguacccuuauuacuugaaacaaaauauaugguaaaaauaagguuauguuucuucagauguaaacucagugacuacagucuagaggcuauggggagcuaacucuccaccaguggcaaagcaaaaagguugggaaccggucugucagucucugaacacaguggagcccauagggaaccggucugucagucucugaacacaguggagcccacacacgguugacagggcagacaguugcuuacagcagguggcauuaucccagaguaucaaggccucuuauucugaaguuauucacaucacuuacaucauuaaaauagacaaagacugcugaauuuuauuccagggaaaucgccuaauagguucaaggaaauugccaguaagcuccaacugauuguauaccaaugaucuugagguuuaaaauuuuaaaacauaguauaguaaaaaaaaagacaaaaaacaaacaaacaaaaaaaaccaugugauuugaguuaaacagugauagcuagcuuauaacgguagcaagcaaacugcgccucagugucacugaccuauuuuggguuaauuccagugggaaauaauuccggcauccugacucaucaacagaaaauaucuuaaguuuagauaaacucagacagacacugcaccagcuucgucucucgcuguauaauuacuguguucaguuuaauuauauaauauugacuuggcccaggacuacauacacucaacagaguuuauaaaucuacuuuuuugaaguugcaggaagcuauagaguuggcaucucuugaaaugggucauggcgacaguagggcuaagaccuucagcauguuaauggaucucaguauuuuuaauucuucuguuuucuuuucucuguaaaggacuagccagagccaagucaguucccacaaagaccuacucaaaugaaguugucacccugugguaucgaccaccugaugugcuucuugguuccucagaauacucaacacagaucgacaugugguaacuacagaugccaucgccguuuauaguuuugaaagagcauagcuguuaacagggcauacugacaaaugcuuacuuuuaaagaguuauuucaaagaguuugagcagugaguaagaauugaggugugaaaauaaaacuauuuagauuuaaauauaagucuaccacuaauggcuauauuagacuaaccaucuuauucacauuaguagcccgugccuucaucuccuccguuaaggagguagacaaaguaaugagaaagucauuaagccugaugguauuaagccugaaugagccaacgugcacagagcaccuuuuagaagaguacgugacacauagcaauucaaaaaaguauuaauauggaaaauauaccuacuuuaaguuggucuaaaaauaauaauuagaguuucaaagaucuucuuaugcauuauuacauauauguauguagguguuauagauauauguacauguguguucaagugcacucgccuguacaugcauacacaauggaggccaaaggucagcaugaagcaugcucagauaccgcuuuucauuuuuaaaaaguuauuuauuuauuuauauuuauuuauuugagacagucuuccacugaaccugaauagacggacuggccagcacacccuggggucugccugucucagucgagccuguagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcagcacugugugcaugggugcagaggaucuggacucagcuucuucucaugcuguguaacaagcacucuagccacugagccacguccaagccaauagaugccucagugccccugugcuuggcuaaccccaucacugccuaugcgcuacaaauugcauuuccuugauccaggagauacagaguuucauagucuauaaacuucccuuucuaacuuaaucuggccuaguucuuaauccagacguugucuuuuagcaaaguugcucuuugcuguucgagcaagcaagccugacucucccagcucuguugagugcucaucccaaucugcccguuggcaugcuccucacccaacagggccacacuuaguaauuaauuccccgggguuuguccucaguccuuuccugagugggccuggccucagaggcagcuccuuucucaaucguggcuguguuuauuauguccuccuuauguccugguaaguuaaugcuuguuuuccugucuugagcaauugcauagaaucucauuugcaggacuuuuuuccguuaguucugauauguauaagauaaaacuuauaauuuuaccuaguuuagcugugugguuuugagguucuaaguucauuacacuguuguacaaccaucuccacuauccauccuuuuagaaauccaaaacuuuuacucuuuuaaacugaaauuuuaccuguuggacaaccauucuaccaauuuuacuugguccuugguaaccaggucacuacuucuugccucugaauuuaccugucccaaguaccucaugcaagugagauucugccauacuugucugccuucugcugacuuacucagcucuucucgguuaccauggugucuucaucguccaucagcacugucuguagugagucuccucacguccuugugcguacacuccacacuuuguuuacucacuccuugugcguacacuccacacuuuguuuacucacguccuugugcauacacuccacacuuuguuuacucacuccuugugcguacacuccacacuuuguuuacucacuccuugugcguacacuccacacuuugucuacucacuccuugugcguacacuccacacuuuguuuacucacguccuugugcguacacuccacacuuuguuuacuuguugggcacuugagucucuuccgucaccacuguaagugaugcugcuuugacggggauggaccuaguguuucaagacgcugcacugggcucucuugcuuauuuacccaaaagugagauugcgggccauagcaauuguauuuuuaaauguugagggaucaucauacugcuuccuauaacaacgugccauuuuauuuccugugaacuguugucaguuuugugaaguuuuacugccugugagcagugcuguggaaguacugugucgcaaccuuccguggaccaccuaguucccaaauaauaaugccuguucucugagccucguccuccucuucccgcccuuacacagucccuagccacagcaaucagcuacagucaccgcuuccugcaucgggcaugagucacucauucacuucucucugagugaaucauuuguucacuucucucugagagaaucaucucucucugagcaaaucacucauucacuucucucugagcgaaucauucauucacuugacucugagcugcuguagccacugucaccucccagauugccauagcgauagucagcacuccaucacuaguaagugguguuuuauucuuuaagaaucuuacaaaaaagaaagcuagaaguuuuaaguggggaaaaggauuaguagcauuaguaguaguugagauuguaaauuuaauaaauuuguuggauucaaaaguaucuguacagaaaauuuucugggaaccugaucuaaaauucuccagaaaggcaaucuugaaaaaauauuaucuugugcuaaccaauggguaaguggauugauuuuuuuuucucucucuuuuuuuaaaugaugcauuuuaaaggggaguuggcuguauuuucuuugaaauggcuucuggaagaccacuguuuccagggucaacuguggaagaugaacugcauuuaauauuucgacuacuagguaagaaagaagucuuuuuucccaugauucacaccugcaguugacuaguuaaauuaggacuaugucuguaaagcauaaguaugacauguauccauagcuguucugauaagaacugccgcuggcucacuuguuacaggggggucuucaagcuaacucagcuucauuucauaaagguuuuaggaaauaagauuugaccuuauacauauuauuaagagcuauuccuaguguaggugaugccaugaggauagaaagggaguuuuaucauauuuagggcauauuuucauuggccccaauccacauguauauauguaguaucccuaaguguacauacaguguauacacacacaaaauauuaauuucaauugaaaaaaguuaaaucauuuaauaaaaguaugauguucuuaaggauaguucuuacuuaugccuguugauauauauguuugcaugcauauaauuuaaauacuuaucaugaauuuauucuuuuaauucaggaacuccaucucaggaaacuuggccagguguuucuucaaaugaugaauucaagaacuacaacuucccaaaauacaagccacaaccucuaauuaaucaugcacccagguauuuuucuucuuaagugagaagggccagacucucgugacucaguacccucauuugauguucaaguucauucaauuuaucccuuccuuugacauaauaauuuuauaaaucaauggccaagaaucaccaaagcauguaaauagaauugagcuguaaagggaauauagaauacauauauuagaauuccaaggcuuauguagguagauccacaaaggugaagacagcacuccugccuaggaguuauauugucuaugucauuggucuuuuagccauauugcugaaguguuuuugaacuuaauacuuuauaguagccauugcuuagcagguuguuuuguauaaucuucuugauggcuuauccauuuugaacgccauugauauauuuuggggucacugucucaauuuuuuaaccuacaugcugggacggugauauuuuggugugucugccuucauugacacacugaauauuuguacccuauuuaaacuuucuuuauaauagaggguacuuuggggauagaaugcuaacuucaaaauuucuauaguauuaguaauuuuucuugaauauuaaaauugugaauggcagucuauucaugauuuguucucaagcaaauagcaagaugagcuuuuuagggauaaacagauuugggucuuugaaagcaguaaagauaguuauuuuagggcacuuaaauuuggcaaauggaagcauuuggaaaauaauuuuaccugaaagguuucuaucauaaaagauaaauggacacuuguuuugguuucuuuuauuuuuuuguuucuagguuagauucugaaggaauugaauugauaacaaaauuucuucagguaagucaaucuuauuuuauaaaguuaaaugaaucaguaagugucacuuuccucauaggaaaaauagacucacuaguaaccccaucaaguaccguuagcaauaguaggaugccuauggugcuucuuaggugcuucagcagcucagagccauguucuuugcagcucaugcucuguguccucugcuucuuugugcuuccugccauggcggauacugcacuuucaaauagcacuccuccucuguuuuccccagagcaggaagacgagaugacaggguagcaacauuaacucucuuauaucucgaaagcauaggcuuuucccaagucucacuggccagagcauucauuguagaaacaaaacaacacaaagagagucugggaauuggggaauuagccucgaccuagaacagucaugauuugucuguuggaguuggaagcaugagcaucuugagcaaaucuaaguugugucauuaagagaggagcaauggcuuuuaucugccgagaaugucggcuauaaaggcacugggcaugguucugucaguacauuucacaguucacaaagaaaaagagcauuaaagauugaauauuuuaauuuuucaccacuucagaaaaaaucuaauuuuuuauuuagaggcuuagcuaggaaauguggaauugagauagaauuauucuccuacuuugaguguauugggaggauucuaaagugauguuaggaaauugucauauuaaguaaucaggaguuuuuaaaaguaguucuaaauacuaauuuauccuccuucaacuucuuacaguaauuagacagagguugaugagccgcuuuuugcuuuuucacaguaugaaucuaagaagaggguuccggcagaagaggccaugaagcacguguacuuccgcagccuggggccgaggauccaugcuuugcccgagaguaaggagcccucgcgcucgcuccucuguucguuugucuaggguugaggaucagcaggcuuaugauuuaauaauuuuuguaaucagaucauaauuuuuccaaggaaguuuuucucgucuuguuuuccuuguucaugucuuauagcucugaguauguugucucuccucauuaagaaauccaucauauuugagugugaaucauuaaucuuccuugauucaaauuagaauaugcuggcaacaucauccuuagcccuaaucuggcuaaaaguggaucucuagauuggauagguggcggcuggcggcgugagcaaaguguuugcugcacgcugugcagaccugaguccgggucaucaggcucccuguaaaagcgcuguccuacgccucuguaaccacaggacuuggcagggugggaacccugagagcucacuggugggaacccugagagcucacuggccagccuagucacaauagugagugcgcacgcacacacacacacacacacacacacacacacacacacuucugaaaagauuagugaagcacagucagaguaacaagauggcuuccuggagaaagugauuuccuuccugagaagauacaaaggaaguuucccuuucuugcgguuucucugacuguacuauuccuaagaaauuagugagucuauuaucaaaaucacuaaaguagaaaauuucccaggccugaaguaacucuuuaauuuuguccaugcugccuuaaguuaguccaguguuuaagugggcugagcggggaaggagggcaguguuugggaacucagcuauggaagcuaucaccaucuccccacucccuuucacuaggcagugcuucuuaacugagggcugcggaacagucaguagcaaaacccaucagaaaauccacaagacuucucgcguagaauuugguuuucuguuuagaacuuagggacaaaugggaaaucuuuccauggggccauaaccuugggggcacaggauggauguuugacauugaaucaguaugcgcuuuuugaauaauuacauuugaucuagauaugucauuaauaucugguaauuucugucuguucauuuuaggcguaucaauauucaguuugaaagagauucaguugcaaaaggacccggguuuucgaaacucuucuuauccagagacagguguguuugucauaaaccauuucacaugucgcucaugaauuuuuuugcguggaaccaagcuuuggguugauaaauugaucaguaaaauuauugauguaacaaacaaacaaacaaaccaauguacagugcaucccacaacucuguauguuuagaauugcacauacuugcuguuguguaugaugggggcaccucaguaaaucuucagagagaaaugugauucagucaagucagggauccugaaagcuacagauggcagagaccuuucccaaguggccuggcuugaccucugcacacgccaucccuggugcccaaggcagaagacgcagccugugcaugccuagucaucagcuucaucacuuggaagccuagacgcuguagacugaccccgucaacacagagggcacuuaagacagccgaucacuaaccguggaauguuagcguuugcuggugggaacguuagcuuccuagagucaccaaauacuguaugugggauuaaaaaaaaccugaccuuugaacugccucauaaaaugacuuuauauuuuaggacaugggaagaacagaagacagagcaugcucuuuuaagucugguaacuuggucucaagcccagcuccagccuuucuuaucagccauggacucagagcugaaggcagucauuucuugugcuggacuugggaacuccgugugucagcacuguccucuucccaguggagucuuuuuauuucagaccuacagauuguuuuuauauuuguugucacagugugacaauuuuuuuuuuuguacaguugguuuuaaggucuucuccgccaguagagccaguagguuacagcuaucaauguaacuguagcugcagauuugugccggacugagaaacacagugcauuauuuauuugcggaaucauugcugcuaaauaacuacugucuguuuauuuaacacaacaguugaaugccugaagaaguugcaguggcuuuauuauaugugaacgcaucuguuucuccucacaaauuguuugacugcugcauuuuguuguuguuuguuuguuuguuuguuuguuuguuuuuuaaaagauuaaacugcaguguuuccuggaauguauauuuuagcuuugcuuagcaguagaauaagugagccaucgugaacacucgaaguccgugcuacauaucauuucuuaggcgcauuggccaauagccaggcugagagggggucagcacaguguguuucgggagcaugcaaugugaggguugaugcaagcaaaugaguagcagacauuuuggguucucaugucaaauaccaauaaacuaaaacacggaguuauuuauuuuuaccuauuccuccucuuagaaaugucugcauauguguaugcuccuacacuugguuagcucuuucucacugugcuuuuaguuaaaauuuagccacauaagucauucaaacaggaagggccuugccgcuguucaucauaagcacauuucucuuauuagaggauacuucauuuugagggaccguuucuuucauuuggggacuguguguguuucaauaacguucacuuggaaugagcugaaagcugugcugugucuuuaaauggagccacgaugaauuagaaaugagaaagaagaacccagaggacugcuuuaguguuguggguauuaucugcucaucagagacacuaacaguguaacuugaauuaugcaucuccuugaacaucacagacacuugguguugguaaucgugucuuaggcauuugcgcucauuguuaaggacuauugguuagugcaucuuacaacuauaaaucuuaauugguuauaguuugcaauggucauguguuugccuuauaucaugaaaauaguuauaacuuaauuuuuguccugccauucacuguaaacauucaggguccucucauuucuguucaggaaauccuguaguuuauuguuuguuauuuaacaguauuaagugaguuuuuguauauuucauuuuaacuuuauuugugaauagugauuguggcauguuuggggauguuauuuuaauauuucacaauacugaaauuuuaauuuuuuuuuaaaaaaaaagaaaguucuggaagaaacagauucauauguaauggugaauauuggaccacugcugcuuucacaguugucagcugguuuuauguuaagcccuguagccuaacugcuguuauuucuaacugacagacauguauuaauauuguacuuugaagguuauaaauauuaugugaaaauuccuucauuuguuuugaaauuuauaauaacuaaaucucuguguuauauaaaaugugauuuuuguggagucacuguucuuuauuggggaagaaagcugugcacacuggggucauccuccuucuggguuaucauugucaggugacaagaugucacugugcugaaagugacagccacguuagguuugugccgaccguuugguuagucucuuaugggaucuccugagauauuauucuuuacuuaugaaguaucagauuuguuaauuugauuugcagauuggccuuaguuugucaguaagcuugauucguacauauaaagaauauacaggcauuauuuaaaauucuuucuagggggucuagggucuuacgguuaagaaaugugcauggguugcuuuuguuuguugacguuucagccuuauccugauccuggaaacugcagagaggagacuuaaaacuuggaaagacugaaccuggaacucucagaagccccuuaaacugacaagaauucugaagguaagaggugcuauaucaaucaaacagcacauccaggguccuucacucaggcauuuuaucagcuuaguuugaaagaauauuuacuacguucuaaucuaucuuucagacucaugacccucuuuacgauauuaacugcauucacaacaugacagugaccuugauuuauuuccagaauugucuuccuuuuucagaaguugaaccuaguaaaauauuccacuccucccgccaagcuucucagaacuauuaauuuacucucuguguguaugaauuuuccuagucuagauacuuucuguccuugcagccauaccaguuuggcuuauuucuuucaacauccuauuuucagaguuucucucgauggcggggugauguuccacugugacugagcaguguaaagacugugaacauuggugugcacacaugcuugagucggaaaaaaaacaaaacaaaacaaacaaacaaaaaaccaauaagguugcuuuguuacauggauucccaaucugcccuuacaaagcacgugcuuuucaguugcuuccuccugcucucugacagcuuucacuuguagaugcccagggaggcugacauuuaaauaucacuuuucacucaguuccuaguuccacaaaagaccagcaggaagcccaggguggggucacagugaggacugcccugacuuuuaaguccugucuccacagguggguacucucucucucuuaacaacacuuuuccugguccuugaguucagggaguccuuuguuuauuuagauuaucuuuaacuguucucagcagcguuaguaguuuuuacauaaaaguuuuccccuccaugcuugaguuuacuccuaaguauuuuuugcugcuggugcaagcgggauaauuuucuucauuucuguuuguuuguuuuucauugcuagugcuuggaaguacagaugauuuuuuuguuuugaucuuguaaccuccaacuuuauugaauuuguugccuuuuuaaaguuuuuuuuuuuugguccauucuuuaugaucuucuacauauaaaauuacaucaucagcaggaagaaauaguuugacuuuuucauuuauaaucuggaugccuuuucuucucuucucuguccuuuacucccccccucccauuucauaauuagucuuuagaccuccaguauuauugaguagugaaugaaggccaguaacuuguguugcuggucuuggggaaaagcuuucagccguucaccaccccguguaaccagcaguggguguguauacagcccuauguuuaaggagcuucccugguugcuagguuacugcguguguuuauuaaggcgggggggggggguuuguuggcuuuaucuucuagaacuuuuuugcugucguuuuugaugaucaugcuguuuucuuuguuuauuaccuugauuuuuguaugacaucagcacugcauuucuugaaagagucccacuuggugaugaauuaaaguuuaauccccuuaugaaaucauuugggacuaaaagcaucucagauuucaagggauuuuucuuuugcccccaguuugggauauuugccuagccugugguaguugaacaucccugcuucaaaacuacgaagucuaaaaugcuucaaaaucuaaaaauguuuugaucauuguuacucugaaauuuucaggugucagugccuuuuagauuucauauuaaggauguuuaaguuguaauucuuuaaacaugcugcuaaguccaguuugcuuguauuuuguugagaauuuuugccugaauucaugauggguguggccugugcucucugcucacagcaucugucucaaugauuucguguuagcauugcugccaucugagauggagugaaggccguauccuccccuucaguuaugugaaguggcuuaggacauugucuuaagucuccgaauaccgcacuguuuuguauuuaguuuauuuuuuuauaguagaccaucuugauuuccuuccuuucucauguguauguguaguuguuuuaauaauauauuacaaauauuauuuugaguuugugugguuuuaagagauuuauccccaaauaucaucccuuucuauuauucugucaguggcucuaguuuuuaaauauucuaaucuagauuccuaagucaauucuuuguuuauuuuacauuuucauucauucaaaaugccaauacaagcucacaagcuugguagaauuaaacguguuuaauguguuccuuuacacacaaugacauccauguuuuccuucuguaaaguuuucuaaugcuaaguucagaccauggacuugcaugucaggagguuuguuaccaucauuccuagucaagaguuucuacuucuaaccuaagaaaacuacugacaacaucuguccauccaaaaugggaagcauauaaguaaauuaacugauuauaaaacuacguugaugugaaaagaauguaagacuugaccuacgaugguuggaaggccuuuucauuccuggcuucucccuaagagaaauucauuuauugggaaacuaacauucuuuuaaagcuaccacuugacagacuaaaguguacacuugugagaaagacagacaaacaagucuuucauagcaacuguggugcugucccuacugagguguuaaugcaggguugccugggcuaugugggagcgugggugaagauggagcugaugagcaccuggucuuagcaccucugggugcagaaagcucugcgucugaaagguuuuccucugggcugugaacaggacauggacucuuagugcagacuggauucccggaacagugcuagcgaagaguuagaaacacuccggccccuuccgcagcuguagggacaguucuuacuuacugccaucuuuccguuuccuccugggcgauugcauacuaacucagugaaaugguagugguguaggcuauagggucaucguggaauggugcucaugugucuuuuguuuuuucuggaaacacuggaacucauuagaaagauugccuuggaagcauuccagcuguuuggcuuuuccagacccccagccagccauucuuucaggucuucuuagcuaccuggaacuccccccacccugugccauucuuuuagaacuuauguuuuauugcuacuaauuauuccacauugcugucuccuaccaugauuuacucuuugaucccgaguuacccaaauguucucuucucuugccucugcuugagucuuggcugauucuucuggaaguccuucccuguacccuaccccaccacagacuggcuuauaaguccuccaguuuuauugcccuccugucuguuguccauguacuucagaauaugauaauacuuaaucacuuuuuaucaucacucaauaacucauaagcccugugaaggggagaauuacuaugucuuggacuaaauaaagacauaagagugaagaaauccuuguuuguaaguaaaacccaccacuuacguuauauuguuaaaaacccaagaacucagaggcagaggcaggcauauuucugaguuugaggccagccuggucuacaaagugaguuccaggacagccagggcuaaacagagaaacccugucucgaaaaaccaaaaaaaaaaaaaaaaaaaaaaccuaagaacucauaaucaaguuguucuaccucuaccccccuacacacacacacacacacacacacacacacacacacacacacacacaggggaggggauagcaagagaucucacacaggacuaggaauaaguacaggagaaguccaggcagagcacacuauaauuacugggaaucuccccggcaacaauggugugugccugguacaauguaaaggcguagauuaauaguucuuaaacuuaaaagacuuuaucuuuuaagcauauugaccaacauccauggccucugcaaucaaaguguaauuuugaaaacugacuagcuguuugagucagugauuuaacuagaguuggucucaguucccuuguaaaauuauguauaauaguacuucucucauagagcugugugcuuggaguuggagcucuggacuccagcugaguuucuuugagucaguuauuuaacuacaguuggucucaguucccuuacuuguaaaauuauguauaauagcacuucccucguagggcugugugagugcucuggacuuggagcagugagggaugcugagcgggugugaaguaguuuagaaguaguucccaccaguaacuaaaccugucaugugauggaaugaaaaugggccuuagguuccagagucauuuggaaguggguaccagaacucagagucaguccuguauugggggccaaagaagggaguccagaugcagagaugucaugccugaagauuaaaacaaaggacacaggaccacacacggcauccuaucaucuuggguagaagcuuucugcagugcuuccgggaaucacaguugguuuucagauguuucuucaguaugugaauaauucccuaucacaccgacaaauauauccuaucuagcuaugaauucgugucccuuuucaaacuguagugacauugaacaucagucugggucucugguuaucugcuauuucuuccuuccuacacacacacacacacacacacacacacaccagucuugugaaccaacccaccuggugacugcacugagaucauuggaaauaaaacaaagaaucgccuuugccaaccagucuguaguucauaugacccugugucaacaaaauggguaaaaggaaauauuagcuucuccuuuuccucauuuucuuaccucuguguagaacaacugacagaacuuugauggagguggugguggugguggugguggugguggugguggugguggugguggugguggugguggugugugugcagugcccaggcgcagacuagaugacaucagcagucccacucagcacucuuccuuauuucuuucagacagggucucacuucuaggccucugcauuucagcuagacugguggccugcaggccucagaccagucccuaacacccacagggcuggauuuauagguccaugcacagucaugcccuauguugcaugugaguguccggguccucaugcucgcuuacucgccaagcagucuuugcagccccaugucuuaagaucaggagaccauuucaaacccauuuuacuacucccccaguucauccucagugguggggugugugguggggugugugguagggugugugugguggggugugugguggggugugugguaggguguguguggugggguguguggugggguguguguggugggguguguggugggguguggugggguguguguggugggguguguggugggguguguggugggguguggugggguguguguggugggguguguggggggguguggggggggguguggugggguguguggugggggguguguggugggguguguggugggggguguguggugggguguguguggugggguguguggugggguguacuguagugggcucuagagucucacaugugcuagguaaguacugucuacugcgcuauaauccucaugcguauguaaagcauuugaugugccauauguagagauaggaacuuauauuuacccaucuuguugacacagaagaagcgguauuugagucacuguaaguaaauggaagggaacaaacacccucgaauccaaacacucuuuuauuacaaaguauuuauucagcaaaacaguauuacaguaaaaacgacacccguguggccgcggaggaagcccugcagcuguaggaaagcugugcgcagggacggaguucagcucccacagugagguucuagagcuccaaccucacucagccucagcagucaaacacugaugacgcaagcauagaaaagagagccggggaugcucuugggagccuacguuccggcugaauuucuccuguuaaaaacacagaaggcagagaggcugucguucuccauucuacaguccucaugccagcaucuggguccacaggagaaucaugguaguuggaagaaaaggaaucaacaggcagacuuacagucaugggaacauuuccaaccagcguuuauaguuuaaaggucgacagaaggucaucuuguugagaucccugcacaucagucccuuuaguuucuucuuaagacucuugcacaucaaaugcauccucaucuagccauuuuaaacauuccaaccuuacguuuccuuacguucugaggcucucuuacucuucccucaguggaugcuauggccccaggcagcuccaggccagcuucuccacccccaccaccccuguccugugugccugucuugaccagagaacagcuggaagccagcacucucaaagccccucccagcucugacacuguguucgguaauuacagccuccugaaccagcuccuuuuuauuuuaguacacauuuauucuucgccgugagggaguggcagggcaucuauuuaugggcuuggagcugucuccauggcuuuacagucagagguuuuuuucuccccuuaguaaagacacaugccccuuagaaagaaagucaacuucgguaguaagucucaauguguaaguaucuaaacauaauuuuagauuguuuaaaauucaaauuuuuugcacgagcuuuguuuuuuuaacccccuuauaauccucuauuuaguaucuagucuguagaggcacauugcaguuguuuguuuguuuguuuguuuaauacuuauagaugagugguguuucagcucaccugaucuugaauuuaaagugccuugccuucagaguguuacaguagaacuuccccuuaagcacaggugugcugccuucagggucucaccagaugagaggcugcucgcgucacagccggaagccauacucagcacgugaagccuucccugcggagcaucugaggagcugcugcauccguuucagagggagauccugacaagucuccccuucucagagucccuuuauucucaucaucauuacuaccgaaagcgguggcucuugagugcucauccucagaagcaaggccuucaguuccuccagcucuuaguaaugcauuggauuuaauccaucaaaaauuauaucuacacacaggaaauaucucuauacauggcugguaguauauaaacauuucuuuguuugaauucaccaucuguaagcaucuuccaaaacauucuuaguuuguuucccaccacgcccuuuuuggggagagacagggagacagguuacugggguuuauacccacagccucaacacaugcagguuacacauucuauggagcuauauccucagcccuaaaacauuagguuuuaaauauuaauugucaugccaggaaucuaaagaaaccuuaacucccaguagugacaaagauaccagaugguugugguuguaggaaaugaagagagcagggcuagucucaaaauuaaauacaaaccuggaaaguccccuugagaguuuggcuggugugaacuuaacggagccuuagcauuccagacuucugcaggaaguagaaaggcuucuacaaacggcugagcggcuuggucucucaaaguucuucuuuuaaaaaagugcacuuuggaacauguucuuuaaacaauguuuauugucuaaauauggcuucguucauucuuauauaaaaacccaucacuuggacauuacuggauuucaguuccgaagagguccuaaggcaguucuuaccgcgauggagguucacuugaacgugucuacgugagaaaauaacccucuacggagagcuguuggaugccaagguguccuucaaacaguuccucucaauacuagaaauacauaaauucauguacauaacacuaaaugcaaaggaaggcacagcugguuacaucguguaugcaagcggaguucagcauauguagaguuaaagcaauaaaaggcuucacauccucauuaguuacauugaaaacauuaagaaaggcuccucccuggcaguguucaacacuccagagcuaacaagauuaaaaaaaaaaccacaaacauuaaaauucacugaaugcgaaacagacuuuuauagagagcugaauauauauauauauauauauauaaaaagacaaaacuuuuguuuuaaaaugcuaacauacaucuagauuauccauguuacgaaaagugcaaaccaaaugaaccagguuucacaauguccuucucaugacacagguaaacuagcccauggggacaaacuggcaucauccgucaucuguucugaguccuuaguugaugacagugacguugguggcccaucaucaggauuucugagagcugggggacagcagaacuggggauggagcucuguccagacuggggagcggcaccggcaugugaccguugagcaguguggggaacuggaaggaacagggagcauuuaguaacugugacaaagccauucgggagcuugcuugccuuuaaugcauagacccacccguggauguuguucccugagcccagugaugggaguuggcugcugaguugcuuuacaaagguuaccuagagcaacagagaggggcccagaaaaugccccuauucugugugccaaagguccuaaccuguccuucgcaugugcagugaaguugagucuacugcuauuuuuuuuuuaaagguucuaagcuaguuugcugauuuucuaacuaucaagggguaaaacuggaaaccaagauccuuuacauaugggucaguaaucucacauuucgaaauuugcugucugguucccacagcacaacagagacgccuguccgcucuuguuggaaacgaggaccgggaagcuggacacagcagccuagcccuuaacaguacugacugcucuguggacaggagcugagccugauuccagcacccaugucgcauggcucagcacuaucccagcgcccggagaugugugguccuggccucugugcauuuuucuaaaagaaagaugaucuuauucuuuccuggagguuugagagugcuuuucccugaucuaauuaucagugcauuaggucgcccuugcacaggcaaacagugagauuucuguguuguugguaacuaaggugguagcuagccgaacaaaagcgcuggauuuccuaagugggacagauauuucagcugugaucccguacgaagaagggugagcaagagcauccuugucauaugugacuguccacucacagcucgaguucugcacugccgaagacacaauguggccaguggaccuccccccccccccccccccgguccuccuguagcuuaaucccuguuuaguccaggaaagcuaaauauuaaaccugagcacuaaauaucaaacggcagagccuggcacaugcgagaaguacaauaaauauuugucgaaugaguacauacuuuuuccccuaaacuauuucgguaacacauuugaacgccuuggccucucaggggccgcuguuucauugggucacuaagaguauaaaguaagcuuuguuaucaccacuuuguaagugagacaaacaacucggggagguucugacuagcucaaggucauagcuccuaagcaaaaguaaguuuuuaaucaccagcuauacuaaacggcccagcuccucuuuuaauugauuuaaugguaacuggcauauguaggggcuucuugucuuuccuggagcuuugggggacuuuguuucuguccaguuccuagaucuaucugcaugcacuuaaaccuuucuaagccaagccccacucgugaagugacuucaggugaacugcagaagcgcacacgcgcucucccccugccccccauuuuacuggugccuaugaaaaaaucaucuuuagugucagcuuuuuccauauguuaggauggauugcugcccacucugugcacuccuuugccauacuuguccugauuggcuuggguuccccccuccccccacagaagguucauuggcuuugcucccaccacagcuauaaaagugugucaagcuaaaauguucuaucgagcacauucucaguuggaaaccgagucuccucuacccuuuuuccacauguaccugccugugagguaugccccaguguguuuguagaucaggcucuagauucacgcucggccagugccuuagauaccucucucucuuuucuaaaacacuuugcaaauagaaaacauaaccucuuccagaaaggguagugcgucguuuucucucucugcugaaauucugccauaucugcucuagucugcuauaagcaugguuuuagguaggcuggugcacacccgucauccccacauucaggaggcugaggcaggaggacuaccgugaguuuaaggucagccugggcuacaaaguaagcuccaagcuagccagaucuacaguguaugacccugugcccaucacucuuccucuaagauagacagacaagcagaucauugucucaggagaucugcguagcaaugccuuagcuccaccaacucccucccuaaggauuucgguuugcuuuuccaaagcucacacaggacacaugcccacucugcucaaaaugugcuguagguuaugauuuuucuuucauuuaccaacacccgguguauguaaaugagacuuacguuuuuauucauuuugaugggacucagugguaaucuguauucccagaaauccauuucagucgauguccuauuauuuuucauuggaaaucucauuccucugaggaaguuuauuguuugccauuuuuaaaacugccaccuccaacuuuuauaugaccacuugcucuuuuuuaugcaggguaauaauauuuuuuaagggacagaguuguuucccuuugcacauggauccagccaucacuugugaacuccaggccaugcaaccucucagccauccaagcuaagcuguggcccccuuucaaccuccccggcugguuuuugaauggcucuuggauugaaaacagaucuguuuacagaaauuagaauagaaccucuuugcagacagccuuuguaugcaguagucugcagaauucuaaauguaaauuaggaaccccuagucuacagcgguuggcucucagaaugugguuccuaauguuuccuagaacauuaucagaagugugacuguuuuaucagaccaugccugagaccccaugaaucagaagccccugggugggccuagcaucuuuacuugacacaauauccaugcaacccugaugcaugcuggcuucgcagaaccacuggcuaugugguauggacuucucccagcucccagagauccuggcugucaacccacuguggaaaugaacucucuuuacuguugggaauacuggaauagaaacaaaguuccacugguuccuuguggcuuuccuggaagaucuuuaaccucuguaccaaucagauggcagaacucgcaaaacccauagacaugagaagcuguuuguuuuucagacauucacugagcucugcagaagcuccacguuagacuccauacucaugcgguccugcccacgaggggugauguauucagacagcucccucccacuacgcuucuacuagacugugccacuugaggauaaaaugguagccaccaacauguucacugugucugagcagaagugagcugggcugggacucagggccagggagagagggaaacucaauuacuccagggaguagucccaccaugacacccuacuccaagccugccaggaaaccagaagcacaggauagcaaucuaaaccuccgaagcugcuccguccucccagagagcucguaaauccugguguguagacaugguguucuugcagagaggugcucagcaaauacuagccuugcuaagcaaagugaccaccuuagaggacagccuggagcucaucacaucuuuuauuggcaugugugcuuuggcaucuugucacuaggcuaucaguaaugacugacaugugugugaccauugaugugcuagaagcugggagacagcacagugaacagguuaugguuuugaggguuuuuuuuggggggggguccacuugccagaucaauggguaguccuaauguaaaauguuaaggaccgugggaauaaggagcgacagccaguuuggggugagcauccuaggccaagggaagcaggcuggguagaccaagcuagagaggagcguggagcuagcaaggcgucuaccuuugcuucauuccugcccugccugaacucacauccucaagacaguaaugcccuauugguguguagcaaucuuugagacucaggagauacugaucuccaugggauacugaguaaagcuccuggaaaauuccagaagaagaauggauaaugaauguguucaccuaacucagggagggcuucauuauucuuuuuucgagacaggguuucucuguguagcccugguguccuggaacucacuuuguagaccaggcuggccucaaacucggaaauccaccugccucugccucccaagugcugggauuaaagguguacaccaccacugcccggcucagcuucaucauucuuuaaccauauguugcacaguauuuuguuacauaauucaagccugauuauaaucuguagaaugaugcggguaacguuucuacuccaguuugggaaaacuguucacuguuucuauuuuuuucaguguuuuuucaugugaaucuauugacuaguuggguuccuguuuuaaagucucuuauagagcuuuuauaaaaaucauguuuuaauuuuaaaucauuuccugcagucaauuuccaguuuuccuagucacguggaaguauccagaacccuuaaagaauccauguguguguuccugauagaagaaccucuucucugccucagagaaaagaaaugucugucucuaaaaugacuuucaacccaauccuuaggaauuccccuuggaaacuuuuaacuugguagcucaguggcagaagguaccgucagagagagcuuuuguggaauuuagagaaaagccauccguuagaugacucgcguuuaaaagcucauuugcagacacuuaccuggaaaaguguguucggcccuugcagccuggcaggacucaguggggcgacaggacuaaggcugcuccagaaguguaugcugggcagcagcggacucgaggccagaaacaguccacuuggugucuagaagacaaggcaacaggcagcucuugauugggggucaccuaacaccagccaugaccaaaaagcagcggaguggucagugugugagaaccaagccucgccuucucgggaaaacugggcaacuuuaguucucuccacaugacuaggaguagcuuaauucucaguacuaauuuuaugugcaguucuuaggcaagcuacauucugguuggaaaagucagguuuguagcaacuugucaaacaguuccuucugucccuucccccugcucccaguagacaaauguauagacugaauaggaucccuggaaggggggcuucguuucuuaucaaacuguuuagccacaguggacagcgaucacacccaaaguuuacaacacccccccacccccgcccacgggccacaugcuuguaaaaaggaucaucuugggcaucaugccccauuaucaacagcccuguaauaauugaaauucuaugagcauggcuugcagccgcuuguucagaagcccugagcugaucuugcggacuucacucuggacguggggcugggaggaauccauugcccuggcaaugggaaaguagggcuguggagccagaaugcagcguuucuuagaagugacggacuggcauuugcuugcccgcacucggcaggaggccuggcccacaagccagcuaaagggcaggagaaacaagccgucccagccaguaaaucugcacggcuuuucuucucagcagaggcaaacucccuggcccagggugucugcaccucuagugaccagaggagccccucaauaagacucuuuguguaagaacacagcaaaggcgccagcauuaaagauugcaucaugcuggaugccgccguguuauuuuuuccuagaacuggccccggcagccucuguaauuaucaaaugcauuugagcuuaaaccuaaauugaaagguuugcucuguucagcgggagagagagacaaacauccaguggucuuccagccgaagugcugacugguaaacagauuuaaaccaaguucuuugagucuuugguuccauggcauuuccuucuacauauugaauggccuacgagguuacuaggauaaauacguguuuugaguuagugauccauuuuuuuuuuccuaguuggaggcaauuucacaagugugcuaggccagcuggccucaugguuaaaaauaaauggguaagcaugagcucugacaggguucccauguucagaaccucugcucauuagcuagacaaccucggacgaacagcccagccucucugguccucaaucuuaaucugucaacugggggaaaggaaaauguaugcuauugcaggguugcugcaaggacauguaauucaaaugauacucuuaauauauuacuauauauuauauuaguuuuauauaguaauauacacauuauuuuauauauuauuuaccuuauauauauuacagcauacaauauaaauagauauuuacauauuauauaaaaguauggauaauguauauauauaauguauauauaugaccaauacacaaagaugucaagucuaagagacucaggucauuuuguaaaucaguaauaaauauaaaauguaccagacauacucauuaaauagaauuuauccauucaugaggaauucucaacugggugcuaaaaaguucugggaauccaacuuguauggguagguuaggcccuaguccgcagacccaggugcuuugagguacuuuagagccagguucaaaccacaguguuauuaacaguuaauaaccagggucagugcucucagguucuucucaaagucggcaggcacagucuucuaaaccagaaagggcagcuaccauuuucucauccaaggccacaaacucacacgucugggaaauauguaaagugcaggaucuaccguuuacauccccucuggaucugaggcgcuugcacauuuguuuccaaggaauacaggaugcacauagaaugcaggggccuucuguuucucaugguuaauacauuugaaaugccuucuauaauauaugcaaauaaacauugugaaaugacuucauucacuccuccuccaauugcaguucucgccggagauccugcaaccuuaaaggaaggauuguuugggaacuuggaaggggaacuuccuaaagagcuuugccuggguuaucucaggacauugcagagccuccaaggugucucugccugaccuggagggaggaccgccuguaaagggcaggcuuuucggggcuguugaggagccugggaaugccuggcuuaacaaauggcuacaguuguuccugaugucagugaaaagacacgcaagaagggcuuucccacuaggaucuccuuucucuuccuccccauucaaauccacuuaauucugggucgccuagagaguguauaccugugaccuuuaacgagagcagcugacucacauccagauguguugcagcuguguguugucugcaccaaccuuuucuacuccugucucucucugcccgucagaaaugccaccaccuggaagcagacccccagucuacccucaggcugauaugauuucuuugauuuuugcugaaucuuuagaauacuauggaacccuuucaccccuuaacauuaaauauauucugucucauacugugcacauccuucugguuccucuuuucauggccguuggaggguuuguucguuguucuuaacccccagugcucgaugagcugaagaacuuuucaacuccgugcccgccuuccucgggucugacuucuuuuuuuuucccccaacuuuuuauuagguauuuucuucauuuacauuucaaaugcuaucccaaaaguccccuaugcccucccccacccacuccccuacccacccacuccccuacacccacucccacuucuuggccuugguguuccccgguacuggggcauauaaaguuugcaagaccaaggggccucucuucccaacgauggccaacuagagacacgagcucugggaguacugguuaguucauauuguuguuccaccuauagggcugcagaucccuuuagcuccuuggguacuuucucuagcuccuccauugggggcccuguguuccagccaauagcugacugugagcauccacuucuguguuugcuaggcacuggcauagccucacaagagagagcuauaucaggguccuuucagcaaaaucuugcuggcguaugcaauagugucuguguuugguggcugauuaugggauggauccccggguggggcagucucuggaugguccauccuuucgucucagcuccaaacuuugucucuguaacuccuuccagggguguuuuguucccaauucuaagaaggggcgaaggucucaaacccaggacaagucucacucaguaccuguggcuccuccccugcccuaagccccucccucccagggccugggcuucacuucccaucuucccuagccuucacccuccagucugauuccuguucuaacucagucaguuuggcaacacuggucucccgauugccucucuuggucagcggcuccucucucccuccccaucucuccucucauggucauuuugucugcgggccagguucggccuggacucuucuuucugccuguuuucucuacauuuacaaaauguaaaaaaaaaaaaaaaaaaaaaaaaaaccuccauccaucaggagugaccguguucucuuccuuuuauuucuuuauuuuucauucaucuucuccugaaaugaccugcauguucaaaacugaacucauuuuucaaauccaccucuucuaagacuucuguuucuguugacgagugccaucagcaguuuaugucaguguguguguguguguguguguauauauauauuacacacacacacacacacacacacacacacacacacacauacauacuuacuuacugagaccgaaaauauuugcagaagcaagaacaaaauaagacaugauuucuggcacacauggcccuaccuacuacucagcaucccaggcaccaagacagaaacacuaccuuccuuggacucauuuucaaucuaucucucuacuuccuucugggcagcauuuagauccagucagcuuaccaccaugacauuccacaagucaccuggaccagucuaccugccucacauccccuauccaggauacaauuccauguagucacucuacaacacuucauucaaaaaaauccguucauuuucgggggggggggggaacggccuccuuagccacaaugcuaaaucccauagacuuacaacacaucgucacuucccucugagaacccuccugcuuggcauuauguguccugggcuuaucacagagagauucauagauuuacaacuccuuaaccucccucccuccccagccacaguucccaggguuguuaacauucccucauguugguggccggauguagcauagcuucccugauuuaccaugguucagaucuauacccuuuucuuccccucacccuuuguuguuguuguuuuuguuuuuuguuguuuguuuguuuuguuuuguuuuuuuuuucugagacaggguuucucuguguagcccuggcuguccuggaacucacucuguagaccaggcuggccucgaacucagaaaucugccugccucugccucccgagugcugggacuaaaggugugcgccaccacgcccggcuccuucccaucauccuccuauucaucucucacucgccccucaaguuagucacuaaggccuguggcugacggucucuaaauuucucacagauccaacuccucuggaugugucaguuagagccuggcaucuucccuguccauuagcuggaguguugcaagguauccuaacugaauacaguguccccuucuguaucuaugcugucagggugacuuguaccacacaguucauacugucccacaugcccuuccaguguuuccacugcugccuuaaucccaucccaucuaacuaaacuccaacucuuccucuagaccuguccuuaucucacgcucuuccuagcccacuguguuccugcacggagaugccagaaagaucucugccacucccucagccccucacccaacugugacugccccuuccauagccacucucaacauuucacuccucuggacaaguucaucccuucuuccuuaacauuccguuugugccuccuagcuuccgggacucuaccacccaggcuugugccccuagugccaacccuggcagcuuacacgggaaggggguggggagugcucccgucagguuucaggaacugagccaaacguacuuguuugugcugcucaggucuccucuguaggauguaacugucuugugugcaugugugcauguauguguguacuucagcagggauagguccuaagguuguaaaauaggucacuucucccaucuuuuucaugucuugcaaaaauuuaugugcaguguaagguuguaaaauagaucacuucucccauccuuuucaugucuugcaaaaauuuauguucagugaucauuuacuaauucuuacaaggcauccguguuccacuuggcuuaugccucuagaaguuguuaauuuccuaucaaaccaugucucaacuucucgggcaguuuucaugaccagaaauuauauuugaccccuauucuuuauuuccgggcagcagcuguaagcucaugagaaccagaaccacaucuauauacuaaucuugguaucccugaggcagcaagcaagugccuggguguucagugacuagcuccacgugaacugauuagaaaggaggcagagaagagacuggguguggccugcccaguggcagugagaagaugucuuuggugaugucuugagugggugcuggagacacuaggaaaccauugggacuucaggaagagugaaggagaagcccuuacacauauaccuuaaaaguggcacagaggccaacggaguccauaaaaauggcgccccagaguucaacauuauuuucaauagcugggccagggguaaaggcacuugccaccaagucagaguuuuaucugugggacucacaugguggaaggagagaaccaacuccuacaaguuguccucugaccuccauaugugcacacuagcccacaucacauacacaauaaauaaguuuuauauauauauauauauagagagagagagagagagagagagagagagaaagagagagagagagagagagggagagagugauggaggcagaccagaagagauggaugacccauugaguagucacuagaagaagagaggagagggggcagcaugggaccccagggcgcaaggagaaaaggcacucccuuuauuguuucucuggggcaaccuacaacuugguagccaagaaccauccuagccuguacugcagagaccuacaaggaaguucucugccuggaggaaaggucaucauggucagagauggaggccugucuggggaaaggucaacagaagaagaaggaaguugaacaacccuggagagaagggagaggggggaaaauguuuuucuuuugaugauaauggcaagagacaggaagauggaaaccacaccagaagugggguguagggggacaggaugcucgcacucuguagguucuccuacacugcuccagacucccacuuuucugacuuggccucagagcugucuccgcuaccccagaauagaggaaguaggcuucagcauuucaaaccgagcaggcugucuccacucagccacuaaucccaggcugccgagcaaacagccugaggcgcacauacucagacucugauggagaugcgugcccagugcugaaacagcucagauuucagcaucuuggacagcacaggugagacgaacacgagucuuggcagaaaugagaaauacaaugccuuggauuccgaauuaacuucaccuuggggggacaggagcaacgggacacagaugggauguggcaggaagagggacagaugaaaccagcaugcagaggagucaggaguuucagcugccaccucggcugccaaggugccuggcuagaggccaggagggcuucacaccccagcuccuuccccucugccuaacauucgguagccugugccaacggggacaagcaagcgccuugcuuuucagcaacauucagaugggaccuccguggcugagcucugacgccaucauuuuucucuguaccuagcugacuuuugcuugagucuuccagccccuuguuggagaagucccugcccggacacuauuuaucauaaacuuagcaccaagagucauguccuccgcucuuugcagcuccugucagcggcuucgccaguguuccugacgggaggcggcucugacacugugagagaggcacauuuguucuggcuuucugcacaucgaauugaagacagaauguucaaaucugaauguagaccccaugacacaugugggaaaggacagugaucaugugauaugucuugucaaggcgccucauuuacaggggacuggguuaguagagcacaccucucccccgcccccucucugaagugagcacucccuuaggagugcucauucuguuucugagccccgccccccagaagggaacacuaagggugagugggagagcuaagaguggaugggucagcuucuggaggacgcccuggggcgucgggcggagcuuuacuacugaucuaaaucuuauaccgacuucaagcauagccuaauccuguagaacaggaagcuuguugugauuaaccccuuaguggccugucuggucagaguuaaaccacugauggcugaaaggaggcugaguuuuaccagaucuuugcccuucucucccucucaguugacuacccacagcccauaggagcagagcaccauuccaggugcauguagucucugguggcauuuagcuccugagguuacacuaugucccuaagcagccucuuuuacuaacugugugacaccucuuuccaagcucacucacucucuaugacucugucucugucucugucucugucucucucucucugucucucucucugucucugucucucucucucugucucugugucucucugugucucucugugucuccccucucucucucucucucugucucucucucugucucugucucugucucucugucucucucucucugucucucucucugugucucucugugucuccccccucucucucucucucucucucucucucucucucucucucucucucucucucucucucucucucucucucucucugucucucaaagccuaggccccauuggauuuccuuucauugaguagucacucaaugaaaguuguauccugucagccugacccccaugugccugagggcacaggcccucugucccagaaguccagcuuccuaagcauucucucuagguuuuaggccacucugguagguucugucucuggggauuaacucucuguccacauguuaggaucccucucucaggucaaggucccucuccuccuauccccugcccugccaucccaggcccccacugaguucacgguaucuaggaccaaagccacgguagcaauuuuccuugaaauagacaggguuggugucggccccacucugcucagagaaggggaugcaggcucacagagaacacagacgccgaaaccggggaugaccuuggccugacuuuggaccacucucagccuuacagucuuaaacacuaaggcccggacucugccuggcagcucucacucuucuuacuugccugagcugcuacuugagaggcagguuucucgccuguugccuggcagcccugcuuuguuagggaaugcuaauuugggaguguguaugugcccauuccaaccuauuaccggaguccugggccucuccucagaaaugagcacaguuccucaagucacuucacaaaaauaagcugccacgugaccccugggaagccuggcaaagaaagcaaaguagcaaagaauugcuggccgcuggucugcacaccccacggacuguugucaggguaagagcggccgggucuucuccccaagggauggcagagacuuuagcuucagaguggauggaugcuggaugcaaaguggcuccaaacucauccuuccgacuuacagcuuuggauccaggucaaggcacuucaccucugaaccccagccaccucagccaggcaguuguaauggcaacaguaucuacacagaggcuggggggagggaagcugcuaugacacagguggcaaggugggugauguggagcaggugucuggcacaugggaagaauuugguggcuacuguugggaguugacagggacagcuaugacaaggacagaggcagagcugggaauuccaggccaccugcagcauaaucuggcauggagccucaaagcuccaggacaaugacgccugccaguuggagcuggcugaguaggguagcaugcccaccguccuaauguguuguuacuauagagcaucacccagaaagcagauacccacuuucccacaccuacgaagcagaaucuagcccaacgcugccaccuucuaccacuagcuugcuucugcuuugaucuggaaccacccaaccugucugcccggcagcugaaccagacaccacugugacacuucugaagggaaaaaggccaccuuucccaggggcucccagcagcuaagacuuacacaccccaugaauuuucccuucucuccccaugggaccugagcuuccccacagcagcccugcuuuugguagggacuuuccuucugcaugucacccuuguguuucuuguuaaaggucaccaugacccacacagcuuuauacugacuuuaaucugugaacaugauuuuucuuaucaggaagcacauggcuuaugagugccuccaaaaauaauaugccuuaaaaacuuccuaaggccuaaaugccccccccucaaaugccaugacccuagaggucuccccacaugguuacucugguaauaucccucuguuaccaggauaccaagccuuuccgcaugugugccucucucucucagcauauacagugauguugcgacacuggccaagggaucucucccaaggagaacaggggugguucucccugcauccagcuaggaucccgggaauagugcuuaccugugcggugaagaaggcuggagugagggauccugaggggagggcugggcuguugagggcgauggagccgaugucggugccggagagcaacaguuggggugcagagauuuccaagccuuuggguuuuuugccuuuugggggaagagauggagacuugguuuuggagcccgaugacagauucaggggcuccagagaauccgagucauggcaggcugccuccaggaagaggcuucuguguucagaagggaggggagagucgggggacagggauggggaccgagaugaagagggugacgcagacgaaaugcuggcagcauuuggcaacauuaaagaggagaucuuggcugagacagacgaggccaggaaagcggaugccgcugccgcagcggucucggauguggaaggcagggacaccacaggccuggugaugugcuugucgguuuuauuggucacaaaccugaucacaguccugacuucuuccacagggggacugucaucacagggcuccuccagcuucuccgucuugauggccuugaaggccucuggagcguucugcagggaguugauggugaaggacgaguagaggcccgaguggagguacucguugcggcuggcacuuuugagagaggacaagccgugccuguggaccucucggccuuccggggacaccuuacagucgccguccugcagcaggaggcucucccggcugaucucuaccgcgugaggauccauuuucaggauauccgggaaagagacgaacuuguacacaaacuucugcccgaucacuuucuugaugauguucugugaaugcaaaacaaaaaacaaaacaaaaaacaaaaaaaaaacccagacauuuagaaggggugagccagugacauggaaggagggggccccuggaaccacaaaugauagcagccaaagcgccaccauauuccugaugcccacagggugccuacaaggagugacgucagagacugaagguucacuguuacacucugguccuguugacccaggaggaggggugaggucuccagccuguggugccuuucucaucuauugucugugacgauuuuguaauagcaaaagcuaccacugagcuagcacuuaacugcagggcugggaugauucagaccguagcacaugucauuugcacaguaauccuacaagcaggcuuuaucguucuuguugugcaauuagaagagagagcuggggagagcgccuagcgaauagaucacaugcaugaggcccgcgaacuucggaucaucagcacccauguaaaaggggggagggggauggaugucuaggacaagcuagauaucuaggauggcuagcuagaccauucugaauccaugagcucuggguucagcaaggguuccugucucagcaaguaaaguggagagugagugaggaagacaucugaugccagucuuguggcuacacacacauggccaaguguguacccauguaccacguauacccacacaugcgugcacgccacauaacacaugcaaaaagaaaaauucuaagaaguaggagauaaacuuugaguacugcagugacgcacauggccaagguuaagcaagaagggccaagggagauugacuucacgcuaacacgggacugucuuacccgccucugggaaccgagagacuacagugaaauacuaacaagcaagcacucugcuagagaacaucugggaaauguaaguuaccgccacccagcaacgcaaccaagguuugcuucagccaggcagccauuucuggcaugaaagccacuggagaaaacgaagucgccugcuugguuauuuauggcauuugguucauauucuuaguugcuggugucuucuucuggcucuucaguuaaguccucaucccuccagcagcaugauauaaauggaacaugaaaaucgcuaugaaggcaagaguuuucucagcccaugagaaagugggucucacguggcaggcuaugcuguucuuaaggguaauugagcugugggaguagucccuguagagccuaccuaguucuaggucugucuggcaaaugcuugcuacaggucucacccuaugguugacucggaguccuggguacucuggggagaaaaacauggcuucccucuggcucaaaaagccagcauuauucuaugagaaagaucccuguaggcuucucuacaaacucauccuucuaaaguuuguaaaaaaaaaaaaucauuugagggagaagcccuuuauggauugaaugccccacaaguccaggaaucugguguauaaauccuucagcagccccaguggagggaagaggguagcauccuuccacugccaaggcaagcauggagcuggagccauagccacagaccaccaagaucuacuggcacuaaagccuuucuacacuuccacacaguggggaggaaagcacaguaguaccccgauaaagaggucucuguaauuccugaccuuccuugggugcucauggcuuguucuaacu

SEQ ID NO: 5700 - RNA, 106705 nt, Mus musculus
aguuagaacaagccaugagcacccaaggaaggucaggaauuacagagaccucuuuaucgggguacuacugugcuuuccuccccacuguguggaaguguagaaaggcuuuagugccaguagaucuugguggucuguggcuauggcuccagcuccaugcuugccuuggcaguggaaggaugcuacccucuucccuccacuggggcugcugaaggauuuauacaccagauuccuggacuuguggggcauucaauccauaaagggcuucucccucaaaugauuuuuuuuuuuuacaaacuuuagaaggaugaguuuguagagaagccuacagggaucuuucucauagaauaaugcuggcuuuuugagccagagggaagccauguuuuucuccccagaguacccaggacuccgagucaaccauagggugagaccuguagcaagcauuugccagacagaccuagaacuagguaggcucuacagggacuacucccacagcucaauuacccuuaagaacagcauagccugccacgugagacccacuuucucaugggcugagaaaacucuugccuucauagcgauuuucauguuccauuuauaucaugcugcuggagggaugaggacuuaacugaagagccagaagaagacaccagcaacuaagaauaugaaccaaaugccauaaauaaccaagcaggcgacuucguuuucuccaguggcuuucaugccagaaauggcugccuggcugaagcaaaccuugguugcguugcuggguggcgguaacuuacauuucccagauguucucuagcagagugcuugcuuguuaguauuucacuguagucucucgguucccagaggcggguaagacagucccguguuagcgugaagucaaucucccuuggcccuucuugcuuaaccuuggccaugugcgucacugcaguacucaaaguuuaucuccuacuucuuagaauuuuucuuuuugcauguguuauguggcgugcacgcauguguggguauacgugguacauggguacacacuuggccauguguguguagccacaagacuggcaucagaugucuuccucacucacucuccacuuuacuugcugagacaggaacccuugcugaacccagagcucauggauucagaauggucuagcuagccauccuagauaucuagcuuguccuagacauccaucccccuccccccuuuuacaugggugcugaugauccgaaguucgcgggccucaugcaugugaucuauucgcuaggcgcucuccccagcucucucuucuaauugcacaacaagaacgauaaagccugcuuguaggauuacugugcaaaugacaugugcuacggucugaaucaucccagcccugcaguuaagugcuagcucagugguagcuuuugcuauuacaaaaucgucacagacaauagaugagaaaggcaccacaggcuggagaccucaccccuccuccugggucaacaggaccagaguguaacagugaaccuucagucucugacgucacuccuuguaggcacccugugggcaucaggaauaugguggcgcuuuggcugcuaucauuugugguuccaggggcccccuccuuccaugucacuggcucaccccuucuaaaugucuggguuuuuuuuuuguuuuuuguuuuguuuuuuguuuugcauucacagaacaucaucaagaaagugaucgggcagaaguuuguguacaaguucgucucuuucccggauauccugaaaauggauccucacgcgguagagaucagccgggagagccuccugcugcaggacggcgacuguaagguguccccggaaggccgagagguccacaggcacggcuuguccucucucaaaagugccagccgcaacgaguaccuccacucgggccucuacucguccuucaccaucaacucccugcagaacgcuccagaggccuucaaggccaucaagacggagaagcuggaggagcccugugaugacagucccccuguggaagaagucaggacugugaucagguuugugaccaauaaaaccgacaagcacaucaccaggccuguggugucccugccuuccacauccgagaccgcugcggcagcggcauccgcuuuccuggccucgucugucucagccaagaucuccucuuuaauguugccaaaugcugccagcauuucgucugcgucacccucuucaucucgguccccaucccugucccccgacucuccccucccuucugaacacagaagccucuuccuggaggcagccugccaugacucggauucucuggagccccugaaucugucaucgggcuccaaaaccaagucuccaucucuucccccaaaaggcaaaaaacccaaaggcuuggaaaucucugcaccccaacuguugcucuccggcaccgacaucggcuccaucgcccucaacagcccagcccuccccucaggaucccucacuccagccuucuucaccgcacagguaagcacuauucccgggauccuagcuggaugcagggagaaccaccccuguucuccuugggagagaucccuuggccagugucgcaacaucacuguauaugcugagagagagaggcacacaugcggaaaggcuugguauccugguaacagagggauauuaccagaguaaccauguggggagaccucuagggucauggcauuugaggggggggcauuuaggccuuaggaaguuuuuaaggcauauuauuuuuggaggcacucauaagccaugugcuuccugauaagaaaaaucauguucacagauuaaagucaguauaaagcugugugggucauggugaccuuuaacaagaaacacaagggugacaugcagaaggaaagucccuaccaaaagcagggcugcuguggggaagcucaggucccauggggagagaagggaaaauucaugggguguguaagucuuagcugcugggagccccugggaaagguggccuuuuucccuucagaagugucacaguggugucugguucagcugccgggcagacagguugggugguuccagaucaaagcagaagcaagcuagugguagaagguggcagcguugggcuagauucugcuucguaggugugggaaaguggguaucugcuuucugggugaugcucuauaguaacaacacauuaggacggugggcaugcuacccuacucagccagcuccaacuggcaggcgucauuguccuggagcuuugaggcuccaugccagauuaugcugcagguggccuggaauucccagcucugccucuguccuugucauagcugucccugucaacucccaacaguagccaccaaauucuucccaugugccagacaccugcuccacaucacccaccuugccaccugugucauagcagcuucccuccccccagccucuguguagauacuguugccauuacaacugccuggcugagguggcugggguucagaggugaagugccuugaccuggauccaaagcuguaagucggaaggaugaguuuggagccacuuugcauccagcauccauccacucugaagcuaaagucucugccaucccuuggggagaagacccggccgcucuuacccugacaacaguccguggggugugcagaccagcggccagcaauucuuugcuacuuugcuuucuuugccaggcuucccaggggucacguggcagcuuauuuuugugaagugacuugaggaacugugcucauuucugaggagaggcccaggacuccgguaauagguuggaaugggcacauacacacucccaaauuagcauucccuaacaaagcagggcugccaggcaacaggcgagaaaccugccucucaaguagcagcucaggcaaguaagaagagugagagcugccaggcagaguccgggccuuaguguuuaagacuguaaggcugagagugguccaaagucaggccaaggucauccccgguuucggcgucuguguucucugugagccugcauccccuucucugagcagaguggggccgacaccaacccugucuauuucaaggaaaauugcuaccguggcuuugguccuagauaccgugaacucagugggggccugggauggcagggcaggggauaggaggagagggaccuugaccugagagagggauccuaacauguggacagagaguuaauccccagagacagaaccuaccagaguggccuaaaaccuagagagaaugcuuaggaagcuggacuucugggacagagggccugugcccucaggcacaugggggucaggcugacaggauacaacuuucauugagugacuacucaaugaaaggaaauccaauggggccuaggcuuugagagacagagagagagagagagagagagagagagagagagagagagagagagagagagagagagagagagagagagagaggggggagacacagagagacacagagagagagacagagagagagagacagagagacagagacagagacagagagagagacagagagagagagagagaggggagacacagagagacacagagagacacagagacagagagagagagacagagacagagagagagacagagagagagagacagagacagagacagagacagagucauagagagugagugagcuuggaaagaggugucacacaguuaguaaaagaggcugcuuagggacauaguguaaccucaggagcuaaaugccaccagagacuacaugcaccuggaauggugcucugcuccuaugggcuguggguagucaacugagagggagagaagggcaaagaucugguaaaacucagccuccuuucagccaucagugguuuaacucugaccagacaggccacuaagggguuaaucacaacaagcuuccuguucuacaggauuaggcuaugcuugaagucgguauaagauuuagaucaguaguaaagcuccgcccgacgccccagggcguccuccagaagcugacccauccacucuuagcucucccacucacccuuaguguucccuucuggggggcggggcucagaaacagaaugagcacuccuaagggagugcucacuucagagagggggcgggggagaggugugcucuacuaacccaguccccuguaaaugaggcgccuugacaagacauaucacaugaucacuguccuuucccacaugugucauggggucuacauucagauuugaacauucugucuucaauucgaugugcagaaagccagaacaaaugugccucucucacagugucagagccgccucccgucaggaacacuggcgaagccgcugacaggagcugcaaagagcggaggacaugacucuuggugcuaaguuuaugauaaauaguguccgggcagggacuucuccaacaaggggcuggaagacucaagcaaaagucagcuagguacagagaaaaaugauggcgucagagcucagccacggaggucccaucugaauguugcugaaaagcaaggcgcuugcuuguccccguuggcacaggcuaccgaauguuaggcagaggggaaggagcuggggugugaagcccuccuggccucuagccaggcaccuuggcagccgagguggcagcugaaacuccugacuccucugcaugcugguuucaucugucccucuuccugccacaucccaucugugucccguugcuccuguccccccaaggugaaguuaauucggaauccaaggcauuguauuucucauuucugccaagacucguguucgucucaccugugcuguccaagaugcugaaaucugagcuguuucagcacugggcacgcaucuccaucagagucugaguaugugcgccucaggcuguuugcucggcagccugggauuaguggcugaguggagacagccugcucgguuugaaaugcugaagccuacuuccucuauucugggguagcggagacagcucugaggccaagucagaaaagugggagucuggagcaguguaggagaaccuacagagugcgagcauccugucccccuacaccccacuucuggugugguuuccaucuuccugucucuugccauuaucaucaaaagaaaaacauuuuccccccucucccuucucuccaggguuguucaacuuccuucuucuucuguugaccuuuccccagacaggccuccaucucugaccaugaugaccuuuccuccaggcagagaacuuccuuguaggucucugcaguacaggcuaggaugguucuuggcuaccaaguuguagguugccccagagaaacaauaaagggagugccuuuucuccuugcgcccuggggucccaugcugcccccucuccucucuucuucuagugacuacucaaugggucauccaucucuucuggucugccuccaucacucucucccucucucucucucucucucuuucucucucucucucucucucucucucucucuauauauauauauauauaaaacuuauuuauuguguaugugaugugggcuagugugcacauauggaggucagaggacaacuuguaggaguugguucucuccuuccaccaugugagucccacagauaaaacucugacuugguggcaagugccuuuaccccuggcccagcuauugaaaauaauguugaacucuggggcgccauuuuuauggacuccguuggccucugugccacuuuuaagguauauguguaagggcuucuccuucacucuuccugaagucccaaugguuuccuagugucuccagcacccacucaagacaucaccaaagacaucuucucacugccacugggcaggccacacccagucucuucucugccuccuuucuaaucaguucacguggagcuagucacugaacacccaggcacuugcuugcugccucagggauaccaagauuaguauauagaugugguucugguucucaugagcuuacagcugcugcccggaaauaaagaauaggggucaaauauaauuucuggucaugaaaacugcccgagaaguugagacaugguuugauaggaaauuaacaacuucuagaggcauaagccaaguggaacacggaugccuuguaagaauuaguaaaugaucacugaacauaaauuuuugcaagacaugaaaaggaugggagaagugaucuauuuuacaaccuuacacugcacauaaauuuuugcaagacaugaaaaagaugggagaagugaccuauuuuacaaccuuaggaccuaucccugcugaaguacacacauacaugcacacaugcacacaagacaguuacauccuacagaggagaccugagcagcacaaacaaguacguuuggcucaguuccugaaaccugacgggagcacuccccacccccuucccguguaagcugccaggguuggcacuaggggcacaagccugggugguagagucccggaagcuaggaggcacaaacggaauguuaaggaagaagggaugaacuuguccagaggagugaaauguugagaguggcuauggaaggggcagucacaguugggugaggggcugagggaguggcagagaucuuucuggcaucuccgugcaggaacacagugggcuaggaagagcgugagauaaggacaggucuagaggaagaguuggaguuuaguuagaugggaugggauuaaggcagcaguggaaacacuggaagggcaugugggacaguaugaacugugugguacaagucacccugacagcauagauacagaaggggacacuguauucaguuaggauaccuugcaacacuccagcuaauggacagggaagaugccaggcucuaacugacacauccagaggaguuggaucugugagaaauuuagagaccgucagccacaggccuuagugacuaacuugaggggcgagugagagaugaauaggaggaugaugggaaggagccgggcgugguggcgcacaccuuuagucccagcacucgggaggcagaggcaggcagauuucugaguucgaggccagccuggucuacagagugaguuccaggacagccagggcuacacagagaaacccugucucagaaaaaaaaaacaaaacaaaacaaacaaacaacaaaaaacaaaaacaacaacaacaaagggugaggggaagaaaaggguauagaucugaaccaugguaaaucagggaagcuaugcuacauccggccaccaacaugagggaauguuaacaacccugggaacuguggcuggggagggagggagguuaaggaguuguaaaucuaugaaucucucugugauaagcccaggacacauaaugccaagcaggaggguucucagagggaagugacgauguguuguaagucuaugggauuuagcauuguggcuaaggaggccguucccccccccccccgaaaaugaacggauuuuuuugaaugaaguguuguagagugacuacauggaauuguauccuggauaggggaugugaggcagguagacugguccaggugacuuguggaaugucauggugguaagcugacuggaucuaaaugcugcccagaaggaaguagagagauagauugaaaaugaguccaaggaagguaguguuucugucuuggugccugggaugcugaguaguagguagggccaugugugccagaaaucaugucuuauuuuguucuugcuucugcaaauauuuucggucucaguaaguaaguauguauguguguguguguguguguguguguguguguguguguguaauauauauauacacacacacacacacacacacugacauaaacugcugauggcacucgucaacagaaacagaagucuuagaagagguggauuugaaaaaugaguucaguuuugaacaugcaggucauuucaggagaagaugaaugaaaaauaaagaaauaaaaggaagagaacacggucacuccugauggauggagguuuuuuuuuuuuuuuuuuuuuuuuuuacauuuuguaaauguagagaaaacaggcagaaagaagaguccaggccgaaccuggcccgcagacaaaaugaccaugagaggagagauggggagggagagaggagccgcugaccaagagaggcaaucgggagaccaguguugccaaacugacugaguuagaacaggaaucagacuggagggugaaggcuagggaagaugggaagugaagcccaggcccugggagggaggggcuuagggcaggggaggagccacagguacugagugagacuuguccuggguuugagaccuucgccccuucuuagaauugggaacaaaacaccccuggaaggaguuacagagacaaaguuuggagcugagacgaaaggauggaccauccagagacugccccacccggggauccaucccauaaucagccaccaaacacagacacuauugcauacgccagcaagauuuugcugaaaggacccugauauagcucucucuugugaggcuaugccagugccuagcaaacacagaaguggaugcucacagucagcuauuggcuggaacacagggcccccaauggaggagcuagagaaaguacccaaggagcuaaagggaucugcagcccuauagguggaacaacaauaugaacuaaccaguacucccagagcucgugucucuaguuggccaucguugggaagagaggccccuuggucuugcaaacuuuauaugccccaguaccggggaacaccaaggccaagaagugggaguggguguaggggaguggguggguaggggagugggugggggagggcauaggggacuuuugggauagcauuugaaauguaaaugaagaaaauaccuaauaaaaaguugggggaaaaaaaaagaagucagacccgaggaaggcgggcacggaguugaaaaguucuucagcucaucgagcacuggggguuaagaacaacgaacaaacccuccaacggccaugaaaagaggaaccagaaggaugugcacaguaugagacagaauauauuuaauguuaaggggugaaaggguuccauaguauucuaaagauucagcaaaaaucaaagaaaucauaucagccugaggguagacugggggucugcuuccaggugguggcauuucugacgggcagagagagacaggaguagaaaagguuggugcagacaacacacagcugcaacacaucuggaugugagucagcugcucucguuaaaggucacagguauacacucucuaggcgacccagaauuaaguggauuugaauggggaggaagagaaaggagauccuagugggaaagcccuucuugcgugucuuuucacugacaucaggaacaacuguagccauuuguuaagccaggcauucccaggcuccucaacagccccgaaaagccugcccuuuacaggcgguccucccuccaggucaggcagagacaccuuggaggcucugcaauguccugagauaacccaggcaaagcucuuuaggaaguuccccuuccaaguucccaaacaauccuuccuuuaagguugcaggaucuccggcgagaacugcaauuggaggaggagugaaugaagucauuucacaauguuuauuugcauauauuauagaaggcauuucaaauguauuaaccaugagaaacagaaggccccugcauucuaugugcauccuguauuccuuggaaacaaaugugcaagcgccucagauccagaggggauguaaacgguagauccugcacuuuacauauuucccagacgugugaguuuguggccuuggaugagaaaaugguagcugcccuuucugguuuagaagacugugccugccgacuuugagaagaaccugagagcacugacccugguuauuaacuguuaauaacacugugguuugaaccuggcucuaaaguaccucaaagcaccugggucugcggacuagggccuaaccuacccauacaaguuggauucccagaacuuuuuagcacccaguugagaauuccucaugaauggauaaauucuauuuaaugaguaugucugguacauuuuauauuuauuacugauuuacaaaaugaccugagucucuuagacuugacaucuuuguguauuggucauauauauacauuauauauauacauuauccauacuuuuauauaauauguaaauaucuauuuauauuguaugcuguaauauauauaagguaaauaauauauaaaauaauguguauauuacuauauaaaacuaauauaauauauaguaauauauuaagaguaucauuugaauuacauguccuugcagcaacccugcaauagcauacauuuuccuuucccccaguugacagauuaagauugaggaccagagaggcugggcuguucguccgagguugucuagcuaaugagcagagguucugaacaugggaacccugucagagcucaugcuuacccauuuauuuuuaaccaugaggccagcuggccuagcacacuugugaaauugccuccaacuaggaaaaaaaaaauggaucacuaacucaaaacacguauuuauccuaguaaccucguaggccauucaauauguagaaggaaaugccauggaaccaaagacucaaagaacuugguuuaaaucuguuuaccagucagcacuucggcuggaagaccacuggauguuugucucucucucccgcugaacagagcaaaccuuucaauuuagguuuaagcucaaaugcauuugauaauuacagaggcugccggggccaguucuaggaaaaaauaacacggcggcauccagcaugaugcaaucuuuaaugcuggcgccuuugcuguguucuuacacaaagagucuuauugaggggcuccucuggucacuagaggugcagacacccugggccagggaguuugccucugcugagaagaaaagccgugcagauuuacuggcugggacggcuuguuucuccugcccuuuagcuggcuugugggccaggccuccugccgagugcgggcaagcaaaugccaguccgucacuucuaagaaacgcugcauucuggcuccacagcccuacuuucccauugccagggcaauggauuccucccagccccacguccagagugaaguccgcaagaucagcucagggcuucugaacaagcggcugcaagccaugcucauagaauuucaauuauuacagggcuguugauaauggggcaugaugcccaagaugauccuuuuuacaagcauguggcccgugggcggggguggggggguguuguaaacuuugggugugaucgcuguccacuguggcuaaacaguuugauaagaaacgaagccccccuuccagggauccuauucagucuauacauuugucuacugggagcagggggaagggacagaaggaacuguuugacaaguugcuacaaaccugacuuuuccaaccagaauguagcuugccuaagaacugcacauaaaauuaguacugagaauuaagcuacuccuagucauguggagagaacuaaaguugcccaguuuucccgagaaggcgaggcuugguucucacacacugaccacuccgcugcuuuuuggucauggcugguguuaggugacccccaaucaagagcugccuguugccuugucuucuagacaccaaguggacuguuucuggccucgaguccgcugcugcccagcauacacuucuggagcagccuuaguccugucgccccacugaguccugccaggcugcaagggccgaacacacuuuuccagguaagugucugcaaaugagcuuuuaaacgcgagucaucuaacggauggcuuuucucuaaauuccacaaaagcucucucugacgguaccuucugccacugagcuaccaaguuaaaaguuuccaaggggaauuccuaaggauuggguugaaagucauuuuagagacagacauuucuuuucucugaggcagagaagagguucuucuaucaggaacacacacauggauucuuuaaggguucuggauacuuccacgugacuaggaaaacuggaaauugacugcaggaaaugauuuaaaauuaaaacaugauuuuuauaaaagcucuauaagagacuuuaaaacaggaacccaacuagucaauagauucacaugaaaaaacacugaaaaaaauagaaacagugaacaguuuucccaaacuggaguagaaacguuacccgcaucauucuacagauuauaaucaggcuugaauuauguaacaaaauacugugcaacauaugguuaaagaaugaugaagcugagccgggcaguggugguguacaccuuuaaucccagcacuugggaggcagaggcagguggauuuccgaguuugaggccagccuggucuacaaagugaguuccaggacaccagggcuacacagagaaacccugucucgaaaaaagaauaaugaagcccucccugaguuaggugaacacauucauuauccauucuucuucuggaauuuuccaggagcuuuacucaguaucccauggagaucaguaucuccugagucucaaagauugcuacacaccaauagggcauuacugucuugaggaugugaguucaggcagggcaggaaugaagcaaagguagacgccuugcuagcuccacgcuccucucuagcuuggucuacccagccugcuucccuuggccuaggaugcucaccccaaacuggcugucgcuccuuauucccacgguccuuaacauuuuacauuaggacuacccauugaucuggcaaguggacccccccccaaaaaaaacccucaaaaccauaaccuguucacugugcugucucccagcuucuagcacaucaauggucacacacaugucagucauuacugauagccuagugacaagaugccaaagcacacaugccaauaaaagaugugaugagcuccaggcuguccucuaagguggucacuuugcuuagcaaggcuaguauuugcugagcaccucucugcaagaacaccaugucuacacaccaggauuuacgagcucucugggaggacggagcagcuucggagguuuagauugcuauccugugcuucugguuuccuggcaggcuuggaguagggugucauggugggacuacucccuggaguaauugaguuucccucucucccuggcccugagucccagcccagcucacuucugcucagacacagugaacauguugguggcuaccauuuuauccucaaguggcacagucuaguagaagcguagugggagggagcugucugaauacaucaccccucgugggcaggaccgcaugaguauggagucuaacguggagcuucugcagagcucagugaaugucugaaaaacaaacagcuucucaugucuauggguuuugcgaguucugccaucugauugguacagagguuaaagaucuuccaggaaagccacaaggaaccaguggaacuuuguuucuauuccaguauucccaacaguaaagagaguucauuuccacaguggguugacagccaggaucucugggagcugggagaaguccauaccacauagccagugguucugcgaagccagcaugcaucaggguugcauggauauugugucaaguaaagaugcuaggcccacccaggggcuucugauucauggggucucaggcauggucugauaaaacagucacacuucugauaauguucuaggaaacauuaggaaccacauucugagagccaaccgcuguagacuagggguuccuaauuuacauuuagaauucugcagacuacugcauacaaaggcugucugcaaagagguucuauucuaauuucuguaaacagaucuguuuucaauccaagagccauucaaaaaccagccggggagguugaaagggggccacagcuuagcuuggauggcugagagguugcauggccuggaguucacaagugauggcuggauccaugugcaaagggaaacaacucugucccuuaaaaaauauuauuacccugcauaaaaaagagcaaguggucauauaaaaguuggagguggcaguuuuaaaaauggcaaacaauaaacuuccucagaggaaugagauuuccaaugaaaaauaauaggacaucgacugaaauggauuucugggaauacagauuaccacugagucccaucaaaaugaauaaaaacguaagucucauuuacauacaccggguguugguaaaugaaagaaaaaucauaaccuacagcacauuuugagcagagugggcauguguccugugugagcuuuggaaaagcaaaccgaaauccuuagggagggaguugguggagcuaaggcauugcuacgcagaucuccugagacaaugaucugcuugucugucuaucuuagaggaagagugaugggcacagggucauacacuguagaucuggcuagcuuggagcuuacuuuguagcccaggcugaccuuaaacucacgguaguccuccugccucagccuccugaauguggggaugacgggugugcaccagccuaccuaaaaccaugcuuauagcagacuagagcagauauggcagaauuucagcagagagagaaaacgacgcacuacccuuucuggaagagguuauguuuucuauuugcaaaguguuuuagaaaagagagagagguaucuaaggcacuggccgagcgugaaucuagagccugaucuacaaacacacuggggcauaccucacaggcagguacauguggaaaaaggguagaggagacucgguuuccaacugagaaugugcucgauagaacauuuuagcuugacacacuuuuauagcuguggugggagcaaagccaaugaaccuucuguggggggaggggggaacccaagccaaucaggacaaguauggcaaaggagugcacagagugggcagcaauccauccuaacauauggaaaaagcugacacuaaagaugauuuuuucauaggcaccaguaaaauggggggcagggggagagcgcgugugcgcuucugcaguucaccugaagucacuucacgaguggggcuuggcuuagaaagguuuaagugcaugcagauagaucuaggaacuggacagaaacaaagucccccaaagcuccaggaaagacaagaagccccuacauaugccaguuaccauuaaaucaauuaaaagaggagcugggccguuuaguauagcuggugauuaaaaacuuacuuuugcuuaggagcuaugaccuugagcuagucagaaccuccccgaguuguuugucucacuuacaaaguggugauaacaaagcuuacuuuauacucuuagugacccaaugaaacagcggccccugagaggccaaggcguucaaauguguuaccgaaauaguuuaggggaaaaaguauguacucauucgacaaauauuuauuguacuucucgcaugugccaggcucugccguuugauauuuagugcucagguuuaauauuuagcuuuccuggacuaaacagggauuaagcuacaggaggaccggggggggggggggggggagguccacuggccacauugugucuucggcagugcagaacucgagcugugaguggacagucacauaugacaaggaugcucuugcucacccuucuucguacgggaucacagcugaaauaucugucccacuuaggaaauccagcgcuuuuguucggcuagcuaccaccuuaguuaccaacaacacagaaaucucacuguuugccugugcaagggcgaccuaaugcacugauaauuagaucagggaaaagcacucucaaaccuccaggaaagaauaagaucaucuuucuuuuagaaaaaugcacagaggccaggaccacacaucuccgggcgcugggauagugcugagccaugcgacaugggugcuggaaucaggcucagcuccuguccacagagcagucaguacuguuaagggcuaggcugcuguguccagcuucccgguccucguuuccaacaagagcggacaggcgucucuguugugcugugggaaccagacagcaaauuucgaaaugugagauuacugacccauauguaaaggaucuugguuuccaguuuuaccccuugauaguuagaaaaucagcaaacuagcuuagaaccuuuaaaaaaaaaauagcaguagacucaacuucacugcacaugcgaaggacagguuaggaccuuuggcacacagaauaggggcauuuucugggccccucucuguugcucuagguaaccuuuguaaagcaacucagcagccaacucccaucacugggcucagggaacaacauccacgggugggucuaugcauuaaaggcaagcaagcucccgaauggcuuugucacaguuacuaaaugcucccuguuccuuccaguuccccacacugcucaacggucacaugccggugccgcuccccagucuggacagagcuccauccccaguucugcugucccccagcucucagaaauccugaugaugggccaccaacgucacugucaucaacuaaggacucagaacagaugacggaugaugccaguuuguccccaugggcuaguuuaccugugucaugagaaggacauugugaaaccugguucauuugguuugcacuuuucguaacauggauaaucuagauguauguuagcauuuuaaaacaaaaguuuugucuuuuuauauauauauauauauauauauucagcucucuauaaaagucuguuucgcauucagugaauuuuaauguuugugguuuuuuuuuuaaucuuguuagcucuggaguguugaacacugccagggaggagccuuucuuaauguuuucaauguaacuaaugaggaugugaagccuuuuauugcuuuaacucuacauaugcugaacuccgcuugcauacacgauguaaccagcugugccuuccuuugcauuuaguguuauguacaugaauuuauguauuucuaguauugagaggaacuguuugaaggacaccuuggcauccaacagcucuccguagaggguuauuuucucacguagacacguucaagugaaccuccaucgcgguaagaacugccuuaggaccucuucggaacugaaauccaguaauguccaagugauggguuuuuauauaagaaugaacgaagccauauuuagacaauaaacauuguuuaaagaacauguuccaaagugcacuuuuuuaaaagaagaacuuugagagaccaagccgcucagccguuuguagaagccuuucuacuuccugcagaagucuggaaugcuaaggcuccguuaaguucacaccagccaaacucucaaggggacuuuccagguuuguauuuaauuuugagacuagcccugcucucuucauuuccuacaaccacaaccaucugguaucuuugucacuacugggaguuaagguuucuuuagauuccuggcaugacaauuaauauuuaaaaccuaauguuuuagggcugaggauauagcuccauagaauguguaaccugcauguguugaggcuguggguauaaaccccaguaaccugucucccugucucuccccaaaaagggcguggugggaaacaaacuaagaauguuuuggaagaugcuuacagauggugaauucaaacaaagaaauguuuauauacuaccagccauguauagagauauuuccuguguguagauauaauuuuugauggauuaaauccaaugcauuacuaagagcuggaggaacugaaggccuugcuucugaggaugagcacucaagagccaccgcuuucgguaguaaugaugaugagaauaaagggacucugagaaggggagacuugucaggaucucccucugaaacggaugcagcagcuccucagaugcuccgcagggaaggcuucacgugcugaguauggcuuccggcugugacgcgagcagccucucaucuggugagacccugaaggcagcacaccugugcuuaaggggaaguucuacuguaacacucugaaggcaaggcacuuuaaauucaagaucaggugagcugaaacaccacucaucuauaaguauuaaacaaacaaacaaacaaacaacugcaaugugccucuacagacuagauacuaaauagaggauuauaaggggguuaaaaaaacaaagcucgugcaaaaaauuugaauuuuaaacaaucuaaaauuauguuuagauacuuacacauugagacuuacuaccgaaguugacuuucuuucuaaggggcaugugucuuuacuaaggggagaaaaaaaccucugacuguaaagccauggagacagcuccaagcccauaaauagaugcccugccacucccucacggcgaagaauaaauguguacuaaaauaaaaaggagcugguucaggaggcuguaauuaccgaacacagugucagagcugggaggggcuuugagagugcuggcuuccagcuguucucuggucaagacaggcacacaggacaggggugguggggguggagaagcuggccuggagcugccuggggccauagcauccacugagggaagaguaagagagccucagaacguaaggaaacguaagguuggaauguuuaaaauggcuagaugaggaugcauuugaugugcaagagucuuaagaagaaacuaaagggacugaugugcagggaucucaacaagaugaccuucugucgaccuuuaaacuauaaacgcugguuggaaauguucccaugacuguaagucugccuguugauuccuuuucuuccaacuaccaugauucuccuguggacccagaugcuggcaugaggacuguagaauggagaacgacagccucucugccuucuguguuuuuaacaggagaaauucagccggaacguaggcucccaagagcauccccggcucucuuuucuaugcuugcgucaucaguguuugacugcugaggcugagugagguuggagcucuagaaccucacugugggagcugaacuccgucccugcgcacagcuuuccuacagcugcagggcuuccuccgcggccacacgggugucguuuuuacuguaauacuguuuugcugaauaaauacuuuguaauaaaagaguguuuggauucgaggguguuuguucccuuccauuuacuuacagugacucaaauaccgcuucuucugugucaacaagauggguaaauauaaguuccuaucucuacauauggcacaucaaaugcuuuacauacgcaugaggauuauagcgcaguagacaguacuuaccuagcacaugugagacucuagagcccacuacaguacaccccaccacacaccccaccacacacaccccaccacacaccccccaccacacaccccaccacacaccccccaccacacaccccaccacacccccccccacacccccccacacaccccaccacacacaccccaccacaccccaccacacaccccaccacacaccccaccacacacaccccaccacaccccaccacacaccccaccacacacaccccaccacacaccccaccacacacacccuaccacacaccccaccacacaccccaccacacacacccuaccacacaccccaccacacaccccaccacugaggaugaacugggggaguaguaaaauggguuugaaauggucuccugaucuuaagacauggggcugcaaagacugcuuggcgaguaagcgagcaugaggacccggacacucacaugcaacauagggcaugacugugcauggaccuauaaauccagcccuguggguguuagggacuggucugaggccugcaggccaccagucuagcugaaaugcagaggccuagaagugagacccugucugaaagaaauaaggaagagugcugagugggacugcugaugucaucuagucugcgccugggcacugcacacacaccaccaccaccaccaccaccaccaccaccaccaccaccaccaccaccaccaccaccaccuccaucaaaguucugucaguuguucuacacagagguaagaaaaugaggaaaaggagaagcuaauauuuccuuuuacccauuuuguugacacagggucauaugaacuacagacugguuggcaaaggcgauucuuuguuuuauuuccaaugaucucagugcagucaccagguggguugguucacaagacugguguguguguguguguguguguguguguguaggaaggaagaaauagcagauaaccagagacccagacugauguucaaugucacuacaguuugaaaagggacacgaauucauagcuagauaggauauauuugucggugugauagggaauuauucacauacugaagaaacaucugaaaaccaacugugauucccggaagcacugcagaaagcuucuacccaagaugauaggaugccgugugugguccuguguccuuuguuuuaaucuucaggcaugacaucucugcaucuggacucccuucuuuggcccccaauacaggacugacucugaguucugguacccacuuccaaaugacucuggaaccuaaggcccauuuucauuccaucacaugacagguuuaguuacuggugggaacuacuucuaaacuacuucacacccgcucagcaucccucacugcuccaaguccagagcacucacacagcccuacgagggaagugcuauuauacauaauuuuacaaguaagggaacugagaccaacuguaguuaaauaacugacucaaagaaacucagcuggaguccagagcuccaacuccaagcacacagcucuaugagagaaguacuauuauacauaauuuuacaagggaacugagaccaacucuaguuaaaucacugacucaaacagcuagucaguuuucaaaauuacacuuugauugcagaggccauggauguuggucaauaugcuuaaaagauaaagucuuuuaaguuuaagaacuauuaaucuacgccuuuacauuguaccaggcacacaccauuguugccggggagauucccaguaauuauagugugcucugccuggacuucuccuguacuuauuccuaguccugugugagaucucuugcuauccccuccccuguguguguguguguguguguguguguguguguguguguguguguguagggggguagagguagaacaacuugauuaugaguucuuagguuuuuuuuuuuuuuuuuuuuuugguuuuucgagacaggguuucucuguuuagcccuggcuguccuggaacucacuuuguagaccaggcuggccucaaacucagaaauaugccugccucugccucugaguucuuggguuuuuaacaauauaacguaagugguggguuuuacuuacaaacaaggauuucuucacucuuaugucuuuauuuaguccaagacauaguaauucuccccuucacagggcuuaugaguuauugagugaugauaaaaagugauuaaguauuaucauauucugaaguacauggacaacagacaggagggcaauaaaacuggaggacuuauaagccagucuguggugggguaggguacagggaaggacuuccagaagaaucagccaagacucaagcagaggcaagagaagagaacauuuggguaacucgggaucaaagaguaaaucaugguaggagacagcaauguggaauaauuaguagcaauaaaacauaaguucuaaaagaauggcacaggguggggggaguuccagguagcuaagaagaccugaaagaauggcuggcugggggucuggaaaagccaaacagcuggaaugcuuccaaggcaaucuuucuaaugaguuccaguguuuccagaaaaaacaaaagacacaugagcaccauuccacgaugacccuauagccuacaccacuaccauuucacugaguuaguaugcaaucgcccaggaggaaacggaaagauggcaguaaguaagaacugucccuacagcugcggaaggggccggaguguuucuaacucuucgcuagcacuguuccgggaauccagucugcacuaagaguccauguccuguucacagcccagaggaaaaccuuucagacgcagagcuuucugcacccagaggugcuaagaccaggugcucaucagcuccaucuucacccacgcucccacauagcccaggcaacccugcauuaacaccucaguagggacagcaccacaguugcuaugaaagacuuguuugucugucuuucucacaaguguacacuuuagucugucaagugguagcuuuaaaagaauguuaguuucccaauaaaugaauuucucuuagggagaagccaggaaugaaaaggccuuccaaccaucguaggucaagucuuacauucuuuucacaucaacguaguuuuauaaucaguuaauuuacuuauaugcuucccauuuuggauggacagauguugucaguaguuuucuuagguuagaaguagaaacucuugacuaggaaugaugguaacaaaccuccugacaugcaaguccauggucugaacuuagcauuagaaaacuuuacagaaggaaaacauggaugucauuguguguaaaggaacacauuaaacacguuuaauucuaccaagcuugugagcuuguauuggcauuuugaaugaaugaaaauguaaaauaaacaaagaauugacuuaggaaucuagauuagaauauuuaaaaacuagagccacugacagaauaauagaaagggaugauauuuggggauaaaucucuuaaaaccacacaaacucaaaauaauauuuguaauauauuauuaaaacaacuacacauacacaugagaaaggaaggaaaucaagauggucuacuauaaaaaaauaaacuaaauacaaaacagugcgguauucggagacuuaagacaauguccuaagccacuucacauaacugaaggggaggauacggccuucacuccaucucagauggcagcaaugcuaacacgaaaucauugagacagaugcugugagcagagagcacaggccacacccaucaugaauucaggcaaaaauucucaacaaaauacaagcaaacuggacuuagcagcauguuuaaagaauuacaacuuaaacauccuuaauaugaaaucuaaaaggcacugacaccugaaaauuucagaguaacaaugaucaaaacauuuuuagauuuugaagcauuuuagacuucguaguuuugaagcagggauguucaacuaccacaggcuaggcaaauaucccaaacugggggcaaaagaaaaaucccuugaaaucugagaugcuuuuagucccaaaugauuucauaaggggauuaaacuuuaauucaucaccaagugggacucuuucaagaaaugcagugcugaugucauacaaaaaucaagguaauaaacaaagaaaacagcaugaucaucaaaaacgacagcaaaaaaguucuagaagauaaagccaacaaaccccccccccccgccuuaauaaacacacgcaguaaccuagcaaccagggaagcuccuuaaacauagggcuguauacacacccacugcugguuacacgggguggugaacggcugaaagcuuuuccccaagaccagcaacacaaguuacuggccuucauucacuacucaauaauacuggaggucuaaagacuaauuaugaaaugggagggggggaguaaaggacagagaagagaagaaaaggcauccagauuauaaaugaaaaagucaaacuauuucuuccugcugaugauguaauuuuauauguagaagaucauaaagaauggaccaaaaaaaaaaaacuuuaaaaaggcaacaaauucaauaaaguuggagguuacaagaucaaaacaaaaaaaucaucuguacuuccaagcacuagcaaugaaaaacaaacaaacagaaaugaagaaaauuaucccgcuugcaccagcagcaaaaaauacuuaggaguaaacucaagcauggaggggaaaacuuuuauguaaaaacuacuaacgcugcugagaacaguuaaagauaaucuaaauaaacaaaggacucccugaacucaaggaccaggaaaaguguuguuaagagagagagaguacccaccuguggagacaggacuuaaaagucagggcaguccucacugugaccccacccugggcuuccugcuggucuuuuguggaacuaggaacugagugaaaagugauauuuaaaugucagccucccugggcaucuacaagugaaagcugucagagagcaggaggaagcaacugaaaagcacgugcuuuguaagggcagauugggaauccauguaacaaagcaaccuuauugguuuuuuguuuguuuguuuuguuuuguuuuuuuuccgacucaagcaugugugcacaccaauguucacagucuuuacacugcucagucacaguggaacaucaccccgccaucgagagaaacucugaaaauaggauguugaaagaaauaagccaaacugguauggcugcaaggacagaaaguaucuagacuaggaaaauucauacacacagagaguaaauuaauaguucugagaagcuuggcgggaggaguggaauauuuuacuagguucaacuucugaaaaaggaagacaauucuggaaauaaaucaaggucacugucauguugugaaugcaguuaauaucguaaagagggucaugagucugaaagauagauuagaacguaguaaauauucuuucaaacuaagcugauaaaaugccugagugaaggacccuggaugugcuguuugauugauauagcaccucuuaccuucagaauucuugucaguuuaaggggcuucugagaguuccagguucagucuuuccaaguuuuaagucuccucucugcaguuuccaggaucaggauaaggcugaaacgucaacaaacaaaagcaacccaugcacauuucuuaaccguaagacccuagacccccuagaaagaauuuuaaauaaugccuguauauucuuuauauguacgaaucaagcuuacugacaaacuaaggccaaucugcaaaucaaauuaacaaaucugauacuucauaaguaaagaauaauaucucaggagaucccauaagagacuaaccaaacggucggcacaaaccuaacguggcugucacuuucagcacagugacaucuugucaccugacaaugauaacccagaaggaggaugaccccagugugcacagcuuucuuccccaauaaagaacagugacuccacaaaaaucacauuuuauauaacacagagauuuaguuauuauaaauuucaaaacaaaugaaggaauuuucacauaauauuuauaaccuucaaaguacaauauuaauacaugucugucaguuagaaauaacagcaguuaggcuacagggcuuaacauaaaaccagcugacaacugugaaagcagcagugguccaauauucaccauuacauaugaaucuguuucuuccagaacuuucuuuuuuuuuaaaaaaaaauuaaaauuucaguauugugaaauauuaaaauaacauccccaaacaugccacaaucacuauucacaaauaaaguuaaaaugaaauauacaaaaacucacuuaauacuguuaaauaacaaacaauaaacuacaggauuuccugaacagaaaugagaggacccugaauguuuacagugaauggcaggacaaaaauuaaguuauaacuauuuucaugauauaaggcaaacacaugaccauugcaaacuauaaccaauuaagauuuauaguuguaagaugcacuaaccaauaguccuuaacaaugagcgcaaaugccuaagacacgauuaccaacaccaagugucugugauguucaaggagaugcauaauucaaguuacacuguuagugucucugaugagcagauaauacccacaacacuaaagcaguccucuggguucuucuuucucauuucuaauucaucguggcuccauuuaaagacacagcacagcuuucagcucauuccaagugaacguuauugaaacacacacaguccccaaaugaaagaaacggucccucaaaaugaaguauccucuaauaagagaaaugugcuuaugaugaacagcggcaaggcccuuccuguuugaaugacuuauguggcuaaauuuuaacuaaaagcacagugagaaagagcuaaccaaguguaggagcauacacauaugcagacauuucuaagaggaggaauagguaaaaauaaauaacuccguguuuuaguuuauugguauuugacaugagaacccaaaaugucugcuacucauuugcuugcaucaacccucacauugcaugcucccgaaacacacugugcugacccccucucagccuggcuauuggccaaugcgccuaagaaaugauauguagcacggacuucgaguguucacgauggcucacuuauucuacugcuaagcaaagcuaaaauauacauuccaggaaacacugcaguuuaaucuuuuaaaaaacaaacaaacaaacaaacaaacaaacaacaacaaaaugcagcagucaaacaauuugugaggagaaacagaugcguucacauauaauaaagccacugcaacuucuucaggcauucaacuguuguguuaaauaaacagacaguaguuauuuagcagcaaugauuccgcaaauaaauaaugcacuguguuucucaguccggcacaaaucugcagcuacaguuacauugauagcuguaaccuacuggcucuacuggcggagaagaccuuaaaaccaacuguacaaaaaaaaaaauugucacacugugacaacaaauauaaaaacaaucuguaggucugaaauaaaaagacuccacugggaagaggacagugcugacacacggaguucccaaguccagcacaagaaaugacugccuucagcucugaguccauggcugauaagaaaggcuggagcugggcuugagaccaaguuaccagacuuaaaagagcaugcucugucuucuguucuucccauguccuaaaauauaaagucauuuuaugaggcaguucaaaggucagguuuuuuuuaaucccacauacaguauuuggugacucuaggaagcuaacguucccaccagcaaacgcuaacauuccacgguuagugaucggcugucuuaagugcccucuguguugacggggucagucuacagcgucuaggcuuccaagugaugaagcugaugacuaggcaugcacaggcugcgucuucugccuugggcaccagggauggcgugugcagaggucaagccaggccacuugggaaaggucucugccaucuguagcuuucaggaucccugacuugacugaaucacauuucucucugaagauuuacugaggugcccccaucauacacaacagcaaguaugugcaauucuaaacauacagaguugugggaugcacuguacauugguuuguuuguuuguuuguuacaucaauaauuuuacugaucaauuuaucaacccaaagcuugguuccacgcaaaaaaauucaugagcgacaugugaaaugguuuaugacaaacacaccugucucuggauaagaagaguuucgaaaacccggguccuuuugcaacugaaucucuuucaaacugaauauugauacgccuaaaaugaacagacagaaauuaccagauauuaaugacauaucuagaucaaauguaauuauucaaaaagcgcauacugauucaaugucaaacauccauccugugcccccaagguuauggccccauggaaagauuucccauuugucccuaaguucuaaacagaaaaccaaauucuacgcgagaagucuuguggauuuucugauggguuuugcuacugacuguuccgcagcccucaguuaagaagcacugccuagugaaagggaguggggagauggugauagcuuccauagcugaguucccaaacacugcccuccuuccccgcucagcccacuuaaacacuggacuaacuuaaggcagcauggacaaaauuaaagaguuacuucaggccugggaaauuuucuacuuuagugauuuugauaauagacucacuaauuucuuaggaauaguacagucagagaaaccgcaagaaagggaaacuuccuuuguaucuucucaggaaggaaaucacuuucuccaggaagccaucuuguuacucugacugugcuucacuaaucuuuucagaagugugugugugugugugugugugugugugugugugugcgugcgcacucacuauugugacuaggcuggccagugagcucucaggguucccaccagugagcucucaggguucccacccugccaaguccugugguuacagaggcguaggacagcgcuuuuacagggagccugaugacccggacucaggucugcacagcgugcagcaaacacuuugcucacgccgccagccgccaccuauccaaucuagagauccacuuuuagccagauuagggcuaaggaugauguugccagcauauucuaauuugaaucaaggaagauuaaugauucacacucaaauaugauggauuucuuaaugaggagagacaacauacucagagcuauaagacaugaacaaggaaaacaagacgagaaaaacuuccuuggaaaaauuaugaucugauuacaaaaauuauuaaaucauaagccugcugauccucaacccuagacaaacgaacagaggagcgagcgcgagggcuccuuacucucgggcaaagcauggauccucggccccaggcugcggaaguacacgugcuucauggccucuucugccggaacccucuucuuagauucauacugugaaaaagcaaaaagcggcucaucaaccucugucuaauuacuguaagaaguugaaggaggauaaauuaguauuuagaacuacuuuuaaaaacuccugauuacuuaauaugacaauuuccuaacaucacuuuagaauccucccaauacacucaaaguaggagaauaauucuaucucaauuccacauuuccuagcuaagccucuaaauaaaaaauuagauuuuuucugaaguggugaaaaauuaaaauauucaaucuuuaaugcucuuuuucuuugugaacugugaaauguacugacagaaccaugcccagugccuuuauagccgacauucucggcagauaaaagccauugcuccucucuuaaugacacaacuuagauuugcucaagaugcucaugcuuccaacuccaacagacaaaucaugacuguucuaggucgaggcuaauuccccaauucccagacucucuuuguguuguuuuguuucuacaaugaaugcucuggccagugagacuugggaaaagccuaugcuuucgagauauaagagaguuaauguugcuacccugucaucucgucuuccugcucuggggaaaacagaggaggagugcuauuugaaagugcaguauccgccauggcaggaagcacaaagaagcagaggacacagagcaugagcugcaaagaacauggcucugagcugcugaagcaccuaagaagcaccauaggcauccuacuauugcuaacgguacuugaugggguuacuagugagucuauuuuuccuaugaggaaagugacacuuacugauucauuuaacuuuauaaaauaagauugacuuaccugaagaaauuuuguuaucaauucaauuccuucagaaucuaaccuagaaacaaaaaaauaaaagaaaccaaaacaaguguccauuuaucuuuuaugauagaaaccuuucagguaaaauuauuuuccaaaugcuuccauuugccaaauuuaagugcccuaaaauaacuaucuuuacugcuuucaaagacccaaaucuguuuaucccuaaaaagcucaucuugcuauuugcuugagaacaaaucaugaauagacugccauucacaauuuuaauauucaagaaaaauuacuaauacuauagaaauuuugaaguuagcauucuauccccaaaguacccucuauuauaaagaaaguuuaaauaggguacaaauauucagugugucaaugaaggcagacacaccaaaauaucaccgucccagcauguagguuaaaaaauugagacagugaccccaaaauauaucaauggcguucaaaauggauaagccaucaagaagauuauacaaaacaaccugcuaagcaauggcuacuauaaaguauuaaguucaaaaacacuucagcaauauggcuaaaagaccaaugacauagacaauauaacuccuaggcaggagugcugucuucaccuuuguggaucuaccuacauaagccuuggaauucuaauauauguauucuauauucccuuuacagcucaauucuauuuacaugcuuuggugauucuuggccauugauuuauaaaauuauuaugucaaaggaagggauaaauugaaugaacuugaacaucaaaugaggguacugagucacgagagucuggcccuucucacuuaagaagaaaaauaccugggugcaugauuaauuagagguuguggcuuguauuuugggaaguuguaguucuugaauucaucauuugaagaaacaccuggccaaguuuccugagauggaguuccugaauuaaaagaauaaauucaugauaaguauuuaaauuauaugcaugcaaacauauauaucaacaggcauaaguaagaacuauccuuaagaacaucauacuuuuauuaaaugauuuaacuuuuuucaauugaaauuaauauuuuguguguguauacacuguauguacacuuagggauacuacauauauacauguggauuggggccaaugaaaauaugcccuaaauaugauaaaacucccuuucuauccucauggcaucaccuacacuaggaauagcucuuaauaauauguauaaggucaaaucuuauuuccuaaaaccuuuaugaaaugaagcugaguuagcuugaagaccccccuguaacaagugagccagcggcaguucuuaucagaacagcuauggauacaugucauacuuaugcuuuacagacauaguccuaauuuaacuagucaacugcaggugugaaucaugggaaaaaagacuucuuucuuaccuaguagucgaaauauuaaaugcaguucaucuuccacaguugacccuggaaacaguggucuuccagaagccauuucaaagaaaauacagccaacuccccuuuaaaaugcaucauuuaaaaaaagagagagaaaaaaaaaucaauccacuuacccauugguuagcacaagauaauauuuuuucaagauugccuuucuggagaauuuuagaucagguucccagaaaauuuucuguacagauacuuuugaauccaacaaauuuauuaaauuuacaaucucaacuacuacuaaugcuacuaauccuuuuccccacuuaaaacuucuagcuuucuuuuuuguaagauucuuaaagaauaaaacaccacuuacuagugauggagugcugacuaucgcuauggcaaucugggaggugacaguggcuacagcagcucagagucaagugaaugaaugauucgcucagagagaagugaaugagugauuugcucagagagagaugauucucucagagagaagugaacaaaugauucacucagagagaagugaaugagugacucaugcccgaugcaggaagcggugacuguagcugauugcuguggcuagggacuguguaagggcgggaagaggaggacgaggcucagagaacaggcauuauuauuugggaacuaggugguccacggaagguugcgacacaguacuuccacagcacugcucacaggcaguaaaacuucacaaaacugacaacaguucacaggaaauaaaauggcacguuguuauaggaagcaguaugaugaucccucaacauuuaaaaauacaauugcuauggcccgcaaucucacuuuuggguaaauaagcaagagagcccagugcagcgucuugaaacacuagguccauccccgucaaagcagcaucacuuacaguggugacggaagagacucaagugcccaacaaguaaacaaaguguggaguguacgcacaaggacgugaguaaacaaaguguggaguguacgcacaaggagugaguagacaaaguguggaguguacgcacaaggagugaguaaacaaaguguggaguguacgcacaaggagugaguaaacaaaguguggaguguaugcacaaggacgugaguaaacaaaguguggaguguacgcacaaggagugaguaaacaaaguguggaguguacgcacaaggacgugaggagacucacuacagacagugcugauggacgaugaagacaccaugguaaccgagaagagcugaguaagucagcagaaggcagacaaguauggcagaaucucacuugcaugagguacuugggacagguaaauucagaggcaagaaguagugaccugguuaccaaggaccaaguaaaauugguagaaugguuguccaacagguaaaauuucaguuuaaaagaguaaaaguuuuggauuucuaaaaggauggauaguggagaugguuguacaacaguguaaugaacuuagaaccucaaaaccacacagcuaaacuagguaaaauuauaaguuuuaucuuauacauaucagaacuaacggaaaaaaguccugcaaaugagauucuaugcaauugcucaagacaggaaaacaagcauuaacuuaccaggacauaaggaggacauaauaaacacagccacgauugagaaaggagcugccucugaggccaggcccacucaggaaaggacugaggacaaaccccggggaauuaauuacuaaguguggcccuguugggugaggagcaugccaacgggcagauugggaugagcacucaacagagcugggagagucaggcuugcuugcucgaacagcaaagagcaacuuugcuaaaagacaacgucuggauuaagaacuaggccagauuaaguuagaaagggaaguuuauagacuaugaaacucuguaucuccuggaucaaggaaaugcaauuuguagcgcauaggcagugaugggguuagccaagcacaggggcacugaggcaucuauuggcuuggacguggcucaguggcuagagugcuuguuacacagcaugagaagaagcugaguccagauccucugcacccaugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcugcacacagugcuacaggcucgacugagacaggcagaccccagggugugcuggccaguccgucuauucagguucaguggaagacugucucaaauaaauaaauauaaauaaauaaauaacuuuuuaaaaaugaaaagcgguaucugagcaugcuucaugcugaccuuuggccuccauuguguaugcauguacaggcgagugcacuugaacacacauguacauauaucuauaacaccuacauacauauauguaauaaugcauaagaagaucuuugaaacucuaauuauuauuuuuagaccaacuuaaaguagguauauuuuccauauuaauacuuuuuugaauugcuaugugucacguacucuucuaaaaggugcucugugcacguuggcucauucaggcuuaauaccaucaggcuuaaugacuuucucauuacuuugucuaccuccuuaacggaggagaugaaggcacgggcuacuaaugugaauaagaugguuagucuaauauagccauuagugguagacuuauauuuaaaucuaaauaguuuuauuuucacaccucaauucuuacucacugcucaaacucuuugaaauaacucuuuaaaaguaagcauuugucaguaugcccuguuaacagcuaugcucuuucaaaacuauaaacggcgauggcaucuguaguuaccacaugucgaucuguguugaguauucugaggaaccaagaagcacaucagguggucgauaccacagggugacaacuucauuugaguaggucuuugugggaacugacuuggcucuggcuaguccuuuacagagaaaagaaaacagaagaauuaaaaauacugagauccauuaacaugcugaaggucuuagcccuacugucgccaugacccauuucaagagaugccaacucuauagcuuccugcaacuucaaaaaaguagauuuauaaacucuguugaguguauguaguccugggccaagucaauauuauauaauuaaacugaacacaguaauuauacagcgagagacgaagcuggugcagugucugucugaguuuaucuaaacuuaagauauuuucuguugaugagucaggaugccggaauuauuucccacuggaauuaacccaaaauaggucagugacacugaggcgcaguuugcuugcuaccguuauaagcuagcuaucacuguuuaacucaaaucacaugguuuuuuuuguuuguuuguuuuuugucuuuuuuuuuacuauacuauguuuuaaaauuuuaaaccucaagaucauugguauacaaucaguuggagcuuacuggcaauuuccuugaaccuauuaggcgauuucccuggaauaaaauucagcagucuuugucuauuuuaaugauguaagugaugugaauaacuucagaauaagaggccuugauacucugggauaaugccaccugcuguaagcaacugucugcccugucaaccgugugugggcuccacuguguucagagacugacagaccgguucccuaugggcuccacuguguucagagacugacagaccgguucccaaccuuuuugcuuugccacugguggagaguuagcuccccauagccucuagacuguagucacugaguuuacaucugaagaaacauaaccuuauuuuuaccauauauuuuguuucaaguaauaaggguacuuaugcuaagauugcuguuauguaaggcuuuauguaucuugugaaaaaaaauugaagaagaaaaaugucauacacaguaguaauucaacacuucauuaaaauaauguaaugcugacauuauuuuaauuacaaaucauuacccuagcauuccagcuugauacagucaugcccaacgaauuauuuuuccacacauuuuaguaauuagcaagauguaggguagcucugauuccucuuccuugguuuuuugagucacuauaccacggugaccuugcuuuuuugugaauuuuacugacuauaauauugacauuuucaaaggaaucaagaguaaguaaagaagguagggcuguaguucagagacagugcuugccuaucuuacucaagucucucacugugaucccagcaccaucaaggaggaguacgggugggggaggcucaacuaacagcagaaauaaucaaaaguaaacaacauucauuacuugaagccauauauauauuugcuaugcaacaacaacaacaacacaacaacaagccaagaaucagaaaaugaugacuguguugugagauuugcuuucuggaggcuaaaagcaugaaauacuagauucaaaguacuuucagauaaaaauuucccauggucuuugacacacccuuugcaugauuccacgcaagcugcacaaaaagcagcuuggcaaagcgagggagugggugcaggggcaaguguaagggaaugacauaaugaugcucaggaaguagagacgggaucuauacaagcauacaaaauuaaccuguagcaucugcuucaaucucagguagccaacagcaaaucccuuucaaacaaacaacaacauacuaaauaaacaaauguccaugaauagccagggcaaauccagcauucaguaagaaugaguuuuuaacuuguuacuaacauagcuuauuagaauaauucaaauucuaaguauauaacucaaaaucaaagcuacucuaaaaacguucuuucaauauagaaguuuacuuccuaaaagcgaaguacacauuacugcguuuuauuuucaggucgcauaaaaucagaucagcuaaaagguuaaccagcggcuagugaagucaccgagcagauaauaaaagcagucagcuguggucagcauaugggggcgccuuucagaggcagcuuccagcuuucgggaucuggcauaaacgcgucaaacuuaagaagccaagugcuucuauuuacaugggcuacugacauuuaccguaucuguaagccaacacugagaaaauggaaagguguuuauuuacagauuaaaaacaaggcacggucaggugcagcgacucuguccuauaaucauggaauucaagagacuggggcaggaugaucaugauguuggggacaauguaggugcacagugagacccugacucaaaaacagaaacgaugcgaaccucaagugcucaccagucauaagcugucugcaauaauaucuuaauaaaaaguuauuuuccaaggcaaaaaaaaaaucuuauacuccuaucacuuauuuuaaauuucauguuaauaaagggcaacuggauaucauuuucuuugauaugcaugguauauagaggacagcacaucaaauuaucaaauuuuuuuuuuuuuuuuuuuuuugcuuguuuguuuguuugguuuuugguuuuucgagacaggguuucucuguauagucuuggcuguccuggaacucacuuuguagaccaggcuggccucgaacucagaaauccgccugucucugccucccaagugcugggauuaaaggcgugcgccaccacgcccggcucaaauuaucaaauuuguaaucgcucacauacauaugacaagaaugaaucucauagagaccaagagaagaaggaggacccugcacauggccccaccccaacugguccaucuaugacacggcuccugcaccuaaggcucaggggacaacuccaaagagggacagaaagagugaaaaagcgggaggaacaggaaaucugcugagaggacaccucccugaaaugucagggaagccacacccaugaaauaucaacaaagcugccuaacucaggccugaagggcaauaauucauuuuuaagaaaaccaaauguuaaagacuaaauaaucagucuauuggucccaaauuuccuaggaaaaaugguguuucuuuaaaaaagaaagaaaggaaggaaggaaaggaccccuaguaaucuuucucuuuagauuacuguuguuucugugugagcucaauguguuuuaugcuuauucuucauuuuaucacaagaaauauuguaaugacuuauagucuaggaaaauaaacuuuacugcaguaucaaguaucccagguauaacugacacuuguccccuaaacaugucagcagugaagacuacacaugcccugcccuaaauacccccaaauacaccaaggaaccagcgacucuacugcuuacuugguguugaguccucggugcaaccaggaaaaagcaaggagaacaguaauucugagugugaauuuaucuuuagacgccauggaaagucuuagaaguucuagaggucucagcaugcuaggaaacacgugcguguuccucacuaauaaaccauucaccuaaauuccaucacacaucuccgagcuacagagaacacgucaaaacacacagaaaauugacgacacucugugacaacgguggucuucucgcuuagccaccuggaaguaauaaugaauaucuuaucucuccauaccaaagucagccagcuuuaguucuccucucucauuaaugaggagguucugugguuucaagucccggugcaacacuuuucuucuauggcaauaugccagaccacggagaauuugguacaggaacagcuacagaaacaaaugaaaagcagucuuacagauaauggaacgggucuugcuauaaagaaaaaccaagcaauuaaagccaauuaaaaugacaucuuuuccucuugcagcuauuuucugaauuugauuguucauuguucaauuuaaaacaucaacuaguuuuuaacccaaugagaaccaggaaaauaaacacuacaaauaaaacuuugaauaacagcaguucauugguuggaggccuauaguuugauuauaaaauucuguuguaacaaccaagcaaacccugucacugauuucuccuuccaaaacacacacacgcacacacacguacacaaacacuucccugaucugcagcagcaucaccuuaaaagggcaucauauuugaugguuuuucagaagagccaggcuaucagaagagaaaagugcuguuuagcucuggcaagccauuugcuauaaaaguaagcggcuccucacccaccuccugggcacuugacuuugagcgccuccuacucacucuucaaacuccacugugacucagaaaggggcccaggcacuauuguacucugaacgacgagaaagggacuccuguaagguuaauggcuaagggcuucuguguauuuuagaagaaggaaagcguuuugagucuuugugguuagaaaaagagaggcugcauacagaagaugccgagugucuuuaggucacggcggaggauguggagaggccugaaugaauucucagaagcaguuuccagaguuggcauugcuauguucugagaacuccagaauuauuaucucaguaucugucacauucuauccuuggaaaacguuaaguguaauuucaacagccagacaauaaaacgcguuccaccuuacagccaccacuuggaccuaacuuaaaaagcagggacuuugcaaaccuuuaucaaauuaugacagcuaaacucuaugcucuuuccaaauuauuguucuaaguagagaaagcaaaauuagcaaaacaaaaauauauaaaugcuauucauaacauuuuauaaaauaugaugaaauauuuuuuaaaaaacucauagaauguaugaaaaucuauucaaaacccuggucuuagcaaugccugucuucagagcacucuguuaguaacaaacuggcuucccucuauuucuaccaaauuacuauuuaaagaaaaaguuaaauuuacuaccuacagaauuagaaaugucucaaccacacaugacacacugccuucuuccaaaauagguuuccaggaacuauuaauuuugcauaaauaaaucuuugauaaaaaaaauaggguaugccaguuaggucaaagauaucuauugugaaaauucagcuauguuaaaugcuuucauguuaaguaacuuuugaguuucauccgauauuagcugccuuagcaaacuucuccaguuacuccaauucuuagauaacuaacgcuaagaaagcuuaucgauuuucuucugaucacacagaucucuauuaccuauaaguuucugaccuuguccaacuggcuauuuuaaauacuucuuucaauacaugaguggcguuuauccuucaaagggucuuucacaggguguacccaacauuuguauuuuuuuuaggggcuuuuuauccagaacagacuuggauauccacccuacauaagagaauaaauuguugucaaaaguguaaaagaccuuuaaagcaaagcaccacuccaaagggucugguuuuuuaacagcuguaauacagucaacaggugcugacuaaauaugcuuagaugguaguaaccuaaccacgccgaugggaacggcuuaugaggccagucuaugugcugggcgauccaguccagcugugcugacacaggcucagaagugcauggacaacauaccuugacauugugcaugcucaugauguucccacagucauccauguauugcuucaggucuuuguccugaaaagaugccgcacuuuagcacgugacaugguuuugggacggcauggcugguuaccuugagagcuuuuuucuuuuuuuaaguauuuauuuauauguuggggugcacucauaugugccauggcaugcauguggggguccaaggacaacuccagggagcugacucuagucuauggaagccccagguacagaacaagcugucagucauggugguaaacaccucuacccacagagccaucugcccagccuaaugguguuuaauauuuuuauuauuauuuuuauucuuuagucuuuuuuuuuuacaguccagucuuuaucccccccaccccugcccagucccagucugcccucugacuguuccucgucccauaccaagaggauguccccacccccaccccuaccccaucagaccuccccucucccuuggggcauuuaauuuuuauaacuaaguugcuuuucaaagaaacauacagaauucauuacaccgcauuuaaacgccaacaguuaaacaacaaugucccugaggcuguuagaaggucuaacuuucuauuauauuaaagcaaaauagaaugcuaaauuguauuaaauacuuaccagguacucaaagaccagagucaaagauuugucugugugaacgaugucgugcaagguuacuauauuugcauguuuuaaauccuuuaacagugaaacuggaaaaacaacaagagggggagggguguuagucugugguaggcagucuauggggcccagaagcuuuaaaccacagcugacuguggguaagauaaagcccaaagguuacagcaggacugacaauggaggcagcgagguucugacuccucugguugugugcugugggucucacacuguauuuccugaaacccucccgauauuccaagcggcaucuccugacuuccugcccgcuguuggaagcucugacacugacugugauacagagcacaggguaccuuucacuccguguucuuugugcuuuuucuuuggcuccaucuuuccuccguuuguuucuaucucaucuuauuauuucuauaucuacugguauuuuaaugagacagaaaagcacauguggauuugggugagugaagaaguagggaggaacugguaggagauagggggugggguggggaccauaaucagaauauauuguaugcgcuguguacauuuucaauuuaaaaaaacucgggaggcagaggcaggcggauuucugaguucgaggccagccuggucuacaaagugaguuccaggacagccagagcuauaaagagaaacucugucuggaaaaaccaaauaaacaaaaaacaaaacccaacauggucauguauauaugcuauuuguuucuuauauuuaguaaaauuuauugauguagcuaauuuauagucaccauggucucuccauaacaauauagaacuuuuucuaggucaauauuuaucugucagagauuuuaauggcuucguaaauauuuuacugugaguuauacaauaacacaauugacugaucccuuucuguugaguacuuugguuuuaaaaacuaccauuugcaagagccaaagaaugacuuccagccauugauuguguuucuaucugagcacuuuuuacaaacaguccucuuaaugugacuuggaccaaaaguucuauguaaacacuguaccuucucuuauagcuguacagggugcaccuucuucguguuccaagcggaucucuuuuaaugccaccaaauuuucugucaguuuacuucuuccuuuauauacuguugcauauguacccuauagaauauauuuugaagaacauuuuuaagaugugacagcugcuaacacgguacugcaugcuuuuacuucgagcacuugggggacagagggacucggaagccaaccuagccaacguagugaguuacagggcagcuggggcuacauggugagucucugcucaaaaaaaguauacagagcagaguaaaccucaguuucuaacuucuaagcauauuaaaguaugucuuauaaaaaaaucauccuauuugguuuuucuuacagcaaugacuuaguucccugcacacaccauccacauccccaccauaccauggugguuccacaucuccuuuauucuuguguuauuucaaaugaacagcuggaccaguggauuucauaucaagggcacuuagguaaugauacauaaaaaccacaggagacugagcauuuucaaugaagauguaaugauaauguucaaucacaaaaacuugauccagaccuucacgcuccucaaaaucugugcaccuuagcucuccucuaaaagcucccuuaaggcuugccugcuauuuuccugcccuuucuuacuguggaucgcaggcaauuuaaaaauuaacaggaguacaggccgaagaagcaagcucaagaaagccagagcuuuaaaaauuuucucaacuuuggugaagcgucuuuaucucuacagcuaguucucugaacucauacaaauuccaugccgccagaauccaugaguaaacaauagacccuauuccauuacucacagagcacagcauuuguacuucaucaaaagauuacaaaucuaccaaaaauauuaauuucaucuuaccugaugcaagguuucaaggaccaagaagauuuauuccaucuaguugugcgaucauuucagagugagauauauagucuuuuagguaauauaggucauugcagaauuugguauaugauauuuuagguaauaguggucauuucagacuucaguaaacaaucucuuagguaauaguggucauugcaaaauuugguauaugauauuuuaggugacagcggucauuucagaauuugguauauaaucucuuagguaauagcggucaucucagaauucaguauauagucuuuuagguaauagcagucaucucaaaauucaguauauagucuguuagguaauugucauuucagagacagguauauaaucuuuuagguaauaguggucauugcagaauucaguauauauauauauauauauauauauauauauucuuuuaaguaauaguggccauuucagagucagcuauauacuuuuagguacuagcagucauuucagagucagguauauacucuuuuagguaauagcggccauuucagaauucgguaaauaaucucguagguaauaguggucauugcagaauuugguauaugauauuuuagguaacagcggucauuucagaauucagaauauaaucucuuagguaauagcagucaucucaaaauucgguauauagucuuuagguaauagcggucaucucaaaauucgguauauagucuguuagguaauaguggucaucucaaaauucgguauauagucuuuuagguaauaguggccaucucaaaauucgguauauagucuuuuagguaauagucauuucagagacagguauauacucuuuuagguaauagcggucauuucagaauucgguaaauaaucucuuagguaauaguggucacugcaaaauuugguauaugauauuuuagguaacaguggucauuucagaauucagaauauaaucucuuagguaauagcagucaucucaaaauuugguauauagucuuuagguaauagcggucaucucaaaauucaguauauagucuguuagguaauagucauuucagagacagguauauaaucuuuuagguaauaguggucauugcagaauucagcauacauacauacauacauauauauauauauauauauacacauauauauucuuuuaaguaauagcggucauuucagagucagguauauacucuuuuaggcaauagcagucauuucagaauucgguauauagucuuuuagguaauaguggucaucucaaaauucaguauauagucuguuagguaauagucauuucagagacagguauauaaucuuuuagguaauaguggucauuguagaauucaguauauauauauauucuuuuaaguaauagcggucauuucagagucagguguauauucuuuuagguaauagcagucauuucagaauucgguaaauaaucucuuagguaauaguggucauugcaaaauuugguauauuauauuuuagguaacagcggucauuucagaauuugguauauaaucucuuagguaauagcgguuaucucagaauucaguauauacucuuuuagguaauagcagucaucucaaaauucgguauauagucuguuagguaauagucauuucagagacagguauauaaucuuuuagguaauaguggucauugcagaauucaguauauauauauauauauauauauauauauauauauauauauacuuuuaaguauauauauauauauacuuuuaaguaauagcggucauuucagagucagguauauacucuuuuagguaauagcggucauuucagaauucgguaaauaaucucuuagguaauaguggucauugcagaauuugguauaucauauuuuagguaacagcggucauuucagaauuugguauauaaucucuuagguaauagugguuaucucagaauucaguauauacucuuuuagguaauagcagucaucucaaaauucgguauauagucuguuagguaauugucauuucagagacagguauauaaucuuuuagguaauaguggucauugcaaaauucaguauauauauauucauucuuuuaaguaauagcggucauuucagagucagguauauacucuuuuagguaacaguggucauuucagaauuugguauauaaucuuuuagauaauaguggucauuccagaauucaguauauagucuuuuagcucacagcggucauuucagagucagguauauaaucuuuuagguaauagcgaucauuucagaauucgguauauagucuuuuagguaauaguggucauuccagaauucaguauauagucuuuuagguaaugucggucauuucagaauuugguauauagucuuucacguaauaucuacagccuuuauuuuucuaagaugacaagaaucauggccuaauugaguuuagauaauaagaaaaugccuugcuuuuaaaauaaagaguauacuuaccucuccgagcuuuuccaauuugauguagguuuccauuuucccaaacccaauuucugacugaaagcaaacaauucggaauuuagcgccuauucuuaaaacucuacuucuuuaucuucuaacucuaacaaguaugaaauuguugaacacuugucaaguucuaaaaugcauuugauguuaaaacaucagaguuuacaauuaaaauagucuuuacaagagccggcugauuuucugcuaaugaacauuuaaaccuccaggacuuuuaaguaucaccggcguuuaaacccuaacgagucugcaaagucuccccaagaacuguucucagaguuguauguguuauauuaugaucacacaugucaugcuaaaaccauacuacaacacuauuuaguguaguuucagcaaacuaaagcuuuuauucacaggugguauuacugaugauuuagugguuuuuucuccuauuuuucuauauguauaugguauuuuuauggaaaaaaauuuagaaaacucaaguuuuagaaccguucuaucuaccuuauguaugacucaguauuaaugaugaugaaaaaguuggguaaaauuacaacagaaauacauuccaaauacaauggaagcuuuaaauuucaacuuagaaaaugcaauaaacauuuaaggauuauauaagauacugucauuauagaagguaucugacccaugacagcuggauucuggacuauuuuuuauguaaaaguuaaguaaaaagcuaauuaccaaggucauagaaacuauaugaaaauuuuuuauacguggguaucuuuagaauuuagauauuuucauuuaaauggcagugaguuuuucuuguucuuuuuuacagagagaacaacacuacauugagaauaaauucaaaguaauaugaacaaaacaauaagcaccuauauucuaacaacaauuaucaacaauggaaggcagaugggaaaauguuaaguauaagcuaaacuuuuuccucucaggaacagugacuucuuaauucacucaucuuguuauagugaacgaauucuaccauacucugggaacacuugguccaguagugauuaugacaaaaauauugaugucugcuauaaggacuauauaauguacugucaacaaaaugaaagcuauauaaauauuuuagaaauuacuauaauaccaaguacauauggaauaagauauaacagauguaucagaaauugauauuacagagucgcucuuuagagaacauuauuaguauauaccucacacacaaauacauguucauaugcacaaguuuacaaacacacaugcacauuuaaauguauauauacacacaaaguaacuauagucaacaauaauuguauaugucaaauaucuaauauaaauauccucacaaagaaauaaauaguuggugauauauaugcugcuuacucuaaucaaagcacucuguacacaaguauugaaaugacaccguaccccauaaauaugcagaauaugccaauuaaaaauaaacacauaucuagaagagaaagcgaauaguaaauuguaauuauuaaaguuauguuugaacaaguaguuagucuaugaaaauaaacaguauuacugaguuccauccacauaguuaguuaggaaauucagacagaaugucuuacaugggugaaguggcugucagauagauucugguucagagaaucagacacacaagcccaagccccucacagaauuuugaacuuaguagacucaaugauuacauccaaauagcaguuaaugaacuuuuaaguguaauuuuuagaaaacuuagccugcacaugcaucuguugaacaugacagauuaacaacagucggcagcuugucaacacucuccuacagaaaucauucugaggacaaacgacaaagcauauuuacuccacauuugcucgggacaacgccaggugcugagcacaaggagaagacaggcgccaucccuguuuuccugaguuaacaaugugcacucagucuacccuggauuauuuuagggauagagaaaaguaacaggcaucauagagacuuagaaauggcucuagaagccuuacauuuuaaaacacuaucaagacuccauaacuuggucauuauauaaauaaagauuuuuaugguaauucacucuaagagcauaauuuauuuugugacuucauuacuucaagaaauaacuuuucacagacuaagcaaauccccguucaggcaacccuuacaacaaaggcauacaaauauuaaaacauuauauauaagauaaauuauaacuuauaguaagccaaccucuaacaguguaacuuguaaguuagguagcaggcacuaugggagcuuuuacuuugucucuaguaacauaaacaaagccauauaggaauggugacgaagccgacaugacagagccuaagaccaagcuuggagaccacggacacgaggaugauaaagucuaacacucagaaaggauacuacaguuauacaacugugcaccauacaaugagagcagacugugacuacauacaacaaaacagaugggcucagacuuaacacugaacaacaugaggaaacuacagaaguacauuugcauacguacaugcaugcugugauuuuauaacagaacagcagcuuuuagacuuuuuaaaauauuacagcagcuuuauauaauauacaaacuuuuugcauauuuguauaagcacauuuuauaacauauauucauaauacauaaaguucaaagauugagugagaguauguaggaaacagauucagguauuguagaauagguuuguaaucccagcccuuaaggaggcuaagcaaagugguaugucagaccagccugauuuacagguuaauuucagacuagcaaaacccucugucaaugaaaauaaaguauuaaauacuucagaaacaacgugaacaugcuuaugaauaagaaggcucaaauauaaaaucauaguacgaaaagaguauaacugagacaguaugaccauguguguaaaacuaccuuuguuauccgagggcaggaauuaugaguaaggugaggaaugaggaguauuaaguaaagagaaaaguagcaggagagugucuaaagcauucauuuauucaucuggccacacaggaugacagcaccacaaacacacugagcuaaagccaggucugggcacucugcugcgccucuagcauucccacccagcugcacaucuggcaugcauggugcacauccagccagcagauacauucaaaaguaagauacaacucaagugcuguuccaguacacucuuuaaguaugaagaaugacaaaauguagacaauaaugugcuacaacuaagugagugauuuaaaauuuacauauaaaaauuaacuucagggcugggguacaaccaaauggcagaguacuugccugguacgugcaaaccucuggguuuaaaagucaugaaaggacaaaaaggagaggaaggaagaaaagaaagggaaggagcaagggagagagaggaggaaugaagggaaaagacuaaaggacaaggaggaagagcaagcaagccauccucacggcacagucaaggccaaaaacuuacuaaggaagcucugcgggaccugcggcucaugggcuggucaaagggugggcugcugaucugcagcuucuccagguagccaucagguauccugaugucugcaggcagcgacagccgcuuauucaaguccuaugcagauaagggagcagggcauuagacuugggaagaugagggcccaggcacauuauuccuuuuuuuuuuuuuuuaagauuuauuuacuuauuuuaugcauaugaguacacuguugcucucuucagacacgccagaagagggcaucacaucccauuacaggugguugugagccaccaugugguugcugagaauugaacacaggaccccuggaagagcagucagugcucuuaaccgcugagccaucucuccagccccccacauuauucuuuagugauaaaccacugaagcuggcuugcaguuccaaaguuacuuaaggcaagaauacuuaucauaaucaaaggcagacgauaugguuugauauaaauaguuuaaaaagacgcaaccguuucuuuaccaaauucaaguggaacuuuacuuugaaauucuucuccaugcagacauaagcagucugcaacagggugggugugaucucuuacagaacuggaagacagucugcagagucaguucucuccuuccaccacacgggcuccagagacugagcucagauugccaggcuugcuggcaagugcugaaccaucucucuagcccccuaaaauuuuaucuuaaagcauguuuaauaucuuugcagaaagcuuuuaacuuacaggguaugcugaaauaguaauagucauaacaaaacuucuguccauaaaacugugacagacaucuuuaaagaaaugaauugcuuggguuguuuucaguauuucuuuaugugcaugaauuuuuuugucaacuuguguauaugugagccauuucuguucagcacccucagaggucagaggggagcgucagggccccuggacccacugagaacggaaccugggcucuucugcaggagcaaugaugcucugaacugcuaagccaucucuccaguccccaguucuucuuuuauauuuaugauaaauguaucauaugaauauauagauacaauguaccauaaaggagaaacuagccaaguaagaaaacaagcuaguucuaguucauuuauaccccuuaaagcauccauauauaaacuauaugaagugcucagaugagcaccguaaaggugugauuaagaaaagguuuucuagccgggcagugguggcacacaccuuuaaucccagcacuugggaggcagaggcagguggauuucugaguucgaggccagccuggucuacagagugaguuccaggacagccagggcuacacagagaaacccugucucaaaaaacaaaaaaaaaggaaagguuuucugcagaaugugaacuguaauuaauguauacuugccuugggauaauuagggaaaaaaaaaacaacaacauucagaccacagcucaccaaggcaaagaaacagcucuugugugaguuccauuugccuucaugaugcuucaaacaagcauugcauguuccuuuacaaacacaaauauucacacaaugguugcguuuccacuuucuuaacugguuaccuccauugagauccgucuauguauacgauuucugaggcaaacaccuguaggugacuggacuucaucagaugaugucccagaagcuuggucacucucaccaucugaucccaucuucagauuuucaugaacaauaucuauaucagaaaaggaggcacuguuuaccuuuaaaggucagaucuuacuaaacaguacacuucauuaucauuacaaguaaaauagagauaucaacaaacacaaaucacaguguugaaagucgucuaugcucgagauccacaggcauguaagcaguuaccagaucagaacauaaaugccuuaccagaaagauaaaucucaggccagcugugcugguuguuuugggucaaccugacacaagcuagagucaucugagaagaaggaaaagucaacugagaaaacgacaccaucagacugccuacaggcaagcuugugggaauuuucuccauuaaugauugacaugaaagaacccagcuauuauggguccuuauuuguauaagaaagcaggcugagcaagccaguaaguaagguuccucuccauggucucugccucaguuccuggcuccagguuccugcccugcuugaguuccugcccaaguuucccucaaagacguacugugacaaagauguguaagccaagggguuucuccccaaguugauuauguuguuccuuacagcaauagaaagcaaacuaauagaaaaaucagcaccagcauugugggcuacuguugugacagaccugacuguguuguuuugggaaaagauuguagcaaugcuugaaacuuuugagcuggaagugccauuagugcuggcagcuuaacaggcugcucaguggaaacaugcuggagguaagaugcugggagcaacacagaugguggaggccuggcucaugcagggccggaaggaagcagacacucuaucaggcuucucuuagacucugauggacagucuguggcuucuggucagcugagagugaaaggcagcugugacuaugaagagaccucagcuccacugaggugagaucuucugggaagcauuuccucagggucaccacaauaagcuguggaccagagggagccaaagcuucgucucaagcuggcacccagucucggugauguguaaacgucucccauguguuacugguuugggcagcaugaaagcugcaggauugaaggcguagcugaggcuuggcacucuaagaggccaggagagcccacugguggauguguccccucagcugugguguagaccccaggauugaaggacuccugcagagaugcugaggcucggcacaaugugagucccugaagagcagcuagcugaugcccugcugacuguacagccaaguuacaguggagacuccgaaauacuggacaguccagcacugcgggaaaaccacuaaggauggcauguguggaacaguaucaaccugagccugugacauuagcugcuuaugcuguggacugcaccaaaggaaagguggagccacuggcgaccaugggagcccaaggacugagagugaaugagucccagaggcugaacauuuagcuaugagcuuugauuuacacuguuagaggauggauuuccucugaucuuauuggaacugugccaugccuuuucccucuugggacaagaacuguuuaacuuaaaaaaaaauuuuuuuacagaagcucaaauugagagacuuuggaguuuuaagauacuuuaaagacugaauuuuuaaaagguguuugaauaguuuuuaaaacuauggaacuuuuaaagauauauuauguuuuagaguuacauaauaguuauauuaguaugcuuucuuggggaaaacacuaaaggaaagguuaggguuuaauaaugaugugucugucaaggugacaagggguuaacuguacugauuaguuuuuugccaacuugacucaaguuagagucaccugggaaagucaguugagaaaaugacucuagcagacugcucuguaggcaaaacauguguugaccuuuuuugguuaauaauugcuaugugaggacccaaccgacuguggaugguaccauuccaggcggcccucagcuguaugagaaagcaagcugagcaagccauguguagcaaggaaggaagcagcgucugccauggucucugcuucaguugcugucuccagguuccucccuuguuuuuccucccuucguuuccccuucaaugauggacugugacaggaauguuuaagucaaaaaacaagaacaaaagaaaaagaaaaaaauacccucucaacaaauugcuuuugaucaugguguuucucauagcaauacagagcaaacuaugguaucagcacuguggcacaagcacuagggagagagaggcaggaaaagacaucucuccacauuuucaaaguaugaaaaauucuauaaggaaaguaauucaagauauugccaagaauugaauaaaauuacagacuugacagaguucuugaaauuacuguaacuuugccuauuuuccagauuccaggagauagagacuuuaaaaauuaaccuacuuuuagaccauguagcuuaggcacacagcuggacuagaaaccuggucuuuugcuucuuaugacuauucucucauuagaugugucaacaagaaaauagagcuaacucauagaacagucuuuaaaauauuuacaaaucugcuacccaccaguagaaagccagacgugguggcacaccuguaacucuggaacuaaggcagcaggauggagcagaggccagcaagaagcugucuggaguuccaagcacuacuugcugagugucuacuacaaagcuaaguuugugcucucuaacguaucacaacccugcugagagccagugcacaaguucaagaccugccuggacaaacugggaacgccuuguaagcucagugacucagcacuucugaagcaagccuuaaugaggcagcggguuuaguuccccagaacuaacaagcaaccaguaagcaaacagaaccgaccaguccugcccuacaaggaugccaagcaaagguaucgucccagauaggaauaaacacugaguuccacuggacucagccaggagagcagccaggguaacaagcacagcuguuucugccuccuuccgaauacagcgaggugagaaagugaaggcccaugucagagcuucacugucuccuuagugggacaaagggcuucgaugaaacgugaaguguaucaggaugcuugcuuagucaagcuucugccacuugcaugaugcacugauaaauuugaucaacauuacuaacgucuuuaguguuccuuucuuaacucgagaccaagaaucucaagaacagaugcuuuuacguugcuccugaacuaaaaauguuucuugcauuuuaaaaggcuuacuacacacagaaaaagaauaugcaacagacuccaguccauaaaaccuaaaacauaacucacucuugacuacacagccaacaaaauuacaagccaagaccugauuucuuaaacauaaauacucccucaugacugacuucaaauuauuggcacaguauuacuggacaggugacacuguccagaaaaaugcaauggcacauuauuacacaguguuaucacuauugacacaugaugcaaauaacauuaccucagagaauagaugaccgggacaggaaaccaacuggagguaaggacucuggaguacucauuaacuuugguuuuuacuuuagcuuaacucuaaaccuguacaauauaaacuauaacaguagcuauguuuaauaaccgacuguaacccacaucucucaugaaccagcuuaagacgacuccagcgcaccauucucugugcugugccagcagggauaucggcacauuucucacagaugaagccacacuguagagaggcucacagucuuaaaauuagggaaaagaaccaggaaguagccuacuguggcaauaaauaaaggaaacagagggauacaauauucaggaacuguaguaaauagucuaucuaaugggacaaucaaacaucuauauuuaaaaugacuucuaaaucaaaacauaauauaccacuaccaaaaaagacauaaaauacauaaaaacuugcagguaucuuuucuggauauuucaaaagcacauaauggcaaaagaauaagcagucaggugauaaucuacuucuuguacugccaauaugcaguaauuaacugaaaagcuacugaagcagcacccacucugcaugaacagacaagcaaacgucauucucugcgguguuagcagcccucaucuuucugcuacccuuccaguccucaccuggucucuacaugacuagaggaaaucugacaaugacagaggcuggcuuuguucauacaaugacacucagugcacauguccuagaagcagacuguuaaacacaacagagcaauaagcacauuaccuagucugcuuccauuccugggcauugccaugaaggaaccaaggcuuccuccaauaacacuguggggucuccgcaacgggggcuucuugaaggagccuguguacugauggaggaaggaaugcacgcugugagacgugggcggccugccauucuucacaaugggcucugugguucacggcauccaagaaucauuccauagccgucccaagagucaggaucacaagagaaggguuaagaaaacagaacaaaacacaaggcuguaacagagaucauuuacauguaagcucacuucuuuggcgauuucauucaaagugcaauaguuagaacggauuucuaugaacacacauuuauagaaaauaccuuaacaacuuagguugguccaaugaccaaaacugguuaacaguuacuaauaugccccaccagguauccugucaaauuacucuaaucuuaaauuuauuugcaaaccaggccucuaugugcugacugaccaugacuaccaugugucacacacaggguuaaauaugcuguagaauauaacacauguaauucuuagcaaaaggcaucuaaucuauaccucuauuacuagacauucagagcagcaugucaauuagugaauaagacagaaaaacuuaaguguaucucaguauggaagcuaagauuaucacuucaaauaugguauucuguuauauaaagaaucuuuaaauaagcaaagacccauugccaagcagaaacaucuuacaguauaauacuuacugaucgguuagcuauagaugaggaagaaucuuagcagggcuuugcuugaacaccuacucugauuuuauugagaauaucccuaaaaaugaaacugcuggucuauaugcuaauucuauguucaacuuuuagagacaaagaaauaaaucaauuuugacgauuuuaaauaauuuugacaauuuaaagagacuaaagacucagggcugggacuauggcucagugauacagugcuggccuagcaugugugagcccccacaucaaagucucgagcuacaaaaacuaacuaacuaacuaaauacauuaauuaauuaauuaauuaauuaauuaaagacauaauuuuugaguuaucucucauagaagacacuuuaggaauacuuucuuauucuuccauuuauaaauuuucaauauauauuuaaguauagcuguuccaaguuagggccaauauguguaaaguggccaagauuaacaauuuuaagcuuacuuuuacauucucaccaccaauucagaacauaaaauucaagauucuuccuuucuggauuugauccaucagacaccgugcacacaucacagcugcacaauguacuguaaauuacaauuacagcacaacauuucuaacuaacuuuagccuucaaggugggauacaguuauuaaaauuacaaaagucucucaaauucuaguuggggggauaguaccuuagauaaaaguaccaugcccauuuaguuuuucuaagauauuuacaauccugcaaguguguacgucuccauuuuguuauuguauacaugucuauauaguaugcaaguauaacagagcucuugaucgaacuagagacagaucaaaaauuggucugaggcaguuuacucagagaaauuacaaacuauuucacuuauuaagcuagaauguucacuguuucaaacuagacaaaucgcucuugcuuuauaaguugauuacguuacguguaacauuuuuaaauagcacacucuacauacauucuuauuuuuguuuuuuguuuuugguuuugguuuuuuuuuuuuguuuuuucgagacaggguuucccuguguagcccuggcuguccuggagcucacucuucugcauacauucuugcagaguacuuugacacagacucuaucucugugugcaaccuagcuuauguaguucuuaugcuaaaaacaaaauggguaaaacaaacaaacucuccaagggggaaacuguguucaguacagcuaguaggcauuaacaugauuuaaaaaaaaaaaaaagacuuaaaauuccugugaaaauaauugaugaaacccacauuacacaaagagaaugagcaucaacugacuaugguaguuaaggucugucuguguacaacuacaggucucucugaugaggaagacagugcucuuaagucuuucuuuuuuaaggucugucacaaauagacagcuuacacuauuuucaaaauaguggauauuuuuaacaucucaccauguguuauaaacuaaccauguuuuaagauaauuaccaaaauauuccagaaaacauccaauuagaacuaaauuguuaauuaguucuaaaaugucaguguaucauccauuacucaguuuuaauaaaaacguuugucugguaaucaaauacucagaggaaugugcuccaaaaaccaccuaccaugguggacaccgugccucuuuuaucucuaaacaucacuggcaaacauguuggucagaauuucuagcacaagaauaagcaagcuggagucagccauuauugccaccaagaauucaaugggaaucugagaauagcaggguucugcuccauguaucgagcagauucucuuagaagaggauuaaauauuacaaaaucaucuucaagacuugagacaaauauaaauuuugcccugcauauagaaugauaaccaaauauugucuugaauuucuuacugagcucauuuuucucugcucuugucaaaacccagaccaucaaggaaaacauuacaaaaccaagauagaccacgagaacagacgcaaggccaccuuggcucugccaacaagauggacaguguucagcaaacaaugaugucugaggaagaaaggcaaggucuaugaaaccugcguaggauaaacugacuuccccccacugugggugaagcaguacuacagugccuuagggcauccacggucccagaccaugacugcuaaccugcacaaccaugcgucucucacaccacaagccuuccccugcaaugaagcaagcgagcacgcguugaccaccaccagagaucucgaaccagauuuuuaagcucagacaagggagcuccgcagacacugaaaaccauggcuuauuauuggcuguuuuuaucuccuuccugaucacuaggacauuccuagguuuauuuuggcuuugaguauauaacaguguucuaaaaacauuuaccaguuuacauuuuaguucaauuuaauaaccucuuuaaauuguuacauuaaaauuuguacacuacuacuuuguauuguaaaaagaacugucaaaugaaagauaauggcuuugucuccaucauaggaguucucaguacaauggacauacuaugguacauaaaauaagaaaacaaccaacucccucaucugaugauccuuguaaucuauaaagucagucaauacagaucuagaaugcuguuagccuauauauaauaaagccacaaacaggaaucuuacaaccuuacuauccuguauuaacucaggauauuuaauacaaauauuuaaaugauaauuuaccaauaguuacuuaacaacugguauaaauuuauagcaugagaaccggagaacuaguaaaaacauaaaggcacuccugggaguaggugaccaaguaugcugcaggcugggaggagaccaggacaugccaucagccaagcacauucaggucagucuccuguuuccaaguaaccacagauaaacaaaacugccauggucagcauaucugcagaggagccuugaguguauugguaagguaacugagucucccccagcuacuuaccguuguccuugcuacugcucuccucuauggucaucugcucagccagcucugacagcgacucaucaaucgucuggcuuccccugagcgugagggacagucuccucuuaaacuuuuucauccuaucaguuggaugugguuugaaaaauucugaagguaaaggacaaacaaacaaacaaaaaacauuaguuuuaaauauuuuauugcugaagaaaaauaucacucuagguuuagaguuuaccuucaaaauaggaauuaagggauucucauuuccagcaaacaucacagaaucuaaacuuuuugcuuaaaaagauauagucuaauuaaugcucuauuuaguugucaucaacagagggucacacuuuuuauggaauucaacagugagcccuuaagaacgacgagaucagaagggaugaaagucccuggaccaugcccccugcaaacucugagagcgacuguuacucugacuugguccaggcacaggucucaaccaccauccagaaccagucagauccguggccuaucccauucucacgguaggaaaaugcucaaagaccuucccucagcgaaccaucaaauaccaagcaaaagaacuaaagacucagaggugagacuaauauuagcuuuuucuuucaauucaaaacauuucugaaaucaggaugcauguuacaacuuauacgacgucaaaugcuacuggcaguauuuucccugucauuggagccuuacuaacugaaaaacaaggcaacugccccccuaagaaacucggucauuuaccuuagugucugcucuuuaugaccuaccuacauguaauaagcaaacugaccagagcaccuugcaaacuauccuaaauaaaaacaagggccuuaacccgaggcuaaaauaaacccagcugugguuguucuccgucuguguuuugcucaauuucucauccuaacgguuuacccuagguuugcucaacaagugacucauagaaagguuuuguugcucaaagucuggagaacacaaauacaaacuuagaacugauaacuuaguaucugaucacuacccaguaggcauuuacuguaauuuaaaaaccaucaccauaauaaaacacgaagcaacacacauuuaaagucaaguauuacaacuacaaucuaauacaguuucucuuuaucuccacacuccagucuuaagacacacggcuuagggagucuaaagagcaaccguggcauagcuugggaugagucugugcugagugucuaugaacuuacgguccaguuuaccguccauccuucucagcuguguccagcccgugacuccacccacccgcuugcugugcugcucauuuuuucaguuauagaacccccuuuugauucuuuucuauagauuccaguucucuggugaaauucucagcuucagcgucuauuuucaugaacauacucaucaccguauuuuaaaguuccugucucuaaccccaccgucugucuaaccuauugaccuguuucugcggcugacguuuuucucuucuugcuguguggguagcaguauuuuacugacugucagacacuacgugaaugacgaggugaagcuggaggaaugcagagguuccagauguggcuaucuuccucuacagaggcuuuacuuauuccccuaacuggauauccaagcagaagcaggucagcaguagagcacaauccaaugaaggacagagacugcuggggacugagcucagacacugagaguugcacucacucccacauuacugucccuucuacgguaagguccuucaagggacuccaacuguaaaucuaacgcagaauaacagcagcggaagcuguuaaguaaaauagguaaugauuacauauauaaauauguaaaauauuaaaaauaaaauauacaaaaauaaagacagggcaguugaggcucugcacugucccuaguugcuuuucguuuuuaagcccuguucagcuucauccucccacagagaacaguuuaaagguuguuaacuaacuuaccaacaccagaaauacagcgucucccucccugcccuccugaaucucaaguuuggacaggcuuauauacuuccaaaauugucucaagcccccacccccaccucccagcauuccuaguaguuucagcaggacuucaguucacuuaguuauuccaucauaggcaaaauggaggcuuuggugugcguuagccaaggcaguauaagaugucaaugggaagcagcccaguaugcuaaacucaaucccaaagaaacaugcuaacuguaagacauggccuaaaugugacaacuguagacacauccuaaacaugccaacugcagacacauccuaaacgugccagcuguagacacauccuaaaugucauguaccugucauccuaaaaguaucagcuucacuucuguagcugcaccuuucgaauagcucuaccccgacaguaacuaauucaggacaucugcuucuacgucuuauuuaagguaaaauacacuacuuccaacuaccguuuuguuucucuauagucuuagcagcugggagguuggcagaugcuaggcccuggacaggaugggccucacagauagacuggagcuacagagugaggccuucucagaagacaaaugacaggaacaagaacaacaaaagagccagcauuacagaagcccuucuuucuaagguuaaagcagugccagacccagcagaggaauaacuaagcaggcuuggguacuacaucaacccuacauugucugcagagaaccucaucugugagagaaaaucuguaagcccuuagaauacugcaugugugaugaguguuucuauauacuugagacuaagucacaacaggaaaucauuucagugcugaagaucaaacccaguaccucaugcaugcuaggcaccacucaaagccaacccucaagccagaucaaaugccuaucaauauuucagccaccaugucucuaauguagucauauggucccuugugucuguccaacuauauagugucauuguggaacccugacacaacauuuuuucaaguuuacuggucacagaucuugccuauuguucuagaaugacaaagaaguauaaaauaauaacacauaacauagaucaacuauauauagcugcuacauuuuaauauaguacugaguuuggcuacccaaaauauaggccgauguggcuaaugagcaccuccaaagugguuaguccaaauggaguuaugcugcaaaugcaaaauauaaauuuggcaagaaaacaagguuguaaaaauaucuucauaacuguagacaaaaucauaaaaacaaacaaacaagcaaacaaaacuaaaaguuccaaggccugggggaaggauggaaagugggaaauuauuaauacggguguccuguuuuucaagaaaaggaacuuuagagauagaaaacaagcuaacacagagcauuaaauacaccuuggugggcuuaaguagauccaugagagggcgcacauaacuucuuacuguagugcauuugaguaauaagacacaacagggaaggauccacuuacccauaaucuacgcuaguacaauuuaguauuuauuuugucaaacaacgaaggaaauucuagcaagcaaaauaaaaagcugagcacaagggacauuugggacccugucacacaaguacacacaugaauaccaggauccuaaaaauucuagaaggacagcaaaacuggagacaaauacauuuuaaaaaauuaauguugaccucaaacuucccaauuccaacgacaaagacgugaauauccaaagccuagaaagaauacaaagagaccaccacacugggacacuucuuuacuaaaaauauagaaaucccacagaaagaaauccugaagcagucagaaugaagcuacuuaaucuacacaaagguuucucaacaugauaaaaggcuggugauauauuagaaauuaagaggacaggaacagcauauuuauauauuagaaagaaaaagaaaauguuaaccaagaauacuauauuccacauaacuauacuuuggaaauuagagagagauuaaggcauuugcucccaacagaacugccuaaccaaaacacacacacacacacacacacacacacacacacacacacacacacacacacacuagaguggaaggaaggcuuccagggcaaaguaaaaggaaaauuacaauaaacugaaaaugucaacagccaacuuacaacuguuagaaaagcacacgaaaagagacagaacuuggaaacgcugcacauuuaauagacaugaccugacaggcgugugcaggauucuucaucaacuaccgugcacacuaacucuucccaaggguucacacaacgcacugcagaccagaccucaagaccacaaaacagacugaaaacauggcuuuccuuuuuuaguaucagauccagggauauguauauacaugcgaggcaggggcucuacuccugagauacaguccuggcagguguguguguguguguguguguguguaucuucuucugaauuuaguaaaaugaaacuagguaucaaacaaggaaaauuuacaaauauguaaaaacaaaacaauccuaaguaauacacuacagaacucacaacugaccacagaauacaccuuaaaaccaaugaaaacacuaacacaauacacccaaacuuacaguguagagcuaagcaucaagaaaacuucuagcugcacugucuacaucaaaagcaaaccucaaauuaguauccaaaugggacacuuuauggaauuagaaagcaaagauccaauuaaaguggaaacuaacuaguagagggccacaguaagagcagagcggagacaccacagaacagaacuggguucuuugaaaauguuacacugacuuagaaaacacaccagugagagagugagauggcucauguccauaggggaccugcugccgagacaagggauugauuuuauccccagacacacacagggaaggaaagaagagacccucagggucgcccuuaccuccacacacaaguucaagugccacauacaaauauauaaacacaauuuaaaaaugaggguauuaguacugauuucaaucaacaagaacauaaaauucuaugaauuauggaccagagaguaaccuaauaaaaugaacaaauauuccagaaauauccacuuacucuugaaaaaguacaauuuaaguagaucucuaacauccaagaacaaauuaauacaaugaagaaaaguccaggacaagauauauuuauuggugagacauucucucucaaaaagcaagcuagauggcuccacccaugcccacacaugugcauguacagcacacacacacacacauacacucacacauaaaaaggaaacaguuauacaguaauuuaaauaguauuaaaaagauaaauccuuacgaguuaugcaaugagauaacacauaugcuaaaaacuaaaaaaauacuguugaauaaagcucaauaagauauauguaaaugaaaauacaacccauuuucauggacuagaagacaaaucaauuaaaacuauggcucaaggaggaucuacauauucaauauggucccaaucaaaaguccagugguguuuuuucaaaaacagaacauacccuaaaauuuauauggcauuccaagggcccuggauaauuguaaugcucuaaaaguauuagaaaauuagagggcuauucuuguuacuacaaaguggugaaacacugcaguaaucaaacacuguaauacuugcaucagaggaaacacauacaccuaagccguagaacuaagagcccaaaccaaccaucaagacaagucuuuccaacaacugugcugggaaaacuagucacucucauggaauucggggagguuggacccuuaugccacaugcgagaguuaccucaaaauagacaaaagaaaauagguguaucuaaaccccagcauuaaaaccauguaacaaaaaccaaaaaugucuuggggcuggugagaugguucagcugguaagggcacuugccaccaagccaagcuugaugaccugaauuugaucuccagagaccacgugauaaaagaaaagaacuaaguccagcaaguuguccuuugaccuucacacguguaccaggccauggguccccacagcccagggcccaaaggccuucaaacauuacaagcuagugccaauguucuugcuuauccuccaagucuugagauaagaccaaauugcugaagacaccaaccauauggagaaagcaagcuggugccguccuggaagcaucaucuuuucuggcuaguuucacagucaucagcauugcccgguggacugaacuguguggauuacaauaacaaccagccuggcaagacgugcaugaauccaauccuggcaugaauauccuaggaguaaccagccacucagcuuggauuuaaggccugcuccacaacaugaaacccauaccuggccaagaaucuguggcuagaacgaccauagacucugggagggaaucuacuacuacuauucugcuaaggggacacaguauuacaucaacucccaaugaccuaucauuauagacauugauugaagcaugucaucagagaagccuguuuucaguacauguccacaagcagcaggguaaguaaguaaguuauagggaguaagagacuagagacugcagacguccaguccugaagaacauccauccuccccuccccuucccuucccuccccuccccuccccuccccuccccuccccuccccuccccuccccuccccuccccuccccuccccuccccuccccuccccuccccuccccuccgcagucacugugggaaagggagcagaaagagcaguaagaggcaggagagguagaugacuagaaggaaagugucuucugaacacagcggagcagcuaugcauaugguaccgaugacugagacgccauacacaaaacccgugugagccuaaaacagaccaagauccaguggggagagggaagcagaacacaggucugccccuagucaaggguaagucuuagcuccugggagaagggucaguuuucucuaaaagcauagcccccaguaaguucaauaaaccacaaccccaaauccucagaacuuaaaaagauaauguuuuuaguucuacaagaaguuuauuauuuucuuuaagcaaauuuucaaauauauuguuuacuagucaauagguuaaaauuuaaauauaauuaaaaucugacuuuaaaaucuucaaauuuaagauacguucucaugaugauuaaucaauugguugacaguaagucuccacaaaggagauucuguuuuaaacagcugcuuaguuucagugaauucagagaauaaucuagaaaagucaucugaugcuuuugaucaucaucaucaucucaccugacagaaccaaaagagugauuguaacuauuuaagggggugcccuacccugauacacagauagaaacaaaagaaaaaauggacagagaacaguggaacaucauuuauaaaugaaacaaauuuuccauuuaauaauguacuccggcuacaccuauuuugccaaauccucuuugacucugaaaaaaaaaaaaagugacuuuaggagcuggagagguagcucaauaguuaggagcacaggcuacacuuccagaggacccgaguucaauucccacccagcacccacauggcugccgaucacaaccauucaaggguacuaggcacaccuauaguacacagauauacgugcagaaagaacaccaguacauguuuaaaaaaaauuaacuuuuaaaauguuauuuuaaaaucauaaaaccaggaguuuccugaaagauaaagaaucauuuuaaaauacuuguucucaugacuacguccuauaguuuaaaaucagucaccacguacagugcauggugaaacacuacugucugauaaaacguaaauuccuccgccauaacucaaagauacagcuccccuccuuuuccuugguacugaggaucaaaugcacuccacugcugauuaacuacuauaacuucaagaucgggaaaccacuuggguauguguggggcgggggugggggguggggucuaaaucaaaagguagccgugauggaaacacauccaagaacacaggguuaaucugugggcccugucagagcaagagaaggggaagccugaggaaaagcaugccagggaaaacuaagacacugugucccugcccaggauugacacucuuaucaaaauggaaccuuggauugauaaugcuuucauaaaacuagaaauaaaguauugcuuagaucagaaguucucaacuugcagauuauuauuuauaauaguagcaaaaucacagcaauaaaguagcaaugaaaauaauuuuauuacuggggggucaccacaccauuaaagagucacagcauuaggaagguugagaaccacugacuuaguagauaaauguacacaauguuuuaauugacugaaaaagacuaaaagauauuuucauaacauguaacuguacaucaugagccaugaacugugacuaccauaauucugcgcaaauuaucaaaaaaaaaacagugguaauaaguuuauaaaauacugggaauagaugggcauaauuaaaaauuaauaggagauuaaaaaucugaagggaauaaacauacuuuaauaaucaaggucaaaaggacaggcuuauguucuucaauccugcuaaacaacuauaaucucaggcuacugacuuaacagugguuugggguuuuuguuuuguuuuguuuuguuuuuuuugcuuuaagauuugauuugguuauuauauuuaauuauguguguucccauaugucuguugaggggccaugucaugcuggcagaagucaaacaucaggcccccauuuguagaguuacacagguaguuaggagccacuugggauagggaagguguuggucuguuaucuagcacuggggaugacagugaggauauauuauauugaucagacauacaaaauguucaaagaaguucuccucugaauccuaaaauccuaaaauaugugauucaaguuaucuaguuggaagaagaacagaccaacaagagaaauaaaagcaggaacugaaaaguaauuucucuaguuugguuguuaaauguuccccaaaggccuaacaauuaaagagccacugagcuacugggacggggcagaacugagaggauguggggccugauaagagagagucucuaaggacaugcuaucaaaggauggcaccaaccauucuucugcuguuuucacucuauggccaggauggagcgccucaccauaagccaccaagaagagggcagccaguaacagacugagaucgccaaaacagugagccaacauaaaccugagauagauaaaauauccugcaacaaaaccaggaagcuaacacaguaauuauaaauuuguuuuauucauaguuagauggagguacccaucuuaacgcagagucaacacaaaagacacuaaagucuauaauccagaucguuauggagaaaucagcaaagguguaugugccaagauguaauuacuauaacuuugagaccuggaaaccacuugggggaggaggguguuccgaaucaaaaaguacuaaaugcagcaaagaauacaguguuagugugggcccagugcugaggaacggaaagugcaagcuugaagacuuauuugaaaguaaagcacaacaggcaaaacccugagaaaguggaccgugucccagcagaccgugucccagcagaccaugucccagcagaccgugucccagcagaccgugucccagcagaccagaccgugucccagcagaccaugucccagcagaccgugucccagcagacugugucccagcagaccagaccgugucccagcagaccgugucccagcagaccgugucccagcagacugugucccagcagaccgugucccagcagaccgugucccagcagaccagaccgugucccagcagaccagaccgugucccagcagaccagaccgugucccagcagaccgugucccagcagacugguuugucucuucucuggaacaccuuacucgaacuggugaggacuggccaguaaggaggaggagcagcuuugaucucaggagccacggagguggaaaggcccagucaagccucagggauguggagucuggagggcuuuuauacaacuuaugacaucaggauuuggauucaaccucugaggaaguuuagaugucagcuguuaaaguuagauccaucccauuaacagauaccuucugcccuucacaaggaucuacaagcacacccauuaguuaaaaaauucauugugcucuuugaguauauagaucuuagguagagaagaaacaaaaccaaacaaaccacccuugcaguaagaaguacagaagagcaaacaacagaagcgugaaaaugagaugcucagacaccucugggcccacaggagagccuaccuggcugaauaacagaagagagagaagccuccauacuggagagccucaguaacuacgauaugaaggcagcuucauauuguuuccggcacucaaguugguagcgccauauuauuuugacaaguauaugaguuaaggcuuugauaaaaagacaagcaucacaucuauaauucaacagucuuucuucuauauuuucauuacauuuguguacuuguggaugugugugugaguaugugaacaggcacauguguggaggucagaagacaacuugcagaagucacuucucuccuuccaccauuggaucucugagacugaacucagggcaucagacuggguggcaggcaccguuaccuacugagccaucucaucagccccaagaauuuaauguaaauugcuaaccaggaacugcagaauugaaaaggaaaaagagaagagauggauuauuauggaagcagggaucgcacagagcugaaagaaacaaagaggacguagcuggaauuauuacaacucagagccuugaaacacaaagccuaugaacugaaccucugaaaggaaugagcaggacaggagaagccaagagcucaagccaaggggcucagcaguagccacaugcagcaaucugaggagcacaugacgagcucaugcuaacuacgcuuugaugaggaugggucaauggacaugcaguggaaccaacugccgcucugcuccugccaggguagcucugaggcugccacgcagugagaggaaaagaagacaaggcccucuugaguguccuuccaaccccuacuucucccagcuacacuuucucuuggcacaauguaaggagggauggagcaaagaacaaacaguuuccaggcuguaggacuccugcucgccaccacacaaauuuagcaugugucagaggcuacuaaaaaaacagauuaauagccagaaccacgugcaugauuuuauuucuucauuuuuauguacuugcaguagugguuugcaaauauuuaccuauaaaaaccuaguuaaaaacacuugguauuuuucuuaugaguucugagguaauuauguaaauucuaaauaagggcaaacacuuaaaaaaaaacaaaguuugaaaaaauagccuuuuauagagcuuauaaaacaaaaucagaaauucaaaaucagaaauggaaaaacugaguaaguccuaauuugacaucuacauagaaaccuuaaauucccaucuauuccacauuccccaaagaaaaagauuagugaggauuagugaaagguauugcauuacuuucauacuuaggccauuuuucccuuuaauguacgccuuauucacuguuguauucucacuggcugaaagguugcuguucucuguuaauauucaauguuugucauuuacagcauaccucuauauguguuuucuaaucuuauuucuuuuccuuccuuaucucacgauauuuuuaaucuuuucuucuuuuucucuaaauauguccuucaagagacaagcacagaucuuugguguaauagaauuuucuuugguaccgugaaaacuuaaccaaguaaaacggcaauuugaaugguacagugaauugcgcaauucaguaauuacauuaugagcuccugaauuuauuauuaaccacuaaagaaaugugagcuauacuuaaugaauuagggcagauuuaagguuauuuuauaauuaaguaauuaaugggggaaaguagauauauaacuuaucacuuggaaacugaucaccauauucaguugcucaucaauagagcgacucagaaaguucuguaggugaaauagcuaucuucucgggcaagucagagaaggaacaaauaaguguuugcaaaauaaagcucagaguugggcacagugacucgugccuauaaugccacagucaggaagcugaggcaggaggacuggugugacuucagagcuagucugggauaaauggcaaguccuuggcuauccuggacuacagagugcuuuucugucucaaaaacagaagcaaacaaagaaaaacuaaaugaaaccuuuguagugagcagaggauaagaacaagaggccuugacuuaucaacgagaagccugacaagaggaauccguaccccagcugggguccagugcucggcgagcaacucugccgagcaaaugugaagcucuuacuuggauccccggcacccacaaggaagccagcugcucagcaggcaucugaaacuuaacccuggaggaggauccagacaggcugaccaaagcuguaagccucagcuuucaugagagaccuccucuccagaaccuucugguacacacacacaccauacacacacacacacacacacacucaaaucauauacucacacacaccauauacacacacacacaccauacacacaccacacacacacacacagacaccauauacacacacacacucacacaccauacacacacacacaagcacacacacacacacaccaagaaacuaguuuguuaucaggaaagaguugcugcuccuuugcacaauauuuuagggacaggguaggucgguuuucccugcugcaucuacaggagcuccaggaagauuagacuaaguauaaaaagagaaagagagagagagagagaaagagagagagagagagagagagaaagagagagagaaagaaagagaaagggagagagaaagagcgagugagcgagcagggaagaacagaacucucuuuacucaacauguaagagcaggcucagaauaauguucccuuuacacuaaaggaaaacuagaagauccaguguaagaucugcccguguuaagaaaucgcugaaaugccacacucuuuuuauguggcuaucuauucccaagcaucuuguggcuagaacuggaaagugacaagaacacucccucuuucaaagguaagaaaggagguuacccugaggucaggagcgucucuguggcccugcauuuccauuguguuaacaugcucugcucuaagaugaaagcaauccugagcagaccaacaugcccugcagcuggucagucagcugcucagaguggccgccagcagaccagcuuuggagcucucucugggcacugcgccucagaggcugagugcaauccaacccaguaccacuuaguccugaagggugcaucccacuccucaacuuacuaagaaaaauaaacaaacagaaaauagccucccuuuauauuccaguuaugcaaguauuuuaugcuuucauaugcacucggaaaugaaauauucugauauuucuguguaaagccauuauacucaguuaagaguccaagucugcccuagaaaagucagcugaagggaauguaaggggaagcccagcuccccuucaguccuaaaacuauucagaagcugaugggaaggaauauaaacgucccuaacuccuagguaacuccaagguccuuaaaaaacaaaaggaagaccaacgggccucucuuuccacugauggccggcuaggccaucuucugauacauaugcagcuagagacaggagcuccaggggguacugguuaguucauauuguuguucuaucuauaggguugcagaucccuuuagcuccuuggauacuuucucuagcuccuccauugugggcccugugauccauccaauagcugacugugagcauccacuucuauguuuucuaggccccggcauagucucacaagagacagcuauaucuggguccuuucagcaaaaucuuucuaguguaugcaauggugucagcguuuggaagcugauuaugggauggauccccggauauggcagucucuagaugguccauccuuuugucucagcuccaaacuuugucucaguaacuccuuccauggguguuuuguucucaauucuaagaaggggcaaaguguccacacuuuggucuucguucuucuugaguuucauguguuugcaaaaugcaucuuguggguggagggggggaggguaugggggacuuuugggauagcauuggaaauguaaaugaagaaaauaccuaauuuuaaaaauuaauuaauuaauuaauauagaagaaaaaacaaaaggaaacaaaaucagcaugauuaagugcuuggaacuauaagguguacuaacuacaaaaaucaaugugguauuccaauucugcucuaaaaccuauguuaaagcucucaaacagaguacuucagucuuacuauuaauuuuuuuguuagaauuuguuuuuaaaaaugcaagauagaagguauagucacuaaaaauaagaauuuagugagaaacuaacuuaggaccagccuaauaaucuaguugguaguucaggaaaacugugugugugugugugugugugugugugugugugugugugugugugugugugugugugcgcguguaaauccuaaaccuuuuaaaaggaauaauaaaguauucaaaugugcuuaccaguccuuuccuagaugaaagcccauccccaguaagacucccugauguaaauaaaccacacaccgacagauacaccccaccucuagcugaucuaagggugaagggaaaacuugaaaacacgcauaaaacaaccaaugccaaacucacuugggugauuagaaccuuugcagacuuucagaugucuuccuuacauccaacuccaagacuuuucucacaggaauuacucuguaugcacuaacacuucacugcuuuagguagugcuugacucggccacagaaauauguauauuauguauauuauguauauauauauuaaguaaagcugacuaacaacuaacaggaaaaaaugaagguccaacuagacagaaaucucuucaaggguuagcauuaaauauguccgagccagcagucuuacagaagaaacaggcacauacugacucagagacuguuaaaggagcuucuacuacaccccacucacagaaguauuuuuauuccccuaauguauuuacaugcgcaugaguguagguacgagaacaauucuguguauccuugacuuccaccacguggcucagagacuacacucaggccagcaggcuugacagcaagcaucucacgccucagccaucucaccagcucuuacucaauuugaagauaaugcccccagugaaaaaguuaaacauguaacaaaugucuucauugaaaacuaagcauguuuuaaacuuccuacugcaaugcugaugaauaagucauaaaagaucuuugcaaucuuaaaugauauaguggaaaaggggauaaagaggaaaaaaggaaccaaauucaauauucccugaaguuguaauaugccugucuguccaucaucuuuaauauaauuaagauuccacacaaggacuuccuuuccaaaaaacaaaaaacaaaaaaaacaaacuuaugaaucucaaaaacuuuaugauuacaacagauauauuugaaauacaguauuuacugcuuaccuaauauaguaauaaaaauacuguaagucugaccugauauuacaaaaucaauuugucuuuaucauguuguuugauauaauagcuuuugaugagaauacaagucaacggguguccaagcacaugcaaaacaaaaauccaagcacgaccccaaaguucuccagaacucaggagcagugcaaucagaauuguuuaauuuacccacauaucagacgagaacccuucaucuagucauaguaacaauacucaguuagauagaagaccucaaaagugugugaaucaugaaaaucccuccccaagagucaaucuccuuuucuguggcuuuaauugcuuucaaaaccucguuuuguuguuguuguuguuuuaagcagaaggaaaacaugaccuuuuccccauacagacuugaucuguuuuucagccucgcacagaccaguaacagcaccucuugcuguaggcaucuccucccagcuaagcuuaaccucgggcccugcugugugcgacauaugacacgaucucacaccuucugugcaaguacugcuuacucccccauauccccagugacacaaaacacggagaaagguuucuacuccuauuuauacuuuucuguaagcagaagaauuaagcucaaagaugcuauggaccuggaaugagauaauauuaauggcguccuacccugacacuugacccagaacaguauaccaaagacaaccaaaagcagucucaggacugaacuauguauaaugcccugcaaguuaaucagacagccugcagauuauacaguagucacuguaaccuuuaaacgaauaugagagaaauaagcagaacaauuugaaagcauuuuuccuaaacuaugucuacuuguuccugaacccaguagaggaaaaaaaaauuuuaaauuugcauucacucuaaaaacuuuauuuacaaguuuaugggaaauuauuaguaucuagagccauuaacagacaguuuuucucucaggaaaguuagaaucaaguugagguaauuuaaauauuguuguagacuucagaagugcaacggaagacaagguuuccccauuaccacuguguaaauaaaugagaagggcuagauucugaggaaagaaaagaccacuggggaucaggaggagguaagcagacauugaaaaggcacagagaaacagagguggcacacagaaaagcugugaacagucccagcuccauccuggguucccagugggaagacacggacgcuacaaccacaaggucuagugcugugagacuaucuaccgcggacacuugaacagggugacaaucccacgucaggaaggcagccacagcaucugggugagagaaguagcaaaagaagaaguaugguuggggaauggugaggcuugagccagcucaaauauuuacgcagcagagaucucaggcuguggaggaugaggugggcccgcccucugugguaaggagcaaagcccaugccuaggccaguacaauggagauggcgguggcuauggucuuggccuccagaacugccuuacugacaguuugcugcugggugggacaggcaguguagaggccacaucugacagauucuucaguuuccacagcuuccuuccuccugcacaguaguuugcugcuggacagugucugaaagcagugauccgggcgggcagagcccagacccucaguucuccccauccaggacagaccuugugcuucucaugucaccaacucugcagcaugcuugccaccacacaggcuggauguguggacucccauuauacaaaauggagggucucuggugugagcgagaaucugccugccaacaggccaaacagcuccuuugggccugcaguggggcacuguacacaaagaagauuaucuacaguggguguagccccucaauggccuggcccucagaccacacagcaccaacuucuaucuccagugagaacaagggaaaacaacacacuccagcgacaacccaaucugucccccuuuccucagcccccagcccugacuuauuccaauauuagaggauuuuaaagaaaaagucacuaauuacuugucuucuuuucccuacagucucaguauuuaaauguuguguauaucguguuuuuauuuauuuuugagaauuucaugauauacuuuuaucauacuuuuccguccccauuuccccaccacccagcuucauguucuuacucucuuuaaaacaacaaaaccuggagaagggucggugacggucaaguacagcuggcugagcaugaggccugcccugggguguguguaagugauaaacucagggcuaaguccucugaagaaaacagauuucucuuucccagcuacauccuacuuagcuuugauguaucugcgcuccauuaccacugucuuccucaggggcguuccuuguuauuugucugccuuuacuuaacuguauggcugcguccuucccugcuccuccucacaucaguuuuauaauaaaauuuuaacaucagagcuuacuuucaguuauuuuugccauuuuuucugacaguucuggguagacugauagcucucuuuaguggauuuuuaucgugguucuguacucgguuucucuugguuguuacuguaacagugguuugcuuucuccuuucugaagaguccugaggugugggcucuucugaaggaugcuaucuaagaccugucuaaguaacuguucuauugcugugaggagacaccaugaccaaggcaacuuauaaaggaaagcauuuaauuaggggcuugcuuauaguuucagagggugaguccaggacuaucauggcagaaaacaugguggcacuagagcaguagcugagagcauauaucugauccacaagcaggagacacagagagacaagagacagagagacagagagacacagagagggagaggaagaaggagagggagaagacaaacugugacuaugccugggcuuagcagaagcuuuugaaacuucaaagcccacucucagugacacaccuccuccaguaacuccacacuuccuaaucuuucccaaacaguacaacuaacuagggaccaagcauccaacucugugccuaggagggccauucucauucaaaaaccacgacaaggcugcaguauaaaaaugggaaagauaucaauuucaacauauggguaaaucacaacacagaaggauaaauauuaaaaaaaaaaagcaaggcaaguuuacuucuacaaagaaucuugacucuuuaauaacugaauccaugaguagugaaacagauaaaaugcuaaggauucuaaaguucaguuuaaagacgacucauaaaugaauccaugaaguaaacgugaauauaaguuuuaagugagaaaucuaaacauguggaugagaaauucaacaaugaggaagauucuggagggacaauuaugaaauccuuaaaacuaaaguucaauaagucaacccaaaacucuaaucaaccaccaagacacuagaccucuuagaagaaagaguuccaaggauggacaaaaggccaaggaauuuuaacacugaaguauaaacaggaagagggagagggugggacagggaaacagaagcagaaggagauggggaaagagagggagacaguaagcauuaagagagaacaagaaagcaaguggucagaaauggccacuaaagaccaagacucucaggacaguacuaagaggcccaaccuaugaaucaguagagagggucagcgagcuaggacgcagacuagcgaugcaguaaaucuagucaaugaaauuacauugaaacagauacagaaaaugucagaaauuccaggaaugaaacagauauccgaauacaaaagcaucccccaugucugacuauaguuaaaccgccaagaguauagaacaaaggaagaauaagaaugcugaaagccacaaggaaggcgugucagaugacuuguaaaggcaaacaaucaggagaacugacucagcagacaucccuaaggccaggagagcgugggccaugccaugaaacaaaaccaucacccaagguuaccguagcaaacagagccaaccuuuaaaaucaaacagaccuucucugagaguaaagcaauucccagucaccacgccagcccuggggagagcucaggacguaacaaacuguacugggagaauugaugaauucgggggggggggggggggggggaucaagaacuguuaguaaaguaagccagcccaguguuaaggugaagaacaaagaaauuaguacacuuugucuaacaauucuaacuauaaauggucuuuaaaagucuaacucuccaauuaaaagauuaaaaaaacaaaaacaaacaacaacagcagcagcuaacugaauuacaaacaagagccuuugaugucugggggaaaaaaaaccucagccuauggcaaagauacuaagacugaaagugaucagagaggaaauguuugcaguaaaugaaaacuuagaaguaagcccaaguaacuauacuaccauccaacuaggccaaguucaaagccaacuaagucagaagauacaaaggucacucuauaucaaugaaaggaauacuccacuaaaaagacacaaugacugcaaauacagaugcacugaguauuagcguacccaacuccauaaagugaaauuacuggacagacagagggacacagguccagguacggucauguaggugaccucaauaguucacucuccucaaaagacagaucaagccggagugaaaaaaaauggcaaaagaaaaaauaaauaaauaaauaaauaaauaaauaaauaaauaaauaaauaaaucucaguuaaacuauaccacacacagagcaccuguggaauacaccacucaaaagcugaagcguacacauucuucccaggagcccauggaacuuucuccaaaauagaucguaucuuaggcuauaacacaagucuuacuauaaaggaacuguagugcuuucuugccaucagaccguaagggaaggagaacagagaucaguaagaaaguagaaacucuacaagaucuugagaaaagaacaguaagagugucugagugaucuggaggguaaugacaaaaucaagagggaaauuaaaaugccccaacaaucuaggccaggcaugguggugcacaccuuuaaucccagcccuuaggaggcggaggcggaggcggaggcggaggcgggcagaucucagugaguucaaggccagccuguuuuacauagugaguuccaggacagccaggccuaugcagagaaacuuugucuaaaaaaaccaaaauauguucaugaguaaggacugggaagagggacaggaugaucaaggaacacuguauuuguguaugaaaaugucaucaugaaacccauuauagguguauagaaauggcucagcguguucaaaaacaagcaaacaaacaaacaaacuugcucucaagccugacauccugaauuagagacuccgaccagagcaaccagccccaaacuguccgcauacacucaccacuccagcaaacucucccaaacucacaaaauaaacaaaauuuuuucuaaagaaauuuauuauuuuauacaauacacguuaauaauuuuuagcuuaaauuuagaagcuuucaaagucauccauuuuucuuacaaguaccuacaauuaaaaaaaauucaaauauaauuuuagguagaauacauccuaaagacugucaggucuggccuuuuaucaguuuuccugguguaagucaaagugauaaaauaugauuuaaacagcaaagaggugaaggagugagcuucuccucuuacaguuuuucuguagucacuuaaaaaaaagaucucuauaggagugcuagauguuaguacuaucaaugaaauaacggcuauucccuuuucaguguauucuguaacaggaaagcagccacgugguauuacaucccagaauguuugagacauuuauauauauuaauucauucgaccauuaaugguuaacauuuuuaaaauuauccucauuuuauacauaagacacuuaccaaguaaagaguuaaaagccuagagcaaguuacaacaaguuagcugagaagccguuugaaggccaagagauuuuaaaaaugcuuguccauacacaguaugauccagcacagaauagaauaaacacauaccuuugcucaaugaacaagcaugcacuggcugggcccuuccuaaccucuuucuguuaggaguucuaaaacucagcacaguucaugcauggugguggcacaugagagacagaagcagguagcucucuguaaguucaaggacagccuggucucauagugacuuccagguaagacggguauauaauauagcaagagacugucucaaaaagaugaaaaagucagacuggagagauggcucagugguuaagggcauggcugcucuuccagagggucugaggucaauucccagcaaucacaugguggcucacaaccaucuguaauaggaucugaugcccucugaagauagcuacaguguacucauauaaauaaaauaaauaaauuuaaaaaauaaauaaauaaugaacuaaauuuaaaagucaauaaauauaaaaauuagcagaaaagaaugcaccagcugguuucuuugcuuuuuuuccaaguuuauuuuuacuuagaacgaguauuccuuauacucugaagucagccucaaaugcaucuacacaguacaacuuccuaacuguucuaaucauuagccauauacucugagcaccuuggagaugagagauauuugcuggaaggauuauauaaguacuagacaaaaaugcaaaagagggauauaacguuaaauaaaacagaacaaaaaucacucuccugaaguaacuuguaagcaagacacacagaguagucacugcuuaguauauuuuguaaauguaaccaaauuaucauguauuagucaggggucucuagaaaaacugaacuuacagacauaaucucucucucuacauauagaaaagggauuuauuaggaugccuuacaggcugcuguuuaggaagaccaacaaugacugauuaugaacaaaaaguccaaaaauccacuacuugcucuguucaugaagcuggaugucucagcuggaaucccaaauaagugggcgcuaaugccagugaagggauggacuugcuguccaugugagagggagcagccagagcuuucuucuucccuggcuucguauaagcuuccagcagaaggcguggcccagauugaagggugucuuccugccucaaagcggaucuuccuacuucaaauuaagcaaaaaucccucacagguauucccuccauuuggggguuuugguuguauguguagucaaguugacaaccaaggacagccaucacauagcccaaaauacaugugacaaaauguaacauauuucagguaguauuauugccagagagauaugguacaaaugugcauuacuuuaauuacugccacagguugcuauugcccuucccauuuuacacaaggaaauacaucccaagucaaagacugugacugagacuaauuauagugacagcuaggagacuuuaccacacccaaacaguuuauacagaacgaaauguauuuacucagugacagucaauuccaaaaguagaaucuagugaaugucuaguaaaggaagagaaggccguaugcauguacaacccaagguccagccggagucauuuugcucuaagucagugguucucaacguuccuaaggcuucaacucuuuaauacaguuccucacguuguggucaccccaaccauaaaagccaggcuacuucauaacuauaauuugcuacuauuaugaaucauaacggaaaugucuguguuuucuauggucuuagguaacccuuguugaaaggaucaaacaaccuggagaggggucaggacccacaggcugagaaccacugcucuaaaccaaaacuuccaaagaacagacuaggaaaucuuuguguguguguguguggggggggggggugucaagcaauuuucaugauaauguaagaauuugauggcuacuuacacuugauacuuucagggagaggggaaaucagcuuccuucaauagaaguugauguugggcauaccaaccgcaucccagggcaaggggcgaguucagcaauagccagccaauacaaaggaacucugccuuuuuuuuuuuuuuuuuuuuuuuuuugcuuugcuuugcuuuugugcguuggggggacuuuuuuguuuuuuauuuuuagaaacagaaagguuaugaagugggaggagguagguaggaucuggaaaagaguugggggagggaaaauauaguucaugaaauuuuuaaacgaauuuuuuaauuaguaaaaauuuuaaaaaugguuuaagaguauaaaguccccaacuaacaacaaaacaaucaaucaaucaauaaauaaaacauugaaaacccacuucucuaaagcuguuucuaaccaaucuucaaauccaaagauuggucuucuggacugauuuauucaucaagauuuaaaugggcuuuauaaaugaaagcuuuugcaauaucauaaacuacuuaaggauggaaacauuuaaaaauaaauccucuagcuacucaaccaaaaaaaguaucagguugucaaccagaccguuucucaugauauguacaugucugucuauacauuuuuuugguaguacugguaccuuuuugucaaaucuggggccuucuauguuggaacacagucuaggaauugaguugucugagaagaguucugagugcuuagaaugcguuuucaugcuccuccaggucugauaggacugaguuuauuucagaucccucauuauugcuugcuguuguuagucaauuaaguguuuauauuaucccuuacuuugccacaugcggcuuguccuugugauuguuuacagcuugacaacgagagaacuuuacucagauggcccuucccuuuucuuucuuucucuuucucucucucucuuucuuuuuauauacucucucucuuucuuuuuauauuaauauauauauuuauuuauuauauguaaguacauuguagcugucuucagacacaccagaagagggugucagaucucguuauaaugauugugagccaccaugugguugcugggauuugaacucagguccuuuggaagagcagucaguguucucaacugcugagccaucucuccagcccccaggugacccuucuuaacccuacgacuauagauuugucugaggcucugaauaaaguuggccagcgcaugagacuuuaguccgccucacugacuggcuucauucucccagaucccgguagguagcggcggcacuuguauacuuuagguaggcacuaggcuauccaucuccagcucucuuguuauuuuaagacagagucuuaauaaauuguccaggcuggccuugccguccuucuauaaaccuagguaggcuuugaacuugugauccuccugcuucagccuccuuaauagcugguaauaccagccuaugauaccaggccccguucacugagcaaugucuaaauucgcuauagucuauuuccuaaucagcauaaauguucuuagaguauauaucacauuaaagcaagcgaaaguaugucagucuacaaagcugaugagacugcuuaugauuauaauguuguaagcacauccuaugaaaucuagccaaucaccuauccuuuuaauuaccucguaagggacuggagaaaucacucaguggccugaguucaauuccuagcgccucugucugguggcucuaagagaucugacaucuccagccucugcaggcuccuauacuccuguucacauaccuacaagccaacacacacagguaagcauaauuuaaaaugcacagugagaucuaagccagccaaagcuacaaagugagacacugucucaaaaaaaaaaaaaaaagcaucuuuuaagaauagauuuaaucaccccuaaacucuaacaguaagaaauuaaagagggccuaauuuuaauaagaaaaauuacgcaauauuauauaauuacauauuuuaaaggacauauuacagcuaccaugagaguaagguguuaauuccaagcuagaccaaaucccagccugagaggggaaauggauaugaaggccuggcccuagccaaggcaccuuuugacaacugaagguggcugggagaggacacucaaauuucucaaagagucacccugauaccaccgcacucacauccuauauaugggcagcacaaacuggacuugaucggucaagaaaagagaaaaagaagagaaccaaaggucagguggauagggaaggaggaggacucuggaaggaguuaggggcggggauacguugcucaaagcaugcucuaucaaacucuuaauugaaaaaauuaauaaaaugcaaauccacauuuuucaaugaacaauacuauauguuuucuuuuacaaguuuuaaagguacaucucagaaaaacuauuuucaagauacuuauguugguuucaguugaagggaacaaagaaagcuguguaggcaacuuucugcuguugucucuaagacacaaguggacugaacaacugugcaugguguuuggucacucuguaauuuaugacacaauagugauuuguuacuuuugcuagacuaacccuuuauuaaagccuacguaggauaaacugcugaggaguggucaaccuuccucagcaacagggagccuuggcaaugcacugcaacugccggcucucuccagucugcugguaaugcuuuucaguaggaaaagaucacucgaaauauucuaaagaaacuggacuguucuuccaaagacuaugccaguugcccucaacacuacacaacgacauucacuccaggaaauuuguguaugauuuggagcggggugagcuaaaauuguccacauuacuugcugagcagagaauuagaaauaguucacauaccaaccuuaaauuggagaggaagagagcauaacaagacagcaguuagcgggcgcacuccucacaaggccuagagcagagaagacaggaugaagaaaguguguguugggcuaaauucaacagccaccauucugcuccucuguuuccaguuuuaauguauuuguaccuugugguaccaauucuacuuucuuaggaaacuucugaagguuaaacagggaagugauguagugggucagauuaguacaaaacaaagcaaaaagaugcccaaauaaagacuuuuucaauauacaaaggaaaguuuccuaugaggacacuagcaaauauuuaggacagucaacacuugaggcuaaggauagugauaacaccuguaauuccagaauucaggaagcacagcagaauaucgaagucucuaggcuagccuggaaacaagauaaugaggguaaccuggacaacauaggaacacccuguccuggaaggauggauggauggauggauggaguaaugcuuaaauuaaucagaacucugaucaagauacuucugacugacugaacuuucuauuaaguagaauuaaaugaauucagcuuaguaacugucuccaugagccuagaauuguuucucacugccuguucaguguugacccucgaaaucugagacgucaacauaucccucccaugaugaaaggguagcuguaaacaacucuggcauuaauggugaagguuuuagagcauacaagaaauuuuaggcagcagaagugagagcagguuuuagaguaagccuaaccugacaacugacucuugacuccuucacugggauacuaaggagagcaaagaaggauggaugcugagagaacugugcucucugccccuuuaaaaacaagaacuaacaaccaccucagaagaacgugagaucgaguaaggauugguuuauggcaauauauacauaugaugcuccaacauugggaauauauaguagaagaagguguugaauguuauaguuuuauauauaccucagccaugaaacaugugugcacugcagacgugaacacacaagcacauaaaagggaagccaugcugaauaacugcccuacacuaucuaguuugucuauguacaacaggcugccuggacaauaaccaaacuuccuaccuacuagcaauguauuucucagaauaugaccccaucaugcuaaccaaggcauggcuauguuagcaugucucaggacuucuauugcugccacaaaaacaccaugaucaggaagcaaguugggaagcaaaggguuuauuuugcucacacuuccagaucacaguccaucaccagugaaagucaggauaggaacucacacagggcaggaaccuggaggcaggagcugaugcagaggccacggagggugcuguuuacucuggcuugcuuccccuggcucacucagccugcuuucuuuauagaacugaggaccuccagugccgggauggcaccacccacaaugagcugggcccucccccauugaucacuaauuuaguauaugccuuacggcuggaucuccuggaagcauuuccucaagugagacuccuuccucucuguugacucuagcuugugucaagcugauccacaaaaccagccggaacagagacuuacaugacuucugcucuacuuaagcuuucucuccaucugcacauuucacaucagcuuucuggacagucaaagcagcaguuuuagucagcaaacugaaaugugccuucacacuguacguuagcucucaacucugcuugaucaaccccaagucaacggcaaaccagaacccccugccuccaacuacugaccuuucacccaaaccacaacugaguacaugugcgcaaccacacucacgggcacaccaacacacccucacaugcuuagccuuaaaaaugaagccugggccguagagauggcucagcgguuaagagcacugacugcucuucccaaaguccugaguucaaaucccagcaaccacaugguggcucacaaccauccguaaugagaucugacacccucuucuggugugucugaagacagcuacaguguauuuacguauaauaauaaauaaaucuucagauuuucuccggagugagcagggcuggagcgagcagggccgaccggagcaagcagagguccugaauucaauucccagcaaccacaugauggcucacaaccaucuguacagcaacauuguacucauauacauaaaauagauaaauaaaucuuuaaaaaaaaaaaagccuaagagaaggaaugcccucagcaaaccuagacagcacuuucaccucuccuucccuguuugagugucugaccucuuucaccauguugcguguauauguauacacggacacacaugugggguggauaugaaggccauaggacaacuucaggugcuguccaccuuguuuguggacacggucucucaccgacucugguucuuaacaaggagacuagacugggugcccaguggaucccagaggucagcuugucuccaccuuccuagguuaggauugcaaaggcgcaccaucacgccaugccuggcugguguuuuugguuuuguuuuuuaauuuaacauagguucuggguaucgaacucagguacucguguuugcaagacaagcaggcacuacugagcuauacccccacccuucuucaucauucuuagcaacauuuuugggggagacucucggagagaugcuucagcagucaugaacacuagcaguucucccaggggaccaugguuuaaccccagcacccacaugguagcucacaaccaucccuaacauuaguuccaggagacccugcccucuucugucugcuuugagcacugcaugcauguaguacccagacaugcgugcaggucaaacaucagcaaaacacauaaaguaagagauuuuaaaagcacuuuuccuaacauccaaacaccacccuaucaguuccgugcucucucauucucucugaacuacuagcuagccacacacgcacacgcacaugcacacaccaguauaaccauuaaauaccagaacucuuuuuuuguuuuuguuuuuguuuuuucgagacaggguuucucuguguagcccugacuguccugaaacucacucuguagaccaggcuggccucaaacucagaaauccaccugccucugccucccgagugcuggaauuaaaggugugcgccaccacugaccaacaacaccagaacucuuaaagcucacaaauuuuucuuacuguuuccuucuaagaaaaacacauucaggcacauguuucaaaagcaucuauguaauaacucacuauuuuuuccucugauucugaacucuuuuuugacuacaaacucauauucaacugccuacuugagugucaaaaauaccaaguuaagguuggaccucguugcugagauggaaaaggucagcaucaaagcagccaucaaaaggcugaguggucuacagaugggaccaaaaaucggauuuuuuauaaacacauuuucaagcuugugcugguucagaaugggugcuaacaacccaaacugucuacacuaaagucacaggcuacaggaaccaccgaaccaccggcagucaucugucugcaguaaaaugacuucacuuuuccaggaaacuucuagugggaagauaagaguuucaaauaacuucauuguucauuucaggaacuccccaaaaaaagccucauauaaaccaacaucagacuauucaguuucaguaaauagcaguaauugauuguucgaguuccagcuguuugauuaccucaccccaaaguacuugccuugcugccugugucaaucaaaacuuaaacucuaucaugauccuuaugcuaacuccuaucaagccuagcauugaauacgaauuguaaaccagccuccccgacacucaacaauccaguuucgcugccccugcuaaucauuucaucauguugcccccaucaccccccacagacacuaccagcucuguaacaagggcacuccuuuacuggcauaaguaauaaaaucaacagccuauuuuugguaccauucuccaggcgaaaacauuccuaaagcacuacuggacaacuucccaaaugucuauuaagaauucaguucagcaauacuggauucauuauaagcccuguuggaaauuuugaauaccuuuguagaagguuaugcuagauuaucacccuauauuagacggcauccaaccacacaacuagcuucaaugucuuaauaagagaguuaauugguccacugauuacgucccuaauuaucaaauauacuaacaauaucacaauggauacaaugagugaggccuuauaagaaagauaggaaauacaucagagacaaauuuacucauuuaaggaaaaagaaucugagagacacaauacggaaaaauugaauguauaaauaaucaccaauagcaguaaacaacaaaagaaaaauaugguacaauuuaacagugaaagaagcuguaaaaccauuuauaaaacgugauucacaacugagagagcuuuccccuuaagucuucuacagaauguuagcaauuccuauccaacaagaguaaaugcuaugccuguaauagcacuuaggaugcugaggcaggaggacugucaugauuagaccuuaucucgaaugcaaaaaacacaggguagagagacugacucaauggccauuuugcuuuugcagaugauccaaguucaguccccagcacccaugucaaguggcuuacaaccaccuguaacuacagcuucagggguaccaaugccucuggccuccugggguaccugcauucaccugcauauacccucccuacccaccccccacucacauaauuuaaaaaugaaucuaaaaaaaaaaaagaguaaaugcaugaacguuuaaaaugcuucaaggggcuagaaagaugacucuucaguaaaaaucugauaaccugagcuaguucccggggacucucaugauggacggggauaacagucccccaagcgcccccugacaucccuacaugccccucuuuuuuccccaccaccacagauccacagauguaauaguaauaauaaaagauguaaaugccaaggacacuaaaggacuaacugaaguauuuagaacuuaaaaucuaaauguguaaacagaagcuucgcaaugcuagucauuuacuuuaaggguguggcccugguagguccaccuugcuccauuagauggaccacacccguguuuaaaugggcagcgggaauuggacucaguggccuauuuaagagacagagacauagagacacacacauagagaaacaggaaauugacaggggaagagguagauggguugaguaugaucaaacuauauucugugugcuuuucaaacuuccaaauaauaaaaaguaauguacuuaaagaaaacagaaacuucaccgcagagggcaaaaacaaagaauucacuuaaaaacugguugugauguaagauuuccuaauuauauuacuaaacauaaaaaguuagcaugaaaacaaaagccucaauuuuucaaaaguccauaaacaaucuuuaaaaaacgaacaaaccaaccgaagcuccgaucacacauaaagugcucaucuucuagagaacagaaccaaaagggaaaggccaaagacccagaagaaaacuaaagaucuuaaagguucauggaugggggaggagacgaugccccauaagccuaugaaauaaacuauuccacaucucuaauaagaugaaaaacaugguaaucugaauuccaacaguccucaucuaccaaacuaguaaauuccagaaacccagcuacaagacagaucaggacuccagaacucacaaaacggcaaccaggcaaucuuuauuggaaaaaugcaaguauuuaucauuucuaaauaagcuuuuuagaaucacuguggacucacaggaaaacacaaacguagaacacaagaguucugcaccccauacacaacuggcugcuauccacaucuuacacuggaguggcaccucugucauagcuagugaaccaacgcuaauacauuaucauuaacugaaguccacuauuuaauuccauuuccuugguuguaaucgaaugcacucuuucuguucuaggauccuauacaguuuauacugcacugcaacaaacacacauucucagguuacuccuggguaugacagugucugacuucccuguuuaugaugacacaaagaacuugaucagcaccaucaagcauugcauagaauguuccucaacuggaaucugacucauguuuucuuacaauuaaacuaggguuaccauuugcaggauggaaaaaaaaaaucacaaaaaugaaguacauucucgccacaaaauauuaucaacacauuuauaauuguugaagcugacuaaggucguguuucucagguuugcccuaugcaacuuauucuucccccaaauccuuacaaugcacucuuuagaaagacgcugcugugugugauuuacacuuaagaaguaaggaaucaggcgggcugugguggcugugcacgccucuggucccagcccuugugaggcagaggcaggugaaccucuaaguuagaggccagccugaucuacagagugaauucuaggacacccaggguuacagggagaaacccucucuugaaaaacaaaacaaaauuagaaguaagaagcuguuacacaugcauggcuucauuuauaaguuggaauucugcacaagagauuuacaucaguauaaaucacaauauaacuuuauauucugguuaacugaauacuaauuuauuuuggucuccuauuauucuggccagugugcacucuuccagcaggaagcugacaaauaacucaggguguuuaaauauuucucacacacugguacuguaagaugccauggggucaccugaaauguucacuucuuuccccaguccaaggagucaggcauuucuucaagaaagccugguuccuuugauuagacagguguuaacaacugagagcuacugugagcggagcaugcucaucccuaccgagguaccaucgcuucuuacgccauucaacugacagggcaagagagacaugggauuccuugucagacacaugcacugauuugugugcgugccugugugugugugugagagagagagagagagagagacagagacagagacagagauagagaacagcauuuucuauauggaccacaaugcucugaagcggcauuugaacaucaacacauucacaguugcuuaucuuagggaacagcuaagaaucacacuguauguacaaaggaugaaaucacagcacagcuacagaauggaauggcuaguaauaaaaaaauuaccuaaauaugcaaagaucuccagcauaaauuauuuauuaguauagaucacgugcuaaaaacauuccucauaaacuugauuguagcagagguauuucaagucaaacucaaguugaauuuaaaauacugacaugcaguauauauauauauauauauauauauauauacacauacauacauacauacagauggcauauuagcuuacccccguauacaauuuaacugagucacuauuacaugaacaguauugcucgggcaucugcauuagcaaggagguaaucaugcacagagcugcaguguuugucuucuuuaucauaaaguaggccauuuauagcuuaauaaaagaacccaucacaucuauauuuuuguaaaucuacuguucauaucuuaucccuccaccucccuccaaaaaaaugguaacagcaacuuguaacagauaagaaguggcaguguuaauacucuuuuccaaguguuccugagacaguaaaauaaucgucccgucucugagguggaggacacuagagcaaaaguagcauucucaauaugcacugcagccacugccgcugccucugcauagcaacacgguacaacgcuguaaccauucagccaccaaggggacuguaggccgcuguucauaaaagcuucccaagaauuuuacuguucagguagaggggugguccacgccuuucaucccagcacuugggaggcagaggcagaagcaggaggaucucagugaguucaaggccagccuggucuacagagcuuaguuccaggauaagcaaggacuacacaaagaaaccugugucaaacaaaaacacaagguuuaacauguaguuuacuucaauaauugaauaaaaucuacgcuccuuccuggguguggcgguaaacuggcucugucucccacaggcuuggauaccugaacauuuggucuugugcugguggcucugcucaggaagguuauggggccuuuaugaagugcagccuugcuagaggagguguaucgcuggagaugggcuuucacaguuuaucguuuugcccccacuucucugcuuucugccuguggcugaagguauauucucucagcuucuucaucuggccuucuccaccaugcgcguccucccaccauuacggacucuucuucuggaaccauaagcccaaauaaagucuuccuuucauacauugccuuggucuuuguauuuuaucacagcaacaaaaaccuaacaaauacucuggggugugucucucuugucucucugugacuucaucuauaauacccucacaagcuaccacuccuuccuacucaccaaagucaggagucauguagaagagagacacuauuuuaugugagugagugaacucauacuugagugauguuccuguggaggccagggacaaccuuggguagggacaaccuugggugcuauccacacauuugccauuuguuuguuuauuguugaggccaagugucuugcuguccugcagcuuaccaacaggccuagacagacauuuuuacauauauauguauauguauauguauauguauauguauuuguguguguguaugccugccugcccugccuaucuaucuaucuaucuaucuaucuaucuaucuaucuaucuaucuaucuaucuaucuaucuaucuaucuaucuauggagaaggagacucucucaggucuggaguuucccagcagccuagccuggcuuauuacagagccccaggaaucccccugucacucuaagugcaugccaucaugccaacuuucuuaugugaacuccggggguugaacuugcauuaagugcuuuagcaaccaaaccaauguccucagcccauauuuuugaaauuuaucuuucugaaaaggcccagaagagaugucagcucauauuuuaaaaaggacauaaaauccuuucucucauugcuaccuuucuuuuuuuacaugcaugcaaggcaauguacugacugaaccagcucccuagccggucccaugcgaauguuccuuugcccccagcaagggcuucuuuucccuaaggaaaccacuaauguuuuacugagguauucuugaaauaguuauaccuagaaaauaaguaaaagaaagaaugcuccaauccugaagcaacucuuacugauagcagacauacuuagaguacaaauuugauaauaaaaagacaguuuugaaaauaaaauuacagaucaacauccucggagcugaggagaaacugcagucuuuuuuccauaaacauucauaccacccuucagucuacacuuuuuuuuuuuugccuuccauuuauaaauggacaauaaaaaaaaaccuauguaagaacaucaaaagauuauguggaaugagugucuuaacauaccagauuggaagauauaaggcaccaauaauuuuaaaaggugaaauaaaaaguagauggauuagcaaaaauaauugucuccaguuuaaaaacaaaacaaaacaaaaaagccacacuuuggaagaaaauaaaaguaguuucuaaaaaaaagaauuccaggauuaaagaagaaaaaacuucaccaucccuauaccaaauacagaggcuaucuuacuacaugccaauuuaugaagaacaagugugugugguguauuuauauacgugguguggugccaugaugcucauguggaggucggaggaccucaggagucaccuuugaccugugugacacagggagaagcagacaucagacuagcugcucugcacaccuccuggcaccccugcuuguagcuccuacgucaccacaguaauaaugagauccaagaagcaagcuacagugccaggcuucacacggacucugaggauucauauucagguccccacacuuacaugccaugugcucuacucaauaagccaaaacaaaagucacuuuauauauuaacagguuagauuucugugugccuuugacagaauacuugacauagacagcuuaggagaguaaccaguuaaaucugugguuucagcagcauauuuagaucacaacaggaaggggguaauggagcagcucacaccaaggcagaccagaagcugaguacacacuaacaggaaguggucagggcaaaucauagcacccaaaauuaugcccccaguggccugcuucuuccauaugguacgacuuaccguaguuccacugcagcccaauagccuaaaucuaucaauggauuaaaccuauucauugggucacagccuucauuaucuaaccaucucuggagacacucagacagacacccuggugugucuuuaccaauguucuaauaugucucaaucuaaucaagauggauuguaacagucagugucacuaauauggcuuaucagugaugauacugguacaguagguaauaccagaaaaagacuaauaagcuuucauuugagaaugcgacuccuagauaucuagaugcccuaagaaauaggguugugggggagaacaaaugaaauaugaaaugugagcauuugucaaacacuaugaaaugguuaaagcucuuuugauaaaucaauguauaaacuaaaaaaaaaaucauagccuuaagaauuaucugcuaccuuaaaaauguuacauuauaaaaauuaucuuaaaaaugcaaaacuauuugugaaaagaagacagcuggggauaucugaaguugaugagcacugggggcggggggggggguucagacuaucuacacuacuguacguuuuaaaauuaauuuucagaagcauaguaauuaagaccagacagacagccacagaaagacccagugagaaacaaacuuaaaagagcaggaguguccacuccgugaagucagaauaagauaaacagaacaaacagcuuuguacaggaacaagcaucuuaacucuuucucuccaaacuggcacaacuggaaggguuuggguaaauaaaagacugaaagauaaaguuuaauaucauuuugucuuuacucuaaauuuaauuuguauauuaguaguagcucugucccuuagcaugaugcuaaaauucaagacucaccaggaauuucacagaacacuagaaaucugagccaggaauuuugauuuaguugucccggaagagcuggagacuacccucaagauagagguagauauagccaagcaggcaggcuggcagauagacagacagacagacagaagacagacacacacacaaacacuguggacuuucuguuucuacucaacaagacuauuuuugcgggucaaguuaaauccacuggccuagaacaaaagauaauugacaggaauacaguaacagcaugcauccaagcagauuucaugacaaagaauaaaaggaaaggucaauuugucuuuaaauuaguuucaugaguaauucuucuauuuugcuuuuugaaagccuugagaguagcacacaagggucguuagcaagaauaaauacugucucaaauguuuagaugccaaacaaggggaaaccgacaaggcuaaggaaggggaaucgacugcaaggaaauuugccuggcccuaaagaaacacuucuuccaaagugugcuugccugagguaaaugcccucuuuauuccuagacugcuggauaugaagcugcaaugagccuggugugguagugcacggccuuaauccagacacuugggaggcagaggcagguggaucucuguuaaucugagacagcuggucugcagaguucuaggagagccagggcuacacagagaaaccuugucuugaaggaaggaaagaaggaaggaaggaaggaaggaagggagggagggagggagggagggagggagggagggagggauacauagagagggagggagggauacauagagagggagggggaaggguggaaggaggagaaacaacaaugaguauacuagaugacuuaguccuauauuacacacacacacacacacacacacacacacacacacacacacacacacacauacauacauccagcgugauuuucacacugggcaagagcagggaggcauuuuagaaaaacccaagagguaugaauaguuuagaaaucccauacuauuuugauucuuuuguccuuauaaaucacugauuaaccugaacaggucagaucucuauuauauuaccaaauacagugcucacuccauuauuuuugaaguaauacauguaauaauuuugaccuaaaaaaaaugacagaaauauuaaugaaucaaggcuauauaauaaguucagauauuuaaaaagcucuaaaucucauaaacuguguaaguuuacuuuuaaauguuacauuuuuaucaagauguuaccagacuauaaccauugcuuuauaaaauaaauguauuaauuauaacagaccuacaccaacaaagguauaauuuaagauucagcuuuaauaguccuuaauuuuaaaaguagaaugcuuuuuaauuuaauuauauuggaaaacaaauauaucuguugcaggaacaauauuaaagccuuguucaauccugcgacacaacucuguacaucguaagugcauucaagccuggcacuguauacacagcuaacaaacuaguucucaucagaaaucaaagguuuucaguuaaacaaaauuacuaguacugaccacuguuuuuagaccuuuagaaauauuuuauguagaaauaugucaguuuuguauuucuaguuugucuaaaagacaaccauuuuuugagagccacaagccuuuucucuucauuuucucuaacaagucaguacagcuuacaugcaauuaaagucucaaaaugccaaauuacuaucccucuaaguuggccuagaaccgguuucuagauuacucucacacaaacacugccaacaugguauucuccaauauucaaaaccugaaauuauucuuuguuucuaggccaacaacucugaugguauuuuacuaucccaguguggcguuaccuagucccccaguccacugaacuaaacaacuuaucacugugauaguaccuaguaaucccacccccaccccggcaagucuucccaguccacugaacugaacaauguaucacugugguauucccuagucucuucccaacccccaguccauugaacugaacaauguaucaaggcggugcucccuaguccccuacuccacugagcugaacugaguguguagaugagaucacagaaaaggaaaacagagcaggaaggagagagacuuaaacauccccuacagcagaaugaagucagcacuacaguagacauaaacguuccaaauaacauaauggccacaacccugucagaccagaauaaggaagaugucagaggaaauggcauuuuggccucaaaagugagaaguucucuccacgucucccaggauuauaauaucaacacccauaguucuucaucgcugaaagccggcuagcucuaaucaacgcugccacuuuucuggccccuaaaaaaaaaacaaaaaaaacaaacaaaaaaaaaaacaaaacaacaaaacaaaacaaaaaaaaaacaacaacaacaaacaugaaaaaccccacauuauuuaaaaaagaauugucucaguuucguuugugaguuggaaauuucucacaaauauauagcucuuaucaaccuuuauuuguauuagugaacaauaauaugugcuaaaaacaacugucagccaucaaugaaaaauacugcagcauuaaaaauaugcuuugagaaaaacaaaaugaccacauaaucuaggggacagugaaaagauaccuucgaauauuuucuucauuauuuacacacauagaaaacugaaaauucuugaacauauaguaacaaguacauaaaaugaaagacaaaacaaaacacgcuaugaaaagacagggggcuggagagacagaucugucaccaacggcuucccuaagcacgaggcucugaguucagguuucuagaacccacaagaagagcugugcaucgugcccaugucuacaggccagugcuggagacugugcagacagggcagggugcucagucuacugcccggacagucuaggugaaaacauuaacucagguucaauugagagaaucucugaaacagaaagagaaaggaaagaaagagagagagagggggagggagggagggagggagggagggagggagggagggagggaaaaaaauuuugagacagaaucucacuguauagcucagaauggcuuuaaaguuguuuguaauccuccugccucacccuccucagcacugggacugcaaguaugugccaguaugaccagcuaaaugauucucaguauuagccuuuauggggggggggauuccuuuucaccuuaauuaaacaccuuucaggaaauaauauuuucuguucuuuaaauugaguacgaaauguaugcuaacaauacuaauuuauagauuuuuuuucuauccuaaagaucaauuuucaacaugaaaaauauuaucauucuauucucaguggguaucugauuaaacauaugcaaaguuucuaccuugcuuacaguaaguuauaucaagauaaaacgaaacaaaacaauaggugguguguguauuuguugaaguuuucacuuugaugguaucauggauuggcucccaaauauucccaggaguucaaggguuaaaagcagucucaaugccacaggguuucagacaguggacugucuggaaggugacuggaucaugaaggcauugaucucacagauagauuaagguauuuauaaauuaauaaccuagagagagguugggaggcaguggaaacuucaggaggaaggucuagguaaggcaagcagguccuggaagacaugagcaugagggauacaauccaucccaggcuccaccucccgccucccuuugcuccccugacaacaggagcaagcggaucugcuuugcucuaccacaugcacguuccucaccaugauguucugucugaccacaggcccagaaaccagggagccaaauaaccaccgaaaccucugaaacaagugucaaaacaacggccuccuccugaagggugacuuuuccccuuaggaaacacuccucugucccaggaguauaaagcuggccaacacagauggcauacgcucacauaaugaaagcauuaucauuuaaaugauagaaagucaaaacuucuaagacauguaaaaucaacgugaacgaacacagacauuuuggaaagaaagcaaauguacuuaaaaccuccgugaaagaagccaggguggggaggacugugggacaaucuugcacacacacugccugugcuuuccucugacuuagcgcggcuucuauguuagccagcaagcuguucagcauugcauccugguagagacacuaugagcacggcauuuuugaauguuaacuggaucuugggucacuauaguggugggacccugggggaaauuaccuaaccuaagaccucugcuuccuuauuaggaaaaaaagguuuacccaauacaauagguuuccugugaggauuuaacaaaacaauagagucuagcacagcaccaggcacaacugaggaucuuucucacagcuuccguuaaacacugaacauuugaguggcuucagauucgcguguugagacucucaccuacggguacaaugguuuuuggaggugaucugggcgaucugacuagauuuaagcaagguccagagggcaggccuuuauaauaguaguuauaagaagaaaacccucuagcccauguuuucuuccucuacccccccccagcacccccucccauuuuuucucucauccucccucuccaccugcaggcaccaaacaaaaggccagaaaaccacaguugagacaggcaucuacaaacaaagaagagagcccucaccaaaauuuaaccgguuuggcacugugaccucagacuucaggaauccagaacagggaggaaaaagcuguuuuaaaaagccacucaaugagugauguuuuguuacggaagaugaaguggacuaagauaagguuuaucaaagaguguuuuugaagauucuuuggaaaauaaaaucauuuucacuaaauccaaauuagcucccucaagccuagcuccaaaccauuuaaccaguagguuaugggucucaacacaugaauuuguggggccaugcaaucauucaguauacaguaugaacuacaaggaaaaaaaguaauuaaauauuaauugugcccucugcuaggcaagcuauccugacacacuguggaucugaucuguaaaucaaccuccuaaaaacaaguguuuaggauggcacguuacuguggaccauaaaacauuagauuuacucuuaauguuuauugauuuuccaaguuggccagcagagagagcaaaacauggcagagugagaaaguuaugcccaaaacaguuuuuuucaggcucuucacaauuccuuuuuccaggucaauauuuuacagauguuaaaaguaaacacacgcacucgugcacgcacacacacacacacacacacacacacacacacacacacacacacacacgaaacuaaacaccaagugauuauacugugagcaaaaggguaacaaagccauaaagacaagaagaauccuuaaaagcccgucaaaucaguccucucuccaaauaguucaaagaaacuggcaacauuacagguugaauuugcuagugagcuauggaaugagucuucuagcauuuacaaguacuauggaaaacacauuuuaaauaccauuacaucagcacuaaaaauuaaaaaugucauaaucguuuuauaaaaauaauucaaauacaauauuaaaaagcuugagcaaaaauacucuuuaaauucgaaauaauccaaaauuacucuuccuuugcaugcacaaaaggagagauuguuucuaaaauagccuagagacuauuucuguaaguagaguuuaacauauaauggccuuucuccaccaucagagaaauacacuuauucaguaauuauccacucuggaaguagaaaacccauguagaagaaugucagaacgugaaguuguaauuauacaaagaacaacaauaaaaugccuacuaugagacaauaacaaaggaaacaggcaaagaaaugcuguguucagacagcuuuuuaguaguaucagaaggcaucccggucuccccuuuggaacagccuccuggguugccacaauccuucucugugcuggucacaauaagguaccccacugcucuucagucuguagcuccauuucaccaaggaaggaaaaggaaacaguuuugcugggaguugaggguugagaacaagccuugccagagccaagcaaauaaucuuauaccccacgccuucccaucacaauugcaggaccacacaauaucugaaaacuaaauguaucaaaacauaccuuaaaaucccuguagucaacagggcuuguagucaccacagguguaagcuacagaacaggacacgauuuucugucuucuaguuuuuguagaaccaauugaagccauuagcaucauuaaugcuaccacacucugaauuaaggccuccaauuucaucuuuccuuacugugcacauaucucuucugcucuuuugauaaccaacucguacaggacagauuacacugugucauacaguuaacacuaaaaguuacuuccuugggccugaacccaaaaaagggaauaaacuacauauuugacaaaacccuauuuuaggaaugcaaaaacuacgauauuaacaagacucuaauucuacauuuuuuuucugacugcaaaaguaauaugaaaauuuagaaaaauagagguaaaaaauaaacgacccacaauccagaaacacuuauugggcauacacuuucuugaagugacacaaauuuuuauuaucuaaguagguacuaauaaguguggagaaaaaauauucacaguuuugauacauuuauuaagcaucaauuacuauaaagugaccuguaauuucacaaaagucucuaaaacauugacugggaaagaggaaguugaaaaugcagacuaaucccuagcugaaauaucuaaaauuuuagugucaauaaggacagcacauuguaggauaugaauaucuuuacagcagcacuaacauuacugcaccuacaauaaauggaucuuacuuugacuuucuucuuauucauauuuucauuagcauucuuauuuccacuguaaaaauaguugaaacuccuauguuugcauaagaacuuuaaaauacauauuauuguuguuauuauuuauuaugaaucaauuguuguugguggugguggugaugauguucgugaugugugugguguaugcauguggaaaucagaggacaacguugugcuguucuugccuccgucuuugcauguguucccaggauugaacucaggcccugagacgggcacccguaccaacugagccaucuugcuggcacuugcauuggaauuuuuuuuuuuuuuguaaagauuuauuuauuuauuauaugcaaguacacuguagcugucuucagacacaccggaagagggagucagaucuuguuacggaugguugugagccaccaugugguugcugggauuugaacucuggaccuuuggaagagcagucgggcgcuccuacccacugagccaucgcaccagcccuugcauuggaauuuuaaagcagcuucaauucaaaggcucugcaacagaucuuugacgagcagcauucaaagaguuaaugcuucuggccuaggagauggcucgccagauaaaagaacagcgcucuucacauuccuguguucacucacaacauuagaaauaaaaauuaaaaugaaagacguccuuagucauauuguuuucuuuuguuuaaacccgcuguuuauggaauuaugcagauguuaaaagaacaaaaaaaaaaaacugaaaugacuucauuaaccaggugacaccacauuuaauacauaagccaauuccugguguucacaagagaacaaaauaaaaccaauuaacauucccacuagcaauuuuuuuuuccuccuuaaauuuaguuuacacauguuucuugauucaaagguuuaggucaauucaacugaucagaggucgucuucuguuccgugguuaacaacgucaauuuccaagucacucaaauccauuacuuugauagucuugcacaaaugcaguuaaaaagaaacccaacaaaggauuaggaaaaaacaaacagcaaaguugggaggcaagagcugucucccuuagucaagcauugccugugacgugacagaagcucugcuaccagaaauacacuuugcuggcccaaggaauggccaagacgcaaaacaaaauuugugacuugugucuagagaaucaauuuggcucaggaggcgauaaaacagggccacugaugcgucgucuucgauggccacauuaacauaagggaaaggcgccacggauuucagcuaaaggcuuuugccauuuuugaagaagaaaagcuaauuguuaauggccaugugacacagaagaucccagaaaggaaagggugggaggaaaaaaaaaaaaaagagaagaguucaaggcaguucagggucagaccaagucaggcauccugucauuagcaaacguuccccuagcugaaggcaaaauaccgcuuaccccagaaggagugggugaaaaguaggggagagaaugaguggggaaccacaggggacggcgagguggcagcgugggggugauguggggaagaaaacuggggccacccagcugagauggggagcagaagcaaccggacaaaaacaccgagaaaagcaacugcggcuaagacaacgguggaacacacacacacacaacccccucuucccggguucucuggguuucccacagucccuccgccuccgguuggagcgacacucaggggugugacccgccagcaagagggcugcccggagcuuugugucgacccgcucccccacgagagggcuccucccccgcggagcugcccacccacccgcgcgcagccucccgcgucuccaaggagcccgcagcgccgcguccucgcccacucccgccgccccgcgcccgcgccuccaccccggccccggggaccuuugugucucggggggacuuuccgccucuuccccucccggcgccccacggggccagcagccuccccaggaagccucgaucggcugcgaacucucagcggcggcgcauggagccccuccccccaggucccccaaccagcuccgcacucccgcagcccacgccgcgcguggacaugcgaccgacaagauccccacucgagccgcccgcugacaggcgucacgaucccugcccagccccgcugccaacucaccagcaagugcggggaccgcgggcuccggaccggcgggcgcgcagagcgagcgagcggaugcagguccggugguggcggacgcgccgaggcgccucaggcucaggccuccccccaccccccaaccucgcgccuuccgcuccgcgagggccgccggccgccucacgcguggcagagccccccgcucaacauggcucccgggccgcggagccucgcggacggcccaguacucccggccaccgagccggggcggagcgaggcggcggggcgcgggcugccggacugccgggcgcuggguagaccgcagccgccgcucucguucgucugagugcgcguugcuuucucucgcucggaggcugcggcuugacgccuccgccuguuccccggagcgagcgagagcggggguuagaaaaaaaaaaagaaaagaaaaaaggaaaaaaaaaaaaaaaagacuuuuauugaaacgauccaaccagcggcggcggagaaaagcgaccggcugcgggagcuuccccacccccgccugcacggcucgccuggggcagcgc

SEQ ID NO: 5701 - RNA, 63989 nt, Mus musculus
cgggcacggcgcgggggcgcgcggggcgugcgggcgggcgcggggcccggcgccggggguaugcgcgggucugggcgggcagccccggcgcacagccgcggcccgggcgcacggcgcggggcggaaaagccuguuuacacagacugcacaccgccuggggaauaaugcaguaaaggaagugagcaggcucggccugacugcuccaacuuccugcucucacacacaccagaggaggggggggggggagaaaaaaaaaaagaggagcgagagaaagaaaaaaaaaagaggggggaaaaucaggaucucauuacaagagcaacagaccgucugcagacgccugucagcauggaaagucgggggcuuucgcccgguuccuccuagaaaucuccccaagaagacucccaaacgcucccccacgucuggguagguugcaggacuguuugccuguugcuccagcgcuugcaaaguuuucuucgggcuauuuuuuuuuuuuaauuuuuccucuuuuuuuuuuuucuccuuucuccuucuuucuuuucuuuggcuggugggggugggguugugggcgcuguggggugaguuguagacugcguugggggaggaugggggugcguccccgcgggggaggaugcugugcgucgccaccgccaccgccaccggcgccaccccgggagcucgugcucgggccuggggucugcacugcgaagcccggaggagacacccugagugcaaacuccuguaucccugcagcgaggcuccggggcucugggauuagggauaguggucgaagcgggcugcguggcuggaggcuggauugucacugaccuccagccgggguugcgguccggaucccuucaggaugggcaccgaggcgcgaguguucggauucaggggagagcacagggguggagagggagcggaggacuugggccauggagauguggggcccggggcuacguccacucucucugggcaggugacccccgcccaggucaccgccccaggcgcacgcccagucuaauggacauuuaaaagccggccgagucggcuaguccagauucggauuggggagaugggccaggcaagggaugaacuugaaacucucagcucuuuaacuuccaacugccugcuggccuguaauguuacuggaacuuuuuuuuaaggggggggggcuugaaauugggaggcgggagcuaaaaauauuaaauggucucuguuuuguuacgaccgaaucauuccgaggauaagcugcaguuacgcggcggguggggguggaagcaagaaaggcuauuucagaaacugcaaaaggggcuuuuuagaaggaaaaaaaaaaagagugucgggagaguuucuggcuugucuggaaacggcaagacuaauugccgugcgcuuccgcuuugaaacuggcugcagacagcaucuugaaaaugacucacugaggagcucacaaagaaacugcggcuugcugcugcuucucagguuuauguauuugugccuuuuacaguuuccuuuguaguguuugagggucccccgccccuucccugccggcccccuccagcccuccccaucucgaaagccccucgccguccuauaacucccugcagugcucugccggagguggggaggggggggcaguuggggggggggcguaugggggggggaagccgaguuguuuuuggaguuggcuggggagaggguuaaagggauucugcugcugcagggggaaaaauguuccuugaauuuuccacuggcugcugcaggaagagagagcccuuuagucauugcuaaguaaugucugcacacacacacacacacacacacacacacaccccgacuaaucgcauugggaguuuccgcuacuccgcacaggagggguuuugugcgagccacugucugccugcagacuuauugacuuagaggugccuucuccaccccugccagucuuucuagggcacacucucaaaaaacuuggcagucccuuuggccauuuugggucucagucaugcuuuccuggggggcggggcugggagagggagagagagagaguuguauguauguucuguuuuguucucugauguucaaucaacucuuacacaaacacacaugccugcccauccucucccaucuguuccucugcuuuguagggguugggaagggggacauggcuggggggggggggguaggucaggucaggcugggaaaccuagcauguuccaggcaucuaucagugagaaccuaaaucaauuuaugagcccuauugcccaccaaaauauccacuggucuccuuccuucucucccauccuguggcacacauuuauuuggaaaagggucaguuacggguuugaauuuaugaggauuauaaaauuacagauuguguuaggaggguauguaggucagacaguuaaggagacuguccauaaguguacuaagagcuuccaguaaugagugcuugcaaaacccccagagcaugaaaagggauggccuuucaaugccagauauagagcaggcucucucucucucucucucucucucucucucucucucucucucucucucucucucucucucucucucuccuuuuaaauguugacuagaaauguguagaguuacuaaaaaggacaaagaauuucagagaaccccacugaaagcacagggcuucuuucuugccgaggacauggugccucucgugaggacuuccaagauguuaccaagacuucuccuuuggcaaaucuguccuaaaaaacaacccagccagcccacccuaggugagucagugggccagacuuccaagaugccccucaaacguuuccuagggcuaaauggguggucaguaaacugcugguguugaguguucaguaggaccacaaaacuucagcugauggggaaaccuuccaggugcuaccaucauccugcaggaggauuccagaagguugugaacacuuccuucuaacccagugcuucucaaccuaacagugcaacccuggaauacaguuccuuauguugugaugaacccccaaccaugauauuauuuuuuguuacuacuucauaacuguaauuuuugcugcuguuaugaaucauaauguuaauauccgauaugcgggauuaucuaauaugugacucccccagacggucucgacucacagguugagaaccagguucugaacagaaggaggguaucagaguccaaguuguugaagaauccugagaucugcuucugugguuuucaaccaggaauaauuuugcuuccuacaaggaacaccuguaggggugcuaaguccaccuggcagaaaccagggaugcugguauucaaccaccagugucccagacagcuccccaucgauaaucugcaagucucccgugcuuacgccaagcaguuauuucaccuuaaugaugaggaugauaaacucucucaggcauucauucaacaaacggacauuaaagucuucaguggucccuuugacaacauacucuuuaugucugucucugucuuuuucucucucuugauccccauccccauccuccaacugucuucuuuucugugccauugaaugauagaauggcagaugcugacauugugaugauauaacuuucaugaguugaaucuuugaacuucccucagcaccgagucuucacacagccagagccgaugcucuuuagaugggaagagcccuguugggauggggagaguccuugaauuuugacgauaccuaagcauuuacuuaaaaccucccccuuugucuccuucugaaagaaaccaauuaauucaaaacugcuaauauacaguaaaugcaacccugaggucauacauuaaaauuuaugcuugucauaacuuuuuggaacuuaaaucucuuccugaaauugguuuuaaaggacuuccaagcaguguguauaauuuaaaaucuuccuucccagcgcucagauaugggacuuugugcguucuaugcuaccaaacuauauuuauauagauagcuuugucagaugucacagaaacauaaccuacuggcaagcccaaggcacuuaauuaaagaauuacccacagauaugacuuccuggaguagucuuuuguuuuaaaggugaguugccccuuacuaauagagaguuuggguccuugacaugccuaggcaauggcaggauccucuuugcuucccagaccucagacuccuccucgugcauaaaaagcaauguguucucugucuguuugauucugugcuagcggccccuucccuagaccuccuuaacucaccuguguucaugagcaaaggcccugaugugcaccauguggcuucgaauguuacaggcagacauuuuucuuucuuucuuuuuuuuuuuuuuuguuuuuuguuuuuuucuuuuucgagacaggguuucucuguguagcccuggauguccuggaacucacucuguagaccaggcuggccuugaacucagaaauccgccugccucugccucucaagugcuaggauuaaaggugugcgccaccaccgcccggcuucuggcagacauuuuucauguaguaguuggcaaagcuccucuuggcuuucgcagggugacuuagagccgguuacaaccacaccagucacgagaugucuucucaaggcuacuuuuucuguuuuucuugguugugaagaguaucacaaauuacucuaggaaaacaaagaaagccacaacgacaacaauaaacaucucccccaaacuccacugauaacauuuuguuguauauuuuuguagucuuuguaaaaugugccuuguguacacagaugugcaggaacaugugugcucgaucgcucggaagguuuuauuuagagucacgucuuacuuuuuaaaagagugcauuuucacccagcacccccacagagugcaguuuaaugaugacggcugagauuccaaguugccagacagugagcuuauguuuauggagggugacaugauuucggaugaacugguuugggguuuugucguuuggaauaucuuaagaaugcugcccucuugaaagacugggguuccugugugcugugaaauuugggauuuugaugaguuucuguaugauuuaagaaugagucaugauuggcaguggaguaucgagcuguaguaacaggaagugagggcacacuacacaucagagcagaaagcuagaaaaggggagagaauggacguuaaacuggaaaaaauauacccuaggcugagcuagcuguggaggggaagaaggguucucguagacaaucuuuguuucuugcuauaucuccacuuuccaaacuuuugcuguuuuaaauuuguuuuuguuuuuuucaagcucaauauuacuauagccuguggccaguuugaaucgaggucauucagcuuuuugacugacaccauggcaggaauaccaugaccacugucguucugccacugagggcuuagcacuagcaaauuaaauuaccccuguguuuguguguuuagcucuccacgaacggauccugaaggcccccaaagauggaggccuguucugccuuuuaauuaacagcucuucaaauauuuaacucucucugugauucuuuuccaugaccagaauuagaaaagccuuguauucauuccuggaaauucacacaaaugucaggagcuuuagaauaaacucugccaguggucacuucagccaaaugugacuugugcugucacuaggaauggacucuggccacuuuacugauguguagcaauuuacauuuuucuggggagaauuacuaaccugcuuuaaaaguuaaguaggauucauuuauaacuuagcugagaguuuuacuuguguauuuuaaaaguaauaaagaugauugguucugguacccuauuugaguuuugagucaaacuaaaugaacuuacacacucuaagcggcucaaaggcuuuuaguauuuuugagucuguuugaagcugguggagccacgugcucccauuuagaucugauaggaaucacgggguagguguaaaauacaauuaucuagauuuauuuucucaagacugguuagguuaggacucucagcaacagaaagcaaaacgaaccaaccaaacagccaaacaaccaaucaaccaaccaaccaaccaaaaaacaauguaagaaccuugccaucauguuugaccuuaacgaaagagaacagguauggcugagcacauuguguaugcacaucuguggcuccagcacuugggccauagaggcaggcuaaccucuaugagucugaggccauccugggcuacauagugucucaaauguaauaaacaaacaaacaaacaaacaaacaaggucauuaacuuacauacauuuuaacacagagaucuugaguauaauuuuauacaaccauguaucuaccuccucugaaugaagaauauuuauguuuccaucacuucagaauauccccccccccaguauuauuuuuuauuccaguggggacagugucaugauucugccaagcagauucaaaaacuccauaaugucuugauaaaaugccgcaccacuuuuauuugauuggccaagcauaaaccaguaggauauguggaauuccucaucaugcaggaaaagggagggacaucuucuaguuuauuugauguaagaaaaaaguauuuuaccaauguuauaggaaaaauaaaaguauuguuuuaaagcuaauuggguccuuaggguauuauauuaucauucugugccucaguuucccuggcuggaugguaaugggcugaaacggaggggcuugguucucacaucccaagcccucuagcuuuuugggggagggcauauuugaccuuguggaaaugugcuaagaauguuugcugccgccuuaggaacaaauguggccguuuaaauucccuuuggaucucacuuguaccuggguugaauuaggaggaccccaaggagaacugugccaccugaccagcuucccugguuuuccccugagcuuugggacagagccacaaccuucugcacuuucauucuugggggcccagugacugaugugaguuggacccugcauacuguugauguggccagccacgucaacaugugguccuuuccuccaggguuuacugagcccccugccacugggcauccuccugagaaucuguucuucagaggaucacaaucaacagccauccuuuauuaauuguuacucauuuuugcugcuuuuuaguauacagaguaguugguuucaccauaucguauuccugcacagggaccacuguaauguuaucaccuuccccuuuccugccuuccuucauccucuucaccauuagcugguccucccccuaauaauuccucuucugcuuucuuuucucucucucccucugauuaagauccugcuuaugaaagaaaacaugauaucuugccugucucuccauuaucuucccuucccuccuccucuuuccuuagcuuucuuucaguucaccugucacagcuggggaaggguaugcuggccccagccuuccccuggccuccugagcuucuccagaaguuuucuuuccagguuuucucauuacccaaauucugacucuuuguauccagaggcuagacaguuuucgguauguauuucuggagacuggcuacuuuuccuaauugcccucuacuaacucuuuucccaaacuccaagaccaaggauauaugauaauacauuguccagacccaagacccaggucgcuucccagccugagggauauuuguauauguguguguguggcaugauaccuucaacaucugugaugcucaucccacccggggcuugcucuggguccacaucugguuuuuucauccuuguguccacccaucacuguguacaacacccaucagugggugaauuagaaacaaaagaaagggaagaaggcuuaucugcagagccugggcuggcuaaagggccacguugugcauaaacccagcccuuuacuagaaagugcccccgcugaauuacuaacaggcaggccuccugguuagauggcugugucacuugccauaguuuucauuuagacuuccaagaagaguguaugcucagaaaucggguuuguuuguuaguauugaggcaaacuuggcuuugcuguucagaucaguguuagaccgagaauggcuggcuaacggcuugaaagacuuuccuguggagcgcuuucuugucagaauugaucaguucuaaagccacuguaguccucuccggaagauuccaguugacaagcuucucccaguugcccuggauaauccauuugggguccugcauguuccuugguuugaaaaucuuucuuucccuggaacagcugcguaagcaguguuuguaaccuuuugaaaucaaugauguuucugcuggaguuuagaauaaugaaagagaugggcuaaagaccagcuuuggggucuuuuguuuguuugguuuuguuuuugacagagcaagacuaguuauauuaacuaguuucaccugaguuuugccaaagagcucuuugcugaggccagucugguuuaaccagagugucugaccaagcagcuaaacaucucgcuuaaaccaugaucuuaggaaaaaaagugaacaauauaacaaaacaagucucaagauugaccccagggccggcucccuaguagauguguggauugacccggagacugcacugcccacaucuguagcuugucaucuucuaaauguaaaaguguaaauggugucauggacaaucagaguauucacccaaggaauacuguaagcaaaaaaaaaaaaaaaaaaaaaaaaaaagaaaaaaagaaaaagaaaaagguggggugggggcaguguguugaugucggaugacuaucuaacacuuaaaguaaugccaugcuuguaggcuucacugaaccaggacuggaguguacccuuguuaucuccucaucagaguucggaagauuugacuuuugaggcugaaauauaagcacuauguauugggauuuaguuuuagaaaugaaggagcuaggaguggaaggggaguuucggggcugugcaugugugcuugcuuagguugacaguggcugcuggagagagcgucugggcaggaugugaccuuagaaaaagugaccaaccaaaagcaacaucuccuacacaggugagcgagccugccugggugggauuugagccuuccuucuguaccuaggguggugccugagggaauguuguuuacggagugaaguuucuccacccggaagaaccauuguuucaauauaggaaaucaggcgagagccuggauuuacucugucauuuucaggaaaggagaaagcuuagacucccaauaaugcccuggagucccaugacgagcauguaaaggaagcacccggacaguggagugugagcacgugggcucccuuaguuuccuugugugaucauggacuugaacucuuagaauccagaauucaggagcauugauaaggaaguuauuucugccagcgcgcaucucuguucuccaagcuucaccuucagaggcccuuuagaccggaggccauuagauucccucugucucugucugucugucccucccuaaccccucuguuuuccuccucuuaucucuuuaaaaaaugucuuuuagaacugugcccgcaaaugcuccuagguaggagugcauggucacaccugcacugcauguccagugccuuagagauggucuugggcagacaccaucuuugauggcugaggcaaaggcaauggccaggcagccacuugguaucccuaggucuugcugaguucacuuuauccaccacuuuaguuuuccugaacuuuggauacgugcauaaauagaguaaugcacauaauacugaaauugccuuaaaguuaguuauuuuaaucaaauuauauacacacacacacacaaccaagaugcuggaauuaggaaccaaauagggugauacaaguguccugugguuccuagaagguugagaguugggauaguaaagucagcugggaaaaugccugccuagccacaugaagcccuggguucuauuucuagcaccacauuaacuaggcaugguagcucaggucuauaaucccagcgcucugaaagugaaggcaggaagaucagauguucaaaaucauccugggcugaauaguuacuccaagaucagccugugcuacaaugagacccuaucuuaaaaagaacaauguagcaagaugauagcagcagcagcagcagcagcaauaaaaacaacaaaauauuagauuuagcauuuuguccuuaaagagcaaaaauuguccuggggguauggcucaauaguuaaagugcuugacuugcaaccaagaaaaccugauuugaucccuaggucccacauaaaaacauugggcgugguugcacuugcuuguaaucuuagugcaggggaggcagagacaggccagucccuggggcucucugaccagacaguccucaguccagaaaguggaugccauuccuaagaaugaccugagguugcccccuggccucuggcacaugugugcauguguguucacgaauacucucagacacagacacacacagauacacgcacacacagacacuuuaagaacuuuuuguagaagauuauaaauuugcuaugggauuagacuaucucacuuuauuuuuuuuaaaggauuauuuucuugaggaaagaggaaauauaaucuaaauccagaacguggcugcuauuuuuauagcugauauauucaugcuguaaaaaaaaaacagcauccaguugugugugguauuucagaaaggaccaacuccguggauggcagaugccugcaugugaguucaaggaggugaaaccacguggggaugaggacccauguuugacccuggcgucaucucuuccguccggugcuuuggauggagugaguggcugggccgcuggaagcaguuuccaggacaccguucucuuaaugaauuuggaugauugauuuuugaaagguuuuaagaauaagacacuggagggggcuucgguuuugaaaccacacacuguguauuuugcaacagucuucuuagaaauaaauaccagugucuaucugccaggcaguggugggcgcacgccuuugaucccagcacucaggaggcagaggcagguggaucucugaguuagaggcuaaccuggucuauaggacaagugccagggcagccaggguuacacagagaagcccugucuugaaagaaaacaaaaagccaaccaaacaaaacagcaucuuccaagaauaccaaguuauuuuaaaccugucccacuaacuguacuaagucacuuacuguugcuucuucaugugugguuuuagauaaaaggucaugaagaauugaguggccucuggcuuacuuuuaccucagugccacuggguuuuuacugcuggaagaaauucucugcaugagaaacgauugcugggucacaucuggcgagacgugauguccaugccagaacgugcaagaggaacucgugcaugugggucagggaagcggauggggccgguugccaccuucccgacuucagaugcaaccaacccuccacacauguccaccacaugagcaggcauugacacacugaagacucuagcugcacugccaaagagcauccgcagaacagacugagguacgagcauccguaccuggaaugugcacuuccuaaacucugagagagcuuugcuuugagcaugguacuagagcugaaugaucagugcgccucagagugcgcaggcaccucagagugcgcaggcaccucagagugcgcaggcaccucagagugcgcaggcacccagcuccugguacagauaaccacucugugaggggcucucugugcuucucaaaaauccaaacacaaugucuccagccaccuccuguucacaaacaccaguagcauguaacuauguuauaugagagaacugucuuaagccacagcagagacuagcuaaugucagcucuaccugccuucagucuagacacuggugaguguuuuacuuuagcaaaagcaaaagaauaauaauacugcaagcccccuggagcuacuggaaaauaucggcaguucugaggugcuauuuaaaaccauuuucaucuuauucauauacuuguagacagagacaagaauugccagcugauuucuuuuucuguaccucuuuaccuagguaccauuaagaaccaagagcuuuaaaauaguugcaguggaguuagucccaggaggaagguugcuauucuaggagagcuguguuugucugagauggacuucugguuauucuaugaugguggugguggugauggugaugguugugguauggugugugugugccugugugccuguguauaugcaugagagggggugauggguagagagacaccugaccauugagaaauugccuugacuucuauggaguagacaagaaaguucuaagcuucccugguagacauggccuuuccccuuugccagggcuucuguggagggaucuggaaggauguggucaaggauucuggccuauuccauucccuaggaaacuguagacuaaugcaucaccagcuugagaggcagauccccgugaaaagccguacuuuggugacgauaguuaacaacauggagauguucauauggagacugguuccaggagcaaggagagggcauauaacugucuccgggaaucucuaacuguacguguuagagguggccagaccgggugcaucuugccaggagaagaggaaggcacucagaugguuggguaccuaccccucucucucugucucucaggaaaugccugacggucucugcaucagagcuaggacacucagcacagcugugcagacuucccaugcccagaaucucccgagguccuuuaaaaaggaagggcuggugcagaggcgacucauacccaaccacaccugggaccccuuccuuccuaggcuugcaccguguuuccugacccugcucagccugugucaggaaaaaggagaaagagggggcagaugaacagggagagaucacuuguaagcagggugccauccguggaaaggaacagcagugggacugagugacuggacuuuuagcuggaguagcugacgugaccaguuuuucuaaguguuucaguuugcacacacaccccugcccccccccaccuccccccacuccuccccuccuccacaccccauguuuccacuggguggugcuguaagaauuccuaccuuuuugccucaggaguuuccccuucccagaaagucgccucugcaacauaauagaaggaaguccugauuuagaaagguuucacaguuucaucgacacaaugagagagcuggaggaugcucuggcaggaagcgccccaguugcuggauguggaaaaaccaccaucauuguguguccugcagaaguguucucagcgugcucggggcuuguggguuuuuuuuuuuuuuuuuacuucuaccaguugccucuuuagcacaaagaguguucaaguuuaucugaaagauuccaguuuucugucucuuagaaggaagauugcuuugauuuuuuuuucuucucguaaaaccaucuucaaguaucaaagugaauaaaccauuccuaaucuuaaaucaagcauagauguuccaguguuucuccccgaauucacaagauugaauuuacuaacauuauaagcuagaacauuugggggaaaggucugccaauccagccaaggucucugaaauacacggauagaaugcugugggaaggagugcucacugcucucuacggaagcucagcucaaagaccgcuggcaagauuugaguaagauaaauugucugugucugugugauggaaagucaccaaggaugcucugggugccaggucccuuccaggggcugccacacacaggucagaaacucccaggcugcugcucuccccagaaggaacaauucucaggaaucauuucugaguacuaugcaaacguccaugggggguccggugggggauagguuuccacuuccgucuucagguuccauaauccuugcguccacacgucaaauaaaaggaccagucccuccaugucugaguucuggaauucacagaggcuuaugugcugaguuuuccauuaagagccaaccucaagcuaggccuggugacacaggccugaaaucccagcuacucagaaggcugugacagguacaaacuugaaccuugcaaguucaaggucaacucagagucuguagagaauucaggaucagccugcaccuuacucagauuuugacucaaaaauuuaaaaagugaacagagcuaucaacaguuguugguccagugcgacuccuagauucaauaccccauuaaacaacaacaacaacaaaaauccucuugggugaaacuggcaugucugucuuucucucugucucucuaucccucgccaucaauaaucaaucugucugucugucuauuucuaccucuguucacugagggaacuggccaaaagaaauguggcaaaaugucuuguacuaauuuaauuuaauuuuaguuuuugagauaggaucucuguguagcauaggcugucccagaacucacucuguagaccaggcuggaacucacugagaucugccugccucuacuuccaugugccaguaggcccagcucagauugagcaaacagaacccaguccaagugccuggagucacagagugguaaggucagaaaucaaggacacuuccugacuugauccugcugagaaugucacuuugucuuuuggcuaacucccgucuuggccacagagagguguaggaagcaggcuucuauuccagcggcugucagccucccuaacgcugcgacccuuuaauacagcuccucauguugcagccaccagcaaccacaagaucauuuuuguugcuacuuccuagugcuuuugcuaccguuaagaaucauaauguaaauauuuguguuuuuugauggucuuaggugaccccuuguuaaagaggcuguggcccacauguugagaauugccaugccagcgugacaauguacagugugauuagggaccuggacuugagagcagauauuccugagagcagauauauugggggucugucuguucugauuacuggguccacacauauuugucuucauguuuuuaaggcacggcuucacaguggcugaggauggccgagaguguaaacuugacaugcauacucaaugcaauaaacucaaugaugcaugaaugaccacugaauauuagcauuuaaagggaaggcugcuauaggggugaaaguuugggguuuagccuuuuucuggagaagccccugaaaucucagcauuggcagagguggagaauguagagagggguuucucagacuaggacucuuuuucuuuuaaaacgauuuauuuacuuuuauuuuauguacauugguguuuugccugcuuauaugccagugugagggugucagaucaguuggaacuggaguuagagacaggugugagcugccauuguggguacugggaauugaacccggaucuucugccagagcagccagugcucuuaacugcugagccaucucugcagcaccccagaccuggaaucuuguuuuggaacuuagagauuuccuguagagcuuuacaaacccuauugaugugauauguuccaacauacacauguuuauaucuauauaaauagacauauacagaauauuuucccccaaggaguccccaaaaugguccauggguccaauacacaaggaagauccuucccugugguuggggugauguguguacucacauuuuuagaugugugauuauaugucuuagguggaauauaugagcuuguugcuguuuaacaguuuugagccauaagaacaguaauuucaugcccuuccaccuaguagguccugaugcugugaggaaccgugacuuggaccagccuuccgaugaggcuggcuauuugaugagguggauauucacagcccccuuuccuguuaggcaucaaagccuggcaagguaaaauucaucaggcagccuguaaaucucuuuacccagaaugacuuggguugugucugguguuaggaaaucaucuugaauuuucacuggaggcuugauuggauucaugggaucgauugcuugggagaagcccaaauccaagggggccuucuaagccacaagcccauggguguucuuucagagagcagcccggccggccgucgugucaaggguuaaaauagaacugacacacagaccgaaugaaaccagagcugcaguuacaaagugggacagaugugggagggccagguuuccuguggcccauuuuccaguuuccugccugcaaccugcagaagaagaggaagcucagcgcuagcaaagucugagaacccucggaugggggcugugccgccagccagaaauaagagucgcggggagagccuggacaauaaaaacaaucgcauagaaaguaaauggccagguucucuuccagaaaugucuggaaaggaauggcccuucuguuuaaagaaaaacacgccccacaucucuggggcgggggugggauggggguggggcggcuguacccaccaugcaagaaccucugugcuuuauggcucuacagcucgacucggcuuucaagacauggucgguuuucuuagaaccguugguuaccuggagugauuuuuccacccaagcacugugguuuucuaccccaucuccuggauuuauggauacacagagagguagccguagacagcccaggggcugcugccucuguugggaaaucuaagcgacuaguugguuucuuucuucacucuucgcucuagcuucacauuguggucugauguuuucaaauaacaaagacaauggaggugugugcguugaagauuccuugcguucuuuuuuuuugugugucgggcuaccuagagagcugaagggaauggugcacagagagcucagagggucagaagauacuggaaaagguggauaaugcuauuuuucccccaagagagcgacuguaaaaugucugggaucuuuagcuuuuguuaaccauccauaaagccaaaauacuucaaucccaccagaaagaauuuaagauuaaaaaaaaaaugguagcuuuauacacuuguuuagugaguguuuguuuucccaucacgugcuguguuggaaucgcaggggaugcuaaugagaugcuggcuaagaauuccuagcacguuugugcaagccuuguuuccuagaaggcaauauuauaagguacucgcgugagcuuugcugcagccagauagcaagcaggauaguauucugagcuuuccccgggcuaucccaauuagaguugacuagcaucuuggagguacacagaaggugugugcuucugggacgccagauauuuauuuaucuucuagguggcucaccuuuucuccaggcccagaaaguacaacuuguaccuugaggaaguucugggacguugccacguuagagaucaaagaggacccaugagaggcugucuagagagcucugaaaagauaggauaagauagggcuggguugugcccugcugggguggggugggaaauggaugaauuugcggauguuggaggaaguagaaugacccauggacgccaucucaauggaggcaauguagccauccacuuaguuuuccaaagaaaacacccuuguacgugagccaccagcaagccagucaaguugcuuuugauuuacccacagaugacaaaguuccaggagagcugggcaguuuguauacacaguugcaauucuguucuggcugagcggccaucaggucaguaauuucucccaaaaaguucucuccucagauggaagauucaguuuuaaaacguggcaaagugucuugcauggucuuagaggauaaaucgcuagguugagcagugcccacuucucuuugcuguuccucuguuucuuuuaaaagacaggaacaagcuguagauugucuacagaagaaaggaaagcacggacauugguuaccccacgagaagaacuuugaggaacauggacccuuggaaggaugucauaccuuuguuuuucacuugugacagcuggcaaugacuaaaaugcuuccugaaaauaaauuguaauagucuuaggcucaucucagaaaaaaaaaaugcaccagagguucucaaccugggagucaugaccccuuuggggguugaaugacccuuuccagaaggccgucagaaaacacacguauuuauauuaccauucgcaacaguagcaaaaugacaguuaugaaguagcaacaaaguaauuuuauggaugggugucagcaccgacaugaggaacuguugcagcauuaggaaggcugagaaccaaccacugcccaagacaaagacuucagaguuuguugguguuguguguucauguacuucgcaaauuacccuugcaugccuaaaaguugcccguccuggggucuggcagacccuagauguauuccuguuccuugguuucaguggguuuguggauagcagugaaccuuuccucauuggacaaagagcugcaacccggagaaaugucagcaagagcuugguuuugguuuuuucuccccccaccccccuccauuucuggauccacacacaucuuaagaaaaagacagcaugcuaucugagugucuccuuuguguguccuucacacaggaauaucccuuguuuucagacagcaggugugauagcucacaccuuuaaucccagcacucagaaggcagaggcagguggaccucagugaguucccagucaucccccaucuacauagggugugccaggacagcuagggcuacauagugagacccugucacagaucaaagcaggaagaaagaaaaucagaagguccuuuuaccugcuuaacugccaccucugugaaaucccagaagcaaagcugauaacgugcaaagagaagcaucaggugugguucaguaggaaaaaaaaggaggagggggaggagaaaaguagaagaaaagaaggagaaggaggaggaggaggaggaggaggaggaagaggaagaggaagaggaagaggaagaggaagaggaagaggaagaggaagaggaagaagaagaagaagaagaagaagaagaagaagaagaagaagaagaagaagaagaagaagaagaagaagaagaagaagaagaagaagaagaaggugguggugguggugaaguuuuggauuucuaagaagcaguucaaaucucuggcucuggauuaugagucugcagccaacucagaggacaucuggcgccaccucguggcagauggaagguaacauguccuccacguuaggaaggaaacagaggggaggaugccagggagacggaaccucuggaaguccaaagaccgcuucucaagcaggcaaucuccuggcugcaaaagcagccagucuguuccaucuuuuacuuugugguucuguccuaagguggguuuuuuuuuucacacgaagauuaggaagaacaacaacaacaacaacaacaaaaaaucucagguuuacauuuguaaagagcugaguguugaaaacacagagugaagauacucacuuggaguauacaaaaaaugucucuuccucauaguaccaguggcccccuugcacuucuuuccucugucuguugcccuaaccagccagcuuggguuaugucauccacagacagacuuguuagucuagauccuccuccgcccagugcaacaguucucaucuacuugauucccuggccuuuuccuggaacacaaguuccaugggagcaacggcauggccaggggcagcauggccagcaggggucgcucucugcugacccgcccaaguuggaggccucuggaauuauugucuuaugcuagccgggaaggauaggugcugugcugccuguaaggauaucagacaacaguccuaacaauguacacaguuacauuccaagucaccuuguaagccgacaagcacacuguggcucaacguucaccuggaugucguugacuguauugaagccauugauugccuaaagacaaagcccacaguccauacaguaucugaaugaugcuuuugagcugggggggugggggggaggccaucugaugucacagcagcaucugugaagagcuuuccuuguuuaagaaguaaaggcagcuaguguuuuaaguaguacuugcuuugucccggauaguuuauuagcgaccuuguaauauucaauaguaacccugcaaggcagggaucuguauccucuauaccaccaccaucacuuuaccugugaggacauacguguagagaaaggugaaugacaccccuaaaacccuacaggcaggcagggcagggcagacgcucagagaugaacacaaagaugcucaaguaucuucucaccugccgaguagccuucuggguaugcacgggcacuccuuagagguguggaaaagaacccugcccuagucaagccagcagugucuaggaccuggggacacuggucggugguuuuaugcugauuuuuauggaagcuaauuuacagcuuuguuucuuauagaggacuggcugugaacuaauucuuguccauagauacccagucgcgucuacaaugcuucuuuguuucucucccacucuuucuuucuuuuuuuuuugucuucauuuaucuguuucacuauuccucaucuguaaaugccccauuauucagauuuuuuuuuuuuugagacaggguuucucuguguagcccuggcuguccuggaacucacucuguagcucaggcuggccuuaaacucagaaaucagccugccucugccucccaagugcugggauuaaaggcaugcgugaccacugcccggcuauuauucagauuuugaugccauuauaaaaucuaccuaguuccuuugucuuaauagacgaagugaguagacaguagacuuaauagacaguagugagcaggagaauaucuuugaccugcauucauuguagauccaucuggcaacugugauuuuuaaccuuguuugaaaauuccauuuuuaaacaaagacauuucuucauuuucgcugucucagcaaggucuucuccgaccccuguaccccugcccaagcccacaaguacauccugcuccuugcccagcuucagugacuuuccauaacacccgucuuccaauacacuguaacuuaauucaucacgcguuuuguuguucacagccugucucuuccacugacaugugagcucaauacggacauaagcccuuuuguuuacugaugcuagacagcaucuuggcauaagauagauaugagagagagagagagagagagagagaguagagguugauguuuccaguugguuauaguauaauauauagcauaauauauaauacuauaguauauauuauauacaucuuauuuaaaagaaccuacauugauauacucaguaucauagcuuuuauuuuucccuuuuaauacauuuauuuauucuugcucuguguguguguaugugugugugugugcacgcgcacacacgcacaugcacaugcacgcugcaugggaauauaucuuaugacauacaugugaaggucagagggccauuuguugggaguugauuaucuucuuucccuauguggaucuugggacuagaacucaggaugccaggcuauugagaaaagugccuuuaucugccucgcugucuugcuggcccugucuuguuuuguuuugugagaugugaacagguuucggcaaacaucaucugcuacgcgugaagcuagcuguuaauuugaauugacugggagaggauuggcuuuugcuauugaaucucauaccauccugagccuuuuguacccagcuuugccuuuuaugaggaaggaagacgacaguaaaaaguguaauaaagaaagauaggcugucaacacggcuggucuaucagucugcuuccugccucuuuaaagggggguuuuucagaucugaugagccauuuuauuuuauuuuaaucauuuaauugacaugguaauuguauguauuuaugaggugugaugugauguuuugauacuuguuuucuguguacaagcaaaucaacaacauuaguacauucgguacguaaacauucacagucccuguaugaugagacuuaaccugguaagacagucuagcagacagugugcuugcaggcaagccuggagacccgaguuuuaucccugagaaccaacuacauguagcuuuccucugccuuccauucgugugcguuuaugcuaugaugugcauaugccccuccccucauaauuuuuuuaagggauggcauuaaaauaccugauaaaaccccacauauucaaaacaagagcuaggcagggcaagagaagcauauucuaauuagcaaacaaacaaaaccagaguaugucguguguucucuuuaauauguggaugcuuuaaaaaagugacuucguagucaauacuaggggcugggaggugggagggcugggugaagggggauucgacagcagaagccaauguauacagcuggaggagcaaguucuguuuuagggaccuauacuucacaauagucuauuguuuaucuuaggaagaucugcaagacagaagucugaggcuccaaaaauaaagagaguaaagaagaagccaucauccugauuugaugggugccccuuugugcauguugacacauccucaaccaacaaaacccaaaaaacccaaagcggaguggggaagaacauuuaaaagcccagacuaccagggaauggaugugggugcauuugucacauuucuagcauugcgcucaagaguucuaguccuuggaagcuagcaggucugggcauccagccagaugaaugucagcugaugacacauuguaacuuaaagccggcucugauaccaggacauuguaucuaugcgguguuacaauaugauacagucucauggauacacuguauccauauaaacacuugcugggaugacagagcccacagccuguccaaguugcaaggcuuuugugaauucuuccuccugguaagucccauaguaaacugagucaaguacagcagucacgguucuuagaacaccccccaccccccagguacacgagucauugcucuuucuggacagucuaaaugacagguauugacagguauuggggauggagguggggugacaugcuggaugguugcauaugagaacaacugcaaguuacaaaauuugauguggccaugauuaaaaugaacaguagaaguggagucaaagaaauauagcuugugcccuugaggggaggagacgaguccucuguuaaugguuuuagcucuauggcuccauguaaugucauuugauaaggggacagggaguuagaaccaccuuaugcuucugugacacaccccucccuaccagauggcuucuaccguaggacuaugagcuggcuaaaagagaaguaugucugauauucaccaccgaggaauguguggcuugggcuuccaacacaaaguagaacuuugugugacucagucgucaaaacuguggcauggaggagggcagagcaguggcuggcgugagcuuggaagaagggccagucugugcugggugggacgcuuuccgcacaugaagccugagcccccagacaccuccagggagcacaguugcucacugcaacucugagugauccugcugcaguuugccaccucagggacugggcucuguccuaagaguuguugggugacucugagguccuuaucuuccacccuggccuucuguggguccauuuccuguauuccagaaaugugggcgauccugaagcugauugccccaucaccaccaaaggccucuucccugccugcccuuucaugccuccuugagcucccaagggcauccuagugaagggaggaacaaauaugugugauguuguagcagucagcuuuagcuauggugaugcuuuguaacaaacagucccaagcguccuuggcucacugugguauuuauuuuacuucugcuucuucagacucaaccugugccaggcuuugaucaaauugagguaaauucuauguaucucaucgcuucaacccaguauuucacugacuaguucaagauacauagcuaagcccaacucucagugugcugaggauauagggacuugcuucagugcggcucuggcugccuggccccuuaaaggagugaagcugggaagagagaggcaggcugagcacuuccccucucugcagaacuccaaacuggcuggcaucucucugccucuccaggaaggcuccucugagugaccacuaaauuucaaagaucuuugaaaaacucacugccagaagauuuggcuggagacacccaugaauuugaaacguguguggcuuauuugagcucauuaggagcuggagccauaaugcuggcacguccuuccaggagcucuuucagagcucaggagucgcuggugugguuugaagucagcaguaacagggcugacucuuacagacccagugacugcuguggugaagggugaucucuuuaaggauacccccuuuaaagaguuauaaauaaaacaucccgugggguuuuuguagcacguucuuagucuggauugucuuuaacagagacacccagguggcacccacggugcucagaggagcaacaggauucuuucuucuggcugggucugugaggaagcagggagggaaugcuuguuaggggugacugggggguggugguggcgggguucauacuucaaugggauguugcuaucagaaucccaaaccugcuucugugguggugugguagaacacaggguccgugcuggccaagcgcucaccacugagcaauacuccugccccgugggaccuaccugaagaugcagaaagaugucaggcaguuugaagucuguccaaagauaguugccugccucucucuggcuccuaggccacuuagaagcugcuuuaugaagagcaaugagaauaggugcugagggagacucacuguagaaaacucuccucguggccauuauucugccuuccagucaucuuuguugcuguacucaucguugucaccgugggcugucccuaacagaccccaaugucuccuugccacagauggaguuuccucauccugacaggcuugucuccgccucacggcuuggcuuuugugugucuugauguagaacccccaaacuccagcuugagaucuuugcugagccuccuagacccagcuuccaaaucucagcucuguuugcccaggucaaaacacccacaguguucgcucucaccagcuauccuggaggaaggcuuuuccuaaugauauggauguuaguaaaauaaauggguaaggcuggcaaccuggcucagugggucuaaaggugccuaccagcaagucugacucccugaguucaauccccaggacuggaaggaaagaauggacgucugcaaguuguccuuugaccuucaugcccaagccaugcuuuguaugggugcacacacacucaauaaauaaguguaauagaacaaaagggugauuucuugugaauacuacucaagugaucaaaauucagaucaugacaguccagugaucccaucugaacugcgucuguauggcugagcagaguccaucagggccuaagaaguagcaagcagcaugucaggaggaaggaacagcagaguucaugcuacaggcaaagaugaaggauaacauuguuuuaugguauuuccucuccuggugggaaaaacacuuccugccggugugcuugaaacuggggcuugggcgacuauaugacaagugcuuaggaaacugaaggacuccuccuucaguuggcgacaacugauucuuuaaccagcgucuacugacuccauaucugcucuaugcaagcccuguccuggguucugagauggcugacuguguaaagaguaacugaguuccccucccugcaaagcagggcuggcuauauugggugaaaggacaguuuaaccaggagaugcuaucuauacuuucaugacccuaggccccugugugacuucacuaagcccuagcagacacucauggccacacuucagcaagugugacugaccaagaugcaguugauguggugggugggaauagauggagcuagccaaugggaacuuaccacacagguguucauuccuuuagucaguuuucucuaaguagcucccagcacaguguggucuccgcugguuugugauuggugaauuucaggaccucggggcacugccauuguguuccugcaucggggcugcucauaacugugcaaccagaaaaccuguguguggcuaggcaguccauugggggugggguagaaaguacuuucucuuaagcucuguggagcagagcccccgcgcagcgccugagcugcagacccgcucugaccugccugccucuugcccaccucccagguauggagagugcaaucacgcuguggcaguuccucuugcacuugcugcuggaccagaaacaugagcaccucaucugcuggacaucgaacgauggcgaguucaagcuccucaaggcggaagaaguggccaagcuguggggccuccgcaagaacaagaccaacaugaacuacgacaagcugagcagagcgcugagauacuauuacgacaagguaaagcaagccuuggcaucaugggaguggggggugguggugggggggcagggagggcucaccucucuuaguucacugaggaggagccugggcugugcauccaaucagaaaacagaagcggagacuaggaggcagcucaguuagugaagagcuugcccuacaggcacaggaucugaaguuaaucucuggagcccagugcaaaggcauggugugguggaauaugcuugguaucccagagccagacaagcagagaccggaggaucugugggugccuaauuuccaaguucucggcacguagagacccuguuuucaaaaaaaaaaugucuacacaugaacacauacauguacaugaacaugaacacauguguguacaagcaaaucacagaaaacacaugaaaauggaggcaauccauaccuuuaauguugagauaaaaacaaauugcugagguuuucccaucccaugggaacccuugguauguuccugaggcucaguuuuuguacccucccccgcuuucauauguaauuugcugaagaccgggcaucuacuggcaucaggcuggcagcagggguaagaugucaacuggcucuggggacaauaagaauuacagucugagcugggcaugguggagcacaccuuuaaucccagcacucgggaggcagaggcagguggaucucugaauucgaggccagccuggucuacagagugaguuccaggauggccaggguuacauugaggaaacccuaaaagcuugaaaaaaaaaacaaaaaacaagacaaacaaaaaugaauuacagucuucaaagucugucuguucuuucuggucaggaguucggucagaagguccuuuccagggaaauaguaguuuggggguugcuguauuuuaccacuugugugcuggggauuguguccuggggccuuguacgugcuaggcaaguuuuccaacacugaguuacacuuccaacccuggacacaauauuacuaccacggggcacuucagcaucucuguuugugaaaugggagacauagcaauuccacagucgggaucucuaugaggauucacugaacuacugcgcgcuaaguacuuggaucugugcuuggccugugacauuuggcuuauuaguaacuccuccaauuagaaacaaagccagucucauuuuuacaucaugggagugaggcacagagugcuauaacuaaagaaaaaguauacuuguuuuauguauaauggauguuuuacuugcaugcguuauacauaacuugcaugcaguacccauggaggccagaagagggcguuggauucccccuaagacuggaaucacagcaguugugagcugccaugagggagcugggaauugaacuggcucuucuggaggagcagccggugcucuuaaccauuaagcugccucuccggcuccuagaguacuuuuuaaggugaaucacagcaaggacaauuggaaugaguuuaauuuaugucuugcaaauuaguuuguaugcuugguagggcaaaacuuguucuauuuaggauaaaucuaucaggccgguaauuauuggccauuucuguuugaacccaugcuugccgacuacuuaaccugauggacgaaaagguuuagaauccuagaaacccaagggaacuuuuguucuggguucauuacucuuauggaaaggugaaucuuaaagugauuuaaauauuaguuccggaucuauauuuagugccuucugucugcaaaccucuuuggaauugaggacacaaggauuacacguuucaggaaaugaagacgucauuaauuauaaagggcuccuuucugugcuccuaauagcaugcgauuaugucauugcggcgcuaaaggugcuucccauuagcacggcaauuaauuaaucccgacuuaaugcaguccuacgaagauguaaaggcacuucucagcuaauugcacuguccggaagccaagcagauggcgucuagcuuugcguuuuguucccaaguucuguguucugccaugagaauugagggcccugcaggaaaacagucugucuugccugcuggcagagagcccagaaacguggccuuucuauuguuuuaaaucaaggugucaaagaaaagagggcuugccccugggccugggacuagagucaucucuucaaguccugggcacugaaccugagcgcuugucccgucagcaugaagggaucuguguccuaggcaggggauugauuguuaguggcugacagccuuuguggagacaagccugugaucucuggagugagcaacuucagguuggugcgggucggagggagagacagacaguaaagugccucccccacaagcagagggcccugagcucauggaaccccugaagaaaugcugggcaugaugguucaugauuauucacgaugguaauuccugcgcugagcagggcagucacagguagauccugagggcuaccgaccagcuagccuagccuaauaggcgagcuccaggccaaagagagacccugucacaaaggauguuccuaucacaaagguguuccuaaagaugacgucugaaguccucuggccucuacaugcaugugcauacuuguacacauacacacaugcacacacacacacauguuucccauguaucugcacacacauauacacagaaguacaacagacauacucaaaagcauaccuacauaugcacacauguaccacacaaguacaauucacauacauugacaaguacacacauauguacacaaacacauguauauacaaguacaauauacauucacacgaacacacacauaccccuacacacaaguauaauccauauauacagaaacacaugcaugcauacacacacagcuuuuuuaaacaagcaguuucauagcuguuagucuguuaggagucuagggcucuguccugggcacuuccuguucucuuuagacgagauggcacucccauuaggacagguccugcaccaguuuuccuauaugaaacagaacauucagauuugguugggagacacuuaagccuaugcagccaguggguggcagggcccggggacccaccuguccugugcuguuccuuaagacacaaaccuucacugcugucuuggaacgucugagaucagguaugaugcccauacgcuguucuaaggucaggaguuuuuauuaucaaggguuuuaauacugaaacagguccaaacagaugucaccguagacuccgcauuugccuguuuucuguugcuauuacaaaacacaccaggcugggcguauaaagaaaggaguucuggagacacagaagcacagcaguggcucugguaaaggguccccuuggccguggugucauaacaggaggauggcguccugccgggagcaugugagaggagacugaggugggguuugcuguuuuacaacaacccacucucaaacgauccaucccugaaagagcaucucucccacacccucagugacauaauacaugaucacaugacacacuccccagcccuaaaagguacagcauugccacacugaggacuugggaacucuggggacacacuccagccauggccgacagcagagucgcaauacaguuagaaaaggaaagaagagggggaggagggaagagaagggcaggauggugaaagggaaaagagaagggaggaacagaagagccaagaggcaaacgcaggaagacaguggccacuguggcauuaagaucaucuauuuugcauuuuuuucuggccaacgcuuccagcuuugccagccuugccagccuugcacucuggugagcugcaucggucaaacugguuuaaacgaguuuaacucuaccgacauuaggcuggcaaucacggccgacauaaaugucugaccucucacuggaagggcacgcuuggcucagagccucuauggcuaugaagcccuugggucacgagggccugggugugauguccugcucuguuucacaggcagauccaggcuggccccuucugcuugucagugugacagucauugacacccuccucccucacacucagccugugagcgggauagcucuaugacugucucgcucugcaagcugugguaauuuugucugcugccuucuauagcguccuuucccuggcggcugaaaaugugcauccuuugguuuguccuaauagggaaguuucucugcccgaaaagacaagccugcgaauagcauuauuuuuauaugguauauguuguauuuuuagcuuauuccagcauauuaaaagugggcagaggagaaauguguaaaaaaaaaaaaaagcuauacaacaagacacggagggaaaauaguuuauguguucaugacaucugguagggugaagggcucuacucagugucccuucaaaacaugugccccccuccccccgccagcccacagacuguaacagagaggugggcauaguguggccuuuggacuagauauuuggguuagaauccagcugugggagaagcaaucucucugggccuuagccuccuuuuaaaauguauuuauuuauuuauucgacauauuuguauauguuuguuuuugugugcacacauguaugggugcauguggaagccaacggucaacgucaggucuccacuguacuuuuugagucagggucucucagugagcaucagggauccuccugacucuaccuucccagcacugagacugcaaacacacaccagaggucagagcugaggucggcccucuggcuuacaucagaagcacuuuacugacugggccguuucuccagcauccucguacccuuaauuuuuucugcgaacugaggauuggguccaaggcccucacaugcugggcaaguacacucuucuuguuagguacacugaagaugacagcaaacucaauucaagggcccacggugaauagucucaggggggccugcaccccuuugacacagugcccacuacuggaaagauaugaugaagccuuggccagagucguaaugugggugaucguguuucucuaccgcuaguuuuaaaacuuugggugaaugcagagaaggaaaaucaaccuuuguaccaacccuugggauggguguggagaugggaagauggacccccuuuguccugcugugcaauggucugagaguggcuagcaacuuuugccaguuaacuuuuucuacacagaaggaaaaucaaccuuuguaccaacccuugggauggguguggagaugggaagauggacccccuuuguccugcugugcaauggucugagaguggccagcaacuuuugccaguuaacuuuuucuacacaggcuguucugaaaauucucccacauuucagugcccuuccugucccucugggucagagccagcguacuccccugugcacuaagagggcaugaacguggcgcccacuccccugugcacuuagaggacaugaacguggcauccacuuccuggugcccuuuagagauuuuggauucaggacuauggagguuggagggcagcuguuucaguuccacuaucacaaaggucagucucugcagcuccuccccuuccggaucacaugaggaucuggaguugaggaugcucaguacccggcaguacucagcagccuauguggcaucaaugcucagaaaugcacgccauuuuaccauccauguuugugaauauuaaugcguuggguaacaggcugguuauuuagaggucuuccauugugauaggaaauauuaaaaaauggcaccaccccgugcuggggcaagacaccagcaggcaggcuggccuguucucaucucguggagacucugacugagagcucugaaaucucuccaccucagcucucuaaguucccacuggcgggucguugccacaccagucccauacuucaaaacucucacggccuuuuguggugcacuuuuggcaaacccacguuuuugcagcgguaccuuuucucuaaaaaacccagucgagccucugcgugaaggaaaacaccacacaaacuuaguucagaaucaaugguaacucaaucgcugggcgcaucaacuagaauccuaaucuuguuaagccuuauuaagucuaaauccuccaguggcaaauccuggcggauucaccaucuaaacugggagacacuuguagcuauaugucuugaccuuucacuguccccguccaaaaagcaccccucucccccacuccugccuacucucuuccucuauccaagcaggaagucccgccuacucgcccagugauugguuccuuuauucauuggggaugguucacaagaagucaccagaguaagagacucauuccugguuccagucagcccuuccugggaaagcagaauuagcaucaaaauauaaacagcaccagggccauccucaacacuccccccuccccuccccgaaccgcacguuacuauuauuauuuauuguuuagauugggucucgccaugcagcucuacaacaaacauaacgcugugacagggaugacacuuagacucaauagcacgugugucacacugugucucugacaccaagggcuuuaagaggugacugaggcugagaggaaaacugugccugagggcuccaauucuggaguggccacagcgucugccugcacaucucuggauucccucauggucacaugcauuaucaauggaaaaucugggguggggugggggcgucagggauugcaacgaugagcuccaacaaaagcccacccagugcuuuugaagaggcuacuggacagaccucaguagcauuccaggcggggggcggggggggcacccaguccagagagcagugugcuuuacuucugggagauaggguagaugggugagggcugagaggccccuggccagaaacucucaggcauugagagaccacugagucuugggcaguggaaggcagagguaggagagggaccagggcucugggugguacucaccuuccagggauagcuugcuuucucugguguggaugacucugaacgaccgucagcucagcucugaugaguugaaggguuuaguaggcuccccccacccccaauuaguuuuaaaccaucacaccagaaagguagacuugaugauguaauccgaaggaugucuuucggagauuuuguuaguaagcugacuuuuuauuccuucacgauacuggguaugcuugguuuugaaaucaaggaaggaggaagagacuggugaacagucaacguagcugucccccuacccccauggauguuugacgugcguguaugucuguauaccuggacccagaagagggcauuagucccugggacuggaguuacagaugguuuuggagugccauguaggugcugggaauuaaucccauuccuuuagaaaaacucagucaguacucuuaagcaccgagccaccucuccagcuccaccccuucacgacuuaacagcucuuggguguucauagcuuggcacggacaagauccuuuucugucaucucuguccccaugcccucaagucccucagccauuucuuugaaaaugucucucccacuccuugcaugguuuggcaacucugggccuggggacagacauguaaaucauucccaugcuucaaauuauagaacgugcuagcagugauggggugcccggccuuccagaggagggaggaagggggguagagacagagagaagauuucugggggucaagauacuuguugaucaggagcuccugggcugaaccugaguucagcuggugccaggcugggagcccuuaggaaggaacgccaaguggcgaacagcagugugggcagaugggaggugugagcguuugaccuuuccaagugcagaauauuuauuuagggaaagagguugaguuugggagagaagcguggggcagcaucucgucucgaaauuggcacuuucucgagagagccagcaaaguguggaaagcaagaaagagccaugguuagauuugaauguuuggaugauaaaaaccgcacaucccccccgccccccaugcuuuuuggcauugguggcuucaugcuccgacgccaccacucugauccuuuuggccaguuacugagaaagcgugguccacacugagcugacuggccgcgccaugacaucagaaccagggccugcagcgccccucccccuccagcaaccccggggacagggaaggaaaguguuacugccuggcaaucuugcaggugcagcugcucaugggaagcugacgacaucgaccugggcugcuacagacggagacccggaagcuuacuuaauccuuacccuuuuccaucuaacagaccuauugucucugcuguuggcaacgagcguucuucccaggaggaggcuggaaacuuugccagcucccuucucagccgcagaugaaacuggcagugggaugaacguccuucccuuccgucuccacagcaaccucucagcugauccucgcagggguaccucgggaucuuuaccuaauuggagggaaauuaggggagagcagucgagacagagucaccggcuccaaaucccaggaagucgaacccaucaccuucuuagcuuaauuggguaauuuguuuuaaaugggguaugcaaucacgcugagaaaauguuaguauuaauaacguguaucugaagucagcugucugggcugaaaagccuuggcuccgguaggauccuuuaaugucccccaauaauuuuuugagaagauaaaaugaucuaucuucagaguggagaccggaugcguccagcaggugcuccuacccuggaacuucuucgaacgcccagcugagcuguugucacagugcuucugccuggcccuaagccuguguaugcagagcccgagcccucugcugggugucucuuuguaccacgucagccgcucagaguguuagaggacaacagauggcaccagggcuuuuguccagaggccaaggguguaaccaggacuucccugcacgaacuuggcccuggaagcuaccuggagaccugcuugguagcugaacuccuucccgguggagggcuucuaagcuguccaccuugucccaggagauggcaaccagcauaagguggcaggccgugggagugcgaaggggucggaggcguuauuugggggugcuuccugucuugcacaugguucugagccggugucccugaagcccuccacauuccuccaaauagggugguugcuaagaaacgggaugaggcagucuugagagcacaguuaacacggggcugcugcaugguacucagcugcugaggcucccacagcccugccaagucgcugcaucaggcccuugcccuugcccacacugagucccccuuggcaggcucccgcauuccugcuccgggcucuuagcugcgggaaaauuuagggauuguguagacaaacugacauaaaaccgccaacauucacaucacaccucccaccgcccaccaacugccagcugcuccucugggcggccucuucccacuccccucacaggcacagcucuuaccccagaugguaaggccaggagggaagcucacguguauggggcaugcugugugugacucagggcuaggcagcgaacauuuguuaacuccuaaggcaucuggccuuguggucagggauggacccauucuagagacagagauacugagucucaggcacauggggguuaaauagcgcacccaagaucaaacagcugcuuggagucaagcauucaucuuagaaauuuggaccuuggcugcguaguuugugcagauugcuggaggcccagguuggagucuuuauccuucauacgguguccuauggcugaucacaaucucuuauguaggccaagagaaggagaggccccaacauuggaaagauuguucugagccccgaguguuagguaaggugcucugugcuagcugugaaugggagguguuuuguugguuggucgccccagagaacacgcgcacuuccugaagggagacaagcugagggcuggagagaugaagcagacagaguuugaagccagucucauguauauagugaguuugaaacccuguugagagagaaaagagggagagagacagacagacagacacagagagacagagacagacagagacagaaacagucagaaaagagacauaggagacaggaagguaugagacaggcaggugugccccuccuguauguuuuuguaccaccguaaccccccaguggcccuggggaaaccccaaacucuccuuaucaucuggccucccucuacugguucugaacauccuaccuuuuagcuuccucauuagcccugccuaccuugccuccuggcuccaggccacaucugcugcugaacucuggcuguaccuugccagccccugcuugguaucugccuucccugcuccaggccggcuccugucucugucucugguuacuacaucuacuuuacugcccacuuccaccccucccccacauuuuuuuuuuucuuaacaccacuauaguuagucucugcagugccugcugugguagcuuccuguaacuguagaacuguagaauguauguaugaggagcuagcagucauccuccuuagcauaggaggaaaucugucacuaugaaaagccagcacuggaaaggcccgaagaaaccaccuugccccacuggcugcagcucuaacaagcaaggaucccaaaaggagagagagagaacacuuuuauucuuauuauuuuucuuauuucuucuucuucuucuucuucuucuucuucuucuucuucuucuucuucuucuucuucuucuucuucuucuucuucaucaucaucaucaucaucauuauuauugcucggugcuugucuuagugugccuucaauggcuguaauaaagcaccaugaccgagagcaacuugaggagaaaaggguuuauuucugucaugaagggaaggcuggguaguaaccaggaugcaggagcugaugcagaggccaugcaguaagcucugccuacuggcuugcuuccugugacuugcucagccugcuuuucucuaccacucaggacuuccugcccauggguggcaccgcccacagugggcugggcccucccacaucaaucauuaaucaagagaaugcccuccagauuuucaauaggcaaucggauggaggcguuuucucaauuaaggucccuuuguccuagaugacucuagcuugugucaaauggacaaaaaaauaaaccaggacagggccagagacugagcccaaggcucugucuccaauauggaaugucaaaaauccauacagcaaagacaggguaggaguguauuucuguccacuuggggcgcugauguccccgugaugacucgcaucauuagaucuggccacucaaaauggagaaccauugcaauuauuccccaacccagcccagaaaggcuuaugcuggcagaacagucuuaugguucaauuuauugaggacaaacacucuuggaggaauguuuaaaggagccaggguaaaauuagagcugaacccagcaagcggcagcugcaaagggcaggagagaaagaugcccucagcauccagcucgagucuccuagggaaggguguccugccagaccagcaagaagaggaguuccucguuugcagcacccucuggguggcacagugaccgcucaggcgagucugaggagcccugccgcugccaaguggccgcauuuggugagcugguucacacugcaguugacuaaugccagaaaacaaagaaaucuuaacccaaaccaugagaaaacuucgaggcuggcagcugguggggcaggucagcucuuaggagccaaacuuaggguguguuauucuuagaaguuugggaugguguguguguguguguguguguguguguguguguuccaaacuuaagauugagacaauggguguuccagcucugccuagccuggugccuaggaccagcauccagcacugaaggcaugcuaggccuuccugagggccacugcugagcaggggcaacuuuaagaagcaccccacucacaaaggcugcucuaacagauaaccccagacuugguagcucaaaguaacagaauuuuagugucccccaggaagccaaaaauccaaagugagcugucugcugggccccuggauggcuucaaggaagauuaccaccaccucccaucccccaagcccugguagcucccagcaguccuugguguuccauagcuguaucccucauucuccaccugucuuuacauguguguuuuuucuuucuugaguggcccucuuguccucuuauaggacacuagucguuuguacuuugcgcuuacccugagucucaacaucccuuggccaauuucaucugcagagaucucauuuccaaauaaggucacauucugaguuucugagggggcaugaguucuugggggggaauaccguucaaccacacugugggaguagagaaggcugucuuguuaaaaguagcucagguggguggggucaaggagccuuucagaagugcucccuccuuaggggcaaaggugacucaaccuugccugaaccauuuagggcugacucuaucccuguuagagccccugagagcccacaagccccaggcagagauggggcagggccuacacugcucacacacaguaacacuugggggcuuaccggacucacucugguucuguuuuuacagagccuggauacuuccauaggaaaguuucucuugggguuuguggguaguuugcuggcuaacggacagggugggcaugcguccuguggguaucauauucuaacuucggagaggggacccuuugggauccgugucaggagaaugagucagccuccagucuggacgugaccucagauggugaacuucuguaggguguuggcugggaagccagugacuuggagacaugccacccuugcugcuagacugugggaacucagcucaaagcuuugggucccucaucuguaaaaugggcguuugaguggugugaggcuuccucaaagauuuuagugugaggugccagcuaaggaauucugauugccccacagcagaauaauagagcagucuguuauaaugaucgcuguuggccaugcagaauccagcugugcccagucuuguuucaaggacucugugagcaaaguacagaugcauaugagccucuaagaggaaacuaucucaugagcuagucuucuuucuauuuuagagguggcaaacugaggcuaugcuaaguagaaaggcugggacuugaacucaggucugccauaccaauguuauuucauguaaugcugguccauccgugcuggucuucgcugugcuggucacaaagccacaccaggccauguguaguucaugaucguuuugugucacucuuuuuaggugguauaccauuuacagguugguuguugauggcuagucaaguuugggauuauagggucccagugcuucaugccagggugucccaucaaagcaagugccucccugccccagggauaggcaaaaugggcagggauguuugugguuauaggaaguaagccuccuggaagggagacagaaggagucauucuucaguaaggaccuuacuuccuuagcagggacccaguuccuaggccacacagccagccucaccacugcuuuggaaugcaaaagcccuggguucuguuacauuaguagcagccuguggacccagggcaguugccuucuggaaggggguguggucauugagcagaaauguuucgggacuagcuguggcuacaguccaguuuagacuucagguacaguuaccagaggcacgugacccaggagacacaugacccagaagacacgugacuugacuucaguuccaaauggacagguaacacguuguaaauacguaccgcauagaaaaugcagauuaaagaaaaugcuauaaucacucuuacauuucauuauccaucuugauuaacuucuuucuuuuaagcaugaauuuauaucucuauauauuauguauauauguauacauauguauguuuaugccaaaaagauauauacauaucugcaaaaauuaacauuauuccauugagaugauggggccaucccauggguacuauaauuuuucaccuaagguauauguaaagacauaagcaggucaaaacacuacuguucucugaaauaaugacaggacacccauucuauggcugcccuaauauuuaauucgccucucuguggcggaggauuagaucaaaccucccugucuacacggugacuccugacagcuccaucuuugcagcagcuggguggugugucccuuguaagguggcuguguuccuggcaggcagcagcccgcuugcuguguuccuauguagcguuugcucugagaagaugcuccauggaaacccgucauccugugucugccggcacucaagcucugguucccugugccaggggucucggugacaggcccuggggccagcagccuccagugagccccucaggagccacagccaccaccaagaagccaggcuuuguguccuugucuggcagcauguucccuccuucaagaggcuucaugcagcaguuggcauugucugggugucugguucucaucuguaacucugcacgggaccugaggugcggugucucugcuacaggcugugagccccaucuuugugaauccccagaguccucaguuuagcaauggaucccugagggccacugcucuuguccccugcccccagcccugaagauuuaauaauuggguggugugagguuuucuucguggugaaugucaaaugcuggcuauguucagcguucuauaccauaaaccucacaucucuuucuugucuggguccaacuaaaucaaacaucguguuuccucugcuugguugagauauacaaaccagauguaaucugccugcugagccaugggccguuuaacucagaaaugugaaaaaaaaaaaaaccaaaaaacccaaaacacuagaauaugugcaguuaucuaggagguucauauugucuauuaaacugcuagccaggccaagagcagguagugauaauggauuaaugcuggcuaaauggggacagaaaauaaggacaauaaugcuaaagcugagaaaugauacuggcuuuucauguguggauuuauuggguaucugguuacaagaugaggacuuaaccccagcaaagccuugcaagaguaucaaguugauauuucugggaaagguccuccgauauugucgccuuucccagcugugcucucaguacaaggcugagaaaagccccagcugguacaggaagcuucuguaugucuuucccuccaggcugacauacaucucucagggcugagcucagggcacgaccguggcaaggucagaaggcaaaaaggcugcaauuccagggagcccuuggaagauggagcguuagggagcuggaucaggcaaaaggaugagaaacucacugggaaaaugagaguuggcuaagaagucagucugagcacaugaaagccagacauggcgccugaggucaacacugaagugccagcccaggaaagcacguuccacgcguacauggugggcauguacugacacacaugucaacacacaugaaguucuagaagcucucagaggagcugugacauuuuagggguaucuauguagauagcaucuauguagaagguuuuagcuuaaauaugccauggggugcugggugggguggcacaugucuuuaauucuagcccccgagaggcagagacaggcugcucucucuugaguuccaggucuacacagugagucccagacuggcuagauaauaagacacugucucagaaaaaaaaaagugguggaagaggggguggaaagacuaagaggcagaguuuagaaaacauugcugcucaagugucuccugggcauggccgauauaccugaguaacgguaaucuacauucugauuaaauggucucuuuccuuucucuuuccuuugucuucuuuuuccuucuuuccuuccuccuucucuccccuuccuccccuucucccuucucucuccucuccuuccccuuaccccucucccuccuuccauccuuccuuccuuccacuccuuucuaggcuuccuuuucuuuuuagcuuucugagacaguuucacugugcagcccaggcuggucucaagccucccauccuucuaccccagccuccagagugcuaggauuacaggugccagcacaccagcccagacggguauuuuccacuccacacauuucauauaggcgaucugauauauagucuuuaaaauuacuuagcacaaugacuccuccaucccuguuguagcaugucucugcccuuccugcuuuuuggggguugcguaauacuccauucuaagucuggcucacaguuuccuguccuaugucagcugugagucaggacccagcaugcugcucuccaucugugacuggcuuuuaaaccccaaccaguuuuuugaggaaggacuuaaagugcuuuucaaauauauuuuuuaaaaguaugucuguaugccuguuugagucuguguuccauguguggguguccaaggaagucagaagagggcaucagauccucuggaauuggaguuacaggcaguugugagccacccaacacgggugcuagcaaccugacuuagaucuucccaaagagccaucuaugcccuuagccacugagcaaucuuguuagacaagauuuuuguuauaaaacuguuauuuuuauaacagucucuaguuacuuguuagcuaacucacaaaucuaguaaucaucucucugauccagucauuuaaaaaaauuaguuugugggacucugcaacaguuuaucugguccuucuguguaguuauuugggcucaaccaauucacucaacuuagauggguauuccaagugguugagaagaaaaaaaaguuuucugccaaaccggaaaguauuacaagcuauaaguaagaucaaauguaauauauagaauauaaauauaaagacccggaaguuuuagcagaggaagcuccacagcgcaugcuccuuuauggcgggaauggcuuugggucaugcaggcccuggauucccugaucugaucuuuuccuucggggagcuggguuuccuggcauggcuucuacccaggcuugguacucuuucaguagagacucugcucccagcagcagguggaaccuuuuggcuuccccauuccucugaagauuugccagcauggggugacgucagcuagagucaccaugggaccagagucacaggauuugguggggugaguugcagccuggaaccccagcacacccaccagccaugggacugcucaaccaggaccaaucugcccuguuccuuggcacagauacacuugugugcuuugcuagacaaggucucucucuggggcgcauguggugggguuuccucacaugccucuuauaaaauccugccccaagaauuucuucuugaaaaucuuaguaacauggcaaccugguucucuccuguuguagcaaaggaugggaaaauguaguaagguagcaggcgaaaaccuaacaggucagaguuagaacaagccaugagcacccaaggaaggucaggaauuacagagaccucuuuaucgggguacuacugugcuuuccuccccacuguguggaaguguagaaaggcuuuagugccaguagaucuugguggucuguggcuauggcuccagcuccaugcuugccuuggcaguggaaggaugcuacccucuucccuccacuggggcugcugaaggauuuauacaccagauuccuggacuuguggggcauucaauccauaaagggcuucucccucaaaugauuuuuuuuuuuuacaaacuuuagaaggaugaguuuguagagaagccuacagggaucuuucucauagaauaaugcuggcuuuuugagccagagggaagccauguuuuucuccccagaguacccaggacuccgagucaaccauagggugagaccuguagcaagcauuugccagacagaccuagaacuagguaggcucuacagggacuacucccacagcucaauuacccuuaagaacagcauagccugccacgugagacccacuuucucaugggcugagaaaacucuugccuucauagcgauuuucauguuccauuuauaucaugcugcuggagggaugaggacuuaacugaagagccagaagaagacaccagcaacuaagaauaugaaccaaaugccauaaauaaccaagcaggcgacuucguuuucuccaguggcuuucaugccagaaauggcugccuggcugaagcaaaccuugguugcguugcuggguggcgguaacuuacauuucccagauguucucuagcagagugcuugcuuguuaguauuucacuguagucucucgguucccagaggcggguaagacagucccguguuagcgugaagucaaucucccuuggcccuucuugcuuaaccuuggccaugugcgucacugcaguacucaaaguuuaucuccuacuucuuagaauuuuucuuuuugcauguguuauguggcgugcacgcauguguggguauacgugguacauggguacacacuuggccauguguguguagccacaagacuggcaucagaugucuuccucacucacucuccacuuuacuugcugagacaggaacccuugcugaacccagagcucauggauucagaauggucuagcuagccauccuagauaucuagcuuguccuagacauccaucccccuccccccuuuuacaugggugcugaugauccgaaguucgcgggccucaugcaugugaucuauucgcuaggcgcucuccccagcucucucuucuaauugcacaacaagaacgauaaagccugcuuguaggauuacugugcaaaugacaugugcuacggucugaaucaucccagcccugcaguuaagugcuagcucagugguagcuuuugcuauuacaaaaucgucacagacaauagaugagaaaggcaccacaggcuggagaccucaccccuccuccugggucaacaggaccagaguguaacagugaaccuucagucucugacgucacuccuuguaggcacccugugggcaucaggaauaugguggcgcuuuggcugcuaucauuugugguuccaggggcccccuccuuccaugucacuggcucaccccuucuaaaugucuggguuuuuuuuuuguuuuuuguuuuguuuuuuguuuugcauucacagaacaucaucaagaaagugaucgggcagaaguuuguguacaaguucgucucuuucccggauauccugaaaauggauccucacgcgguagagaucagccgggagagccuccugcugcaggacggcgacuguaagguguccccggaaggccgagagguccacaggcacggcuuguccucucucaaaagugccagccgcaacgaguaccuccacucgggccucuacucguccuucaccaucaacucccugcagaacgcuccagaggccuucaaggccaucaagacggagaagcuggaggagcccugugaugacagucccccuguggaagaagucaggacugugaucagguuugugaccaauaaaaccgacaagcacaucaccaggccuguggugucccugccuuccacauccgagaccgcugcggcagcggcauccgcuuuccuggccucgucugucucagccaagaucuccucuuuaauguugccaaaugcugccagcauuucgucugcgucacccucuucaucucgguccccaucccugucccccgacucuccccucccuucugaacacagaagccucuuccuggaggcagccugccaugacucggauucucuggagccccugaaucugucaucgggcuccaaaaccaagucuccaucucuucccccaaaaggcaaaaaacccaaaggcuuggaaaucucugcaccccaacuguugcucuccggcaccgacaucggcuccaucgcccucaacagcccagcccuccccucaggaucccucacuccagccuucuucaccgcacagguaagcacuauucccgggauccuagcuggaugcagggagaaccaccccuguucuccuugggagagaucccuuggccagugucgcaacaucacuguauaugcugagagagagaggcacacaugcggaaaggcuugguauccugguaacagagggauauuaccagaguaaccauguggggagaccucuagggucauggcauuugaggggggggcauuuaggccuuaggaaguuuuuaaggcauauuauuuuuggaggcacucauaagccaugugcuuccugauaagaaaaaucauguucacagauuaaagucaguauaaagcugugugggucauggugaccuuuaacaagaaacacaagggugacaugcagaaggaaagucccuaccaaaagcagggcugcuguggggaagcucaggucccauggggagagaagggaaaauucaugggguguguaagucuuagcugcugggagccccugggaaagguggccuuuuucccuucagaagugucacaguggugucugguucagcugccgggcagacagguugggugguuccagaucaaagcagaagcaagcuagugguagaagguggcagcguugggcuagauucugcuucguaggugugggaaaguggguaucugcuuucugggugaugcucuauaguaacaacacauuaggacggugggcaugcuacccuacucagccagcuccaacuggcaggcgucauuguccuggagcuuugaggcuccaugccagauuaugcugcagguggccuggaauucccagcucugccucuguccuugucauagcugucccugucaacucccaacaguagccaccaaauucuucccaugugccagacaccugcuccacaucacccaccuugccaccugugucauagcagcuucccuccccccagccucuguguagauacuguugccauuacaacugccuggcugagguggcugggguucagaggugaagugccuugaccuggauccaaagcuguaagucggaaggaugaguuuggagccacuuugcauccagcauccauccacucugaagcuaaagucucugccaucccuuggggagaagacccggccgcucuuacccugacaacaguccguggggugugcagaccagcggccagcaauucuuugcuacuuugcuuucuuugccaggcuucccaggggucacguggcagcuuauuuuugugaagugacuugaggaacugugcucauuucugaggagaggcccaggacuccgguaauagguuggaaugggcacauacacacucccaaauuagcauucccuaacaaagcagggcugccaggcaacaggcgagaaaccugccucucaaguagcagcucaggcaaguaagaagagugagagcugccaggcagaguccgggccuuaguguuuaagacuguaaggcugagagugguccaaagucaggccaaggucauccccgguuucggcgucuguguucucugugagccugcauccccuucucugagcagaguggggccgacaccaacccugucuauuucaaggaaaauugcuaccguggcuuugguccuagauaccgugaacucagugggggccugggauggcagggcaggggauaggaggagagggaccuugaccugagagagggauccuaacauguggacagagaguuaauccccagagacagaaccuaccagaguggccuaaaaccuagagagaaugcuuaggaagcuggacuucugggacagagggccugugcccucaggcacaugggggucaggcugacaggauacaacuuucauugagugacuacucaaugaaaggaaauccaauggggccuaggcuuugagagacagagagagagagagagagagagagagagagagagagagagagagagagagagagagagagagagagagagagaggggggagacacagagagacacagagagagagacagagagagagagacagagagacagagacagagacagagagagagacagagagagagagagagaggggagacacagagagacacagagagacacagagacagagagagagagacagagacagagagagagacagagagagagagacagagacagagacagagacagagucauagagagugagugagcuuggaaagaggugucacacaguuaguaaaagaggcugcuuagggacauaguguaaccucaggagcuaaaugccaccagagacuacaugcaccuggaauggugcucugcuccuaugggcuguggguagucaacugagagggagagaagggcaaagaucugguaaaacucagccuccuuucagccaucagugguuuaacucugaccagacaggccacuaagggguuaaucacaacaagcuuccuguucuacaggauuaggcuaugcuugaagucgguauaagauuuagaucaguaguaaagcuccgcccgacgccccagggcguccuccagaagcugacccauccacucuuagcucucccacucacccuuaguguucccuucuggggggcggggcucagaaacagaaugagcacuccuaagggagugcucacuucagagagggggcgggggagaggugugcucuacuaacccaguccccuguaaaugaggcgccuugacaagacauaucacaugaucacuguccuuucccacaugugucauggggucuacauucagauuugaacauucugucuucaauucgaugugcagaaagccagaacaaaugugccucucucacagugucagagccgccucccgucaggaacacuggcgaagccgcugacaggagcugcaaagagcggaggacaugacucuuggugcuaaguuuaugauaaauaguguccgggcagggacuucuccaacaaggggcuggaagacucaagcaaaagucagcuagguacagagaaaaaugauggcgucagagcucagccacggaggucccaucugaauguugcugaaaagcaaggcgcuugcuuguccccguuggcacaggcuaccgaauguuaggcagaggggaaggagcuggggugugaagcccuccuggccucuagccaggcaccuuggcagccgagguggcagcugaaacuccugacuccucugcaugcugguuucaucugucccucuuccugccacaucccaucugugucccguugcuccuguccccccaaggugaaguuaauucggaauccaaggcauuguauuucucauuucugccaagacucguguucgucucaccugugcuguccaagaugcugaaaucugagcuguuucagcacugggcacgcaucuccaucagagucugaguaugugcgccucaggcuguuugcucggcagccugggauuaguggcugaguggagacagccugcucgguuugaaaugcugaagccuacuuccucuauucugggguagcggagacagcucugaggccaagucagaaaagugggagucuggagcaguguaggagaaccuacagagugcgagcauccugucccccuacaccccacuucuggugugguuuccaucuuccugucucuugccauuaucaucaaaagaaaaacauuuuccccccucucccuucucuccaggguuguucaacuuccuucuucuucuguugaccuuuccccagacaggccuccaucucugaccaugaugaccuuuccuccaggcagagaacuuccuuguaggucucugcaguacaggcuaggaugguucuuggcuaccaaguuguagguugccccagagaaacaauaaagggagugccuuuucuccuugcgcccuggggucccaugcugcccccucuccucucuucuucuagugacuacucaaugggucauccaucucuucuggucugccuccaucacucucucccucucucucucucucucucuuucucucucucucucucucucucucucucucuauauauauauauauauaaaacuuauuuauuguguaugugaugugggcuagugugcacauauggaggucagaggacaacuuguaggaguugguucucuccuuccaccaugugagucccacagauaaaacucugacuugguggcaagugccuuuaccccuggcccagcuauugaaaauaauguugaacucuggggcgccauuuuuauggacuccguuggccucugugccacuuuuaagguauauguguaagggcuucuccuucacucuuccugaagucccaaugguuuccuagugucuccagcacccacucaagacaucaccaaagacaucuucucacugccacugggcaggccacacccagucucuucucugccuccuuucuaaucaguucacguggagcuagucacugaacacccaggcacuugcuugcugccucagggauaccaagauuaguauauagaugugguucugguucucaugagcuuacagcugcugcccggaaauaaagaauaggggucaaauauaauuucuggucaugaaaacugcccgagaaguugagacaugguuugauaggaaauuaacaacuucuagaggcauaagccaaguggaacacggaugccuuguaagaauuaguaaaugaucacugaacauaaauuuuugcaagacaugaaaaggaugggagaagugaucuauuuuacaaccuuacacugcacauaaauuuuugcaagacaugaaaaagaugggagaagugaccuauuuuacaaccuuaggaccuaucccugcugaaguacacacauacaugcacacaugcacacaagacaguuacauccuacagaggagaccugagcagcacaaacaaguacguuuggcucaguuccugaaaccugacgggagcacuccccacccccuucccguguaagcugccaggguuggcacuaggggcacaagccugggugguagagucccggaagcuaggaggcacaaacggaauguuaaggaagaagggaugaacuuguccagaggagugaaauguugagaguggcuauggaaggggcagucacaguugggugaggggcugagggaguggcagagaucuuucuggcaucuccgugcaggaacacagugggcuaggaagagcgugagauaaggacaggucuagaggaagaguuggaguuuaguuagaugggaugggauuaaggcagcaguggaaacacuggaagggcaugugggacaguaugaacugugugguacaagucacccugacagcauagauacagaaggggacacuguauucaguuaggauaccuugcaacacuccagcuaauggacagggaagaugccaggcucuaacugacacauccagaggaguuggaucugugagaaauuuagagaccgucagccacaggccuuagugacuaacuugaggggcgagugagagaugaauaggaggaugaugggaaggagccgggcgugguggcgcacaccuuuagucccagcacucgggaggcagaggcaggcagauuucugaguucgaggccagccuggucuacagagugaguuccaggacagccagggcuacacagagaaacccugucucagaaaaaaaaaacaaaacaaaacaaacaaacaacaaaaaacaaaaacaacaacaacaaagggugaggggaagaaaaggguauagaucugaaccaugguaaaucagggaagcuaugcuacauccggccaccaacaugagggaauguuaacaacccugggaacuguggcuggggagggagggagguuaaggaguuguaaaucuaugaaucucucugugauaagcccaggacacauaaugccaagcaggaggguucucagagggaagugacgauguguuguaagucuaugggauuuagcauuguggcuaaggaggccguucccccccccccccgaaaaugaacggauuuuuuugaaugaaguguuguagagugacuacauggaauuguauccuggauaggggaugugaggcagguagacugguccaggugacuuguggaaugucauggugguaagcugacuggaucuaaaugcugcccagaaggaaguagagagauagauugaaaaugaguccaaggaagguaguguuucugucuuggugccugggaugcugaguaguagguagggccaugugugccagaaaucaugucuuauuuuguucuugcuucugcaaauauuuucggucucaguaaguaaguauguauguguguguguguguguguguguguguguguguguguguaauauauauauacacacacacacacacacacacugacauaaacugcugauggcacucgucaacagaaacagaagucuuagaagagguggauuugaaaaaugaguucaguuuugaacaugcaggucauuucaggagaagaugaaugaaaaauaaagaaauaaaaggaagagaacacggucacuccugauggauggagguuuuuuuuuuuuuuuuuuuuuuuuuuacauuuuguaaauguagagaaaacaggcagaaagaagaguccaggccgaaccuggcccgcagacaaaaugaccaugagaggagagauggggagggagagaggagccgcugaccaagagaggcaaucgggagaccaguguugccaaacugacugaguuagaacaggaaucagacuggagggugaaggcuagggaagaugggaagugaagcccaggcccugggagggaggggcuuagggcaggggaggagccacagguacugagugagacuuguccuggguuugagaccuucgccccuucuuagaauugggaacaaaacaccccuggaaggaguuacagagacaaaguuuggagcugagacgaaaggauggaccauccagagacugccccacccggggauccaucccauaaucagccaccaaacacagacacuauugcauacgccagcaagauuuugcugaaaggacccugauauagcucucucuugugaggcuaugccagugccuagcaaacacagaaguggaugcucacagucagcuauuggcuggaacacagggcccccaauggaggagcuagagaaaguacccaaggagcuaaagggaucugcagcccuauagguggaacaacaauaugaacuaaccaguacucccagagcucgugucucuaguuggccaucguugggaagagaggccccuuggucuugcaaacuuuauaugccccaguaccggggaacaccaaggccaagaagugggaguggguguaggggaguggguggguaggggagugggugggggagggcauaggggacuuuugggauagcauuugaaauguaaaugaagaaaauaccuaauaaaaaguugggggaaaaaaaaagaagucagacccgaggaaggcgggcacggaguugaaaaguucuucagcucaucgagcacuggggguuaagaacaacgaacaaacccuccaacggccaugaaaagaggaaccagaaggaugugcacaguaugagacagaauauauuuaauguuaaggggugaaaggguuccauaguauucuaaagauucagcaaaaaucaaagaaaucauaucagccugaggguagacugggggucugcuuccaggugguggcauuucugacgggcagagagagacaggaguagaaaagguuggugcagacaacacacagcugcaacacaucuggaugugagucagcugcucucguuaaaggucacagguauacacucucuaggcgacccagaauuaaguggauuugaauggggaggaagagaaaggagauccuagugggaaagcccuucuugcgugucuuuucacugacaucaggaacaacuguagccauuuguuaagccaggcauucccaggcuccucaacagccccgaaaagccugcccuuuacaggcgguccucccuccaggucaggcagagacaccuuggaggcucugcaauguccugagauaacccaggcaaagcucuuuaggaaguuccccuuccaaguucccaaacaauccuuccuuuaagguugcaggaucuccggcgagaacugcaauuggaggaggagugaaugaagucauuucacaauguuuauuugcauauauuauagaaggcauuucaaauguauuaaccaugagaaacagaaggccccugcauucuaugugcauccuguauuccuuggaaacaaaugugcaagcgccucagauccagaggggauguaaacgguagauccugcacuuuacauauuucccagacgugugaguuuguggccuuggaugagaaaaugguagcugcccuuucugguuuagaagacugugccugccgacuuugagaagaaccugagagcacugacccugguuauuaacuguuaauaacacugugguuugaaccuggcucuaaaguaccucaaagcaccugggucugcggacuagggccuaaccuacccauacaaguuggauucccagaacuuuuuagcacccaguugagaauuccucaugaauggauaaauucuauuuaaugaguaugucugguacauuuuauauuuauuacugauuuacaaaaugaccugagucucuuagacuugacaucuuuguguauuggucauauauauacauuauauauauacauuauccauacuuuuauauaauauguaaauaucuauuuauauuguaugcuguaauauauauaagguaaauaauauauaaaauaauguguauauuacuauauaaaacuaauauaauauauaguaauauauuaagaguaucauuugaauuacauguccuugcagcaacccugcaauagcauacauuuuccuuucccccaguugacagauuaagauugaggaccagagaggcugggcuguucguccgagguugucuagcuaaugagcagagguucugaacaugggaacccugucagagcucaugcuuacccauuuauuuuuaaccaugaggccagcuggccuagcacacuugugaaauugccuccaacuaggaaaaaaaaaauggaucacuaacucaaaacacguauuuauccuaguaaccucguaggccauucaauauguagaaggaaaugccauggaaccaaagacucaaagaacuugguuuaaaucuguuuaccagucagcacuucggcuggaagaccacuggauguuugucucucucucccgcugaacagagcaaaccuuucaauuuagguuuaagcucaaaugcauuugauaauuacagaggcugccggggccaguucuaggaaaaaauaacacggcggcauccagcaugaugcaaucuuuaaugcuggcgccuuugcuguguucuuacacaaagagucuuauugaggggcuccucuggucacuagaggugcagacacccugggccagggaguuugccucugcugagaagaaaagccgugcagauuuacuggcugggacggcuuguuucuccugcccuuuagcuggcuugugggccaggccuccugccgagugcgggcaagcaaaugccaguccgucacuucuaagaaacgcugcauucuggcuccacagcccuacuuucccauugccagggcaauggauuccucccagccccacguccagagugaaguccgcaagaucagcucagggcuucugaacaagcggcugcaagccaugcucauagaauuucaauuauuacagggcuguugauaauggggcaugaugcccaagaugauccuuuuuacaagcauguggcccgugggcggggguggggggguguuguaaacuuugggugugaucgcuguccacuguggcuaaacaguuugauaagaaacgaagccccccuuccagggauccuauucagucuauacauuugucuacugggagcagggggaagggacagaaggaacuguuugacaaguugcuacaaaccugacuuuuccaaccagaauguagcuugccuaagaacugcacauaaaauuaguacugagaauuaagcuacuccuagucauguggagagaacuaaaguugcccaguuuucccgagaaggcgaggcuugguucucacacacugaccacuccgcugcuuuuuggucauggcugguguuaggugacccccaaucaagagcugccuguugccuugucuucuagacaccaaguggacuguuucuggccucgaguccgcugcugcccagcauacacuucuggagcagccuuaguccugucgccccacugaguccugccaggcugcaagggccgaacacacuuuuccagguaagugucugcaaaugagcuuuuaaacgcgagucaucuaacggauggcuuuucucuaaauuccacaaaagcucucucugacgguaccuucugccacugagcuaccaaguuaaaaguuuccaaggggaauuccuaaggauuggguugaaagucauuuuagagacagacauuucuuuucucugaggcagagaagagguucuucuaucaggaacacacacauggauucuuuaaggguucuggauacuuccacgugacuaggaaaacuggaaauugacugcaggaaaugauuuaaaauuaaaacaugauuuuuauaaaagcucuauaagagacuuuaaaacaggaacccaacuagucaauagauucacaugaaaaaacacugaaaaaaauagaaacagugaacaguuuucccaaacuggaguagaaacguuacccgcaucauucuacagauuauaaucaggcuugaauuauguaacaaaauacugugcaacauaugguuaaagaaugaugaagcugagccgggcaguggugguguacaccuuuaaucccagcacuugggaggcagaggcagguggauuuccgaguuugaggccagccuggucuacaaagugaguuccaggacaccagggcuacacagagaaacccugucucgaaaaaagaauaaugaagcccucccugaguuaggugaacacauucauuauccauucuucuucuggaauuuuccaggagcuuuacucaguaucccauggagaucaguaucuccugagucucaaagauugcuacacaccaauagggcauuacugucuugaggaugugaguucaggcagggcaggaaugaagcaaagguagacgccuugcuagcuccacgcuccucucuagcuuggucuacccagccugcuucccuuggccuaggaugcucaccccaaacuggcugucgcuccuuauucccacgguccuuaacauuuuacauuaggacuacccauugaucuggcaaguggacccccccccaaaaaaaacccucaaaaccauaaccuguucacugugcugucucccagcuucuagcacaucaauggucacacacaugucagucauuacugauagccuagugacaagaugccaaagcacacaugccaauaaaagaugugaugagcuccaggcuguccucuaagguggucacuuugcuuagcaaggcuaguauuugcugagcaccucucugcaagaacaccaugucuacacaccaggauuuacgagcucucugggaggacggagcagcuucggagguuuagauugcuauccugugcuucugguuuccuggcaggcuuggaguagggugucauggugggacuacucccuggaguaauugaguuucccucucucccuggcccugagucccagcccagcucacuucugcucagacacagugaacauguugguggcuaccauuuuauccucaaguggcacagucuaguagaagcguagugggagggagcugucugaauacaucaccccucgugggcaggaccgcaugaguauggagucuaacguggagcuucugcagagcucagugaaugucugaaaaacaaacagcuucucaugucuauggguuuugcgaguucugccaucugauugguacagagguuaaagaucuuccaggaaagccacaaggaaccaguggaacuuuguuucuauuccaguauucccaacaguaaagagaguucauuuccacaguggguugacagccaggaucucugggagcugggagaaguccauaccacauagccagugguucugcgaagccagcaugcaucaggguugcauggauauugugucaaguaaagaugcuaggcccacccaggggcuucugauucauggggucucaggcauggucugauaaaacagucacacuucugauaauguucuaggaaacauuaggaaccacauucugagagccaaccgcuguagacuagggguuccuaauuuacauuuagaauucugcagacuacugcauacaaaggcugucugcaaagagguucuauucuaauuucuguaaacagaucuguuuucaauccaagagccauucaaaaaccagccggggagguugaaagggggccacagcuuagcuuggauggcugagagguugcauggccuggaguucacaagugauggcuggauccaugugcaaagggaaacaacucugucccuuaaaaaauauuauuacccugcauaaaaaagagcaaguggucauauaaaaguuggagguggcaguuuuaaaaauggcaaacaauaaacuuccucagaggaaugagauuuccaaugaaaaauaauaggacaucgacugaaauggauuucugggaauacagauuaccacugagucccaucaaaaugaauaaaaacguaagucucauuuacauacaccggguguugguaaaugaaagaaaaaucauaaccuacagcacauuuugagcagagugggcauguguccugugugagcuuuggaaaagcaaaccgaaauccuuagggagggaguugguggagcuaaggcauugcuacgcagaucuccugagacaaugaucugcuugucugucuaucuuagaggaagagugaugggcacagggucauacacuguagaucuggcuagcuuggagcuuacuuuguagcccaggcugaccuuaaacucacgguaguccuccugccucagccuccugaauguggggaugacgggugugcaccagccuaccuaaaaccaugcuuauagcagacuagagcagauauggcagaauuucagcagagagagaaaacgacgcacuacccuuucuggaagagguuauguuuucuauuugcaaaguguuuuagaaaagagagagagguaucuaaggcacuggccgagcgugaaucuagagccugaucuacaaacacacuggggcauaccucacaggcagguacauguggaaaaaggguagaggagacucgguuuccaacugagaaugugcucgauagaacauuuuagcuugacacacuuuuauagcuguggugggagcaaagccaaugaaccuucuguggggggaggggggaacccaagccaaucaggacaaguauggcaaaggagugcacagagugggcagcaauccauccuaacauauggaaaaagcugacacuaaagaugauuuuuucauaggcaccaguaaaauggggggcagggggagagcgcgugugcgcuucugcaguucaccugaagucacuucacgaguggggcuuggcuuagaaagguuuaagugcaugcagauagaucuaggaacuggacagaaacaaagucccccaaagcuccaggaaagacaagaagccccuacauaugccaguuaccauuaaaucaauuaaaagaggagcugggccguuuaguauagcuggugauuaaaaacuuacuuuugcuuaggagcuaugaccuugagcuagucagaaccuccccgaguuguuugucucacuuacaaaguggugauaacaaagcuuacuuuauacucuuagugacccaaugaaacagcggccccugagaggccaaggcguucaaauguguuaccgaaauaguuuaggggaaaaaguauguacucauucgacaaauauuuauuguacuucucgcaugugccaggcucugccguuugauauuuagugcucagguuuaauauuuagcuuuccuggacuaaacagggauuaagcuacaggaggaccggggggggggggggggggagguccacuggccacauugugucuucggcagugcagaacucgagcugugaguggacagucacauaugacaaggaugcucuugcucacccuucuucguacgggaucacagcugaaauaucugucccacuuaggaaauccagcgcuuuuguucggcuagcuaccaccuuaguuaccaacaacacagaaaucucacuguuugccugugcaagggcgaccuaaugcacugauaauuagaucagggaaaagcacucucaaaccuccaggaaagaauaagaucaucuuucuuuuagaaaaaugcacagaggccaggaccacacaucuccgggcgcugggauagugcugagccaugcgacaugggugcuggaaucaggcucagcuccuguccacagagcagucaguacuguuaagggcuaggcugcuguguccagcuucccgguccucguuuccaacaagagcggacaggcgucucuguugugcugugggaaccagacagcaaauuucgaaaugugagauuacugacccauauguaaaggaucuugguuuccaguuuuaccccuugauaguuagaaaaucagcaaacuagcuuagaaccuuuaaaaaaaaaauagcaguagacucaacuucacugcacaugcgaaggacagguuaggaccuuuggcacacagaauaggggcauuuucugggccccucucuguugcucuagguaaccuuuguaaagcaacucagcagccaacucccaucacugggcucagggaacaacauccacgggugggucuaugcauuaaaggcaagcaagcucccgaauggcuuugucacaguuacuaaaugcucccuguuccuuccaguuccccacacugcucaacggucacaugccggugccgcuccccagucuggacagagcuccauccccaguucugcugucccccagcucucagaaauccugaugaugggccaccaacgucacugucaucaacuaaggacucagaacagaugacggaugaugccaguuuguccccaugggcuaguuuaccugugucaugagaaggacauugugaaaccugguucauuugguuugcacuuuucguaacauggauaaucuagauguauguuagcauuuuaaaacaaaaguuuugucuuuuuauauauauauauauauauauauucagcucucuauaaaagucuguuucgcauucagugaauuuuaauguuugugguuuuuuuuuuaaucuuguuagcucuggaguguugaacacugccagggaggagccuuucuuaauguuuucaauguaacuaaugaggaugugaagccuuuuauugcuuuaacucuacauaugcugaacuccgcuugcauacacgauguaaccagcugugccuuccuuugcauuuaguguuauguacaugaauuuauguauuucuaguauugagaggaacuguuugaaggacaccuuggcauccaacagcucuccguagaggguuauuuucucacguagacacguucaagugaaccuccaucgcgguaagaacugccuuaggaccucuucggaacugaaauccaguaauguccaagugauggguuuuuauauaagaaugaacgaagccauauuuagacaauaaacauuguuuaaagaacauguuccaaagugcacuuuuuuaaaagaagaacuuugagagaccaagccgcucagccguuuguagaagccuuucuacuuccugcagaagucuggaaugcuaaggcuccguuaaguucacaccagccaaacucucaaggggacuuuccagguuuguauuuaauuuugagacuagcccugcucucuucauuuccuacaaccacaaccaucugguaucuuugucacuacugggaguuaagguuucuuuagauuccuggcaugacaauuaauauuuaaaaccuaauguuuuagggcugaggauauagcuccauagaauguguaaccugcauguguugaggcuguggguauaaaccccaguaaccugucucccugucucuccccaaaaagggcguggugggaaacaaacuaagaauguuuuggaagaugcuuacagauggugaauucaaacaaagaaauguuuauauacuaccagccauguauagagauauuuccuguguguagauauaauuuuugauggauuaaauccaaugcauuacuaagagcuggaggaacugaaggccuugcuucugaggaugagcacucaagagccaccgcuuucgguaguaaugaugaugagaauaaagggacucugagaaggggagacuugucaggaucucccucugaaacggaugcagcagcuccucagaugcuccgcagggaaggcuucacgugcugaguauggcuuccggcugugacgcgagcagccucucaucuggugagacccugaaggcagcacaccugugcuuaaggggaaguucuacuguaacacucugaaggcaaggcacuuuaaauucaagaucaggugagcugaaacaccacucaucuauaaguauuaaacaaacaaacaaacaaacaacugcaaugugccucuacagacuagauacuaaauagaggauuauaaggggguuaaaaaaacaaagcucgugcaaaaaauuugaauuuuaaacaaucuaaaauuauguuuagauacuuacacauugagacuuacuaccgaaguugacuuucuuucuaaggggcaugugucuuuacuaaggggagaaaaaaaccucugacuguaaagccauggagacagcuccaagcccauaaauagaugcccugccacucccucacggcgaagaauaaauguguacuaaaauaaaaaggagcugguucaggaggcuguaauuaccgaacacagugucagagcugggaggggcuuugagagugcuggcuuccagcuguucucuggucaagacaggcacacaggacaggggugguggggguggagaagcuggccuggagcugccuggggccauagcauccacugagggaagaguaagagagccucagaacguaaggaaacguaagguuggaauguuuaaaauggcuagaugaggaugcauuugaugugcaagagucuuaagaagaaacuaaagggacugaugugcagggaucucaacaagaugaccuucugucgaccuuuaaacuauaaacgcugguuggaaauguucccaugacuguaagucugccuguugauuccuuuucuuccaacuaccaugauucuccuguggacccagaugcuggcaugaggacuguagaauggagaacgacagccucucugccuucuguguuuuuaacaggagaaauucagccggaacguaggcucccaagagcauccccggcucucuuuucuaugcuugcgucaucaguguuugacugcugaggcugagugagguuggagcucuagaaccucacugugggagcugaacuccgucccugcgcacagcuuuccuacagcugcagggcuuccuccgcggccacacgggugucguuuuuacuguaauacuguuuugcugaauaaauacuuuguaauaaaagaguguuuggauucgaggguguuuguucccuuccauuuacuuacagugacucaaauaccgcuucuucugugucaacaagauggguaaauauaaguuccuaucucuacauauggcacaucaaaugcuuuacauacgcaugaggauuauagcgcaguagacaguacuuaccuagcacaugugagacucuagagcccacuacaguacaccccaccacacaccccaccacacacaccccaccacacacc

SEQ ID NO: 5702 - RNA, 31585 nt, Mus musculus
ccuuucccggggugcaccgcgccaucuacccucugagcuucccuccgcucucgggcucgcggugaaagucuggcgguagagugucugggugcuggcugacgugcggcggaucucccacaaccaugcccgaggucgcggauacuugcuccuuggcuucuccagccucggucugccgaacccagcaccuccaucuucgcugcagcgucgacuucgcucgccggacgcugaccgggacggccgcgcucacgguccagucacaggaggagaaucugcgcagccugguacggggcgucugugcagcgccgcuucuccggggccgcucuccucccgcucuucgccccugcuccccgcgagcccugagaucgcuggccuucccucuuguaccucuuucucagccccacuuuuacaucagcacucucuccuucgccuuccacguaugacggucuccucccgcucccuccccuuuuccuggacacuuccuagcgcccgcuccacgccucgccccucaacccacucuugggauauuucguccuaccccccaucgcaguccccucgcuuacuacucccaaccuuguggcccccuucuuccuuggcccacuucccagaaucccccuccccaggccccagacuuugccagccccccagcgcaccguccuuacuccgcaggccaccccaacucucagauccaacauccuguguuucaagccccuuaggauucccugcccuuuccaccccguuuuagguuuccagugucugcucucuaagagcaggugcaacccuugcucuucagagacucuuccugccuuugcuucuuauugcgauuaucuucugauaguuuaaggacaggugguauauaguccagcuuucuaaggaugacccaaugcaauuuuuaaugagguguuccaaggagcaagucauuauugcacuuauuauaaaauauguacuucuauaaacuaaccauuugaauaaagauguauuuagaaucaugaaacacacaaugguuugaucuguuucauauagucaacagucgguggucuuacguugucugaugguauuagauggaaccuuuuccuugaggagaaaagucagaggacuguuuuagaaauaagaggaacaugaaaagaccggcuguauccagccugcuaacuagccaguguugcagcguuguaugguuaucucugcugaaguaugucagcuaagcaaccagggcuggaauuuaggagugaaauuaacggggucaauauuugauugaauuagaaguguagauaagaacgguaauuuugccucuuaaaaaucuuuuguuguuguuugacuuacaaauacuguaagaaagaaaaaacgaagccuuaucggugacaaaagaggcuauuuccuuauaagucaacugcacuuuggucucgaaguacgguacuugcuaucuuuuauugcaggggcagcuuugccccaacaggacagaaguuuagccuuuggacucaguuuccuuuuaauaaggaaaauuuugcuugcuuaucagugcuuccuaugacuguccgcugcccuuuaucuguagauagaaagcucuaucacuuucugcucaucgaggaggcaggaguuaggaggcuuaaguuuuuaacugugucccaaucuuuaaaguuauguuaucuucacaauccccuaaacuacagaaaaguaagacuuggaaauucugauuucugguuggcauaucuguuuaguaaugcgauuggaauuaugaugucccguucucuucaaaagagguuauuauaguacaaaguaacaucuguuuguaauuguuuugcuuguuuauggcaacagccagagaccaaaugcuugguacuacuuauauuuauuugaaguuggcuuguuucucucucuuaguagauuagggaucccuuucagagacagggucucucuauagcuuauauuggccuuaaacccaauaaguagcucagacuggccucaaacuagugauucgccuaucucaaguuccugaguucugggauuauagacaugaaccacaacuccugacauagauuuacaguagaaagaaacugucuuuucucucuauaauucagauuccucguguagcgcuuggcaugcagaggacaccgagggacugauuuaauggaacaaauccaauuagaaagcaguacuuaaaccuaauauaggcuucauggccaacagugcuguccgcaucccaaagguggcaugacaucauacccuuccaccccuggcucuguaccagcaccaagugacgagagagcaggucuucuuuuccaugccuuucuuggagucugugaugguggggccgauggucccucuaagaggacuaagucccaccuuucuagaagccuuucuaguuuuagguugcuugcacugaaccuugguacucagaauucguaacuuccaagcauuuguuuaccuugaaauuuccaguucuguuuagguguucuguuaguggccuagaggguuuugugucacgggucagccacuagggaauggagggagacagguauugagucuuccugcuguucagguucugggugccguuaaauacaguggcugagcugaagaucacauccagaugguuuggaguuuuaguuuugauuucauuccauaugcucuuguuuguugguuuguuuguuuguuuguuuguuuucucaacgcagucuguggauaaguuuaaaaaguaggaauaugguauagaggcauaagccucucucuauccaaaccugcuuuuauuuagaaagaacuugguucaggcaaugguggugcauaccuuuaacuccagcacuccagagucagagacagucaaaucucugaguuugaggccagcucuggucuacagagcugguucuaggacagccaaggcuacacaaagaaacccugucuugaaacacaauaugugcaaaaacuggccauguaguuuugugauuuaggguuugccucgcaugcaugaccccuugggucucauccuuaggaccuggaaaaguaaaauuaaaacagcauauaugguauaauauuuuuaaaaggagucuagaagaggagaguaaacgcaaggcaguugugugcuauaaaguuggcauggaacuucccaacagccuaugcaaaaggcauaaugacgugacuuacauguguugcaugucaucuguucagacguacagagcuuuuuuguguguugucuaaagagggacacugugacaguuucuuaugaugauguagguagcuuggcgcugugcuagucggccggcacucaguuaagugucugccagaaggucuaaugcggacgcuucaguuacccgguauccuuuauuuugcuacuacaguuuuuagugacagugaugguuaguaacaugagcgaaauuugaaggggaccuucuuguaauauuuggaaauaaagguugagguuugggaugggcucgguagcuuaaaauuucacuuucugucuuguuugguguagagcuugcuuuguggguaaguuguuauauuuucagauacugagcuacaaccauggggaugcaaaucaagguaacagucucuuuaagcauccccagccauaguauaauagugcaguagaugucguuugagagcgcaaggccaacuauuagaacaaucaggagaucggaaaggagcuucgcacaaaguagucaucacaauagccagcucuucugauccugagcagauucgaaagauuuaggcgauacagaaaauaggauguguuccauugggaaaugacgcagcuaauccaucuuuauuuucuuauauuuuugguugugagccuaggcuuuaauggcugagccaucucuccagucccaucuuuauuuucuuaaagucugauaugaacagagauauucgaauuauauucuuaaaaucaauuccauguucagacaaaaaggaauuagaccaugaagggacaagauuaauuaauguuaguaauaauauagaauuauuaaugaaaucauauauugugaauaugcaagugugaaaagaugagccaguucugguugaaguaauaguugggguaccacaaaaaguaauuugaaagaaacaauuguccucagaacagaaguggauaggacucaggguaaauuugaaacuaacuacucuuuccccaaauaaaaguuguuggugucagagaaauggaaaucaaaucuagagaucuccccuggguccuauuuuccuuugacagugucuuauguauccccuguuggccucauucaguaggaagccaaaguugaccuugaacuucucauccuucugccucuacuugcugagugcugggauuacaggcaaccaccacuccugguauguguuggugcuggggauggaccccaggauuuucaucaugauaggaaagcacucagcuaacugagcuauacccucagccucccugugacuuucugggcuugucacccauuggucuaagggagguacuggagagucucuaagagucucuaagcagucuaacuuccgauccuuuuccaggcucaucagggacaggaauaaagcuuuggaaggcagggagaugagacauaguagaauucuaacugcaggguuaggaccaaugauggugguggugaauggaaagagaagagaguguaaaaacaauauaaagaaaugacucugggacuuaggaaggauuugagaccaguuuguggaucgugccagacaaauauuugguaccuucaggaguucuaauaaaagaugccagaggagggagcugacuuguuuggggcggggacgacacagugauggugucaguuuuagaagccuauuaagugugaggugguauugccugggguauuaggcaguugcagauguccaguuaacaucacaggaaaggauacaacuggcagagcaggguguggugacauaucucuauaaucucagugcacauaguaggaaugcuaagacaagaagauugcaaguccaaggccuaguccagccuucaugacaggacccuauguugaaaagcaaacaaaacgaaagagucuggcugaauaugugugugggcaugagcuagagccagaggaccaaggcuuacauuggguuguaccuguauucagggauuaaagagaagagaggcaggacuguaaaaguagucagagaaccauuuucacggagagucagaauccacugaggggccgaguggccaaacccacaagagugaggcuagacagugguuaaguuaccagaauagaucuuguaggccaaggagacuugugggccaaggugcuagaagccaguaaagagggggaggaaaugaugggaugauggaagcagccaucuucgauugcccucaguuuaaaaaagaaaaaaaacaaagaaaaauagacgaguuaguaaguggauggacagagcagagucuucacaguacugugagaggcuccguuaggcuguugggaaacagcuuggugguguaggaagguugaaaauucugaaagaagagcuuaguuggacauagugaaaguauccuaagguuucuaaggagauuaccaggaugggaacucagauuugcugcugcccaaggccaaaguaaguaggcaugguuguucagcuuucugcagacucagccgggcagcguugccuuccaaggcugaccuuuguuuagcuguauaacaauagugccuagugagugccagcauuuguuucaauuuggggguuuacaugguaggaguugggcucuguguuuucuuccaaagaauauguagcgagauguuaauaugucaaacugagucacaggugaagauuuuuauaacagagaauuaaagaauuaguccaaaguauaugugagcaucccagaauucauuauauaggcaagucccaaagcuccaaauuuuucaaguugcuuagaauguugaaaaguuagaguccuucacugcuguugacuacuuauuucaguuucgcuucuauuacuuugauaaaauaccuuggcaaaagcaucugugagggaaaagggguuccuuugacuucuaguuugagguuguaguccaucauuacugggaagaaaaggcaggaauuugaagcagccguuacauccgcagcaaaaagcagagaaugacugaaugccuacuuacuugugcucagccccaucucuacauuuauucaguuugcauccaaaccuagggaaugagccacccacggugggggcuggggggggggcucuucccaccacaaugaauacaaacaagacaaugccucacagacaugcccauaggcccaaguaauccagacaaucucuuauugagauucucuuccugauucuagauugugucaaauugacaguuaaaaccgucauacaucugccuuuaguucuuaguuucaaucuguuuuacuuucuagaaguagcuaguuuucuccucacuguaauaaaccucuagguaguauuuguucugaucuguaaaacuaucuucuuauuuaauuugauuuuagacuuuggacacaaaagaccucacaauagaaaaaguggugaucaauggacaagaagucaaauacacccuuggagaaagucaagguuacaaagggucaccgauggaaaucucucuucccaucgcccugagcaaguaugaaugcuccccuccuuuuaugacuuaaguaauggcaagauauaucuuaaaagaagucagacgucuuucccguguuucuaauauuuguuuguauguagugauuggcgaucacuucuguaauccaugcacauuggugcuggcagugaaaaacgguaaguucuucagauccugcauaaauggagugcaugaggcacuggugggaaggacacuggguaacguugcuggagccgcccaucacuucacuggugucugguggcggggagcaugccauuucuagaggaccuggggaauacgugaagccacgcacucucugccucugccccagaggcuggccacugucacuggagugaucauucggaauguagggaggcugacuuccugccacucccagugucggugcuuaaagggcuccuuuaguucucuaagccacccucugccuaggagcugcacuuacagacgaggaaagcgacucauggagaaagucgcucauuuaagaaaaaaaguagccaggaucaucacacggggaguguaccucacuccuugauaccuggggggaaggagaaagaguagaaaccauuauccugaaacaaaggugaucugcugccaucuuccgauaucuuuaugccuucuccccuuuaagaaugagaaaagaaacccaagcauagcaugggcgacagaaucauuuauucuacaggugaagaaacugguagguugaggucaagucguugaccuaguguacagugguggggucaggguuucgguccagguugggcugccuggcuccaaagcucuugcuccucccucaucaucaaaguuucugaaacucuaggaugaagaaucaguuuuugucuccuguagucuaucacagauggauacuuagaaaaucacuguguaugaauuacuuagaggaagagguuuuuuuuuuuaaaauuagauucuacagcuacaaaaaucaguacaagcuucuuucccuuggcgugacuuaucaugucacccagcaucacugggcugggucacaugcugccacccaccacugagguagggugaugacauugguccucccacauccccacugucacagaaaacacgaucacagaugcaaaguacgugacacacugugggccacuuggcugauuaucaccccaucauguguucauuaguaugagggugagaggaaaccucaggcuggcauccaagcagcaaagagucagauuuaugugagcugcgguuucucgaacucacgcugaaccgaugagaccucggagagcgcucgugcuguuguucccugugcguguucugaauacaaauccugcgaggugugauuuauacuccauuaauaucuguauuugucucgugcagaaaucaagagaucguuauagaaauuuccuuugagacaucucccaaauccucugcgcuucaguggcucacuccugaacagacgucagggaagcagcauccguaucucuucagucagugccagguaaaagaaugcucagagacgcugggaaguucccagcaugcgcaggcccuguggacaaacacgcucuauuguuucguauuacauagagcgacauauauucucauuuauaugcugcuauuaauacagcuucuuuuaaaagucagauuucuuuaauuuggaaacagcccaucuaaauggaaguauauagggcuuauucauauuuaacuucccaaacaccuagaguacaaccugcccuugaauggggacucagugaauggcccugaaaugcaaggagaauucaguaagcaaaggccgccauguguguugguugcagaaaggcugccggugagaaagagaacccugaaagacugaguuccugauugugaaauauauuaaguauacuuuuuaaaugacaugauuucaaacacuuccaugcuccauuuuaaagcuagagauaaaauacacugcaguuagagguagucuguuacaaggauaaauaaaaaaaguccuaguuguguuaauaaucaaaucaccuaugacuaaagaaagccccucauuaaacauuuccucuauuucuagacaucaggucagacacucugccuguuuaguuaucuuaacaccccugugugcuaacuguacguuaaacucaagugcagcuuuaaauacguaaaguaucaaagcaugccuuaaacauacuuacuuuguaggacacugcuugaaauaaucuuuuuaaucuaagaaaauuacuuggaagagggcuggggcuguagcuaaccugaagccuugggugggguccccagcaccccaugaacaggcuguggcggugaaugcuuguguucccagcaucugguaaguguguaaaagcagagggaucagaaauacaagguugccaggcagugguggcacaugggaggcagaaaugggcugaucucugugagcuccaagccugccuggucuauagagucacuuccaagacagccaagguuaccuagagaaacccuguuucaaccacuauucucccccacccccaagguuacaagguauccuugguuacauagcuaacuggaggccagcacuggcuacaugagacccugucucaaaaaaaaaaaaaagcaaacucccaacaccccaaaacaacaacaaaacccacagaaaaugacuugaaaauggcaaaaaguuuuagacaagaauauuacgagucauguacgccguauuacuucauaauaguugaauaugaaaucggcauuucucauagaauugucuauaagguaaagcuaacaagaaauguaaugcguguaaaucccaagaaugucaaauuuaaauauauccuucccgguuuuuacuggcagugguguuuaaaguacaggaaauggauuaagaauccauugcaguugcugggagcccugcagaugugacuuugaugggugcuuucagcuguuguccacauauuucuguacccaaguugauuugcccagugaaagucaucuagaaaugcuguaguguugccaggacaccuguccacagccuggugagaaaacucaggcggugugcucugggaaccuaccucaggagaaggaacuaguuaguucuuugggcaguacuuuaucccaauauuaaauauauauguuaaaauauguauccauuuuuauuguauguuuauggcuguuuugccugcauauaugucugugcaccacauauauguagugcccaagaaagccagaagagagugucuuuaguuacagacagcuguuagagggcauguagguguugacagcugaaccccaguccucugcaagaguaacaggugugguauuuuuggugggggugggguguggcuagguagggaguguuaauagugguagugggaguuucaaaaccggguuucucgguguaucccucccuggcuguccuugaacucagcuccuccagccucuucuucgggaauguggaacuaagggcacgugccaccacaccuagagagcuaugacauuuccaguguguuuuaguaaucugaggaguuuggcaaguuuuuauuuuauuguuaaaaucagcacacaacguauuaugucacaucucauuauggcauuguuuuaaacgaaauauaucuaggagagccgagggauuuuaaggaaucccaggauuuuuagcccuucagagagggauguuaguaugaauucucccucaagcacagcacacuguccugcugaaaccuagagucuuugcuuggcaagagccgaucagacacaggcagcuuaaagaaucgcagagucuaucguguccuuucuuuguuggagugcuguuucccacagacggcugcaagacagugugauaagcaugcaaguuuguuucauaauagcgcaucuuccccucagggcuccugugaguuccucuacagauguaacugucaacagugaugaacagucuauguaacgauucauagggaauugggaggguucacgggaguuaaggaaguuugcacgcgugagugcgugcaugggugugugcgugugcauaugcguguguguacacaugugggguguuguuugcaugugcacgggagccagagguugacaucaggugacuucuccagucucuuuccuucuaauguuuggauacaaaauaucucauugaaccuggaucucaucgacuuggcuagacugacaagcuagugagguccagugaucccccugccuccaccuccgagcaccaggauuacaggagugugccuuaggacuaagcuuuauaaaaacaaaacaguguuaaccaaaaccaaaccaaaaaaaaaaaaccaaaaaaaccaaaaggaaaccucgagugcauccagacucagguccucugccucucccgacugauuuauucagugaaccggcuucucagccccgaaaucagauuaccuuaagcccacggaucuauccuugcugcucuaaaagaucccgagagauucgaagacucuauuauucuuuaggcagaagcuauguaaaauccgugguguggcuuuaaugauuucuguguuucuucaucuuuuucccuuuuaggccauccacugcagggccauccucccuugccaagacacuccuuccgugaaauuaacguacaccgcagagguaagcauuacagaguguagccgaauuaaauaaguaaauguggagugauaaggggagacaagucaaauuucagagguggaaauacuguacuuaauacguuuccacugagccugcacaucucauuuuggaucucuaauaaaaagguaguuuuaaacauucuaauuaugaaaaagggaaaccaucuuguucucauuucgaaaaagauauuaaaauucaagaucuaaagauuuaagaauuuaggaccauuguuuuuccuaagaguaccuucugcagccaugacgccuguguacggaugucccgggcagcagcuguuggacuugucuguguguccaguuccucugucacuggugcugcucggcccuuuggugaagguuggauuauaauuacagaguacccuuccaaaggcuggggcuccuuagaccaagcaaaugaaaggaagaccaauguuuauucaugggauuugcuuucuuccccaguuucucuguagcccagacagacuuuacuagugcuguagaaaauuaugcuugcaggcacaggaccuccgaguucaagacucuucucuaccacagaauugugugaccguagcaagucugaauguucuugggggggggggguuaugaaccaucccuaacccugcuuuuagcaccugagggacaugguugucccgugaacaucuuauuaccuaaccgaugagagaggaugaagcugacuccugcuggcugacccuggcuccagagcucuguucugugcuugucuccauuauagcugggaggccugauccgugcaaggacagaaggucaaaccugaguguccuugcuacauuacaaacacucaugggucucaggaugccagagcgaagggacacacaucugugacccucuguuuuaugauuuccagggaaaaaaaugauuucaugguuuccagccaaaguuguaguuacucccccuuagaaaauauuguuuguaccucugaguucuaaauguaagauggccaaagcuguauucucuggccugcugcaaguauaucaucuauugaguuuguuugggggcauggaggggacaguugguggcugccagucuaacuuguggugcugcuggucucuucauuuuuauucuuccuugcagaaagccugugacauuuggcccauacuugguggggagacuacuaagauaguguucugcuguaguuucucuccaaauccugcucuuaguauuucuggaugaguagaaggaucugucacguucaugaucuaggcagcuuuccacguugcuggcccuguuuacagaacucacaugcaugugcauuuuaaguccagagucgguuuaucguguagaucgucaagaaguggugaaaaaagcauuuacauuuuuauuuuaagcugcacagaccccugccuuauaauuagaagaagggguuuugucuuucuucugacuaggugucugucccgaaagaacugguggcucucaugagugccauccgugauggagaagccccugacccagaagaccccagcaggaagauuuacagauucaaccagaggguaaggucagaucagcgccuacauuuugucucaguggugaacuucaaaggaaacgcaccuauccagggaguccuggaacaccguaggcuuuaaaacacagccuuucucgccuccucucuccugauuguuacauuacgggaagagguugcugagaaggcacggcuagggaugccugaccccauuucuggauccagucuuagucagcuuccuggucucucucucucucucucucuguuguuuugaaacuugguuucucuguguaguccuggcuguccuggaacucacucuguagaccagguuggccucgaccuccaagauccgccugccucugccucccaagugcagggauuagaggaguacccaguacccaguacccaguacccagccuggcuuccuguuuucuuuaagugcucauucucucgugggccucgcacaucagugugcacuguggcuggccagaaaaugggaggguuaccagaaaaggacagugugaccgcccaguguguuaaaaacccgacacagcugggacuuaaccgaacuugugucuuugaccuucagcaggcagaauggaccugucugaguauacccaccugugagauguguuuucuuaauugucuucagaguggacaguguugcuuccuuuugggaccuaugauaucauagcuuuggcaucuacuuacugcugguuuaaaauauaaaggaauuuagggggaaauguuuuaaaaguuggaagggggaagaaaaauccagaaauacaagggaaaagcaccuguguaguuagcuguugcuuuugagagaugcuuaaaguaccguuuagauuuguucagcccuggguuuugccugucaguagccuucccuuuuguagaaugaaaggggaaugaauguuuugaaguguuucugugucauacauuugaacuauuugagaaggacugagggauaguucauagcaaugcuuggagauuuaaagaagaaucguguaauuuuaaaucugaacuguccggcucaacccguuccuauacacugaugcagcacgcacuguguguuuuugucuccuccagguucccauaccaugcuaccugauugcuuugguuguuggagcuuuagaaagcaggugaguuuugcccaaauuuugagguuuauaaaaaggcaagaccauaggcaaguugaacugcagacaggguugugcauugccuaagaugucaggccgacagcuugaaagaaauucaaauaguuaugaauugcagacagcaaauuaauuuugguuacaaagucuuugccacugugccuuaaguuuuccagauguaaagugagcaugcacuuaagcuuaggcugagagcaagacucugaugugagcuucaacaagucaugucauacauucuccauuuccuucuccuggaaacuauaaucugccacuccagccucauagguggccucaggagauaagauagauaaagcccuuggaguccuagaaauaguacagaaauagggcauuuugauuaacguuuuaccaauagcuaaaguguucuuucguuugguugguuauuguguuuuguagccagagucucauuauauauagcucuggcuggcccaguacguagaccaggcuggccuugaaugcacagagauguaccugccucugccucccacgugcugugaggaaaggugugcaccaccacucccaguuucuuacuuagaauuuuuauccgcguguguacguacguaucgguggcaggugcgcuuaauguguguugggcauuugguuccugugcacucuggggagccacuguucugcuuacacgccuacagucugcguuggcuaauucauagggauagaaaaaugcagcaugugccucuugcuggccacuguauuucauugagcaugguauacaugaggcuuagcuguauuacauugugugacaagacuucuugcuucuuccacugacuuauuacaugcauguccggugugugucugucccuauucugggauuaucuuguacagucucugccugagucucuucacugguagguagagagaggagccuguauucccagaggucucagcacacagccaggagcuaacccuuugggggcacuucaugccucuguuugccuugccuuuccuuuuuccuuuccuuuuuccuuuccuuuuuccuuuccuuuuuccuuuccuuuccuuuccuuuuuccuuuccuuuuuccuuuccuuuuuccuuuccuuuuuccuuuccuuuuuccuuuccuuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccccuuuccuuuccuuuccuuuccuuuccuuuccuuuccuuuccuuuccuuuccuuuccuuuccuuuccuuuccuuuccuuuccuuuccuggcacugugccucuguggagaguucuugcuguguguuuaacagcagauuagauaccuuaaaugauuuggccuccucccucccugccagugcacaaccaaucccaucuuacuuuacaagcuuuuguuacuacaaaacgucuagguucuucuuagacccagaugaguaauuugacuggaauuucucucaugaagcuuuugcauuuugcagacaaauuggcccaagaacucuggugugguccgagaaagagcagguggagaaaucugcuaaugaauuuucugagguuggucagacauacccuuccuaauaguaugaggcgguagauuuuagguucguggguaaugccauagcugugagcacuuuccgauguguuuguaguugcuacuuccugcuuaucauuucaguaaauuucuaaaacagccuucacagaaagccguuuugcacuuuuaagaaaugacuauuaugaccauuaagagauuuguaugcauucauuuuuuuccagaccgaauccaugcuuaaaauugcagaagaucugggggggcccuauguuugggggcaguacgaccucuugguucugcccccauccuucccguacgguggcauggagaacccuugucucacguucguaacgccuacgcuacuggugagaaagauuucuucguuugaaauggagguccccaaaauaagccugggugaagggcuggggcauagcucagcugauaaagggcuugcugcauaauuaaugaggacuuaaguuugacuucccagaacccaugugaaaagucgguuguauacacuaauccuggaccagggagguggagacagcagguccuagaccauagccuucuuccuuggcccaggccaaugagagauacugucucaaaauccaaggagggcagcaugugaauaauagaaucuaaggcuauuccacauggaaacacacacaugcaggcaugcgcacaugcacacacacauacacagaugggaagagcuuuggaugcuaguaauauuuuuaauauauuuuuguuuguauagccuuuauuucuaauuuuauugcuaguugugguuaucgcaauuuucacuuuuucaaaggagacuuauuuggccaucgggaaagggaauguucuacaguauuuugaaauguugagaguagcccugccauacaacgcacuuuggacaaauuauguaucuagacaaaggauccacaucauucauacuuggcagucagguaugaggcacagaaacuuagugcccagcaucuaagggaagacuggccuaccacacauugcugcuuuauagaccuagugagcugcuuggaguucuaggaauccagcaaggacuuaacuaggaccuaaguagauuggaauucgccauagaacacauuggacaguguaaacuuuccuuuaaucuauugucaauuaaaagaaaggagggagugggagguugugcuuaccaaagcccucguguagccuagagcuaggaccugcuggaacccaccucagugcucccugccuguaauuccagccucagaaagcagagaugagauucccagagcaggcuaccuaucaagacucgccauagcacagagcucuggguuugauugagagacccugccucaguagaaaaggcagacaugcgugcaucuacacacgcacacacacacauacauauacacacacgcgcgcacacacacacacauacacaugcacacacacauacacauacacacgcacacacacauacauauacacauacauacacauacaccuauacauacacacacaccuauacacacacacacacacacacacgcacacacauacauauacacacacacucacacacacauacacaugcagacaugcacacauauacaugcacaccuauacauacacacacacauacacaugcacauacacagcuacauacacacacauacacacacgcgcgugcgugcgcauacacacacacacacacacacacacacaguaagaaggaaagagggguagauacaugaaauggaaguaaagagcucucucugggguuaggccuauuaguccuauugauguuaaagagguuucugugauuagggaaggaaagaaggcaguguuugcuuccuaaugccuguguguugaaccuguugacauacagaguagacauacagugacccuucaggccaggucugagaugucgucagcugcagccugucgaucgaucugaugauggaaauucuaagauguuuucuuuuuuguaggcaggugacaagucacucuccaacguaaguaaaaauuucuucuuacaaucuuaacacucaagaaguuguuaaaauacccacuguguuguuuagaaguuauuauuguaaaagaaaacugggguuauccucuugcuacuucagcaauuagguuuaguagaguaaagaaaaauuuagccaaauauauaugauacauaaucacagaaacaaguauuguuauuuccuguguaugaaacauuuuaaucggcuuacaugcucauugaauuuaauacuuuccaugucuuuuuuuuuuuuuucuuugugguaguuguuucuaauccauuagcauguucuauaccuuuuuggucuugguuaaauugcauuuuccucccgaaguaaguaauuuuuuaauacguuuuuaaaaacaucaagucaugugacauugaaguauuuaaauaaggacuugcuucaggaugagguauccggugugaccacuaaucccuuaacacuguccucucagguuauugcacaugaaauaucucauagcuggacaggaaaccuagugacuaacaagacgugggaucacuuuugguaugauggguuguuuuguuuucuuuuguuuuauugguugcucuuguugauccuucugcuuuccacccaccgccaccgcugucuccucuguacuucuuguuucucuccccuacggucucuaugauccacggaguuucaaaagacccugccgcaccugucacagagguccauacagucuaggugugcaguuuauuccugccgcuaacucucugacauugccgcauuuuaacacagacuuggcaauagcaagauugccgcuuccuuuucucugcugccaccugcuggucugggcuugcuaucgucuuaguugacugccugggccucucuaggcagcaugggcugggauguagaggccaugcuaucuauaagggcucuccucccgggggaagacacaaaagaaaagauccgcuuggcuaagaugcuguguucuaucugcugggacaguacccauuuuguuguuguuuuuuuuuguuuuguucccuuucagguuaaacgaaggacauacugucuacuuagagcgccacauuuguggacgguuguuuggggaaaaguucagacauuuccaugcuuugggaggauggggagagcuacagaauacgguaaguagggugggcuucuacaagagucacccagccuugcauagucauuaccaaacuggguuaauaaacuaucuuuuuaacaacaggguagucauagguguagaggauguagcaggugccaugcauagcccuguucuaaacugggagccaagaaacacauacguucuuuacugcuaacauagaugacuauugcauagaaauuuaugugaauacuugugauuuguuuguuuguuuguuuguuugagacagagugaucuguguaacagcccuagcuaucuuggaacucacucuguagaccaggcaggccuugaacucacugagaucucugccugcuugccucugccucccgagugcuacaguugaaggugugcaccaccacugccuggcccuaauacuugugauuuuuuuuuuucaaaaauguauuuauuuauuuuguuuuuuuuggagacaggguuucucugcaccaccacugccaggcagauuuauuuauuacuuauaucuaaguacacuguagcugucuucauacgcaucugaaaagggugucagaucucaauacagaugguugugagucaccaugugguugcugggauuugaacucaggaccuuuggaagagcagucagugcucuuaaccgccgagccaucucuccaaccccuacuugugaauuuuuaaacacacucuccccaacucuaaaugugucgcucagacauuaaaucaucuuucuaguucuuuugucaaaguaaagccuguuauuagcaaggaauaucugagacauacauguaguuagacuccaggagugauagcagcauacuguuuccagucuguacguugaagguuuagaagccugagugaaacagagccuccccaacagcuugcuggcgcaguaacaguccucuuccuaugaggguacucaucucacuuuauuggguugcagauaaaaacauuuggggagucccaccccuucaccaagcucgugguugaucugaaggacguagaccccgauguagccuauuccuccauccccuaugagaagggcuuugcgcuacucuucuaccuugaacagcuucuugggggaccagguaaguagcugccauuguccgccgguuggcuuucguuuguuuuuaaucucugggagggugauaugaagaguagagaugacuuguuaacucuuucuagucuuuuuacauuucugguucauucugcuagagacgucuauugcugucagauguugccuucauccacaaaacucuacacaaccccuuaaucuagauaaugggggcuugacuuuuuuuuaaaucccauuauaguuaaagaguuaggguaauagcguauauccauagacaaacuuccugcaauccagaaguuuaugagugacaaaugagcggccucccagcccucgccagccccagagucaccucauuagcacuuugaugucacuggcuccagaucuuauucuagggguagaugacugucagucacacacacacauauacauggaaugacuuuaauaaaaucagggauccuguagacucuuauugguggguccacuuccuccauugaaguucccagaagucgcuguaauucucucuucuuucuucaaguuuucauggaugugacgucaccuacaucagcuuccuccuuccugugggucuuagccaccucagcauaggguuuucccccucaccuuugcaccucguggcuucacuuuggaauaucuagauugccagugucguuguuggguugcacccugugcccuucaguaaauaaaacaagcacuccuggaacauaagccaugugugacucagcggggccccugagaaccggagcggcuuagcagaggauuuggggagagaccagucgaguugcuucuaucacacaguguccugaugauucugcuucauuacuaguuacugauguuaaccucuucccgugccacaagcaugaauucgaguuucccacaggucuguccgcauggagguccguacaguaggguguggugcuguacaggcaagagagagcgacugucuuauguauugguucugcaucugucuuuuuuaaauuucuaagcucaguguuuugcauccucguacucagggcacgugacucucucucucucacacagaugugcugggauuaugugacauuauauugauggccugggcggggugguacccguuuccaucggcuuugaaggcgccugcccuuccauuccauuugugggcuuacucccccuuugucucaucgaugagggcuauugcuuuagaacuuggguuauucuugcucugugacuucauuaugucauccuggcuggaaggagacuucuaggcccaacuggagaccugccuccuguccugaacauucucucacuguccagagcucuccuugguccuuugacuguucucuguugcccgugguuaccagaacaacgucaacugcaaaaacgacgucaaagaauugccuuccugugaauugauuucuuuuucuuucuuuuaauuuuguuuuuccuccuagagguguuucuaggauucuuaaaggcuuauguuaagaaguuuuccuaccaaaguguaacgacugaugacuggaagagcuuccuauauucccacuuuaaagacaaggucagcuuuaaauucuuccuauuuuucaugcuccauguagcucuauaaacuacuuguuaggcuguguguauuucuuaaccauaaguauuggcucagaauuucccaagagacuccucuguuguauucugauucccuuucagaacacuugugauaucuguaaguuuguauguuaauuggucagauuuaaccgucccacauuuagaaauuaucucgacguggcagcguagaguagauggugucugaucacucccagguuuucaguugggcaucugugagcuuguuacaaccuaggacaagucucucuaucugucacgaacuggcuggucuucuguucacagguggaucuucucaaucaaguugauuggaacaccuggcucuacgcuccgggccugccuccugucaagcccaagugcguacccgccugcuaaccugcuuccuuuccuucuuccuguccauuuuguuuguuuaguuauuguuuucccagaacaggauuucuguguguagcccuggcuguccagaacucacucuguagaucaggcuggccucagacucacagagaucugccugccucucaagcacugggauuauggugugcauuaccaccacacagcgaguauuuaaccucuuguuauugcuuugcggcauacuaaccuacaaauguguuggacugcauguguagcuaucucaggacagguggcugagggcugcagguugaacacaccuaaccggaucccuuuuggaguaucuggacagacuaugugcuuuucuugaacuguuaccagucagcaaagcgugcagaggcuuggauagauuucuuagacuuuuuucccugaagcccaaagccauuuccaugguuuacaaacagaucuguugaacugauugcaguuauuacugagugcuuuguuucuacugagauauggagagggacucaggaaagaguaagauauuuucuccuuuuaaagguuuugugaaggcuagguaugguggcugucucucaccccagcccuugggaagagauaggaggaucaugagcucaggguucaaguagcaagacuugaucuaaaauacacauacacauuuucaguaaggaaaaaaauagcauuuuacuguuaaauaauauguacagauauuauaucuacccuuaagcuauuauaaguuauuaucccuauuucuagaaguagugauuuagaguuagcugaccaaaguguuuugcccaaaauugcacaacucauaaauaguaagccuuaaaucccuggagccuuaacccccugucuuuuaaguuaaacaccucccuggcgucagggagcuaguugcaccuuugaguucagcugucguguaaggaugcugacucuggcauacuccagcucuugguugcccucccuuccuucagaucauggaaaguccuuaccagccacucucccaccaaauagccugauuuaauuuaggugcagggugagcaucacaaguugagguagaaauaaagaugccaugguccuguguguuuggcacgccucuugagagcccaggcugagaaaggaguacucagaagagaugcaguaauucccacauucuuacaacacucuccacauuuguaugcauucaaaugucucccaggcguauccucuuuucuccauuuccugccccuccacucauacucacugugacguuagcacacaggaagacugcuguggccucugaacugugcaccuagauguuuucuggccuccuccuguaccagucuguauagagagccgaaguaaacauuuaaaaacacagugugacucaggaugcagaggcauacagguaucugugaauugaaggcugccuuggucuauaugauggguuccaggacagacaaggcuacauaaugaagagauccugucucaaaaauagaugauggauagauggauagaugagagagagagaaagagaguaagagagagaagauggaagauagauagauagauauagaugauggauagaugauugauaagauagaugauagauggauagaugauugauagaugauagauggauggauggauagauagauagauagauagauagauagauagauagaugguuagauaauagagacagacagacaagcaauaacaaacaccuacaacugugucaaucuauagucuugcuagucaucuucucuagugcucaucuggucuuggacagaagccaguccuuucuuucauggaaaccauguagcuccugacgucccacccccuuugcuucggucaggcuggcaguccagggucccucagacucucugcccucauucaagccuguuccucagacacacacuuccuucuacauggaaaauuccaaccucagcuuaggaacuuccuuccucauggagcaucucuuaaccucucugucaggucagaccuuacguguaagagucucuuggugcuguauugggcagcuuuucauuuucucaugugacugagcacuucuuugcgucacugcacccaagggagagcaaggcucaaguuugguuugcacauuacuucucauagggcuuuuuugugaguagcaauuacuucuucucccugagcuaacccuugacuuagcccucuuagucuagucacccauacugagaaggaaguuucagaacccuaagaaaaacaccagccaacccuuucuagugucuugguguuuaagaacucagugugagcagcccggcugcuguguggagauuaaaguggcugcuccggccuaguguuacucugaugccuucgcuggacaaaaauccccaacaugauuugaggaaaccuaguuuaguucuguuucugucuguggucauauuacuucgagccuguaaugaaguagaacacagagaagguagcaggggcagacagacacacagacaaacacagacagagacccacuuccaaucaggccuccccuccuaauggccuauuaauuuaugggugaaguuaguauccuuaugauccagucaccucuaaauaccacgccagcugaagacagagccccaacucguggguggggcuuuggaggacuuuucaaauucaaacgcaacacuuaggguauacuuacugccagggucccagugcagcgaguuauuacuuccugcugauccuaccucgaagagaauugugaacuggcucccuauucguucccuagaaaaagaauagaagaagaaaaaaaaaaaaaaguaggucccuaccagcaguaggugggccucuugucacugaugagcguuucacagcaaguaggcuuggugcuuagauaaagagggcuguuuugcaggaauuuuguuuacaugacacauucacguuaggagcacacacauagagacacagaucaucuugcuuaaugguuaaucccaccucccgaaaaggaaaggaaugaggcuaucacaccacgacuuuggacucuccagucugcuaucuggaacagugucuguuacuuagccugcuuguagacuugcuaggugaugagaagauuggagcaacccaaaguaaaaccccugagaugggggaugucuuugugcugucucgacugccugaagcuguugcugccaggcagagacacuugagugcgccucacugguccugacccugucccgaguccuccaugggcgugugacaugugcugggaugccuguguucucaaugaaggacggccaggagcuucauugauguggcaucuauauggugcccauuuggauuugguucuuagaugagucaauagacuuccuuuuucuaacacucaggagcucuuuaucuuaaagaaauguaaacuuuuaaggauguuuuauagcguaaaagugcauuugcgcaaaaggauauguuuauaaacuuuaaccuugacuaccuuucauuuccacaguuacgacgugacucugacaaaugcuugcauugccuuaagucaaagauggguuacuguaaguagcgauggaagauuuccggcucguuucugaauuguacaaagacguuucuuguuuauugaggguaguuucaacugugagcgguuguuuuuaauucuuucccuggggugauacugucuucaccccuuccccuucacucaagaggugcuucaaauaccuguagaugaaucugaaugauguugggugaauguuuaaggccaacuauggaacaggaggaucagacgguuugcuggcuucugguucuauucauuucuauaaacuuuccuaaaaaggaguuuccacauacaugugcucaaacguacgcccagggaagccagacugagcaucugcccuggaugagucuggaauagaaaccgagagagaacuuaacaguugcuuuaucucgacaacaguugauguugcucucugaaauuuaucuuuaaaguuuacguggucagcauuucuugacaaucauccacauauugaguguugagauucccaguaugaaagaaacagagguggacuugccuuugggguaaugaaagaaauuugagguaguuuaaugaaagaaauuagauuuagacacacauuacuuuuauguugggcaauucauuuacugggguggggauacuggcgaccaaacccagggcacgcagagcauuucucccauguagggagacaacgcuuaagagauaaagaagaaagcaaagcaagaggauaaggcaggaaauagaagugagaaaccaguggacaguucucugacucagcccagcuucaugacacacaugugacaccugcagacaggaggguugugaauucagggccagcuacauccagaaaccuugucaagaaagaaaggaggggggaaggaggcaggaauggggucuccuuuaaacacuguggacuguaagcuuuuuggagguucaagucauaaccaaucgacugaagucuuguaagucucugcccuucagagaauuguuguauacacaggauccuuggcuguggauauuuuuaccuggaguguagaaaguguaguuuaguggacuuccuguaacauuuccaaaggcuuaauuguuuguauccaaggagagaaaccuugacaugugagccuccaucuuuuagcccagucuuucugugcucacagacgugccagagagagaacaagagccgucugugggaggcagcaccuguaacgggagucuccuagaacccucuuauuaaauuugagaaaugcacgcagcucgccuggugcuggagaagcugccgcgaucuccacucugauaguccuuugggcccagcagugaaaggcagaugguuauaaacaucucagcuaucagaaggaacagguggacuugguaacagugaggacgguugccaugagcgcucuccuuagcuguugccuugguucuuuuccccauguauugaagguauauguguauauauguauauguauauacauauauauauacauguguguguaugugcggaggcagggggacccccaggaugagcugauuaccuagacuccugaauugggaacugcaaguucagcaagaaaacacacuuggaagagcggagagcgagcagaggaugauacccagggccacccccuggccuccacgugcuacgcacacagguucauagucaguguauguauguauacacacacacacacacacacacacacacacacacacacacauacacacacacacuacauacacacacacuacauacacacacacacagaggaauaaaaaggauuauacauguaggaaacagugguaaggcauaagaacagacuguaaagcagcagccauguagcgccaguacgagaagcacagccaucuuagggucuguggaacaccacucucauuucguguauaaaaugucucuucuguauucaguuaguuuauaagugaguugaagugcuuuauguagcguuucuuugcuuuggaaaucacuguacuucuaaugguccaaacugucaagaaagcaaaggcaggcgacugucccugcauucucacuaggaaugauguacacagauuuuaggaaccacccuccucuuagguuauaguaccuuaacaucugguuauguuagcucagcugcaaauucauuuguuuuucuuaaucuuuaccugugugucagauuaacaauauuacgaaacugcgccugaacagaaauaacccggugauguuuauuucaggccaaagaggaagauuuaagcucauucagcaucgcagaccugaaggaucucucgucccaucagcugaaugaguuccuggcacaggugcuucagaaggugagccccagcucccagccccggagaugaaagugggcucagaggcacagcgcgcccugaccccagugcagggaaaaacacuaaugaagaaagugugggaagagaaaggaauuacguaguccacuuuuuuuugaaacagcacucauugaauuaugauauuaguacuguucaaaucaaaaccuguguaagaaaggagaauucuuguucuagaaagcacauaauccacuaggaggggaagacaggggcguuggcaguuggcaggagccauuuggaauggaucagugaggaaagacuccgcccucacaggcaucaucaacaaggaaggucuugugguggacugagccuugguucgcuaccagcagaaugguagaaguuagguugagggaggcuccacccauggagcauggccugcguugagcgaacaguagggcugggugaggcaccagaggcccuguccuagcaagagagaguuugguuuuagugcacgagucaucagccugauagcuuucuguggugcggcgggugugaucuaggauggagaagaaacaggaaagccugauaggcugacguggggggagggaaguggggcaaaacagggagagucgggagauggaggaggcuggccuagcaggguggacuuggaauugcaauauguccauugggagcuaauguacuaacuuggaacaggccuagcaguuagugagaauggaggcagcuggcucacaggcaguccugucagguaaggaggccacacagggugggcaggaagggagcgccuccccagagaccucagacuguccuccagaggcaauuuacguccuguguguccacacugaaccugucuccuuuccuccuuccaaacugguuuccccuucuaguguggguuaacaugagugcaggagggccagguauugccugaacuuguaucaggcgccuguguuuauauggaaaaugcaccccaccccaccccaccaaggacagaguccauauuccucaucccaaaggggucugugaugugaaagguuaagagcgaccauuuuaaaaggauauagagaaucuaaaagugaugucagaagaaacagacacagauaaagccaaucaggaaaaugucaggaggugugaguuaucuacagagugggcuaagucuagguuauguaggagguggagaagaaccuaacggauucaggaacggucuaggcugaggagagcauaacaccccuuuauuucucucaguuccccacaagauauagcgcauuccugcucucccagaacaaacacccuucucgggaacuaguugcuaggcauuggcuucagcucgcaucuguuccuuuuacccuuguccagcauauguccguauuauaagggauguaggacuguaaucuggcuaagaauuucucuccagcuccuuucuuccagggaauccuguugaaaugaucccucauacgucuucauuucgcucuuaggcaccucuucccuuggggcacauaaagcgaaugcaagagguguacaacuucaaugccauuaacaauucugaaauacgauucagguacaucauuuuaacuugucucuguggaagaaagcugagugguagcuuaaacaguggagaaaggggaagccgagugcgggagcccacgaguccucggaacccccgucagaucaucuacauagauggccacaguaguaucgaagggagaguugugaugucuguaacacgauguuaaucuuucuuugcuagguucucaguuucccucaaacuuaaaaacaaaaacaaaaaaauuagaaugaagacuuuaauggcaaacacucuaccuuucccaaguugucaaaucaacucugagugggcgcggguagacaccuuugauucugugauacguuaaccguccuuaauucaaaugugugguguuagguuuaagucaaagccacuucuuuuauugugcacacaagcacucccacaguccagaccugacacuuagggccuuucccaagacccagcuccuccuaugucucuucucccguuguuaacugugcgugugugcagaugugaauucgugacgugcaggugcccaguguggcuggaaugggauggucggucaugauuguuuaggaguaccgcucacuuguuuccccgguucucaccuucccuccugcccacgccuguauaaauccuucuuucagaugguuacggcucugcauucaaucgaaaugggaggaagcaauuccuuuggcccuaaagauggcaacugaacaaggaaggaugaaauucacacguccucuauucaaguaaggccacaucaggcugugcacacgggagggacaggaagcagaaucugaagauguuuccugugaauguuucuaaaggggccguggcuguaguuucauaguggaacacuuagcgugccugaggccagagguucaguacccagucagccuggugggaaaaauaacuucauaaaaugacaucuauagcauaggucuaagagcauucaaguugguuaucauaaauaaagaguuaauacuuaugaccauuuaaauuuuaaaauagcaucauuagcugcugcaggagcccaguaugugauuagcuaccauagagcggaggcgaggugaaaaggagacaaacucaagacagccguagauacacagaagggguuggaaagcagaaagucugacgagugaguacggggccaaggaauaaucuaaaacuaaauacaaagagaccuuugcacauaguucaagcugaguuggguguugcuugacauauuaaagaggaaugcaggaacauaagggagaguguguuagcaacaggguggaaguuaagaacagcuccauuaagguauuuguuccauguucuuaaaagguuucagucacagcaucagauuucaugauuagucuggcagcuuggcacacacuuccuaaauauagugaaauugugucagugcaaacuauuaucagguuucuuaaauauggccacaaaacuaauuuuuauuaagguauuuuaaagcaaacuucacuaccuuaccagaauuaaaacccaucuaccugcaaauugagugauguauaccucaaauacaaauauauacccuuggggucagcaaauggcuuggcagacaaggugucuauggccaaaccugauauccugaguucaaguccugggacucacauaguggaagagagaaacaccuugcacaggcuggccucugaccuccaauuguacuaugagucucaaucacucucucucugucucugucucucugugucucugucucucucugucuuucucucugucucugucucucugucacucucacacauacacaccuaaagaaacaaacuuaagaacauacguuuuaugggaaaaauaaauguucugucuuguaucacaaacuaauagccauacuuaaagcgacuaacccuacauuucauauacuuacccaguuuauuugccaaaucguuucacuacacuugguauuuuuauucucacuggaugaagcuuucagaaauuccuuuuguaaguuagaauguuuauacucuugaaugauugauuagcauaaacuugaaaagauuauuuuuuuaaagacaaaauaauagaggucugcccucucaugcaaggucaguauuuagccaaucacccuccacacugcucuguaaccgcugcuguccccucacugugccuccucuguguagcucccuccaaauuccugugaucugcucucucugggccagcauuugaugcagagaugguacaggaccaucugguuuuacaugggugacgcuuagcuguuccguugugaucuuuaauuuaaccuuagcucugacgugauaucucugcuccucucuccaucucuucccgaugccucuccuuugcccuuugcucugcagggaucucgcugccuucgacaaaucccaugaucaagcuguccacaccuaccaagagcauaaagccagcaugcaucccgugacugcgaugcugguggggagagaucugaaaguggauuaaggaacugauuguugcugauuucagaaaauuccuuuuuuuuaaaaaaaaaaaaaauugaaccuauuaagaaauacaaaauuuuagcugucauuguauuuuaaagugucauuuuugguuuuuuguuguuguuguuuauuuguuuuuaaaucauuuuucaugauuucacuaauauucucugccccuuacaaacca

SEQ ID NO: 5703 - RNA, 695 nt, Mus musculus
ucuucuucuuuuuuuuuuuuuuuaauaacagaucuugccugaguuuauuuguaagaacggcauaggacacuggucaucugcaaauaguguguggggaggugugucacagcagucugucuucacacuggcaggagccuuuuuuacggggccuucacaggggccugggcaccuuugggagccugggcuggagcugaagccugggccuuagcuggagcuuuggccccugccuugguuugaaccuuaggcuucgguuggcagagccucugacccuuggccauguagcuucgaauccgcuucccaagcuuagggcgagcgaugaaagccagccgcuugaauuuggggccuuuuggcaucuugggcuugauggccugaggcuucaccagggccuugauggccucugcacgcgcacucacugccuuugcauuguuggccugcgucuucuccaggccuuucuuguugugcuucuuggcaaugcgcauguuccucaggaacuuggggucaacccccuaagagauucguaucuuugcaaccgggguuucuugaugccauuucugugccauuugagggacugguugugugugguguaguucuuggacuuggccaugucugcacgguaacccgcggcucccgcagcaccugggacuggaagagccccaugggucuuuucaaacggacuauugcuuaaguuaagcgga

SEQ ID NO: 5704 - RNA, 1297 nt, Mus musculus
caugggccaaguguuuucuguauuuggaguaguguuguuguugcuguuguucuuuuucuuagcugaguacauaagucagaagucagacagcugcccgggagaauccgaguugaagaacagagcauuuagcuccucugucagaaugaaugggaaccagaaauuggaugcuuauaaccaagaaaagcagaauuucauccagcacuucucccagaucgucaaggugcugacugagaaggagcugggacacccagagauaggggaugcuauugcccggcucaaggagguccuagaguacaaugccuuaggaggcaaguacaaccgggguuugacugugguacaagccuuccaggagcugguagagccgaagaaacaggaugcugagagucuucagcaggcccugacagugggcugguguguagaacugcuccaggcuuucuuccuugugucagaugacaucauggacucuucccucacucgccggggacagaucugcugguaucagaagccaggcauaggcuuagaugccaucaacgacgcucugcuucuggaagccuccaucuaucguuugcugaaguucuacugcagggagcagcccuacuaccugaaccugcuggagcuuucugcagaguuccuaucagacagagaucaggcagacucuagaccucaugacagcaccccagggccauguggaucuugguagauacacugaaaagagguacaaaucgauugucaaguacaagacagcuuucuacucuuucuaccugccuauugcggccgcuauguacauggcaggcauugauggggagaaggaacacgccaaugcccugaagauccugauggagaugggcgaguucuuucagguccaggacgacuaccuugaucucuuuggagaccccagugugacgggaaaggucggcacugacauccaggacaacaaaugcagcuggcuggugguucagugucugcuacgagccucuccucaacagugccagaucuuagaggagaauuaugggcagaaggacccagaaaaaguggcucgggugaaagcacuguaugaggcgcuggaucugcagucugcuuucuucaaguaugaggaagacaguuacaaccaccucaagagucucauagagcagugcucugcgccccugcccccauccaucuucauggaacuugcaaacaagaucuacaaacggagaaagugaccccggaauuggagaggcugggagggaggggucucaauaaauuauuguccaacaaaaaaaaaaaaaaaaaagaagucagacagcuuucuuuggaa

SEQ ID NO: 5705 - RNA, 1297 nt, Mus musculus
uuccaaagaaagcugucugacuucuuuuuuuuuuuuuuuuuuguuggacaauaauuuauugagaccccucccucccagccucuccaauuccggggucacuuucuccguuuguagaucuuguuugcaaguuccaugaagauggaugggggcaggggcgcagagcacugcucuaugagacucuugaggugguuguaacugucuuccucauacuugaagaaagcagacugcagauccagcgccucauacagugcuuucacccgagccacuuuuucuggguccuucugcccauaauucuccucuaagaucuggcacuguugaggagaggcucguagcagacacugaaccaccagccagcugcauuuguuguccuggaugucagugccgaccuuucccgucacacuggggucuccaaagagaucaagguagucguccuggaccugaaagaacucgcccaucuccaucaggaucuucagggcauuggcguguuccuucuccccaucaaugccugccauguacauagcggccgcaauaggcagguagaaagaguagaaagcugucuuguacuugacaaucgauuuguaccucuuuucaguguaucuaccaagauccacauggcccuggggugcugucaugaggucuagagucugccugaucucugucugauaggaacucugcagaaagcuccagcagguucagguaguagggcugcucccugcaguagaacuucagcaaacgauagauggaggcuuccagaagcagagcgucguugauggcaucuaagccuaugccuggcuucugauaccagcagaucuguccccggcgagugagggaagaguccaugaugucaucugacacaaggaagaaagccuggagcaguucuacacaccagcccacugucagggccugcugaagacucucagcauccuguuucuucggcucuaccagcuccuggaaggcuuguaccacagucaaaccccgguuguacuugccuccuaaggcauuguacucuaggaccuccuugagccgggcaauagcauccccuaucucugggugucccagcuccuucucagucagcaccuugacgaucugggagaagugcuggaugaaauucugcuuuucuugguuauaagcauccaauuucugguucccauucauucugacagaggagcuaaaugcucuguucuucaacucggauucucccgggcagcugucugacuucugacuuauguacucagcuaagaaaaagaacaacagcaacaacaacacuacuccaaauacagaaaacacuuggcccaug

SEQ ID NO: 5706 - RNA, 4801 nt, Mus musculus
caauagaucucucagaacuggaagcugaugaggcagaagguagguacuuuauuuauuuauggggucucucucugucucugucucucuugaucuaucucucuguguguacaauguugagaauucaucccacgccuacccugugagugccaagagagugcucugucacugagccacacuccccagugcucacaggcauuuucuuuuacaaagaccuauuuuuaauuauguguagccugcacauugugcacuugagcgccagugccuuuagacaccagcagaggacaucagauugcauacagcuggaguuacagacaauugugagccucacgauauggggccuuggaaccaauccucugaaaagaacaguauucacuccuaaccacggaaccaucucucuggcucccccauagguacuuuuaaaggugugcagacauuuucgaugacuuggcuuccagcuguuggcaucucuagucuggcauggauagaagauggaaccgauugaguuccucuuaaaaauacaauucacggggcuggagagauggcuuagugguuaagagcacugacuguucuuccagagguucugaguucauaaucccagcaaccacauaguggcucacaaccaucuguaaugggaucugaugucuuuuucugguaugucugaagacagcuucaguguacucuuauaauaaauacaaucuuuaaaauaaauaaauacauauauacauacauauauacauuauauauagccacuuugauaugacaacuauaauaggccaaauauauauacauauguauauauauaauucaccuuuuuucuuuuuuucuuuuucgagacaggguuucucuguauagcccuggcuguccuggaacucacuuuguagaccaggcuggccucgaacucagaaauucgccugucucugccucccgagugcugggauuaaaggcgugugccaccaugccuggcuccauaguuuucuuuaaagcauuuuauuacauauauguaguagagugugugcaugugugugcaugcauguccagugcaugauguguggaagaagucagaggggcacuuucaggagucaguucccacgugggucccagggauggaacucgggucaucaggccccguuacaagcugccgagucaucuugcuaucuuccaaucagcugcucaacaccaaaaagcauugguuucuauccugaccuuuucuuuguuguuguuguuguuuguuuguuuguuuuuguuuuuacuguuguuuggguuuuuuguuuguuugauuuugagacaggguauuucauccacucuggugacacagggccugcuguguagcucaggguacccuugaacagucccuucagcauuacccuccugagugcuaggaucacugacaugaugaacaaucacaacugcuguucugauacuucuuuaaaauuauccuugguagcagcaucuugucauaauugccugccugggauauccaagucccuccuggugcaccaauuaacguuugccucuuguguucugcacaaucuagcacagauuucucuucucuccucucucuuccccucuucuccuccccucuucuucuucuucuucuucuucuucuucuucuucuucuucuucuucuucuucuucuucuucuucuucuucuucuucuucucucucucucucucucucucucucucucucucucuccucccccucccccucccccucccccuccuucugucuuccuuaugggucucacuauguauuccuggugggcucagaacucaguauuuagaccaagguggccucaaauacagagagucaccugccucuguuucuagaauguugggauuaaacucaugggucaccaugcccugcccuaaaaauuccucuuuaaaaaaggguuuaucuuuuuuuauuuucuuacaauguuaugugcaugaguguuugcaugugugcauuuauaugugcuguugugccaggaagcauuuaugaaccucaaagaccaccaaagagccaucucggauguuagggucucuuuauuacaagcucaggcuagggcucuccuccaacccaacccugacacagcaggcaggaaaggaaggugaagcagccucgaacccucagugggacaagguuuuauaggaaaauaggagcaagugaggggguguuuagucuggcaagcaucuaauagaaugacuauaagacaacagguggaugcucugaagcaagacuguauacgaucucaaauggucugaaaguacaucugaaacaaucagauuaaucauuaacuguugcuaggaaguagcuagggaguaacucuggccaaggacaagcugugagguccuuccugguacguggguacagcuuggguucuccuguaggucaaguucucaggcuuuuuugguuuuuuuuggauggaggccaucccaaguagguuuggcaucucaugccaugugcaugccugguacccucagaggucagaagagggcaucagauccccuggaacuaaguuacaaauggucaugagcuacuauggaugcugggaauugaaccugagucaucugcaagagcaacaggagcucguaacggcugaaucauuucuccagccccaauggucuugagugaggcucagaaaggucucuuaauuuuuaccgaugauaauaacaacucuuucuuguccauuccugugagaaugggaugaauccuaucucugacucacucugucaaaucuuucucagaaaccuuagagauuugccuaccucugccucacaggugcugagcucagagacgugagccacggugcuagucuggcuggacauagagcacaaggcagcuccuuacuguaaagaaugauuugguccaaggugucggugguguugaaucuuugagcgacuguauugacguuagagcguugcuuugucucccugcuuggcuuuuaucucuguugcaucaguggcacaucugcggccccaccaggaaaugaagauggagauagaagaacaauggcauccacuccagaacuguuuauacgucacugaaaauaagacaucugaacuuaaaaccaucgggcacuuugcauuaucaccuaccaccaugauaacuccuuuucagauuucaaauguccccuucuuaggucucaugcguggcagaaucgaggaauuuaucggcuccacacccuuuuucuccaggcccagguauuuuuuucaaucaggugacacuguugcuccauuucaacaaaguaugauuuaaaaaaaauucacuuuuuaaugcuuuuuauaaugcaauuauucuguauauuauuuuuaauuuuggugcauugauguuucaccugcacguauguuuauaugacgguaugggaugcccuagagcuggaguuauugacaguuguaaguugucaugugggagcugggaacucaaccuaggucuucuggaaaagcagccagugcuuguaacuauugagccaucucuccagccccaacaaaguaucauuugugugugguguguguauguguguguguguauguguguguguucauguguguacgagugcaaauauuaugcaguuuugaauguacaugcaugcacucagggguagggguggguagaagugucaauucucaaacacuguccaccuuuuaaaaaacuguuuauuuuauguguauggguguuucaccuggaugugugucuauguguuacacauaugccugguucucacagagauugaaguuaagaugguugugagccacuaugugggugcuaggaacugaacuuaggucuuuuggaacagcagucagugcucuucaucacugggccauuucuccagccccaccuggcuuuuugagccagggacaguaggcuagacuggcuggcgacugagccccaaggauccucuugucccaaccuccauaguucuggaauuaccggagcaagccaccaugcauacguggucucugagauuugaacucagcucuucauguuugcaugagacacacuuuaccaaucugggugacaccgcccccccaccagcccuuucuuguaaaaaucuuuucaccuuuaaccaacaucuuccuccacaucauaaccacaaacuuuucuuuuguuucaaauaagaccuaaaauaagaaaauggaaaaaggaaaucaggaaagaccaauucuuguucuccaaggugacagaugaguugcacacauuuggaauugcucuucuguuuuuguucuuauguuacauuugggaggguuuguuacacagugcuggauaccaguauuucuuaugugcggacgugcaaauuccccguguaauuugggaaccuaauuaacauaguauaagcaauaagccgaauccacaacgugaggcuugcuuugauuuagauuucuauucucuugcuacccuagcauuccauaucacccuuccuaccuuaauuuuuuugguuguguucuguauugcaaaugauaucuguggaacaggcuggccucagacccacagauaucugccugcccucugccucucaaguucugggaucagagaugugcaccaccacaucccuuauuaucuccuuccuuuucaagagaguauuaggucuuuaguggcuuuggguuguauguuuccuuugcuuuucuauccccagucauuacauugcacuuggagcauagaaugcauggacuuccuaaaggcuugugauugacagccauggaauguaugucucagauagauggaugcaauaauagacuagacauuuuaccuuuucgcccuuuucacccuuagauacugcacuucauuuguaaaauggaaauaaaaucacucugauccgucu

SEQ ID NO: 5707 - RNA, 1949 nt, Mus musculus
ccugaggucgucaagagcuugugauuguccugccucugcuuccugcgaacgaacuagaauuauaagagugugccacaagaccaaucuucuuaugcucacuucaaaaagaaaaaaauuagucuguguguaggggugaugcgugccgugacaggccuguggaggucaggggacaacugugggaauccguucacuccuucuaccagguaaggucuggggaucaacccgggucaucaggcuuggcugcaaacgccucuacucgcugagguaucccgugggccauguguucacuuguuauuuuagcagauuauucuagguuucaaccucaugcacugacuuucauaauacaagaagaagcuuacacacuugauuugagugguugauucuuggcagaaaucccaaucauuaucugguuuuuauucugagacuguuggcauagaaaaauaccaaaacagccucaaugcccuuucaagucaaauuacucaucucgaaaaugaaccucuaagcugggacacuccuccguacaccccagagucagcaacauacacauauggacccuuguaucucagaucuaaguuaaaagacgaugccacucauuauugauacuucugaugcucaauggaccgggacucaccaucuccaucaugcacccugaggaagcuauaucagcauguuuauuuuauaaaaaagcgagauggguuuuuuuuuaaauaaagauuugcaaagucuauguugaucaggaacccgugugugaacacugaguguccuguucuccaauugguucccgaucgaccaauaaagaugccaguggcaauggcuggguggaagaggugggacuuccggguuuccacagguaggcuagaagacacaggaggagagagaauucgccaugcuuuggagggagaaagagucagcuaugugagauuucagauggagcagucaauggccgcuuccccaggcaggagauuagaaaugaaacuaagcugaggacagauguaggguguugagcaaggagaagguaacugggcaacuaagcuaagggcagauuagaauguuaagcaaggagucgaggaaaaagcaugcuagaggcuuagaagagcccagguucaaaauaagcuguguguguguguguguguguaugugugugugugugugugugugugugugugugugugcgugugugugugugugcgcgcgcgugcgugagagagagagugggguggugguggugguggugugugugugggggggugucuuucauccaaggauccaagggaaccagggcaguggcugguagcaugguccacauggagcuuaaagugggguaguagaaaugacgugcuacacuauauaaaauggagguguaccaacgccaauucuuugucauccaacuauacuguugccagagacuuuuuuccaaaugcgcauuacaaaaaguaauuuguaacugucgaccugguagaagugaccaucuguuaaacagcuggagcccacgaugugugaaucugcacagauauggagacauacgaggaacugaacuuguggucaucucaccguugcccuggcauuugcugagcacauccuaucugcuccccuaggucugcuguacuaccucugggagccugacagacaaggacugcauccagggucuuccagcuggacucacuccugggaacagcaggaggaaugaugggacagaggagugaggcuggggugugcucugcucauccugggcuggcuguauucuuugacuugugguccagggagccccauccccacugacuuuugggccccaggucuggguguucacuccagguuuugggcuggcaucaaccaaaguuccuuuaucuaauuuggguuuaucauuuauuugcuauugccaugcaggucuaucaaggacccaagccagaauacccauaacgcaugcaaagaaggauauuaccagaaguacg

SEQ ID NO: 5708 - RNA, 6114 nt, Mus musculus
ugaaguagcaacaaaaauaauuuuaugguugggggacaccauauuacaaggucaaagcauuaggaagauugagaacuacugccuuagaguuuuuaaaccacucucucucuuuuuuaauguaggagagugugccucuuuucccacagcaaacauggcggaacaaacuucaaccugacgucuugcgcccucaacaaagauggcuacagcacuuccugcucuugccuuuaacaaagauggucgcaauacuuccugucuaggacuuuugcccucaacaaagauggucuuuaugguacagguucccuagcagucuggauuccgguuguaguuuuaguuauucuuuuuuuuuuuuuuuuuaaacgguacguggucgcagacguaaguaagaugacuccaucuucucucgcuguccccgcgccguggcgacaucgccccugcgcggcucucccgggggcuggaccgggguucggguggcggugccgggggucgguuuccuccgagaggacagucugcggcuucauuuaccgugaaaaucgucgguagcucuaacugugccacaaccacggcuuucagcugccgagacagggaacuuuuuacaaguuccaaauggaaacacgcugccaaaacaaaacaaaacaaaacggucacccacgcccuccucaccugccaccucccgauuuggcggaagaucgcgagcaaggcugggauccgacgucccgcuugugugggcugaggguggcagaagccccgcccgccacccuugcuccccuugccuucauugccaccgcaagccaccccgcagcacacuagcgaccugagcucauucagugucccaugcaugcgugcucacggcccuacugcgacccacauuccgaauucuugugaggcuuaucgguaaaggcacacaaacacucauuuucuugagggugcuuguccuuucuuugaaugcucuauaaacuucuuuccuccggacugucuucuauugcuggucagggucuauaaauaaaugucccuggugcuuuuuagcaguuucuaaagcgugggugcuggacuaacucuggcaaagcaauauugaaauccacuauuuucuagcauuuaauuuuauauaauaauauaaauagauuaauaaaucuguaauccuuagggauugcauuuuaaguaagggaucagaucuguuuucuguuggcucucuuacugcacaaggaauugaaauagggccccauuaucgugagaagcagagguagaaacauccauaaugagugucguucauuaugccgggaaguguuugaaauauccgugguuuggcuuaacagccgcuuaggaaacaccguggcucagcagccucuuaagauauaaagaccugacugauuuuugaggugcucauuaaugaguuugcagcaauacacugacuuuggggggggggguguccaucagcauuccugaaaccuaggugcucauuuuggcucuuuccaggaagaaauggaagccagagacaagcagguacuccgcucccugcgucuggagcugggugccgagguacugguggaaggacugguucuucaguaccuuuaccaggaaggaauuuugacagaaaaccacauucaagaaaucaaagcucaaaccacaggccuccggaagacaaugcuguugcuggacauccugccuuccaggggccccaaagcuuuugacaccuuccucgauucccuccaggaauuucccuggguaagagagaagcuggagaaggcgagagaggaagucacagccgagcugccuacagguaggccccaaagagauccccucaaaacagcucuggaaguguugcaaccaugcccaguggauuggaauuuggucuuuuaggagggaccagggccacgagcaugggcaacgguuuggaugcagagggcauggcgucggagggucaagacgaggaggcgguguuaggaaacucgaggaaggaagggaacaugaacccugaggcugagggguuaaggagggaacugagaguacaauuuagacaugcuuccaggggaacuuggcaagucacaugggaggcuuguucucaucggagagccaggucaaucugagcccuuuggcaacaggaaccguuuggaaagcgcagaugggaaugcaggcuuuggccuacugauaacugauuuguggggugccaagcugccagcuggaggaggucagaucaugggagacagccucuaggaaggcauguccugcaccuguccccacagccagccuccaaggccaaggggauuauuuugaagccugccuuuaguuuguuuuuaaaggcuguugguguaaaguggcccuuuaaaauucagcucugugcagacaccuggggaauuuuauuuugcaagggcaguaauuugggggugcgaggggggggcggaucuuauuuugauuuuuuuccaggaaaaaaaaucccuggaagcagugaucugaaaagaaacagcuuggugcuugugagaggaaggugcugcgguauaaaucacuguuuucuucaacuccucccagauauacugcucuuucacaaagaugagggacugaccuagaaagauuaauuuuuuuuuuuaaauaauaaaauggaaaguuaaccaagccaaaccaaaucaguagauuuccagaguuaagaauucaacguuuucugguuuucaguauagauauggaccaagucaguggucuccagaauuuauuguuaaugguuuuuaaaaaugacuguaacagagcuggugugugugugugugugugugagugugugucagcagcgacauugguguccugccuuuauggaggcagaggcaggugguucuuugugagcccagccuggucuacauagcaaguucugggauagccagagcuacauauugaaucccuuucuacacucccaauuuucaaauaacuguaauugguaacaacaacaacaacaaaaaaaaucaaauacuaccaguaaauuacuuuuauaauuuaaauguaaaacuaugggucuuauauuuugaaugguucugagagcacauaugauaauuauuuuuuuaaaauuaaugacauauaucugaauauuugaccagaaugggauagccaguuaauuuagaaagaccuggugaacacucaguggaaaaucuaaaaauaucuuuauuccuaggagcuuguccaaauuacaugucuuuuugaaaccaugagaaugccggccuuugaggaccucuagaauuuucagcuuggguuguccuuagaaaauuacauauuccaugugucugaacaaaaccaggaccaaguaucccugacauuucuaccacauuauuacaagcagaauauauaacauggaguugcggagggaacaucaaugaguugugccuuucugguauucacaucgaaggcucuccuggccgcacgcaguuggaaaugacaaaagacccgaaugcuuuucacucccaaaauguugaguuuaaccaggugauuauuuuggguuauauaaacguugucaugaauugucauagacaugagacccucauucucacuucuucagguuuauucagagagcaagagagaacuaagauauccugaagacauuaaaaaguuaaggagaaacggaggggaaaggcgcuuuuauaucuagcuguuuaucuucuauguaugagugcugcauccugugugucaguaugggcacugcgugugccuggugcacauggaggugggaagagagggcaggagccuuggcagcagagcuguagauggucgugagaugccaugugaaaggcaaagaaacccaguacucugcaagcccagccagugcuccuaaugccgagcccacuccccagccucaaagagcagcuuuauaauggaagcaaaaaccaaaaaagauugaacauaucuguauauaugcuuaggaaaccagguuuuccccaagacuuguuaacucuguugaaggguuaaauggaaaccuggcuugccucacaacacaagugaguguugugaauuguuuguuuguuuauuuuauaauuaacucuacuagugaaaaaauucugaccuggggcuuagauuuauugauuucuuggugacaucaacccauuuucaaguaugacuguaguuaaaucuugacuauuuaaacuaauacugaaaauacaaguaagguagagaugagugauagagucaacaccuuucucaugcucacuuuaagaagagcaaugcuccacgcagggguagugcucccuuuggcuggugcuuacagauauggguguuuuuggguuagugcucccuuuggccggugcuuacagauauggguguucucgggcuagugcucccuuuggcugguguuuggagauaugcguguucucggcuacugcggcagugccaugccugccugucugcugccagguuccucgccaugauggugauggauucuaaccuucuagaacuguaagccagcccucaagaaacuaauucuuuauaaggaaaaacaaaaaggcgacauuauuucuaagucuuacuaauaagcccuggauucgagguuugucagucauucucuucucucuucuucauugguaguuuucuagcucacaggagucucuuuaaaaguuauuauugauuauugaaaaucuauuaugccuuagggucuagugguaaauguguauaucuauacauuguauauauuuuauuacaucauaugccguauaccauauauuauauaucauguauuauauauuauguguuauuauauuauauauaauaauuauauauauaguguuuuaggguuaggguagaaguuauauauuuuaaagaaguagaugccuaacugcuuucugucacuuaaggccuuaaauauuuauaagugucuaguuucaugaaaauaugauuuugaaauuagguugagguuuagugaauuggaagcugugugaguguuggguucuuuuuuuagggaguagggggaugagcggaggcuuagaaccauggaccagcaucagagcugaaaugccuuccaacuuaacgucucuggaaaaaaagcaaacaaacccagaguccuguuuccugggaccuccgugucucucuagcacggugucagaacuggguaggcacacuugugcuucugaaaaggcuuugcaacccaggcucagggaaaaccgggcguuugcgaggcgcgcacacaguaaccuuuucuagauuucugcuuauguugguugugguugucccuggacugguuuggugcccugcggucaggaagccuugagaagaagcgaggagugcccuucgcuuagccacgcggcccauccuuccucaagaacaaacuaacuuuauuuuuauuacaguuuucugcuuggcuccucuggcaggcucuugguuucccccuuguuuguguauuaacuuugguguuucauuucuauacuuggagcugccgaggauauuucuguguuguacuaguuauuugcuuuuuguauauacacugaauguaagugauauagaguaaaacugaguugugucucagucucuauucuucuaacuucaagucucaaccaauccucagacagaaaagaacaaaaacuaccugaauuuucugauuauaucucagaauuuucuuaggucuccuaaugucuguuuuaaaaauccaaguauaaaaguccgggauguugagcagauauuugguuugcgucuuccucaccccacaaggacucuuaccuuuuaaaggaagaauucugcugauaaaaugacuuaauccaccuuggcacagcggaagggacacuuggcagcgcuucgcugcgaccaaggucacacaccagacauuagaucagcuggaaguccucucuggguuccugcugggucacuuuaggagacaggacagcacuggguguggggaaggcagccugugaccgguggccugccuucccagccuggugggucugucugagccggggcucucuguggugcccaaguucaucuggcugaagcccuggccucaguaucugaugggacuccgcgucaggcacaguagaguggcucacaggccccaggacucucuguuccagccuguuugcucuggccuggcuguccggcugcagcucugccacgauccuuucuuaacagucuccggguagccuugccuuucaccuugccuucccuuug

SEQ ID NO: 5709 - RNA, 11342 nt, Mus musculus
ccaucuuacuuugugagacauggucucucacuauuaugguuugaauaagaaugguccccauagacucagguacuugaauacuugguuguagagauguuuagugggguaaaacagccuuguuggaagaaauaugucauuggggacaguuuugaggguucauagcuucauccguacauuuuugcuuucuacuuuguguuuacaguugaagcuaugauuucuuagcuuccuguuuuggucuucugauaccauuucuccuccucugggacuguagccccuacauaaacucuuccuucuuuaaguuaugguguuuuggucacagcaacagagaaguaaccaauacgcucacugcuccugaagcuuagcaguuuggccugccugcauggccaacacauuccagggacccuucuuucucugugcuucaccgcuugccccagugcaggggucauacacguacgcuguggugcuuuucucugcgugcugggauccaaacucagcuucuccugcuugcauggcaagaaccguccaacugagccacuuccccgauccauacagcagcauuauucuugucaagucugcagcuggaaaucaacagagcacaauacaacuaacccaguugacaauaaggauguggcagggcaaagcuugggagcucuggcauggucgaaggcauuguaggcugugggcuuaaagcauuacauugaggcugacaaguaauugcccgaugacuuugacagacaaauuugccuaucuuaagcaugagcuuuuaaaugggagugggaaagagagaaaagcuuguucaaaggaaauagcaauuaaagauguucccagcaaguugggaaaagcuaaaggaaaaggcagaauuugugaccacgaugucuagagagcuauuuguaaagauuuaguuugaauuuugugugugugugugugugugugugugugugugugugugugugugcgcgcgcagagccccaacgaagccaaaaagagaguguugaauccccaagagcuggagccccagguaauugugagccaucuuauacagguccuaggagccaaacucuaaagagaucuguguguugaguguauguuucacaagaaacauacuuucauguuuguuuuagaauuuuuggcauauggauacucacguacuuguugucugggaguauauuaaaacaaaacagaaaagauuugacuuuucccaagaauauuccuaguaauuucuggggaagccagguguuguggcuuaggccuguauucucaacauucuggacguuggcagagguugauuuaguuuguuugcuuuuuagaauuccacgacuaagccaggaauuguguuuguuguuuauugauacucauuucuuuugccugccucgauuaccauaccauugcagcaaccagaccuacagugugagagccugucucagaaaacaaacagaaaaacaaacaaacaaacaucuuuuggagaggcugaagagauggcucauggguuaagagcacuugcugcucuugcagaagaccuggguucaguucugagcaccuaccugguggcucacauccaucuguuacuccaguuccagagcaucugaucccuccgggcaccagggacccuuaguauucauauauaugcaugcagacaaacacucauacauguaaaauaaauggcuuuaaagcccuuugaacuugcacuuauaauuauugaaaugaccucuauuaaaaaguaacuuucucucccaacuucucucccauguaaaaugcuaccuuuguacacacuacaucacuguucuaaaacaaaucugcuugcagcuacagaacugccuaauuaauggacuuuagcuuaguuuugcuuaccggugaaguagguugguuuuucaacagucaucaaagggugguuacaaaaacagguaucuagaugacaguguagugguggagagagauggcaaccauuauauaaagguagauggauguucuuggaccaccuuucuuuauggugagacaggaauguuauaacuuuaccaugcuaacuaagauaucagagaagacuguauucauaugccaucauccggcuuucucuuggagaaggcauacacugcuuuccuugugguguguguggagcuagcugcagcuuguggggccugcuuuuuuggcucugccacauguugacagcuaaaguuagucucacccacgauuggcugaucugguucgguugcuucucagaaucccaugacuaagccaggaauagcauuuugcuguuuauugauacgcauuucuuuugccugucucgauuaccacaccaucgcggcagacuuuggucuuugugaaccugucuggaaagucaaauauaucuagaggccuagggcuaaugacaccaucaacuggagguuauggaacagaaguuggagguaacucaaaugagaagaaaacguguguguguguguguguguguguguguguguguguguguguguguacaaacuuacaugugugcuaguacacaugaguagaggccaaccucugguuugauuccuuguacacugucaaucugguuauuuuugagacaggguuggucucucauuggcacagaacucaucaaguagguuugucuggguugccagugaaccccaagaacuccccugugaaguggaaacuuaaggguucuuuggagagucaguuguguuggaugguguuuugcugggacaaacacgugaaggagucuuugggggcacaugugugugugugugugugugugugugugugugugugugugugugugucaaacucaggcucuugugcuuacaaggcaaacauuuuacugaaugaaccaucccuccagccugagaagaaagcuuaauagcacacucaaccugacccccuuuuucauaacacuuaacgagaaagcgaaaguguagaggaagucuacagagauggcucaguacauaaaacccuugcuggacaagauggcgagccgguuuggucccuggaacucacauaaauaaauguggaaggagagagcugacuccucugaacuccacacgugcaccauggcacgugcacugguguuccaaacagcagcagcaacagcagcggcagcauacuaguaucuaccaagggucuugaucaggguccccucuucugugauguuagcugagaucuuccaaaguggucggaacgauacuucccaagugucuacaaagcuucucuuuguguucucccacgaggucucaccccuuuuggaauuauccuuagacugaggcccucucacuuacacugugaccuauuuaaggggugaacccaaaaguccaggacguugaaagaacucacguggguuugaggaucaggugaucuuuugcucuuuacccgauucuacauguagugggggggucagacucacaagggaucaaggaaaaacuucacgagagccaggcuccuuugagucacaggcccaagaguggagugaaucacaagaguaagccaagaggcacaucaaaguguaagaugaagaguuaaagggauggaagccagaaggaagauaagaaaaagguuuccauuuccugacuuaaggaugcacuccaucuauuuugguuguucuuuuuucucaucugaagugggggccuacuaugucgggggggggcuguuuaaaguacuagggguauagcaauggggacacagaccaagugucuacucauauucucguggggggaaaaagacaaacauaagaaacgaacagcuauugucaugccaaguaucagcaaaggcauagguaaaaagugaagccagaaagaaagaagcaaucuccaacaggacccaagcgagaaagcuuuucugaccaaaggucugagcucagugaacgccuuaugggaaggugaagaaaggacaauggccucaaggcaagauggccauauugaggaaaaaggugacacaagguuagaacaccuuggggaagaacaaaggacauaaaaccuggcacuggcaacaaucaucaccuucccagaacugauuguggcugaugcaccuuugacagugcaguucaagcgugucaauucccaacugaaggcaaccucuguuucucagaaguacuuuuagagucauuccgcucagcccuuguaaucugugcucucaccagaggcuaacaggccuggggagucacagugaaccuugaggagacuuuaaaaauagggucuccuaagguagcccuaguucaccuggagcucacuauguagagcaggcuggcuucacacuuugguggauugucuugccucuguuuucugagggcugggaucaaagguacagagaagaauaaaguaagccagcugugagaauccagucucuuaaacacagagaauuucacuucuacugacaaauacgcucccucccacuacuccugauacaaccagucuuuuaaaaugucuuugaaauuacauguauguauguauguauguauguauguauguauguauuuauuuguuuguuuguuuguuuguuuguuuguaucuaguggguguacgugugugcagugguacaaaccugccaaaggaugucagagaacauccguuugggaguuuguacucucuccacugugugggacucaaggauagaacucaguugucagguuccaugguaaguaccugcagccacugagcugucucacuggcuugauuuuuuuuuuuuuuuuuuugagacgguguuucucuguauagcucuggcuguccuggaacucacuuuguagaccaggcuagccucaaacucagaaauccaccugccucucuggcuugauauuuaaaacuuuggggcuuucuccuauuuccccacuaucaauagugaguuauuucuccaccguaagauaaaaccacaaguguuacaaaaggcaacuccuguccaugcuggagaggucccaagaugggugaggacuguggccaaugggagggccaugugcuggccaaagaagcuagccacuacucuaugucugcugauccuguuuugugggagugggaccucacaucggcagaucauauacuugggcaaaagaggggauuaaucuggauauaccaggggcauaaaaucuauagaguuuuaaucucuuucugcuuuugaaugccggcacaccaaccaaucaaccaaccugaggaagccaacccauaggcaagugguuuguggucucuauaguuacaagaaucucugagagacuugauuucaauagcauuaacaacauccauccaucaacauccacuuuugugggaaaauccacuauguucuuaggucucagaagucuggaggauggguuccaccugaccuacuucuccugauuccacaacccugaucuagggcacugauuuuaguggcauccuccucccuuccucccuaacaaguccucuguuguggggauggcacaaguaggauauuaugaauggaguaugcuauuaagaagcgcaugguagaaagugugagaugccuuggcauagaagaugacuccugucugcaucuucucaggacucuacacuccuuccccuaaaucucucacacuuaggccaaccacagcauaggaaugccucaccugcaguuacagaaacccaaaucaaaccaggccaaggaagaguaaauuuaucaguucccauacccaagacauacagcgucauacagguuggaauuccaacacacgggguccuuugucccuccagccccuguugccuuccuucuuugauguggcuaaaaacaaguugacccaccugguuaucauugcuguuucuccugaagcauuuauacucaaagacaaggaucuaguugccuaaagggguugugacacuagacaaggccuugugucccagggcaugagucacuccugugaauaagccaggcuuacauaugcucuagaaaagagaacagucccagcgucagagagagcugaagauacacugcaugcuggcuguacaaaugugagacguggaaccuuugaagaagagggccagaggauaauuaaauacgugauuucugucuacauguacgccagacucauaucagauuuaguugccaaagaucauccauuguucacccaacuucuguaagcugguagaagcuugccaacuccaguacuagcguacugucauugcagaacaaacauauccaguuugguacacuuugauuggguguucaagcccaggacacuccucaaugcaggcaaugaaagcagcucucuaguucugugggcaacacuccugugcccucgcaggguagaaccauaguagggauuugccauagucaguaugucauccaacugaacagacauguucuuaggcauccaguaauagaauuauaucccucuuugacccucuauaaguuuuauuuauuuguuuaaaaauucuauucuuuaggugugagguguuuugucuggauguauguuucugcauuguguucaugccuacuccccucagaagccagaagguggcacuugguccccugaaacugggguuacaaaugguuguaagccaccaugugggugcugagaauugaagccagguccucuggaagagcagccagugcucuuaaacacugaccuaugucucuagcuguaacacccuguaaauuuuaaaguugaaccagaacucccuggaguucuugggcagccaccgauggaaguuuguggugagaauggugugugugugugugugugugugugugugugugugugugugaucauuucauuccauguacgugaaaguaagacaagcuucuccauacugagcacaaccaaacucucugagaguagaagggcaagugaaauaccagccaguccuuagaaagaaugcacuaagugccaaagcucuuuucauggauuauuuuaauugucagauaucuuguggggcaacauaucuguucagugggcaccaggcacaacauccccguaauauagguucuaucaccgucucucuaacuugccaaagguaacauauauaaaaaauugacaguuuacaccugggaagugcaaucauaaagccuugaugauucauucauucauucauucauucauucauucauucauucuuacuuacacuccuuaaucagugauguccagugccuccuacauguuaaggaugguucuuggugugcaagcagcagccacauuugugagcaauggaaggaagaguacacgaugcucacauucuagaagaaaagaaauagugugaguuccacagguacacgaaauuuuauuuaaguugguguggcagcuuacaccuuucaugccuguguuugggaagccgaggcaggaggauucccuugaguauguggccaguuugggcuacugagugaaaccuugauccaaaaggcccuuuguccccccaaauaaaacaucaaaacagugaauagcguuagugccuagaagaggguugugcguguguguguuuguguguuguguguguguguaagauucuaaauugggugucgagucuugcuaagaaggcaacauuaaauaaagaucuaagggggacuggcgagauggcuuagcagguaagagcacugacugcuuuucugaagauccugaguucaaaucccagcaaccacaugguggcucaugagaucugacacccucuuuuggugcgucugaagucagcuacaguguacuuauguaauaauaagaaauaaaucuuugagccggagcaagcagggacugagcgagcagagguccuaaaauucaauucccaacaaccacaugaaggcucacaaccaucugaacagccauaguguacucacauacauaaauaaauaaauuuuggaaaaaaaaaaagauguaaggaauguacucaggaguaaaccauaaagaugucugaaugaacacaagucguggaacagacaauuggaccagaagcagcagcagaagagcauuuuaggaaaggcaaggaguccagaaugccugagacugaggcugacuggggcaagagugggcuaugaguauaaauaggccugggacucaaggguguaggaaacaagauccgaaagguaagugggaauggauccugaaagacccugcaaguggcagggcuucgucuuuuauuuggcugcaauguagucauuuggguugggccagaagaaaacaacccaguuuccacacgugaacucuugcuucucugucgaggagaggcugcaaaggggcgaggaagccauggaagagacacagcagugaccggggcagagguuaggcuaguuugucccggugugcacuagauguguggcaagcacuucaagucuaagauuguugugaaaccucgaguggaaggauuggucgacggguguguaugggagcaauuggucgugugaugcccugagccuuuuagcccuagcgacugaacugggaucccuggcaggagaggcagggcaggugcagaggaacagcaugcuuuuguucuaagugggagggguuaucagggcucaguucagggauguuuaauuagaaauaccuauuaggcgucuccaaaggugaugcugagagcucaggagagggguccuucaaugccgaaguucaaggucaacaagauacgcucuacuucagggcaacugaagacauugauucacacaugacuuuggcaaaaugaugauuaucaaacacacaaaccaaaaccaaaauaaauaaauaaauaaacaaauaaauaaacccacacacaaaaaaacuagauuaagaaugucagauuuaaaaauccaccccuauucugcuacccucaaauacuugauuugcuuucucuauauucccuccugguuuugcccacugguacacauaauugcacaaugccguucuacccuauuugcuugccaggaacucauagacauuuccuaaguggcuccuacagugcucaaagaggauuugaaaggcugacaaaauguagggcauggaauaggcuagaaagaaaaguugaaaaauccuaaauagcuuggugaccuacgguaagcugugugccuaccguaaucuuuguggccagugacuccuuguuuaggagacugaacuuugagaugaaugagggcaagccaccuugcacucagucagggagagauucuagaaaaagagggucugugcaaaggcccaggagggagaaaaaaacaaacaaacaacaacaaaaaaaaacacaugcuaugguuugaauggaaaaauaucccaugaaggcuuauguauuugagucacuucuuagcugguagcacucacuuuugaaggcuguaaagccuucaaucuguggguccuaccccuuuggcaaaccuugaucuccaaaguuacauaagcacaggcacacacuuccacuuccucugagguuuucuaccaagaaaggaucaaccauucauaaaauguugguccuagugaacccugcacauuguagaggcuuaaaaaguuuaauuugggccuccaacucacuacacaggaacuccagcgggauccgccuguccguucaugcuaaccuuucaccgacaucuuguuuuuaaguuuacagaaaacguuagggaccuaaagaaggucauuacauuacaguacauuacaguacaacagaaguuacaaaguagcaaugaggggcuuggggauuuagcucagugcuagagcgcuugccuagcaagugcaagacccuagguucgguccucagcucugaaaaaucaaaacaaaacaaaacaaaguagcaaugauaauaauuuuaugguugaggggucaccaugauaugaggaacuguauuaaacggucgcugcauuagggaggaugaggaccacuguggggcucagcugaaggaagugaguugcugguguagggcaccggagugcuagauguaaaccgguuuccugucucccuucuaaggcugacugcaccacuaauuccugccucccguggagggugcuuuccaggcuccaagccuuccugccauguuggaauguguccugugaaccaugaaccgagaucaaucuuuccucccuuccaucaccucugccaggugguuuggucauaguacucaguagaguaaggaggcuggaagauuuacuacaccugacaaagaaaaauuaaucuguaugaucucaaaaaaaaaaaaaaaaaaaacaccaccaccaacaacaaaaaaaccaacaaaaaaccaaaacccuuuaggagugcagaagcacaggcacacacuuccacuuccucugagguuuucuaccaagaaaggaucaaccauucauaaaacguuggucuuaguuaucccugcacauuguagaggcuuaaaaaguuuaacuugggccuccaacucacuacacagaacuccagagggauccgccuguccguucaugcuaaccuuucaccgacaucuuguuuuuaaguuuacagaaaacguuagggaccuaaagaagguaagcauccugcuaaguuacucccuggcuuuacacaggcuuucuaaaacuugaguaagaggcauccuucccaucaaagauuccaggaaaacagccuccccccuccgcggccacacauacgaaucuaucgcugacaaagccccuguaagcuggcuuauguccuccccucgcguucaccauucuguaagugcauagaauuauuuaagaggaaaaaaauuacuguggauaaaaauugguucggggccuuggaauuggccggucguguuguguuuccuuccagggccggcaggcggggcaccaggcaaggcuuggaagccgcgccucucucaaccucuccuggccacccuugcccaacuuccccauagacacagcuucaacuaaaaguggccauugaccuuucaagcuuuugagcaguggggcaacagaacaguauuucaaagaaaaaugguuaucgaaauuucgaauccgguuuucccaugaguguuuuuuuuuuguuuuuguuuuucuguuaaaaaaaaaaaaaguaggucacauucaaagugggucacguuucaggagccggcgugccuggaugccggcgcggaggcuagguggccucuuacagagugggaggugagggucccaauaggaaagaaguacugggaucaauacgaacuccgggucccuggcuuugcaaggauucacagagacaaacgcaccaggccugugaccccgcaccccacccgggcacagguaagggcaccuccucuguaggguggccagggugggucucccgaagggcaagcaggaguugagcugaggaggaaaggagaagcugggcaaggcugaugcaggggacuaccaguuggagcuccaggggggagggauugagggcagucugcgcagcuuuaaggaggcgcucagcucgucucuuuccuggccuucuaggaugcuggcggaggggacagucucugguucgcuucccgaggugcccgggagugguagucgaccugggcaguggcgug

SEQ ID NO: 5710 - RNA, 17214 nt, Mus musculus
uaaacuaaaaauaaacauacagagguuguuuccauuuuuauuugauguuuccaaacguaaaaaagucaagauucuuacaauucuuacaacaguucgaaugcaaccaucucagaugagaccaugcaaagcaacucuuguacacauacccuuuucucuccuucaccuuugcugcuucauacggugugacugacaacuggauggcuuguccuuggugggaaaaugccauuucuuuacaccaccacccaacaguuucuacuuuuuugcaagucaauuuuuaacaaguuacuuugcuuuuuucuuuuaaacauuaggaggcacauggaacuggagaauuuagcugccccguuuuauucagcgccugcacagauaagcacaaacagcagucuccccgcugcaggcggcugggcugguagacaugagcucuacuagauucaauuuccuuuagaucuuucaaguucuggguuccagaagaauaaugaggagcccucaggugaaauuuaacagugaagcugcauucaguugcauucuguaaaucuuugcuauuugcauagacuaaagacaguuugcuaaauggcacugaaagaaauccugacccaggugacaugacuuaguccaaauguuucugaccaaagaaauuauacaacaauauuuauaggcuaacuuuuaaagagaugguugacaugaauacuguacauauuuuacauauaaaauagguucaugcauuauuaccucugagaguaucguguacauacaaacccccaagcacuugugaugguuuauuugcuggaagcaguauucuauacaaaacaguccaguuucucuguuguguuuaguacagggaagaauugcagagaaucgugagaaaacaagauagagaaugacaaucuguggguuucuuuaaaauguuucuuuuaaaacacccagaguacaugaccucuguacaaagaaaaauauaaaaggucuggacgaucacgcuugguuacacuacauaauuuagaaugaguacuacuggcugaguucuucugcuuuggaaucuaaugcuuuuaguucugcugcaucgguggcccaagaucucauuauggaaacggugccaguuuuccuuacaggcaaggacccuugucagcagcacuauuacaguuuaaagguuaacaagcgacagaacaaaugucuucacugucuuaagcuugccaguuagaguauuuacaaaagguuaauaauggcuaaagaucuuuuccucuucucccccuucacuuccuccaugaagucaugguacuuuuucaugggauggccaauuuugagucagcacaaaggcgagguacaauaauucuuggcucgaauguucuaguuuccccacaguuaacucaucugacucgucacuuacugacccucaagacagugucuuaggccuagaacagccaucuuauuuagugugacaaagucgucacugaccggcauccaagguuagucuaguccaguggugaacaaugucucuaaaucagaaacugaaaauauauuuaaagaguacucacccuugagggaaauguggccccuaauagagucuaugucaaagaagggaaauagcagcugagcgugcuaaauagauuucuauaaccaguuucaggaugagcuaugcagagccacguguaaguacugacaguuuucccuaaaagacggcacacuuucacaucaaaucacuguggcagaggggaaccgguccuaguacauggaccgugacauaauucugccugugaacaaauucucagaaacaggaagcugaagugcuuugucaaaggcuccuggcccauacaaacacggcccaaaucugcaguuuacaaagggagaauaugacucucuuuaaguuuugggguggauagauuucuuuaaauaccaagaauuuuucauuaauucccaacaaagauuuggugucuauuuugauacuguaagaaaaaaaaaaauugggcaaaaaauauacccaauaaccaguugaucugucaaaacaaaccauagaauguuaaguggacaaaagugaaaaugucaaaaagguuauaaaaaugaaaaccaaaggaaugggguacaaugaaggcuuuaaaaaaaauuccacauggcuuuggcaucuuaaaauauuuuuugcuauuuuguuauuuauuuuaaaagacuugaaagcagaugaaauacaugcaaauuauuugaaaucccugcauagcaaauacagaguuugccagcagcagucagguguguuagaagugaaagagccucuccuugugacaugugcaucacaugaugggggagggaccccaacccucuaucuuauacuggauggcaccccagagggcggcgcagcagucacaaacaaggcauuguuaucugggagggaagggaccgaggaauuuccauuggucggagaacagcccagcuuuaguuuuuccagauacucugcguggacaggcuuaugacacugaagaaccuugauugcaucuucuacuuugaaccacucucucuuccuuccuagagaagaguacagcagcagucacugucaggucaguuuaagaaggcauacccuacuaauauacaagauuuccuuucuuuccccccaaacaaugaguuuuuuacuuccuaaaugacuuaauaauaugguagggaaaaaucauaagguaguucaaaaguagaacuacauguucaccccucucaaaacaguaaccaaaaaaaucaguuaagaaggaauggcagaaggugggagggaccagaaggaauggcaggugggagggacggaguaaaggaacagaagcucaccuauauucacggagucuucccagucuuccaauauuucagugacagucagaacauaaacauauguucugugcuuccggucuugauucugcuugaauagagaaaaaaagcauuuuaauucagggcucuggcccagugaccagcacggcuguuuccagugugacggugcauaguguagcaaugcagacagaaguguguauauauaaaacacacaccucaaaauuggcauuggcaggauggcucagcacagaaaagcugaguuggaucuugggagccuacaguagaggaaaaucauucccaaaagcuguucucuagccuuuacacgugugcauacaugagcacaggcaugcacgcgcgcgcacacacacacacacacacacacacacacacacaaaaaaaaaacuuugcacugaagaugguaggcauaguaguaguucacagcugaaaucagaaccuggaggaccaaggcaggaaggauucaguuucaaggccgccuggacuaccuaccuagcaaguucuaagccagcugaggucagauuuacgauccugucucaagaccaaagacacuagucuggguauguuggugcaccccagaaaccucagcauuuagaagcugagacagccugcauuacaaugauguaucucaaaaucugaaacgggagguccaacaccgccaaugggaaauugcuaaaaacaugucacgugcugugauacucuaaagggaaaaacugcuggcugccauuuccugucaaauagugugcugucuccuuaaccaguuaaguuuuaguuaugauuuuucuuuacaaacuggccauagugacaaagguguaauugguuucuacacauuaucacagaaaaauuuguauuucucacuuuaaccagaagauggugcuauguaaccacagauaggcauuuuguguaauauuuuaagaacuacauuuaaaaauuuuuuaucuuaugugccugcauaugccugagugagggucagguccccuggaacuggaauuacacuuguggacgugggugcugggaguugaacucagguccucuggcaaaacaaccaguacucuuaccuugaauauucuuaccauugagccaucucuccaaccacaagaacuggugccuuaucaauuccaauacauacacacuugaauuccuaaaggcuuaauuaacucuugguucuaccaagaaagacugagcuaacucuuacguuuugaugagggaagaccccguacuuguggcacagcacacaccacacugacuagggauucacugacuucucaacccagccucucucuccaccguccccuugcugaauuccauccugccucguuagugagagaacacaaaugagguuuauuuuagcauuuauuccuuguaccugaguuuuccgugguccuucaagucacuguuuguuguucagcgucacaugcugaacuagacagaacccagucgcccccagaucuuaagaccuagaucucagacugcuaaagaugcugccuaugcccauguggccagucuuugugugagcucuacuccacggucagacauggguaacuacccagccucccccgaugcuaaccaguggccugccugcuggucguuuuagaggaaccuggugcaggcugcuguuaggaagaaucaggaaucaaagugagggcuauuuugugacucaccucaaauauuccgagcagucugccuagcuuuccuuugacuccagccuauuaaaaaagaaacaggcuagguaaguaaaaugcuuaucuucauaaugauucauuauaagcuauguuuuguuucaacuucugaaucuaaauaguucaggcguucccuagcaaguuagcugucuaauuguaaauuucuuggccauaccaagacucacugccuauguauagaauaauggcucaauucacacacaaaucccaauugccuggauugauuagaugacuuucauuuaaaaagaaaugacaugggugauaaaaaaugaacuucuuaucaaacugaaggaaaacaauuuucuguaugaacuaacagacuccccccacuucucaauuuuuaaaaauuuucauuuauuguaugagcacuuugcugcauagacauccuuaggccagaagagggcaucagauccccuuauagaugguugugagucaccaugggacaguuggggauugaacucagaaccucuggagaaacagcugagccaucucuccagcccaacuauaccuucuuacaaaccugccuucuuuuccaggcaagagcuacaauucucuagccaccauucaaaggguccugauuccucaccccuguuacuauagcaacagcagcaauggcagugcuuccugucagugaagcugggaagcauuucccccaggaagcccaucucccaagacuaaaaccuuccugaauguacccggaagcccagugacagagucuagcauauacuacacacuucuaccuuacauggucucaucugaguguaaagccaaguuccaauccugagggaagggacaaucaggccacuugagauuuugugcaugaaggugugacaccuuuuauuauugaauuuuaaggcaguuugaauguaaucuagacaauccuuauaaacauugcagaagagaacacuucugucaacugccugcuugcauuugcucaggauuaccuggcaaaaagccagaagacccuccuguaaaaccccucaagacagccuucaucucaccucuucauacacuucccucacagcagcaccgccaggcuccuccuccggcuccaucccuccuccugggacaauccauuggucuggguaccgacugcuacucaccagcagcaccuguagaacccauaguagccacagacuuaggcacuaagacacagauagcauuuucauggcuguugcuggacucuggauuaauccacucugaaaucucacugaaauuauuaagggcacacaucaacaggauacagacugacaucacuaaaccauccuacuucugcagacucauuuauauuggggugugugacuuuggcuagccuggaacucuggcuccucugggauuauuuaaacuaccagauuuaagaagugcaguuuuugaagggcagugguggugcacgccuuuaaucccagcacuaugggaagcagaggcaggcagauuuccgaguuccagaccagcuuggucuacagagugaguuccaggacagccagggcuucaguuacucuugagcuauauauagaaucuuuucucuucaaauuaaagacacaaggccacaggcaggccacccuguucacccaugaucuaagaguuugugaagaccagugcugugagaaagaaguagggaaaugugcgaacaaacacuagcugagcagagugugaagcucacaguuaggugggaagaggggccugcauauuccaaaaccauuugauuaagccagucagauaaacagcuguuaacuugugucuagaacaagggcaaacuacagugcacuaguuuugaacagcucaagcugaaaaggaaaacaaaaaacaaaacaaaacaaaacaaaacaaaaagguucuuuuuucucuuccuuuguuuuuggaaaugggaucuugcuguauagccuaggcuauauggaacuugguauguagcuagcacaggcuauguaugcuugaacauacuccucuggcucuuaaaauuaaaagcuagggauucuauagaagaugccaggugguuuuuauguuuuaaauuauguaauauucagacuucagugcucauaaguaaaacuuuauuaagcaguagacacuaucacucacuuuugcauuuugucuggugcuuuuaugcggcugugacagcagaauuacugagaauagaccagaugagcugcaaagccuggaauagucacgugaccuuucacaggagaaacuugcagacccaugaucaagaagagcauuaagcccacaguauuaaaaaccaaaacaaacaccaccaacaacaacaaaaagcccacucucaccauaaacaaggauccaaguugcuaacucaauagcacugagguacuacugcagucauuguucaaaugagaaacugaaaugcauucauucaaguaguacaagucugaaacaaccgaacacuccugaagguagcacaugucuuaccuauccugaacuaugcugccuucaaauacauuucaacagucuucccguggacggggaacacaccacauucacaacuuaguugaugguacuugggaucaaacccaaggccuuggacaugcuagguauccuagucggcuucccauugcucugauaaaacacugguccaaaccaacuugggguagggagcaaaggguuuauuuauuugguuuauacuuccaagucaccauccauuacugagagaagucggcagacgcugaggaggacagcagggagcauugagacucacuggcuuaugcucaccacacuuacacaacccagacccacuugccuagggauggugccacccacaacgggcugagccugcccucccacuucacuuggucaagacaaucucuuacagauauagccucagaccuaucugaucuacaauuacucaacuaagguucccucuucucagggaaaucuguugugucgaggugauaacauaacauuagcaagcagcacagcaggcaaccacucuaaaauugagcuauauccucaucuccccuccccacaggggguggggagagauuaauccccaaauguggauacugcaucuuccugacaaccacaguaccaauucugcuuuucucccuucugcuagaaacacagggguucacuccuauuugaaaaaggaugguguguuugugugucuacaugcaugagugugcauggguagaugucuugugucuucuauggcucucuacaacucucacugaaccugguccucaccguuuuggcuagguugacccacaagcuccugggaccugccuguucugcaccacuugacacacucccgaguguugugugucaccaugucuagcuuuucaugcggcugcuaaggauucaaccuucuccagaugggaagcuucaguugaccaaagugauucaacaguuccucuaaucugcuguccuugccguccugggccuaacugaacacugcugugcuguccacaccacugcuuuaagcauggcgagacaguggccaauccagggaaacacugagccagcauaaugguuggcagggcauuagguaaagcaccuguggcugcuuugggggcaacagcaucauguccaaauagagcuguaaauaaaaagcuuaauaucugcaaauagggccuacauucauaauuagaaaugaaggagcaggcauuaggcagagcuaauguguuagcagacaggagucugaacuugaagcacacagacuggagaacaucguuccuuguuagugcuaagaucucuucgaggaaagcacuuaucuggcaagccuaauauuugagcugcuggccuuagcaggcccugauggccacuggggacuccaugcucuccugccuggugagacgagucagcucagccuaauucugagacugaaaacaggauggcaggaaauauuuauuuuuaagaaacuguaaagacucacuaaaaguaggcuauucauugaugugcaauauaguauugagaaguuggauaaaauuuaaauccagaauucugaagaguagguaggagucuuuauguucaaauucuaccuuaaaggaagcgagguugugccaggcagugguggcccacaccuuugauuccagcacucgggaggcagaggcaggcagaucugaguucgaggccuggucugagagagaaagagagagagagagagagagagagagagagagagagagagagagauugcaaaccccacuucaguaacacuguuguuacccaaaaggaggcgaagcaacaaccccuggcucugacccguuacuagccucuuguucuagucagaguuaagaggugaccugguauuauuggcuggauaaaacuuuugcuccauaauccugugcuaagugacuuccuugugcuuuuauaaugggucaggacaguggcacagauggccaucgacucauuuagugacgucgucucaaaaccauugguguucagcacuaaaaacuaaaaucggcgccaggaaucgaggcugaugagccuuucccgggauuuucacucauauucaucccgaccccaggcacagccccuucucugcaccccgcccguuucagcugagacagggucuccuguagagugcuccacagcgcccacccuugggaaggcggaucugugaucuaguacaugccaggaaaugcuuccucauccacaacucuacgcccuugguuugccacuuccacgcugugcugaacccuggggcuaacuuucugaccuuuccugguuuacugagcaccagggacauacaugugaacagcugccacugguggcaggcagcuacuuaagaaacaaauucaaaacccuguaccucaaguccagucauauuuuaggugcucauuucaagugccacagagcagauuacagagaucuacggcacuucagagggggugagagguguaacuuuccacguacuccacacaaaaggucaccacucagacuaagcccgcgcagccccgcuuuccaacucccuacccucauaauccaucuccugucacggcaauaaaaucuagcgcuguggaggaaggaucacuaaacuuacccuuauucucauucucuuacaggugcaggcaacugcggcaaaccaccagcuucgccaggcuaagagaugacauaaaccccauggcggagauagagacuaguuaaaguauuauuaagcucucaucuacucacccugaauauuccauuaaguuggaaugagggcacagccaccuuuuagagggaagggcaagggugacuaaagagcaagaggccuguguggugacacauucuuguggucccagcacuuaggagguagaggcaggaucaagauuuuugaugucaacauggauuggugaagcccuaugucaaaaaacucaaacaccaaaaauaaugguguagagggcuggagagagggcucaguagugaagagugccgacugcucuuccagaggaccuggguucaaaucccagggcccacauggugccucacaacuuguguacaaugccaguuuaaggugacccaaacccucuucuggccucccuggauaacagggauagacacggcacacaaacuucuuccuuuuuuuuuuuuuuuuuucaagacaggguuucucuguguagcucuggcuguccuggaacucacucuguagaccaggcuguacucgaacucagaaauccgccugccucugccucccgagugccgguauuaaaggcgugugccaccacaacuggugcacacaaacacuuaaaaaaucuuuuuuuggguaaagccuacugagugcuguucucccaaauaaaaaauuacuaagguauauuuauaaaggacucacuuaucuuuuuccaguucaagccaagaaagaggggaguggcccagguuacaauugcagauacucuggagggaggcagaaggccacaaagucaaggccugucuaaguuacagaguuagcacaaggccaccuugggcaauuuuaaaugaagguucuguuguuuuguuccuuguuucugcuugguuuugagauguacuuauuauguacaguggccugccugcauguaugccugcaggccagaagagggcaccagaucacauuauagauggucaugagccaccauguguuugcuaggaauugaacucaggaccucuugaaaaauaccuagugcucuuaaccuuggaggcaccuuagccucauaaucacugaggccuuagugagaucuugaaucgcaaaggcaaugugugaaguauaacuccugccuggccuucccaagacccgggcucaagccccagcaugagggccguggucacaguagggcuccacccugcaguccuuuccacugaagcgagugcacugccaggagccgcagguggugcugccacugaauucauaaggucucaggguguagaccaaacuagccuggagccuuauguagaccaagcuggccuugaacuuaugaccuuaugcacaaccauaaaaguuaaguaagccagggccuuucguggugacacacaccuuuaaucccagcacucggaaggcaggggcaggcggauuucugaauucaaggccagccuggucuacagagugaguuccaggacagccagggcuacacagagaaacccugucucgaaaaagcaaaaaaguuaagccaggggaaaguuaauauaauucaguguacucuucaaauaugagccacucagagcccagcuuccaccuucccuucuuccaucacaaaucaggcuuuuucagugcugggcacacaugcuaaguaaguacuacugggcuauauacauccaccuuuaaaacaaacugagauugaugccagacuugaaggcuccugaguguaaucccagcacugcagaaaacagaggcggccugggcuauggggaagaugcuaucaacaagcaagaaaagggcccuggcaagauagcucaguuaagugcacugacugcucuuccggagguccugaguucaacucccagcaaccacauggugguuuauaaccaucuguaaugggaucugguguccucuucuggugugucugaagagugugacaguguacucauauaaauaaucuuaaguuaagaaagaaagaaagaaagaaagaaagaaagaaagaaagaaagaaaggaagauagaaagaaagaaagaaagaaagacccaccugacuuuggguaaugagauggcucagcuggacaggucacuugcugacaagccagaauaccugaggcugguacccacaugguagaaggaaggaaagaaagggauucuacaaguuguccgcugaccuccauagcauccucuccuguccauauacauauaugcaaguaagaauuuugaagagggggaccgaacaguugggugagagagcaggagucacuguuucucagcaggugggaguucaucuucuguuucauuauaccuuuguuuuaaacucuagguugguggguaaauuagacuaugaauaacuucugcacaugcagacucuaaaaucaagucaacgugauuuauuuugggugugugugugucuguggugagcugaggagggcuggggggcuggggagggggcuggguggcggggaugaagccauuuaccuagucacaacagcaaacacuuccuuguaauuauacugucuucagaaacuggacagcugaccccaagcucccuccaugaacacuaaagacucuccccagagaaaccuaucaaaaaguacuauuauuuaacaccccaaagcagacaaauaggaucuacuggguguacaacacagucaacaugcuagcugauaaacacaugguauuacugaagcaacgaaucagaaccaucacagagcucuuccaguagcaagaggcacccacggcugacaggaagaaagccaaguagacauucaaucuuccagguaagccguggcugacuccaacgcuggagaauuaucccgaaaucacccucugacaaaucauacaaaugguagcuagacacaugcucuuccuagaagaagcugcuucaguggucugagagguucuccuucaggucugggggagccacagucacagauggguguaccucacaauguuccuaaaaggugugccucgagcugggggcgcagcucagcgguagagugccugcuugccuagcacacacaagcucugacacaggaaagaaaacccaugugguuauuguaaguggucuccauuugaaugccuuaucuguucagugacuuaaaucucuuggucaaacaggccaauaccuaugaaccgggagacugccagagguuaaaugacaacugauccccacccccuguaaaggccggcaggguuuauuuguuuguuugguugguugguuuuuuuuuuuuuuaauugcauuaggauuccugacuggggccgauacucuucccggcucugguuuuaguuuugccuuuuaaggagccuucauuuucaccaugccuuacuuuugcuggauuuggacuuuccuaagcuaucaagcucuacagcaggcuagcccagagggaggcuagaugcuucauuugaaccaccgauccagauccaagacagaacuggugucccucucagauuuuucgagacaugguuucucuguguagcccuggcuggccucgaacucagagaucugccugccucugccucuuaagugcugggauugaaggcgcgcacgccaccacugccuggcucgcucucagacugauuugcucaugcaccuggaugcaacccaggauggaguugcuugauucuaugucccacuuugcucucaaaucccucaaaagucuaaaauugaaauguccuuccugucuugccuggugugugaccucugaggugcuguuuucccuggaggcuuugugugugguaggcaagcaagcauuccaccacugagcuauucucuacccaagguucucacguuuaaaaaaaaaucauuccccuuucucugccaacccaagcugcucuugcagaccacagccccgagccauccuccucuucuauuuggggugcuaggucccuccuuucccauuuacugaaguuccaagugacacacacugggcuccuaaaccaaagcacacagagaagaaagcacuccaggccuccguuguuauuucccccuguuucaucuaaucuuccauacgacaguguauguuccuugccagcucaaacuaucuuuacauccacuauucaaauacauaugcaaauauauucaacgagagccauuucuggcuaccaacucaccacgucaccgucuuuucuuugccuauggagagaggagcccaggauugaacccaggcuccuguguucgaggcaagcucucgaccauggugcuaucuccuuuagcaacgcuuccagcagaaacaauuuccaagcacacacacacacacacacaccaauccaccuaccugcuuaaagucauuuauggacauauaccugugggcuggucugaaggcucaaagccacacugaagcugacaggccuccacaggaaaaacuagccagagaggcugcucagauacacugaagacuuaaaaacacggggagucaaguccugcuuguucugugaccuugagauauguuacuucugugcccuaauuuauaugcccugucacucuguagaccaggcuggccuugaacucagagaucagacccccuuugccucccacaugcugguaguuauggcgugcaccaguaugaaccacuacuauaagaaaaaccuguucgggcuggugagauggcucaguggguaagagcacccgacuguucuuccgaagguccagaguucaaaucccagcaaccacaugguggcucacaaccaucuguaacaagaucugacucccucuucuggagugucugaagacagcuacaguguacuuacauauaauaaauaaauaaaucuuaaaaaaaaaaaaaaaaaaaaaaaaaaaaaagaaaaaccuguucucagugggcaucaaggcucucgccuauaaucccggcacucaggugagccagccaaugggggcucuccguagccuuuuaggaucagaugguaauuaacuuuuuuuuuuugaaguuacccucaucuuuaaaaacauacauuuaaauguucuaaccaggaccuacaacuccuuaacccaauaaauaagcaguuuuuacccauuagcuggaagggugggacaagcagcuuuggucuauccuuggauggcucgugguaucauuucaacagggaaagcccaccuguagcuuucccagacaucuuacugugcugcuaagagucuauuccguaauuaucacauaauagaaagagccucaacuguacacaaccacagaaguaaaauuuccaaagagccaaaccagaugcugaaaguuggcugugugcucgggagaauuccagcgucuucccucagagcauauccccuaacaaguugauucaccggggucccccagccuacaggcuccaagagccagcgcuuuacauaauggguuucucuaauacuccccaagccuugcucaucucacuguauuuaaaaauacuggucucauuuugaaaacaggcuguagcaaugauuuuacagcaacuuccuggagagagagagagaggagcccaggauugaacccaggcuccuguguucgaggcaagcucucgaccauggugcuaucuccuuuagcaacgcuuccagcagaaacaauuuccaagcacacacacacacacacacacaccaauccaccuaccugcuuaaagucauuuauggagcucuugucaagacugccuugccagacacacaauuuagauaauuuugauuucuccuauccucauagcuuccccuagggacacacacagauacaucccacccccaaacaaccccccacacccccagacacccccccccacauacacacaaaaugggcccugaauuuccaacuguguauuauggcacaaucucaaagguaacuuaaaaggcuuucaaguuuagccucacaaaacacggagcacccgacugcugagcagaggcccuuuaccaagaggccagcuuucugggguaggaacuacaucccuaacuaugauugcuaccuaauucugucaucuggacaaagaauuucugcucaaagccgucuucucaccuauaaaacagggcggaccaguacuaccuccaagugcuaaaaggauuaaauguaacacucccggguugcaccuaacucauuguaaacgcucagcuaaaaauccgauagagcagugaacaggucagacuggauccugggucacuauucgcuauuacauguuuuuauacuuaguuugccuugcccuagcacggcaccuccuucaaagacuccccccaccccaugauagacugcauuuaaggcuuguuggccuuuuuuguccuuugugcacuuuuaaaagguccuauauuccguucucuucuaaguagacucagcucaaagaccuuucucuagaaguuccuucgggauuuggguuuaacacuuagaagcuuucaaaucaaccuuuaaaauaaauaaauaaaaagcaaaagcgguuuaaagauccuaacuuucaagcacgcggcuaucuguuaaccaccacugaguguacgcugucauacuuaucauaacuucaggggcuagcaauaaggaagccauuagaucccaucuccaguuuuaugcuuggugcuucccuggacgcggcuacagaagcagaacucagaacgcuaacuuuuuuuccucuaucaguucauuuuaggcguggcagcgcuacaagauuucccccagcuaccaagugacugaacuauccagagcaggaugaaaacggaaucauuuuaaaaccgaauagaacugaagugaaauaaaauaggcucucccagagauuacuccaaaggucccuauccguccaaagcagggcgaagggucggguaaaaucacacgccgcuccuucccagaugucaagucacaccgcagaacagccuugagaaaccagaagagcgagagauggccgggcugaaaagggcaacuucgccccguuccuggccuaucuugucccuucuggcgucauuccacaucucucgcuggccaucuuucggucgucagaaaaacuuuaaaagcggaguccgcuuugcaaaaggagguaucuacguaaugaagccaacagcuugcgaccuaaugggaggucuaaaaggcaggcuggcgaaccccggaggccgaucuccagcuccgggcguggggguugccggugacccgcaggcccgggcggugcaggggggugcgggaugaagcccggucgccagccuuuguccccgcgcuuaccucguccuccugcucgcugcggaagcacaggcaggccgcccucuucuugaagcccucgcggucguacguccgcgucugguugggcuugaacuucauccuagagccgggcuccugcagccgcugcuccggccgccaccguggggacccggccgccgccaccccgccggggagucgggccgaaggaagucgcgaugcucgggcgccggugggacgggcggcggcggcggcacggacacggacggcgaggccgggcggccgccgggacgcggggcggaacgcgggucacugcaguccgggcgcagcgguggaagcgccgccucugcuccggcgcccgccgcucuccauggagcccgccgccgcucgcagccacuccuugcuugcacccgccgccgccgccgccgccgggggaagagcgcggcucguggcucgugccacgcggagacaguuggaagcgacggugcagaccgggcagagacgccgaggaugcgcgccgcccccuucgcccgcauuuaagcggggcucccgcgcgcgcgcgccg

SEQ ID NO: 5711 - RNA, 4132 nt, Mus musculus
ugagauaacuaugugcuccugcaauugagugcccucagcacucaagaggcugaggcaagaggaucuugaguuugaggccagucuggucuacacagcaagacuuuaucuaaaacaaaguagaacaagacaacaaaacaaaucaguaaugugaggggguggggagacuaugaaagaaauagaauguuagauagcuuggggcuagggagggagcucaaucaauagaguuugggccuaguuuuguacuaggccaugguuuaaauccuaccaccagacaagcaagggaugguggucccauggcuguaaacccagcaccuagagaugggaagaacaguucuaugcuauccuuagcuauguagagaguuugaggccaucccgggcuaugugaggcuuucucucaauaaaaacaaaagcuaaaagaaaauaaaaacaaaaacaaacaaagaaacccagcuuggugugguagauugaagaaagcagcacucucuguuuauccuuacuguuucucacagauguggagucagucuagacuuugauggaugauuguaaagauaagagcuccuacugccucgggccagacaggugacaaagcagcuucccuuuccugccuagggauugaacuauccucuccuuguccucugcagacucccccucccccacaguacuguccagguuuggucuguugcuauguauuguaaugauacauacuggccuccaagaucuggucccccuaccacacacacacagccuuagggacaaggaaauccuccuguacaugaugcuauguaaccuugucucccaagcuaucccugaugggucaauaaaaaugccuacagccuguagcugggcagaaagagguaggcagggcuuggguucuggggcuuggggucugagugagagacuagaagaggagaggggaaggaagaagauucuguggggcagguggauugugggcacgaaggucagccugauggaguagguguggcccaggcaguguugggggcuggccagcggcucacauguccagguucgagccuggaaggcaucuuggaaucuggaagaaaagagggagccuagguggguugagaaacaauggaaccaagacaugcuagucuucucaagguucaacuuuaaugucggggaacacgccuuauaaagaaaaggggagaaaaguccauuccgccaauucauccuuggagccuggaaccagcugcaggugaugauguucagaauagggcguagucucuggaauagcucagcggcuucucugcggguaucuugaagcagcagcugcaguggcagaacaauagagugaucuagggaggaaggcuccacccuagauaaucucuuuaguggcagcaaggucaaggucugguuuagccugcuucaggcuuauggaaggcuacaaggcagaacauggcaacugaagucuuaggguuacuagagaagcagacaaacuagcagaggguggccaucugcccagcucuagugcuuuaaggcuuauucuagauauaaagguuuugugucuuuuauuuaggaacucagugggguagacacuccuaaauaauaccaccauacaguaucauaguacugaauccuuguuuggaggccuggggccaggcuuugggguucuacuagagcaaugugggguaacuuucuagaugcagaucccuuaucaaaauaaacaagcagaaguuaccaaugcuagguaggguuuguggacacaggaaacaagagggaucagggauguacacaacgggacuugacauuuaggacagauguuaaucuuaaccagcuauuuggauccaguagaaauauuuaccuuguagauugucacaugcagaagaccagcagggguucaaaggcauggcuagaaggguugaguuguguccauagcagucacugggacggggugccaaaugcuuuugugaucaccucgggaggccagacaaagguguggccaggucgccauuugcuuuuucaccucauuggcugaggcaggauuuuugcugucaugucacaggaccccugacuggggaccgugauuggacagagagcccugcuguucucacuacggccauuguuuucucucagagcuggaccguggccccugcagccugccuuccugccucucacuuucucccucauggcuguuuccuugaccuuucgacuuaacccugcacuuacauggauguuuaccucagguugugucacacuuaccucaguguggucucgccuuacucacauggucuggggccggacacgcccauuucugugggcucagcugccuauuuguugcugaugucucuaagauaaaacuggcaaccuugaacccagaucuuccgggcucagcuccaaacacccagcgccuuugcuuccuguaacccuuuccagagucuaacacagaaaucccagcuauggucccugucuuagacacuagagacauacaauggaucagcaccuguccugggauggauaguucuugagcuggaguuugaacgcaggcugucuagccagaucccacacuugcagcugaucuucuguaacuggcaaugagcgauggcucaaucauagacagagcaucauuuugaaggcugccuucugcccugucuccagcacugaauccaaugccccgccuuugucuccugagugacagcaccuuuuccuucugucuucucuuuaccuaauuuuccugaguuauccaucaggcuugagggaucuccaucccgagggccugagaaggacucuaaucugaugccuuggcugugaguccuuagacauuugcauuuauuguguacaugguucuguuccaagcauuugaagcuauauuagcuugcuuaguuuugcagcaagcuucugauguaugccuaaugccuuuuauuuuauuagcagacacagcacagagucauagauccaucaggaaaauugaugccacuacuaguaguugagagaauguguguguguguguguaugugugugugugugugugauguauuaugugcucaugcacauaugauuguaggugcccauggaggucagaagagguugucagauccccugaagccaaaguaacaggcagaugaaagccauccaauguaggugcugagaacugaacucugaaucucugugagugguaugugcucuuaauugcugagccaucucuccagcccuaguaccuggcuuuuuaaaaauauggguucuguggacugaauucagauccuucagaccgucauccuugcagggcaaggucucuacagauggagugaucccuccagccccaccaaaggaaagcuaauaaucaggguccaauuacaccaguguaaggggcagaacaagcaaagaguaaauaaauacaaaucagcccagggaugggcggcaguggaagccauuaccgguuuggagagacagagauguugaugcuauaugaguugagacacggaggcuaacaacagagacuggagccuauaggacacaaggccccuccagaguuacugaaacacccuaacauuucccucuuugaagccaccaagauuaccuacugucucccauugagacaugaacucaccacacacacaauggcaaggagccaggggauuguagucugcagagaugacaggacagagugaagaaugauuucaaaauaaacaagcagaacacugacccagaugaaugagaaguuuuccccaggucacagaauuuugaauggcagggucaagugguuugagccaggcuuugacuugccuuucugggaauccaggacaagguaccuaccugagcacuguccccaggaguauaaugacaaugacaguugcauccacuuaaaauggucuggagaaggucaaacaagcccaaacagugccuagacuaucacaacacacaucuggguugcguuauuacagaggucucggcguggaagcuguggccccggcuuccacuccuaucuuacugccgcaucugcuuuacagauggaaaccccaagagucugacuugcccaggcugcccagcgaaaguaagccuggagcucagugaacucuggggccagcgugcuggcugcuguugcauuuccuguucugggacucucacgcagccaacuguggucucucuggggacacaacccagaccuuuuuugccucug

SEQ ID NO: 5712 - RNA, 4132 nt, Mus musculus
cagaggcaaaaaaggucuggguuguguccccagagagaccacaguuggcugcgugagagucccagaacaggaaaugcaacagcagccagcacgcuggccccagaguucacugagcuccaggcuuacuuucgcugggcagccugggcaagucagacucuugggguuuccaucuguaaagcagaugcggcaguaagauaggaguggaagccggggccacagcuuccacgccgagaccucuguaauaacgcaacccagauguguguugugauagucuaggcacuguuugggcuuguuugaccuucuccagaccauuuuaaguggaugcaacugucauugucauuauacuccuggggacagugcucagguagguaccuuguccuggauucccagaaaggcaagucaaagccuggcucaaaccacuugacccugccauucaaaauucugugaccuggggaaaacuucucauucaucugggucaguguucugcuuguuuauuuugaaaucauucuucacucuguccugucaucucugcagacuacaauccccuggcuccuugccauuguguguguggugaguucaugucucaaugggagacaguagguaaucuugguggcuucaaagagggaaauguuaggguguuucaguaacucuggaggggccuuguguccuauaggcuccagucucuguuguuagccuccgugucucaacucauauagcaucaacaucucugucucuccaaaccgguaauggcuuccacugccgcccaucccugggcugauuuguauuuauuuacucuuugcuuguucugccccuuacacugguguaauuggacccugauuauuagcuuuccuuugguggggcuggagggaucacuccaucuguagagaccuugcccugcaaggaugacggucugaaggaucugaauucaguccacagaacccauauuuuuaaaaagccagguacuagggcuggagagauggcucagcaauuaagagcacauaccacucacagagauucagaguucaguucucagcaccuacauuggauggcuuucaucugccuguuacuuuggcuucaggggaucugacaaccucuucugaccuccaugggcaccuacaaucauaugugcaugagcacauaauacaucacacacacacacacacauacacacacacacacacauucucucaacuacuaguaguggcaucaauuuuccugauggaucuaugacucugugcugugucugcuaauaaaauaaaaggcauuaggcauacaucagaagcuugcugcaaaacuaagcaagcuaauauagcuucaaaugcuuggaacagaaccauguacacaauaaaugcaaaugucuaaggacucacagccaaggcaucagauuagaguccuucucaggcccucgggauggagaucccucaagccugauggauaacucaggaaaauuagguaaagagaagacagaaggaaaaggugcugucacucaggagacaaaggcggggcauuggauucagugcuggagacagggcagaaggcagccuucaaaaugaugcucugucuaugauugagccaucgcucauugccaguuacagaagaucagcugcaagugugggaucuggcuagacagccugcguucaaacuccagcucaagaacuauccaucccaggacaggugcugauccauuguaugucucuagugucuaagacagggaccauagcugggauuucuguguuagacucuggaaaggguuacaggaagcaaaggcgcuggguguuuggagcugagcccggaagaucuggguucaagguugccaguuuuaucuuagagacaucagcaacaaauaggcagcugagcccacagaaaugggcguguccggccccagaccaugugaguaaggcgagaccacacugagguaagugugacacaaccugagguaaacauccauguaagugcaggguuaagucgaaaggucaaggaaacagccaugagggagaaagugagaggcaggaaggcaggcugcaggggccacgguccagcucugagagaaaacaauggccguagugagaacagcagggcucucuguccaaucacgguccccagucagggguccugugacaugacagcaaaaauccugccucagccaaugaggugaaaaagcaaauggcgaccuggccacaccuuugucuggccucccgaggugaucacaaaagcauuuggcaccccgucccagugacugcuauggacacaacucaacccuucuagccaugccuuugaaccccugcuggucuucugcaugugacaaucuacaagguaaauauuucuacuggauccaaauagcugguuaagauuaacaucuguccuaaaugucaagucccguuguguacaucccugaucccucuuguuuccuguguccacaaacccuaccuagcauugguaacuucugcuuguuuauuuugauaagggaucugcaucuagaaaguuaccccacauugcucuaguagaaccccaaagccuggccccaggccuccaaacaaggauucaguacuaugauacuguauggugguauuauuuaggagugucuaccccacugaguuccuaaauaaaagacacaaaaccuuuauaucuagaauaagccuuaaagcacuagagcugggcagauggccacccucugcuaguuugucugcuucucuaguaacccuaagacuucaguugccauguucugccuuguagccuuccauaagccugaagcaggcuaaaccagaccuugaccuugcugccacuaaagagauuaucuaggguggagccuuccucccuagaucacucuauuguucugccacugcagcugcugcuucaagauacccgcagagaagccgcugagcuauuccagagacuacgcccuauucugaacaucaucaccugcagcugguuccaggcuccaaggaugaauuggcggaauggacuuuucuccccuuuucuuuauaaggcguguuccccgacauuaaaguugaaccuugagaagacuagcaugucuugguuccauuguuucucaacccaccuaggcucccucuuuucuuccagauuccaagaugccuuccaggcucgaaccuggacaugugagccgcuggccagcccccaacacugccugggccacaccuacuccaucaggcugaccuucgugcccacaauccaccugccccacagaaucuucuuccuuccccucuccucuucuagucucucacucagaccccaagccccagaacccaagcccugccuaccucuuucugcccagcuacaggcuguaggcauuuuuauugacccaucagggauagcuugggagacaagguuacauagcaucauguacaggaggauuuccuugucccuaaggcugugugugugugguagggggaccagaucuuggaggccaguauguaucauuacaauacauagcaacagaccaaaccuggacaguacugugggggagggggagucugcagaggacaaggagaggauaguucaaucccuaggcaggaaagggaagcugcuuugucaccugucuggcccgaggcaguaggagcucuuaucuuuacaaucauccaucaaagucuagacugacuccacaucugugagaaacaguaaggauaaacagagagugcugcuuucuucaaucuaccacaccaagcuggguuucuuuguuuguuuuuguuuuuauuuucuuuuagcuuuuguuuuuauugagagaaagccucacauagcccgggauggccucaaacucucuacauagcuaaggauagcauagaacuguucuucccaucucuaggugcuggguuuacagccaugggaccaccaucccuugcuugucuggugguaggauuuaaaccauggccuaguacaaaacuaggcccaaacucuauugauugagcucccucccuagccccaagcuaucuaacauucuauuucuuucauagucuccccacccccucacauuacugauuuguuuuguugucuuguucuacuuuguuuuagauaaagucuugcuguguagaccagacuggccucaaacucaagauccucuugccucagccucuugagugcugagggcacucaauugcaggagcacauaguuaucuca

SEQ ID NO: 5713 - RNA, 2645 nt, Mus musculus
ucaugacaagagauugauuaaaaugccaagauaagaaacaauuuauuauagagagaagaaaaauuucucauccaaaauauagaaaucuguacaacuuugccacaaucaauauacaugaacuguacaaauuuacaccaguucauaauuuaccaaauaaaagaugacuaacaaaguucacaaaauagauggugguuugugggaaagacucuuacccaauugaguacaaggaaaguuacaaaccagaccuccacuuucuaaaaauaagaaguuuacuccacucagucuuagaaaacuacaagcuagcaaauguacagagagcuggcuggugcuaacaaccacaguugagacagugucuuuuugaagggucuuuucaaagccugcugccauggcagagccuggucgcucccuacucucaacgccaaaaacacaaggucugaccauuucccccaggucaugcguacuaaguuugucuuuauguacauuuauacauuuuaagugcuagguaaaagucuccguguaaaaauuuuuccaguacuaccaugcuuaaaacauugagcuuuccuauugagcugccaaaaaaguuacugagaacuuucaaguguaauagugcaaauuccccugcaagguugacugcgaaagaggguucuuugaaagacagaauuuccuuaaagggacugcugugacaaauuggguauaaggucugggagaaacugaaaccacccuucgacuucacucccuagcaaauaaagugauccuuuccuuggacucacaggcuauuuaaaucacugaaagguacuguccaaacuauggcacugucacuaaauuaaaaaaaaaaaaaaagaaagaaauaaaaaaauuauuaccacucuaucuugugccagaucuucacagcugugacaugguuuaaauuccauaauccauccccaagaggagcccacccaaagcaaaaaaaaucaaauucauccauccauuauaagaugauccauccaauagacuauaucuuaaccugauacagucaucauauuguaguuuuuggaagggcuuguucugcccaagagaaguuccuccuuacagcugauucugcugucuaccauuugcacguuggugcuguuuugagugcuaccuccugcuggugaggcuucguacagcacgcagauggagccauccucuccaauccgguaggacacuucguaggggucaacccagagugugaguucacuugggagaagccugaacaacuccugacugcucaguccaauccgcugggcugccuguccaaucagaggauccaucuuaugguugaugcgaauacaacgguaaccugaucccuugcacggcuuuucugggaaccagugauguuuguaauguucuguggaagaaaagaacagagaaacaaugcucaggacgguagucaacgcagccguaccguagcguacuuuccuccuccugcugcuagcuucuuagcgaagcgaaaaugaaaaccaccaacuuucacaaauguccgggaccgaauucgcugucgugagacagaauagagaaagcaaagacacuguggcaaacacuguccggguacugaccgguugagccgccaaaacaggaaucccgcgcgcagcccuggauggccaacuagcuggauggcacaggcaagcgggcgggaaccuguuuacuuucuccaccccaacggggucccauacaauagacuuuauggaacugguggggggugggggcaagacaacgccacuauggccaguuaaccccaaagggaagaaaacccaagaaaccuuaaaccaagaucuggguuggguuguaauuguaccggugacaaauccgaugauuaaugggcaagaggcacaggaggugcggagaccuggcacguccgucccgggccggcuccgaaacacagaggcgacaagccacccaggggcucagccgcagacucucgcaacggucgcggcgacccggcagaggagaccgacgggacuccgggcccugggucuuuugucccccgcgaccggccgguagccgucggggcgcagcuccgcgucgccccgcuucggauccuuuguugugcgugucgcggcgccccgccgcccagcucccccccccucccccagccacgaccgggacgcgcccguuaguggcgacccgcgacgguccccgcgccccgcucaccugccagcagcuccugcaggcucuggcugaaagucugcagcugucgcucgcucgugagccccuuggugcggaggaacuuggagaugaaggacaccgcggcggcgaucucgccuaucaugguggcggcccggguguagaagggaugcaugggggcggcggccggggguggcccggggcggccggggcucggccccgacggcgaagcggccaccccgggcucucgcccagacccgacggccgagaggaagcgagggcgcgaggcgcggacggcuacugguucuaggggauuuuuuuucuuuccuuuagaguaaaaaaguuauuuucaagccaggaggcggcaggagagacagagagagacgagcgauggcggccuggucacaucgcucggaccuccccagccgccuccgccuccagcucgguagccuccgaggaucccgagaguugcauuuccagcuccgaggggcgaagagcug

SEQ ID NO: 5714 - RNA, 3006 nt, Mus musculus
aagcauggacacauucacaagcuaaugaucucaugaggauaaagacagagguaacaucuuccaaaaguggcgaugcccaaaggaucccagucacugcuuccuggggaagugaagauaacaauccucucuggcccuccuuugagaaacaguucuuuugcccccuuggauuuguuccuuuagaaaauccuggggcaggugaccuauagccuuaaagaacaggcuuaucacagcagagccaucugccgcuuucugguucucaucuugcaagaguuacauaaaauaaaauccccuaagcuggaauccaacaacagguacguugaugcacuucuuuucucaaaaguugaagcccuggcuuuguccgcauuuccauagcaggggaaacugaguguugugcuggagguuaguaacguguaccucaugggcaaagacaugcugcuaguuuggggguuguagaagauaaacugauauuuugguggaaauugaaagcagaaauuugaguucugcuuuacaguuaaaauuaacuggauugggggaggggcagcaugugaaaacaugugaacacugggaauugaggcaauuuaaaugacuuuaagucaguaauuguucuaagucaguaguauuuccaaacaaauuggagguuuuuugguuuuguuuuguuuuguuuuuuaauuuguaauaaguuucccugauacuuuuauuaacgauccagaaacacaucacuaaacccuaaacaugccauguauuuaagaguacgaauggaauucauauauuuuugucaguaggcuauuuggaagaguuuggauuuuguuucccuuauuuugcuuucugagauggucucuuguucuauauguagcucaggcuggcccccccacucuagaucuuccugcuuuagcccccagaaugcaggcgucucggauaauauggcacagcuccagaccaggagcucagauucuucuucuuucuacacaauaaugggucucauugugacauuuuuuuuaaaugacauauuucaucuagcccuuucucuaaaaggucccucauuucaaauuugaguuugagcauuauaucccaggcugguuuaaagcaggucucacucuccugcuggccaauuuguguaucauuugggaacuccuuggaagcugccugacuggcuuugaacacuggacucuuccacacuguucaggucuauccugaguaccuaagaugucaucaucauaaaugaaauagagaagugucuuugacuuugcugucaagacuuuuuguugcugcuugaacaaaagaagcgccuauucaaacugcaguuuuagaguucaggugacauccggccugugaagccugcaaguaucucagaccuagcauccagcuguuuccugugacucucaccuccauuccccagaccacugagccgagccugugugugcagcacagcauagcuacuugaguaguucgugccaacugcuucuggcuaauguuugguuuagcuauuuuaacaaaacaaaaaaacugagugucugcugcugugucauuuacuaccaguuuuuuguuuuuuuguuuuuuguuuuuuuuuuuuuuuuuuuuuauuucgagagguguaauuuaaaaggguuuacacugcccaaauuaaagaaaaaaaauaauuuauaaaagaugacugcuaaaauuaggaauucauaauuaacaguaaguuugaggacuuauuuuuacaaguugggucuugcuuugugauccuaaaacaagccuugacaugcuaauguuuuguuuugagaccagaggucuugaggcucugggcuagccuugaacuugccauauagcuaaggaagaccagaauuccugauccuccugucugacugagauuacacuuagcaccaugaagccuggcuugauguggacuguaggaaaauuaccccauucaauacaggaugugacuaucccuuaugucauccuuaccuuugagauaguucuggaauugcaggccuuucugccggaaguggcuuucuguuaugauuguuuaugagguuucuuugucgccauaacucacacuuugacaaguaauuuuuggguuuuuuguuuguuuuuugaaaaagggucucacuguguauccuugacuggcucggagcucaguauguacaccaugauacccuggaacgcagagauuuaccugucucugccucccaaauacuggaauuaaaggcgugcaccaccacaccugacuaguaauuuugcuguaaauauuaacgggguuugagcuucacauuccaaggaagggagggagggguccugguguccauguuuagugauuaaagguuucugggucuccccccaccuuaggacucuucccuggucauauauuaaugauuuuugagacuucuucgucuuuauaaauuuagcgggcugcauuuugcaugugaaaguuuaaagaaacuugccccgucuuuuuccgauuucagguuguggugcuuucgauaagcuucucggaguuugccagcagcuuuagaaagcaucaucaccugaaacugcaaagauuuuguuuaccuacggggagcacgcagagcccagaugacgcugucuuugcagucaaacuuuuacagguggacccugucagucugcccaguucauuuuuugugucaggaccguagcugagucaaaacaucuuuuaggguaaaaugcccuguguuacaaauuggacugagcugcgacacaggcuuccugccaggauugcagacuuggguaauccagagaaauguguauuguugguaguuucuggugguuuaguuuaugcuuaaguuaaaaagcagcauugcuaagguguugugucuugauuuugagcugcuccaggguaaaccuccuguuagcagugagguuugauaacauguuuuuaaaaccauuuguggaauauuaacacuaguguucugauugcagcuuuaaaucagucggauuuaugaauaacuucauugcuuagguugucaaacaggaauuaaaaaaaaaaaaagacacccaucauaaaau

SEQ ID NO: 5715 - RNA, 38717 nt, Mus musculus
caaaagcaguuuggaaugcugggcggaugcaaagggauaaagcaaauguggagggggagggagaagggggccgauaaaguuucuggcuacaauacaagagacguaucauuaccauaugaucuaaugugggugucagcuggaugcgcucacgcagugaaaccuuaguucuuaacugugcuauggaguagaagcaggagguuuucaacccagugacagucacagggcagcaccacccccuccuccuucuuuccacaccugcaaacccuuuugccugggcugcauaguuaguguuaauuacaucgcagcuuugagggcuccuguggcaaauacccggauuaaaagguauggcuuucaauaauuguccugaacucugcuacaggcuaauaaagcuucugucaaguggagggcagaagaaaauaucuggugagaaaaaggaacgagaaggaagcugugcuaaacuuuuaguaaucuuuagacaacguuagaaaugaauugcuugaaaacagaaguuaaguacucgguaaaacaaacaaacaaaaaggcaaaacuguuugaaugcauugguuuugugcucuugcuucuguucuugcaaauaugcuuauuaaaaacuuguaaccuaacaccaugacuugucuauauugguaguuuuguguuuguacugaugaaaugcuuugcucuuuauaaacugucagcagaaaagcauucguaacuagcauauugcuugugccuaaauuagguauuuaaggguuucuucucgugcuguguucuugcauacuucacaaucuuuaaaacaucagcaagacaagucucuggcuguagaaauauaaugccuacuucugcaacaccagaaaugaauaggaauuauuaccagaaaggugaaaaggaacacaggaaauauuuaugauguuaaagaucugagauaauacagcugcagagcucuuugguuauaaauguuucugucaauauuuucgaugcaaauuaaccuuucuuaugaggugcauucacuaugaggugaggguggggguugauucucauuuuaacuuaaagcagaguaagcagaggaccacugguuacgugugccccagugugugacuccagugaucucugugccuguggcuuuuucuuccugcagcugcuuauuuuagcagaccucuccaaaagaaacauagguuuuauuguaguucuuguuuguggacaaauguauuuuuauugcuuguauuuuaauuauuccuauuguuacugaaguuuuaaauucaccuuaaaaugagggauuuacagauucacuucauacauacguguuaaguuuuaacucugaaacaccuaacaacaguauaaguauguuuauacaaaaguuaaccuggaugaaauagcuaaguaaauaaagaaagauuguuuuggggccagacagauuacuuuuggugagacauuucggaacuuaaacaacucuuuuuaguggaaaaauggcuuuacaaauauuugagaggaacaguuucuacaagauauaguguugcuucagucacaaccuguucguuuguaaauuguuuuuuguuguucuaguugccauuuauaacaaaaggaaaaaaaaacaaacaaacaaaaaaacaaaacaaacaaacaaaaaaaaaaacacugaagaaauguugaggaccagugacucuuaagauuucucuuaaguuaauugcucuaaacacgcuggaucuuugaguaguauaaaaaauauuuuaaaagaaauuucaugggagaacuggaagaaaauuuauaagcauuuuuuuaggauaacagaguucaaaaacaugcauauaugcaugcacacuugcacauauacacacauacacacaugagagagaaagagagagagagaggguauuaaugaagugguaugcagucuggcuguaucaggcuuuagucuaaaggaagauugagcagagaauuuguccuauuuuaacaagguaaacacauauaaagaaagaugguguuccucagagccugggcucaacauuuccuuuuuaggguugauagggaagucaccaggcaugucugcuuuggagcguagaugacaaagagacaucuccagaaaugcuccuuauucuuauuaaaucugagauuacguuguuucauuucuuuucuucuccuaaaauuacaaggcauuaaauaugcaaguccagcaaacuugugguaaaccauaaacauucuauuuuaaugugaagcagucuucuccuuuacugcaauccaaauaaacaucccuaaacaauaaccucccuuuaagagcagcugagugggauuggguuacuagaggacacuugcccuugaacuuggggagguuggaugaaucacaaucuuuaugauuuuuuuuuaaauugagaaaucacaauuauguauggaguauucuguuuuagacauacugcaguauuagauguaaauuaaaaaugaauguguggaguuuuuuuuuuuuuuaacuuguguguguguguauuuccuaguguuuuuggaaaaagcuucaaggcuauacauucuguguauuguuauauggaaacauaguagcgaguaaauccaacauauuugcagagaugcagcucuucuugagaucacgagucugaaagugaugccuucaaugguugaggaugacuucuaagagcugaagagggaucuuaagccauguccguucaaaaaauagguggcuugaucucuuuugauuguucauuuugaguuaucuuuaauuaauauccaaauaacuagaaauuugcugugaauauacaauuugggcucuaagacaucagacuuguuugguuucuuggagccagcagaaugcacuguguuauuaauaaacugaugguagcugagucacuuguguucaaaauauugugcaaggcaugggugaagaacaaggaauacuaaggcacgcccugagggagaacauccacuaauguugggguaaacacagaaagcccauuauaacaugauaaguucauuaaaagaggucagaauaucgugcuucagaucacagaagcgguaacgagcagcacccugcucagaggagaagugaggggagacaggggcaggagacccagaaucucacguaaccuuuaaacuucuucagaagguagguaaucaaaauggcaaagcugucuaagugugggggguugaaguaaagaaaaugucuggguugaagugggagagagaaaaugcagagaauuguaucuuuaaguaccaauugauaccaaauaaugucuggcuucucaaccaacuuaggaaccaugguuaucauugacaggucagaagaugucaaaaaauugugucaguagaucuguacagaagaaccuuaaauuuuauacgauggcuugggcagcaacaugguggaagaugauuugaaauaauagaaauauuuagagcagaaacaaguuggagucuuuuacaacaauuuuauggggugguagaugagaccaaaggaaacacaggaggaucuggagaugaauagggcuuaaggagaugucucuggaagaaguuggagauuucuuacuacaaaggcacaguuuuauuugacugucauaugacagcacugagccaacaugguaauacaaccaugauuucuuauucaaggacacccugacagugaucuggcauaucgucuuaauccauaccccaagaugagacacacuauuucauacuguuugaauugcuacuggcaaggaaaugguuuacuuaugucuguaaucaccuuuaccuccuuuuaaagaccuuuugcugaaugcuugacuucuucauggcaaauguuauuuucuauacuuuuucucugugcucucacucugcuaugauauauuauguaucaaauugcacauaaaucaaguggcauccuugcucagaaacccuucucuuuguuucccugguccccaggucgugaaaauacaugagauaaucaugaaggcaacucucaucuucuuccuucuggcacaagucucuugggcuggaccauuugaacagagaggcuuauuugacuucaugcuagaagaugaggcuucuggcauaaucccuuaugacccugacaauccccugauaucuaugugccccuaccgaugccagugucaucuucgaguggugcaguguucugaucuggguaagugugucuggccaaagguaugccucuucuucauggaacugaguucucuugagugcuuggcccuuugaggucucaucucugcaauuccagaaguaagagacacacccccuaaagaggaguagggcaaauagucaaggagaaaaagaauuaacuuugaggcuaggacacuuuaggcuuuccacgcuacacugccccaccucucacccuuuucaaucaggucuacaaagguuuguagugaaucacuuuaaaaaaaaacuuaaugacuugaauagauccccuuuuugcaaaguaaaaugucuaccaauacaucaucuauauuguguuuccagggggauguuuauucuuucccauuuucauuuuuguuucuuuuucuaaauuuuugauuugguuuccuaaaguguuagauacuaugaaaacuuggaaagucccuuuacucuuuacagguuccaggcaacagagauuaaacgugacuaacuugcaaaaugcauaguuaucagaagcaaaaugagauggauugugcaacaaaaaauuaucuucaagaugcacaggcauucccugcauucucuggucuggguucccauguagcuuuggcagccgauuauggucuuuagaacuauucaacaggaauauuuauaacuaaagcacaauguaaauaucugauauaaucucauguucugaaacuucagcucaauacacuaaagagagcuggcuuaucuguuugaaaguaaaaauuggccuggaauuccaaaagccacaugauuagaagauaaaucuucagaaaguuuggaggcccagcaguugagccaaagguuaaugcauuggcuucccauggcagcugcuuucccuucuucucuuuacuugucuauuuucuuaucgcaaaaaaaaaaaaaaaaaaaaaaaaaaaaaaaccaugaucacaggacuaguguuuuugcugugugucuugcuuauagaagaaauaccacagcauaagaaggugcuucacagagaagccccauaguuauucagggcaauuugcuaggcauauuuugcagaaaaaugaucaguaauauuaaccagggaaauaugcucuacagaggagcacagacaaacguagaaguaaacuguucagcaucaacaaccaagaaacacuuaucuuacuuuucaauguugacacuuuaaaacuucagugaggguauacacggaggcuuucaggaggcuagagguaguuucucugguugcucagugaucugguaaguauauucuucccuaugaugggucaguggcacuccagauguaggaauauacauuauuaucuguuuccuuagaacuaccauuuucauagguuuuaaugagacaaaacagaugcaauguucaaacuuuugucaguauugacuauauuguauuuaauauaaguaauuuucuauuuaaaugcuugacuguguguuuuccucuauggcugaaguucucaaccuuccaaacacugugacccuuuaauauaguuccucauguuguuuauggugaccccacagugauaaaauuauuucuuguugccaauuuguaacuguaauuuugcuacucuuaugaauuguaauguaaauacuucuagagguagaagguuguuaaaggaguugggacccagagguugagagccacugcucuaaggguuauuugugccaguguuaaaccacaaugauucuuaaacauauuuucaaugagaguaaaugaaaaaugagaagcuggagcucagccauuuguuuauaaggagaugugaaagcuucuggaagauuccccgggacguuuggcuccaguuaucuccacuguagcaucauuuccugguuaucuagagcacagagggcugagaaaguacacaugaauuugccaaguacuucugcauguuuuguuaaaauuuaguuugagguuuaaaccagaauucagugugagacccauaguuccauucuaucuuuaucagauaaagaacuauuuuggaaaacugaucagcaaauguagucuuuaucaaauuauggaguccaguuguuaccaaaaggaaaggacaacucauuccuuuuauauuugcuauuaacggauaugugauuuuauauacauugcauauauuacauguagcaugaaauauuuugauacauauguacaucgaguuaugcuuuaauuuguuaaacauaccuauuaucucagacauuuagcacuuacccaugaagauaaucuuuccaaagccuuuccucuagcauucugaaacauuugguacacugaacuaaucuagcguugccugauuguguaauauaccacagaacaacauucucuaacugaacuuaguaaccucacaacuucucuaaccauucauuaguuaacacauacuagaacauauuuuguguuaaauuacaaaacuuucauccagaaaauggaacaauagaugugagaaacaacgggagaauauuuuuuugacuauacagcuaugaguuuuuuucuuuuuuuuuuuuucagaagaaauaaugaacuccaaaaauccacuaacaaaaaaauuaacuauauauuuaggagagagagagagagagagagagagagggagagagagagagagagagagagagagagagagagagagagacugagacugugccaagaaaggcaaucuuggguacuccagacaacuccagcuuagcagcacagaaugcuauucauaagaauaagucuuuggggauccaguccagacuagacuuccaugaccuuugauccuguuaauauuugguuaccaaugcauaagggaccauaacugagagcaaacuuucugaucccuugccaaauucuguguuuuaggucauaaaauaaaugauaauguuugaaagcucccuucuuugacaggcauucaucaaugguaacaguuacuuuuucaaaaugaaaaauagaccuaaauacacauuucucagaacugacccauuaacgcgugaaauaaaaauacaucaaaggucauucaucauuggggaaacgcuuaucgaaacuauaucacuggacagcaguaaaaaugacuuuaucaggaauacuaaaguagccaauucuuagaagggugucuaaaaaagggaguccuugaacucugugggcaagaauuaaaauaaaaauagcccucauagaaaaugauauggauaguccucagaauauuaaaaguagcacauuaccaucuagauguucuacuccuggguaagugucagagagguaccuucauacccauaggcgauggaaaaccauucacagccaauaaccgcuaacaggaaguaugcagaugaaugcagcucauuccuuuccaaauguugucuaaccuagaucuugaucagauauucaguucugugugcuugguaucuuggaggaagauaauuucucuugcuuauagauuuuuggcucaguuauuguugauggggccagggaucaccaaggagcaugauuugguaauaacuuugaucucacugcuagaauacauaugagcccugaaaagucaaauacacacaaucauugucuuaaguuuaauuuuuaaaaacuaagcacauaaugacugauauuugaaaaguaucucuaugccuuuaaaauaauuuaaaagagcuuugucuauauggaugaauauccuugaacugaaaccugcuuuguccucuccuauauggaacuugauauuuuaaaaaggcuuuucucauuuaauagguggauauguauauuauauugcuagacaagaacuuaaaaugcauauaaacauucuuacaagaguaacguuuauauucgggauacuaguucguagauaagcaucucaaccgcaaggcaauuaaugacauguguucuaucuuccuugaaaaugauugucucauagguacauggcucaugaagcugacaaaggcagguauggaggcaaaauccaauauucucagcuacucagcagacugaugaggguugcaagcucaagguccauuugggcuacagggagagagagagagagagagagagagagagagagagagagagagagagagaaucagagcgacacauagagagaaacugagaaagauugaggaagagacagagaaagaaagaaauggagaggagagagacagaaacacagagagagguagagagaaaugaaaaagacagagacagaggucaaaggucauccuagauaaguaaggaccucuuaucaaaauaaaagguaaagaccuuuuauugcugcaauaaucuaucaccuccuuuauaagcauugaagauuagcuuuaguuugaacuguuaguguuuagucaucacaaugauucguaccuccaagguauuuccaacucaguguuuugaauaagaacagagagucucaaguguuugaacuuggcacucaaucaucucuaauucauagcuugauuuauuuuuaauucaagucacucugaagcuaaaaguugucuuagcauaucugauauuuuauugauuuacaaaaaaacuggaguuuuuaaauagaauuuuuaaaaauguuuauuuaauguccuaauuaagcagaauuaaguugauuaagggcagaucuggguauaaucauuuuguugggaagcaucugcuaacugaaugaaggcuuucuaugcacacauggaccuuuguagguaaacucucugaagaugcugaacuucguggaacaaagaugcacacaacaguagccauuacucacaagaaaaacuagcucaagguuaagauguuuacauaaaaaaaaauuaguguuuguuauaccugcaaaauaaaauuuaguuuccauuuaguuaauaauuguaauguaaagaagagaaaaacagagagauguagauucuaaucaucagcaaaaaaaauguagcuuaaauugucuauauuuauacaaaucauaauaggaauugagacuggcucuaccugugauagauaauuaauuuguaauacgauuuacugauuucucauaaaggguaucuucuaaaagguaucauuuaaauaugcuuucagggaaacuuauaauuugugaccauaaugaaaaagacaaaaaaauuauuauuaaaauuaaaauaauaagaauuauguaacuaucucaacuuacacauggaaauucaccaccaucgguaacuccagauccaagagagauccaauauucacuggauggcacuccaucaucacuaggcacacaugugguauaaaaacaaacaugcaggcaaaaagucacauacauacaaauaaaaucauucuuaaaguguuuuaauaagaugaacuuuuaauuuacugaagaacuucaacuaguucauugaacuacauuaauuauuauauucacccucucucaaaauagcuuuuagguaauuuccagaaguuucauguaacacauaaauauauaauaaaauaaauaauaaaaauuaaauaaaauauucaugaguaaacucuaaaaauaacaacagcuuauuguguauauuaccaauuacucuguaaauauugguguguuuauuccauuccuaguuaauauuuauuauaauccauguuguacauauauugcacaguugcagggagaugguaguaucaccagugacuaaauuuagggucuuacauguuuacacucuuacaguaagcagugaacuggguccacucuccaguuuuaagauuuccuucagucuucuuuaaauuguaguuccacaaauuuuccuucauguuccuuccaagccauuuauucaaaaaguugaggccccaacuuuaugauaucaucuugacucauuucaagugaaaguguagaucuauuaaucaaauucaaaauuaauuuguauauagguuuuggucaauaucucuccaugaauguauauuuguuuucccaucuagcagcuuauaguuuauccuucuccaagauaaguauauacuauggaaaaaaguuguuaacccagaccccagggccauguaaaacagagagaacaaacaaucuuuuucagccacacaugugacuaaagaugccuuaaaaauaugucacagucaaagaagaggcaacaauucacaggugaagacaaaggacauggcauauuugauggggagauucauuugauaauugaaaacuuaggacuaaaugaagaaaguuuugucauaauacacuggaggaaaaagaaaaccuuaauauaaaaaauuaggaugcagagagauuuuauaacacaacauagcagaaaaacauuucaagagcaugcucaugaauucuucagugcaugauuacaaggcagcuuuauuuuuuuaauuuaauuuauuuugcuuucuuuacuuuacaucucaaucacugcuccuucccugucaacccuuccacaauauuuccucauccccuucuucuacuccucugagcagguggggauaccucuagauauccccugauuccuagaacuucaaguauaagcacuuccucucccauugaggccagacaaggcaucccagcuagaagaacauaucccauguauagacaacagcuuuugguauaugccacauuccaguuguucaggacccacaugaagaccaagcugcacauaugcggcauaugaguguggaggccuagguccuauguguauguucuuugguuggugguucaaaaucugacaacuccaagaguccagguugguugacucuguuggucuuccuguggaguuccuauccccuugggggucugcaauccauccuccuauucuuucauaaacguccuuaagcuccauccacuguuugacuggguuucugcaucugucugagucagcugcuggguggagccucucagagaagaacuugcuccugccucaagcauaacagaguaucauuauaauaguguuagggguuggcgcuugcccaugggaugggccucaagaugggaaaguugauuggucauucccucagucucugcuccuucccccaagccugcauuuccuguagacagggaugaaguuuggguuaaaaauuuggcagcuugauguuuuauugcuaaugugccagaaagaaacuugugcaugaagcauccagaaaaccuucagaauggaaagcaaaacaaaacaacaacauaaaccacuucuauuuauccugcauuugcaggugaacaagcaaagacucuacgaagaugagaauguaggccaugagccugugguuucuaagaaguguggguucaaggcccugucgggcagauuaguauuuguagaggaagaaccuugagugagcucuaaaggguaauagagucagagcaaugggugaaugugauuucucacaaaacauucaugauaugaaccaaagugaauuucuaggaaugaggguguucaagaugagguggugcucaggaugggguggugcucaggaugguguggugcucaggaugagguggugcucaggaugggguggugcucaggaugagguggugcucaggaugggguggugcucagaaugaggugaugcucaggauggggugguggugcucaggaugggguggugcucaggaugggguggugcucaggaugggguggugcucaggauggggugguggugcucaggaugggguggugcucaggaugggguggugcucaggaugagguggugcucaggaugggguggugcucaggaugagguggugcucaggguggggugguggugcucaggaugggauggugcucaggaugggguggugcucaggaugggguggugcucaggaugggguggugcucacauguaugaauagcaaagccgauguuucaauggugaggacucauaccaucuugguuauuggucuaguuuagcuaggaucuaugauggaaguuuuacuucucuggucuuguuuagucaggauaaaaaaaaaaaaagaggguugacuuagauuacaaauuaccucccuccccucccccuuuauuucugagacacauuuucuuuuagacaagaacucaguauguaacacuggcugaaaacaaaucuaucacgaauacaguugaaauaaagcuuaacaaaauaaugcaaccuuccagcaccaauuaagucaguuuuaaaaggaguuauauuuaaaaguaaauagaaagauaauaaacaaacaaacaaacaaauaaauaaauaaaagcagagaaugugugugagagagagauugagagaccaagagagagacugagagagaaaaauagagagauuuuuacaucaaaaguauucagauuaacuuaucuacuuuucuuauuugaauguagucugcuaagcaaccucauuuagcugacauuaagggcucuuucccuuugugauguucuaagaacucauauuauggguaaucuacccauuguacuuuaccuagaucuuugaagauacuaauuuacagugggacauuuuaucuagauauaaaauguauagaauuagggggaggaaucuggugugagaacauuuuuuuuuuuggcugggggacauauaaauaaaccugacgcaugaaauauuauguugcaagccuagagggucaucuuuuagucauguucauuauuccuaaugaggauuuuguuuaugccauuaaacccuuccuaaaagucaccagguaaaggaaguuaccaugcugccuuacauuucugcuucaaucaagagcuuucacagcaagguuuuauaaauuauuauaguacuguugggaagggaauaguauaacauaacuuuaauugaaauaaucacuauaguuauguaauucaaaguagucaugaugaacuucaguguaugagguucaccaaaugaguaugaauccauuaguacuucagagcaaauauguaagcauuauaauuugaucacugaaauggaccuccaagagcuaauuugcaagagucacaagucugagaggguauuuuucuuuuaugcuccaucuccagauauaacacauguaacuuagcuuaagcaauuucugucauaaaguucaagggugacaacaugaacaaaagggugagccuuccagagacagaguccuuuccuuacgugcaugggauuuuuuucacacaaucuugacauuguucaaauguuaagacaggcucuagaguuuuaucucauaauuauacaaaaguaagcauaagaggaaauuaaaucucugacagaaagcagaaaacaagcacuaaugagacacaggacuacauuccaaaggaaaggaaaucaugucuuuuugugguuggaucacacuaauuaucacagauuuggcaaaaggcuacauccucuaauugcaggcaauuagcaaauugacauuuuugaaaauggcugugauuacgguuguggaguacccuccugucacccucccacaagguagcuguucuauagucuacuucccagugcugaacacacgucaaucuuucauuucuaugggaaccacgccuguaaugaguucaguguuuauagaacauaugaugucaguugagcaucacaugcauuagauacugaacuuuacuaagacacuggucauugcuaugaacaauauuuccuacuacuauaauuggagaggcagucucuggacaagaccaacaacaauaacaacaacaacaaaaaagaccucuuagaaauaagugauuuucaaauguauguaauuaucauggaagaaauggaagagauuugaaauuugauagccaugugguuucugaguacaugcucauuaaaggcucagaacuggaaagcuaucuucccaacauaguuguuauuauacucuguugugauuguaguucuaaugaaaaacuauagugaauuguauuuuucaugaguuauacucccaugugaguaaagucuguuugcuuccgcugcauaugcagccuccagucaaugaaacaaaguauuuuccaaggagucagaacucuuuaguauuucaagcuuuauaguuauggaaaacuuguuucuauucaaaauuuuaaauuuuaaauuuuuguuaagauaucugaaaguagagggauugucacacuaugugagaguagaauuuccaaguuguuaaauuuuuugaaaaaguauauguguguguguuuauguguguaagcagaggguguauauaugcacaccuauuuauaugaaucuguauugauauaaauauagauauagauauaagugcccaugaagccaaagaaggacuggagucauugcaguuggauuugcaggcaguuguggccucuuguuguagcuuauagaaaucaaacgcagacccacugcagaaacagcacacauuuguaaacacugugucucugaacucaaauauccaguuuuuauuuuaccucccuucaucccucaaaauaaaaaugaaaauauguauuauaauugguuaaaugaguagugaaucguauuuuugaccauaaaggucauaacuugguuguuaugugucuauauugacguacugaaaaucuacauuccaaaauuaaggcuucaugaaguuaguuucacagaacuuaugccaccaaauuuauccuauucaaccauagaccucuugguuauaaaauggcaauuaaaacugauauugucacggcacucuaauucaaaugaaaagaauuacucucccaaaagcuucaauuuucaauguaugaaaagggcccuguuuacaaguucaaaugacuuuaaguuuucauguaaauccaugucaguguuagauuuauaaaaguugaugcaaacuuugguuggagcccacguauuuauaggguauuuauguagguaguacagguuacaauucuagccaauauuuacaaacauuuguuaaggcuuaacauguagccaaagauuagagccucaucguaagaagagcaaaaauuuccgcugugaggaccaacaaauauauaggaaacauuuuuaguuuggaaacuaaacuaaggaaaaaaaauucuugacuugguugggaaagaugaaacaaacaguuucagcuacaauugauguaaaucuuggggaaaauacauaacagacaagcuggcaccuuaauucccuuguguauugguuaggguuuuacuguugugaacaggcaccaugaccaaggcaagucuuauaaaaacaaaauuuacuuggggcuggcuuacagguucagagguucagucuauuaucaucaaggggggagcauggcaauauccaggcaggcauggcacgggcagagcugagauuucuaugucuucauucaaaggcugcuaguggaagauugacuuccaggcaacuagggugaggaacuuaagcccacacccacagugacacaccuacuccaaccaggucacaccuauuccaacaagaccacaccuccaaauggugccacuuccuggcccaagaauaugcaaacuaucacaccuuguaaacacauaauuuuuauauguuggagaugguuauaauccaaguauuuaguaggcuuaggcagaagaauugcagaaggaaggguagccuacaaaauuagauauuguaucaaaaacuaaaaaacaacaacacuguuuuaugaugccgucuuugggaauuucuucucagagguuaugccuucuuguuuccccuuugcuagguuuggacaaagugcccugggauuuuccacccgacacaaccuugcuagaccugcaaaacaacaaaauuacagagaucaaagaaggggccuucaagaaccugaaggacuugcauguaagaaucauuuuaucuuauuauuuguucuaagaccagacucuaaugguauuuucaaaagaaaccuacaguuagaucaaaacaggcugcgguaaugaaauaguacauaacugugcgcuuaucugauucucuuccuggcaaggacagauaagcagaguaccauauuaaguagccacuaacaaaaaaucaccaccaauauuucuacauauaauccaugugucaucacuauuuacuuaaaacaucuuuauacuuuaaucuuugucaauguuuccaugaauaaauacauguacugucacaaauagagggcauuuugauuauagaauaaaacacagaacuacuuaauucuaguguuauuuuaugcuuuuguuucuuuuguugugauuuauucucuaagagagguauggauggccuuggaaauucucuugguaucaacagaauaaggaauaaccaccauuuuauucguguguguguguguguuuaacuuaugucuacucuauguucaauaggauauucaagaauacauuggaaagggaagauacuuucagauggguuucauaagaacauuucauaaaggccuuguucauaaagcagcuagaaaaugaggcauugugaggcacucaaaucugaagguagcaggagguaggagaauuauggggcagaacacuagaaggucuuacuucaucaucuacauuacuuaaucuuagaguguggucaaggcacuaggcugaggcagaguucagcuuccucagacauagaguaguagguaccccaaacaaaaaaacauaaacauccuugucuugggaaaugugacaugacugagucaaauugugucaagcuuucugaagcaaaccuuugaaguaugacuacagagagcacuggaaucucuacaaaauauaucuuuuauuuuucaguuggauuccugugggagaaguaugauaccuuucaaaauaccaguaaacauuuaauauaggcaagccaggcaucaacaucuaaaguacacuguacuaugaaaaccucaaccucuauacucuacuguggggccauucucugaguucugaguaugauccuugacaaagcccauugagauggccuuaaagaacauucagagauggaugauaaugggagaaaguaacugagugucauguauguugacauaaucaauagagauaucaaugccuacauugaaugaaaggugacauaucuuauuugaaagucacaaugagaaagaaugacuacagucacuucucucaacagugagacaacacaauucuuuuuuuuuuucauuuuuuauuagauauuuucuucauuuacauuucaaauacuaucccggaaguccccuauacccucucccugcccugcucccacuucuuggcccugguguuccccuguacuggggcauauaaaauuugcaagaccaaggggccucuccugccauugauggccgacuagaccaucuucugcuacauaugcagcuagagacacgagcucuagguguacugauuaguucauauuguuguuccaccuguaggguugcagaccccuucagcuccuuggauacuuucucuagcuccuccauugggggcccuguguuccauccaauagaugauuuugagcauccacuucuguauuugccaggcacuggccuagccucacaugagacagcuauaucaggguccuuucagcaaaaucuugcuggcauaugcuauagugagacaacacaauucuuguauuggggagaaauaucagagaagcacauuuguauuccauauuaaaaccuaauuuaaagagaauuuacagaaaauagaacuucuagugauauggccccaacuguggucguaaugguucguaaacauuuuauuuuaacgaugaaugucauaguaauauaauucugaggccuagggcacuuauucacguuuauuuauuaugcucauugaugaaauaauugaggaaauggauauuaaaaucagaaauauauaauaaaauacaucuauaaaauguaccagccugauguuacauaguagaauaggggauguagauauaaaagcaauaaugaaaugcaaaauggaauaggcuggucugaaaacauuacaaaguuaauauagucaaaaugagauuucguagugaauuucuugacagcugagaagauggucguaaugcauauccauagacaauauacuagauuuguacaagaaaucaacuguuuuucucaaucuauagauucuauauggaugaugcuaacuaauguguaaugugaaagaauuaaaauuaacauugcaaccauucaaaaaacucuguaucagucagauaagguaguaguauaugugaaaaagguaaugucaauuugucaguaugucccaacauaaacaacauacauguaaguugugaguguugagagaaaaaucgaaugccaguguauacucaauuaacagguuuuuuuguuuuguuuuguuuuuguuuguuuuuguuuuguuuuuguuuuuuuaagcggcucaaaggauuagcaggguauugaaaagcaaaaaggaaaggggguucacuguguaagagaaaaggaaaggcaggagagagagagagagagagagagagagagagagagagagagagagagagagagagagagagagagagagagaauaaaaugucacaaagacugagugaaaguuaaagguaugccugaaugaggaaaugaccugagccugagccaggcgcuuuuuggagugcucugcagcacugcuccuaagaugccugagucccacaccccgccuggcucauggcuuucaucaaagcuucguggcagaguuguuggcaaaaucagcaauauuugucucugacucucuaagucgcugcuaaaacaauuuuagaaaagugaaaauaaagaacgaguaccauuuaaaugaacugauacagacuaaaauaugaacuuacuuugccuacauuuuauuccaaaucugccgguuuuagggaaggaaaguuacaaguuuuagacaauacaaggguaaucugagccuggguuugaaagguccugagccuggguuugaaagguccugagccuggguuagaaagacauccaguuucugcaaggcucuccuuaaaucggccacagaugccaggcguucucucuauaaguaaguuuccuucuggaaguuuugugaagcguucuucaucuuggcgagccucuguuucuacuucaaaguauccaucggaagaagaggagaguucauuagaaccugugaucaugcagggaugccaaacggcuaguuaucucucagucuuucauucuuuauuccuucuuuccuuguuauuaugcaaaaagacguuauaauuuugguuaggaaaacuguguugggaugacaagggaggaaagaaacaaaaguuuaguuaggauuaaaauagaaaagucuaagcagggagaaguccuuuaugcccuauuuuuuaucuucauuuacaacucaguggguuauuucuuuaauagcuuuccguagaccauauguacguauagaugcacguguaaugaacaacuuuuauguaauaauagagccauguuuccuucuuucuuuuuuuucaggagcaaggugcuauguaauuauucuuuuuuaaaaauauuuuuuauuauuacguauuuuccucaauuacauuucgaaugcuaucccaaaagucccccauacccucccccacacuuuccuacccacccauucccaauuuuuggcccuggcauuccccugcacuggggcauauacaguuugcguguccaaaggauauaccuucuucucagcaccucacgggaccuucuccaaaauugaccacauaauuggucacaaaacaagccucaacagauacaaaaauauugaaauugucccaugcauccuaucagaccaccauggacuaaggcugaucuucaauaacaacauaaauaauggaaagccaacauucacauggaaacugaacaacacucuucucaaugauaccuuggucuagagccauguuucuuaugcucguuucaaauugcggcauuguagacauagcaaggaagggguuuuaaaauaaaagucaacagaaauugucagccacugaaaacuaaaaaauagucuguguggcacucacaguauuacagguguguagguuuccaucccaggaggccuuaagguaauuaauccuuuuggcuguuguuuuacuauccugcucuauagauacaggaacucaggcagagggagguggguuucuauuucacacagcacauaagagccagaacuugaguguagaagcugaccuucuauacucaggagcauagcuaugagauggaguccaauaagacucuuggaacagaagcccuacauaaaggucuuuuggggaaaaauguauaaagcacuaaaagucauauuucaauauucaauagaguaaaccaggccuuuuaaacuggaauucauacauugaacaaugucaaaauuucauuucuauccucuauggcuggcauuuaaggcugcagaaacuaggugccuaaauuuaaggguuucguguaaaauuaagguucuacaaucucuaguaucaacaaaugucgcaauuugcuuuucuguacucuucugacuuaagacaucacugauauuuuucuuuuuuuuuuaauuagguauuuauuucauuuacauuuccaaugcuaucccaaaagucccacacacgcuccccuauccacucccacuucuuggcucuaguguuccccuguacugagggauauaaaguuugcacgaccaauggaccucucuuuccacugauauuuuucuuuaaaauaacuuucaauuaaaaauauaugauaguuuauuauuaugguuuuuuuuuacucuucuacaacuccucccagauacuacccauuucgcuaucuacccaacuucaugauaucucucuuuuucucucucucucuuuuccuccaaaaacaaaaccaaccagauacuaaaauacauaaauagaaagaaagcagucugacaaacaguaucaaaauaaaacaaaagauagaaaauccaaauaaaacaaaagauaggggaucuguuuugugguggcugccagguacucauggguauagagccugucuggaauauaauuguuauaucuagugacccuccauuggacaaaaaugauuuucccucucuuuugcagguaucaauagcaaauagcuucuuagucagagugggaguuuuucuucacuccauuucucaguaauuuuuuuuuuuuuggggggggggucugguuugaaugugugcaccgcuuguaaguaccaucacagucucuuucaguucauuucuuuaccaguucugcugugucuagaagauucuguuccuuggagucacucaccacguuugacucuugcaauuuuuccuccauuuuaaaacauagaucccugaguauuggggagggcugugguugccaaagacaucccaauuagggcugaaugcuucaaaaucucucuuauggaaggggacuguugcaucaauagcucuuuuaggcaggucuuuguuguaggucauagguuuguaauuggugacaccgaugauugcauucuccuccaacagccugcuagucauuagaggaaaagcauuuauuugggcaccaguacuuuuccuccauguuugaugacauaguaagugguaucuucaggaauagggacuucccauuguggaagcugaccaaugaccuuggcaauacucucugauggauauuugguguguaugcggggaccccuugggucaauuauuccacacaauuccugacacagagucuuacuugguaacauaauuauuuaguuggaacauucucaccgauauuauauggugagcccauuuaaauuauuuucuuacuuguaugcauuuugggaagcuucuacuauguuagauuuccauacagcuguuaaaaaagucuuuuuuauuauugauuuacugcuauauuucuuuacaucccaagugcugaccuccucacaguugccccuuguagagucucuuuucccaucaacauuacccuuagcauauaagaggguagcauccccccaggauaacuccacgcuccccagaaaaucaugucuuuguaggauuaggugcauauucccucacugaagccagacaaggcagcccucuguuacauaugugccuuagccucggaccaguuccugugugaucuuugguuguuggcucagucucugggaggucccauggguccagguuccuugacacuguuggucuuacugugaggucaccaucuccuucagggcccucaguccuuccccuucaucuauaggggucccugcccuccaucuaauauuuggcagugggcuucugcaucugucucagucagcugcuggguagagccucucagagugcagcuaagcuaggcuucucugucuguaagcacaagguagcaucaauaauagugucagggauuagugcuugccugugggauaggucucaaguuggucuggucauuuggucagucauucauucagucucugcugcaucuuugucccuguauuccuuuuagacagacccaguuuggggucaaaauuuuguaggugggcugauguuccuauuccuccauuggggguccuaucuaacuacugucucaucagguuccauauccccacuuuugggcacuuucacauggaguacugggaagguaccacaucccagaucucuaggacuugcuagagguuccucucccccacccccagcaguugcaugcuucauuuauucuccuggcccucuggagaggaaggucuucaccaucucuccugucuccaccauaccugacccuuuccacuuuuccccucccucucccuuucucacacagaacccucccucucucugccucccaugauuauuuucuucccccuucuaagugggauugaggcauccuugcuugugcuuuccuucuuguuuaaauucuuagagccugugguuuguaucauggguauucuguacuuuuuuggcuaauauccacuuaucagugaguacauaccaugcauauccuuuuggguuuggguuaucucucccaggaugauauuuucaaauucucuucauuugccuucaaauuuuaugcuguccucauuuuuaauagauaaauuuuauuccauuguauaaagguaccauauuuucuguauccauucuucaguugaggaauaugugggauggcccguuucuugauauuaugaauaaaacugcuaaaaacauauuggaacacauguccuuuugguaugguggaguauauuuggguauaugcccaggguugguauagcugugucuugagguagcuuuucuguuuuguuuuguuuuuguuuuuguuuuuguuuuuguuuuugcuuuugcuuuuguuuuuguuuuuuucgagauaggguuucucuguauaucccuggcuguccugaaacucacuuuguagaccaggcugaccucaaacucagaaauccgccugccucugcuuccugagugcuggguuuaaaggcgugcgccaccacacccggcuugagguagcuuuuuaucuuagccauucugacagguaugcgauagaaucucagagucauuuugauuugcauuuccuugauaaguaaagacuuugaacauuucuuuaagugguucucagccauucuguuuagcucuguaccccauuuuuauugggguauuuguugucuuggauucuaacauaacaucuguaacaacaacaacaaaaaacccaacccauauaugucuuuugguaucuuuguuaccucagacauggugauuauuucuaguucccucuaauuuacuucccugcaaauaauuuaaucuuuuugaucagcuuaacaauauuccuuugagcaaaugcaccauguuuuccuuaucuguuccuuugauuauuggaagaugaacuugguagcuuggcuuuuucaaauuucuggcuggcuguuauagagcugaaaugaacacaguugagcaaguaucuguguaguaaaauggagaguccuuuggguauaugcuuacaagugauaauaguuggaucuagugguaggucuguugccagcuuuuuugagggaugauagcaacaguuuccauaguggauuuaguaguucacacucacaucaacaaguacuaacuuuuccccuuuccccacaucuuauccaucaugagaucucauauguuuuauuaaucuuggacguucugucuuugaguaaaaugaaaucucaagauuucauuuucauuuuccugaggacuaagaaugcugaacauuucuucagguucuucucaaccauugcauuucagcuuucgagaacucuuucuuuaguucuguuucccauuuuuuguguguuuguuuauuugagacaagauuacucucuguagcucuuucuguacuggaacacacucuguagaccaggcuggccucagagauaugcuuguauuugacucauaagugcuggaauuaaaagcaugcaccaccauggccacuccauaccccauuauaauuggguuacuugcuuucuucauguucaguuuuuuugcuuguuuguuuuuguuuuuguuuuuguuuuuuugagacaggguuucucuguauagcccuggcuguccgggaacucacuuuguagaccaggcuggccucgaacucagaaauccgccugccucugccucccgagugcugggauuaaagacaugcccuacuaugcccggccaguuuuuuuuuuuuuuuuucuuuuuuaauucuuuguaucuccuaauuaaugaugcucugucuauuguauaauugacaaguuuuuuuuccccuuuguagguuuccauuuuccugacaugauagugucuuuuguuguacagagaguguuuaguuucaucagguaccauuauuuucagucuuaaugccuugguaagacugauuagcauccuuuucagaaaguuuuuucuugugucuuguuuucaagccuauucucuaauuauucuccuaucauauucaggguaucugguauuauguuggggccuuugacacauuuugaguugaguuuuaugcaggauuaugaaaauggaacuauucucaugagaagagagaggauugcuuugacucuguagauugcuuuggguaggaggccuauuucacaacaaaaaucuuacuaacccaugagcauaagagaucuucugauaucuucuccaauuucuuucaaauauccuauauauaugauaauuugaaagguauuguuuccaugaauucuuucuuaguauguuugucauuucuacauagagagacuauugaucuuuuuuuuuuuuuugaguuaauguuaaguaaucccugcuauuuuacugaaaguguuuaucagguguagcaguuucuuagugauguuuuuauuguuaaaaacuuaucuucugcucauaaagguccuucccuuucuauuucaacccccuugaucuuacauuuuauuguuauucuagcuaagacuucaaguucuauguuucacagguauggagagaguagauaucuuugucuuguuccucauuguaguggaaaugcuugcauuucuuuugauguaugaagauguugucuaagagcuuauuauaaauugacuuuauugcuuugacuauaggucaauucuaaaaugauuuuuaauuuuuuuacauuguaaguuuaucuagcagaagcaguucguuuuuaugaacacuuaauaaaauauauaguuaucuuuauauuaucuuuccuaaauuuugucaucagaauuuuuuuucucaaccaguuucaauaauuaauaucugaaagcacaagacucaagucauuagagagacaaacuuaaaauuaacguuucaguaagccugucuaggauagucuuggaucaaguuuucuuuuucuuuaaauaaucugaaucacuggacacacacacacacacacacacacacacacacacacacacacacacaauaaucauucaugauuauuggcacacagcuaguuuaaaacaguuaauuaaaacugaaguguccaaaguuuucucuucaagaguccaaagguaagcugguuuugcuccauuauuaucuaagaaauaaucuugaguuuuuagagcauuaguaccaaauucacagaacuauuacauuuucauuauuacagaaaucauuacagaccucugcaccaucgacuuuuuugaaaugguuccacagaacuucaaugucucaaaagagccuggaaccuucuuugucgcauggccaaugucccaaauaguuuaacaguacuccacacuuacucaccacaucuuccaaauuggcaaagccugucucacaagugggaucauuuucugauuauguguucuuuccuuuacuaugcuuaucauucagguuucaaccuguaggucaagaccccucuaggauugaaugaccccuuuccagcggucaugugucaaauauucugcaugucagauauuuacauuacaauucauaacaguaccaaaauuagaguuacuaaguagcaacaaaaaaacuuuuaugguugggggucacuacaacaugacaaacuguguuagaggaucacggcaugagguagguugagaaccacugcucuagaaagucaagaugaauguucucauagaucuaacaagcccuuucuacacagagcacagcaggaaaaaaaaauagaacaaaggaggccaaagcaugaugucuaccugaagccacauauugugggaagacagcagagucucccucucuguacagucgcuaucaccagcuauguuuaaguucucagacuugggcccccuuuugccaaacacugacucugagccuuaggaagacuggaugauggggagaugagaucgcuggcauugaugguaucuaagaaucuggcgucauccgaugauuucuuuagcaucacuuauaguuuuuuaaaacauuugaaauauguuucuuuaauuucuuauuggauauucuauuuauuuacauuucaaauguuacucccuuucuugguuucuccuccagaaacccccaucccaucccccuccucaugcuucuaugagagugcucaccuacacaccgaccuacucccaccuccacacacaccucuaugcuggggcauugagccuucacaggauaacaacagcugagucuccucccauugaugcccuacaaggccauccucugcuucauauguggcuagagacaucagucuuuccauguguacucuuugguuggugguuuagucccugggagcucuggguagucugguugguugauauuguuguguacacacauauccaacacaagagaagcacauuucuauauauuuuccggucuucugauuguuuuucuagaauuuccuaccucuuugacaaaaggaauaaauuggcuacauauaugucaugugcauauguguggaagccuucggauuucagauauuauuuucugccauuuccacagaccuugauccuugucaacaacaagaucagcaaaaucaguccagaggcauucaaaccucucgugaaguuggaaaggcuuuaccugucuaagaaccaacuaaaggaacugccugaaaaaaugcccagaacucuccaggaacuucguguccaugagaaugagaucaccaagcugcggaaauccgacuucaauggacugaacaaugugcuugucauagguacagacuuaauuauuagcuugaggaucgggaccaaggggacaugaugaaauuucaaggaauccuuaacugcaggaaggggaugaauccaagugagugcugugugucagagggcugugugaccaucagucucagggcccaaagaaaagugacaaggugcuugugccagacuuuuucuucuuugaccuugaugaucuagcauggagggaagacugacuauaucugaucagaugagcaggauauaacauagagagugcuucauaaaagagauuugggaaaaccuguuuauagcagaguuuuauuguggucugaacacaacacaucuauagauuauuuccccucuaaaaguaagguuuuggggugugugugugugugugugugugugugugugugugugugugugugugaaagagagagaaagagggagagagacagagagacagagagacagaaagacagagagacagagacagaaauauuauuuaauguaaauucauaauugucuugcaaaaugauagcuuuaaauucucuaucaacauugaaaauugccugaaaaaucucuaccauaaaguaucguuuauuaacaccuucuuagcauuucuggaagaauuauaaauaguuccuugacuguuuauuuuuauuuuuauaaauaaauugauuuuggguuuuuuuuauacuuguuauuauucguuugauuaguuaauuaacuaauccauacaugguuucauugcauagaaagagauucaagcugcccuugaauggugaacuuccugucagaaguucucuaguguuggggugauggccccauugucuaucccauaacaccaggcuguguuucaguagggauaaggcuucauuguauuuugaugcuucucugaaagcaucugguuucucaaucaagaaguaaugaagcuaaaauuuuugucuagaauccucgcugaagcaggcagacaucgaacacucccucuaacagcuuugcaccuuuugccuuuguagaacugggcggcaacccacugaaaaacucugggauugaaaacggagccuuccagggacugaagagucucucauacauucgcaucucagacaccaacauaacugcgaucccucaaggugacaggaaauucuccaaaaaauguuuugaaaaaucaagcuccaaauagcuuugagauaguuuuaaaauaaaugauuguggagguuuaaauugggacacauguggcaaaccuuauccucagugaacucucaauuccgggcauuguguuucuagacgcugguugacucuugggcucugcaggcacacauagacucacuguaaaaucuguucuaagugggaacuuaagauacagucuauuuguauucugccuuuaugauuuucuaaagaaaaaaaaauacuguuagugaaagugcauucauauuauguuuaaaaaaaaaaauaggaaaaaauauuccugguaguauuucugaaauugagccaagugugaccuuaguuuuccaauccauggggaauucuugucacugcaaaacuuuccauucaucagcaucucaauaaggagaucuaacugccuucugaaucuuggugaucagaaagaauguagacaccacaaucuuugauucaaguugucacuugaauuugagaguucaaggacucuuaaauucuuaggguuagggucucaaaaguaaguagcaaagcauguggguuauagauagguagggaacuaauaaugccuccuauuuucauuugaaaauguauugaaauuuuaagcuuaaucaauguacacuagagacaugugaguggguaaggagauacuguuucucugucaaacagagccagaccauuuaagaguggucaaaucugucagcuucaaaccugcuuuuacugcuccauggaagccugucuuggugaaccauaaaagaugaaaaccacauuuuuaaaaacaugccuugaaugucacuuuccuccaaccucaaaguacagucucacaaacgucucuccacauuccucccuaucuccccucccagaccuccuaagcacaggugccuuguuccaaaacugggacuagaugcaaauucuccucugcaggagacauuggugauuuuuuuacuguacuuuuagaaauuaacucuuaaauguaauuagaccauagaaaccuuuuuuaaaacucccaccuguacagucuuuuuauauagaggguguuuuuggugcccaggggauaggcaccaaugauagauuaaugaauaagauagcuagcuagguaaguacauauuuauucauaccuuaaaauguauacuuauucugaauauuuguuauuucccaauucugugucuuaaauaauuauuaaauaauuauaaauaaauuaaauaaaaccucccuucaggcacguacuagauccguagguaugaauucacuguuuucuuguagcuguugcuacucauuaaagcagaacucugcauuauuaacagccauauauagacaugguccuuuggaaggcaagaagaaaugaaaaauuuaaauauugcuuacuacuuacauuacuaaaucuucggaauucacaaccauuaaucaaguauuguugagaguuuagugggcccuuuaaauuuuaaauuauuugcccagguguucuacauaugucagguuauagggcucuggaccuccucucagggggaaacagucuggauuuaauaggucuauguaaguucuagcuauugcuggacagccauggugcagaggcaucaaauacucucacaaaggcauccuguccacaggccaacaccagcacgauacacugaguucucauucugaauuaaucuuauaauaaaauaucuguguauauuuauacacggacuuaacugauacacuggugcauaaucccugcacuagcauuccagugucggcuuccuccuuuucaugauuuuacaucaugaauguguuuauauaauaacagcaaugugagcucacugacacagguggagagagcaaugaaggucaaugucugacuuugguucugcaguugcaagcacaaaaauccaucccaugauacuggcaguucuuaaccuuaucaaugucucucuaagauaaaaacaguaaagugucacaucacuuuaaaguaugcauuguuuuuauaaaaagaaagaaggaaaaagaugaagaccaaaauuauuugaaaugguauuuagaaauucacagcauggguacccauuggaguauauucugcauuuauaauguguguuggccacuucagcaucuuuuucugcuuauuccaggucugccuacuucucucacugaagugcaucuagauggcaacaagaucaccaagguugaugcacccagccugaaaggacugauuaauuugucuaaguaagaaauccaucacuuucuaucaaaggaugccaagggaaggguguuauucaacguuagaaacacaaugcucuaucaauuuuuaaaaacuaucacaccuuauuguugcuuuuaaguaaaacuccagcuuaucagaugaauucuugauaaaagucaacgaacuauuauaauuacuguaggcaacaaaauuugucacauguuuuguauauuuugugaauauuguauggcuuauaguucuuuuauacaggugcucaguuaaaacauguuuuagaugucuauuuaauauauucuaguucaaugugaucaaaaagaaaccuaagaaagacuguaaacaguuugacccaaguuugagaauauauucaaacaggaauuauaugggcacugaaauauuacuuugagacuagcugcaacaaaaauuauuuaacccauauucucuuaauggcuuaaaagaaaaugucagucucacaaaagaaagaaaaaaucuuguggcccuacuuaacuguauguuuacuauguauaucaccaugugucugcuuucuaacuugguuucaaucucucuguguuuaaaacuugauuauuauguaagaaaaaguaggccaauaaggugaucuuguuuaguagucaucaagggauacucuguccuugaugagcauauagcugaauauucuuagaggaaauauuucugcaguagcauuaugcuaagucaacauggccaaugaaugaauacacaaugcacaucucuuuaucuuagagagauaucaguaaccaaguuaauauacaagguaccauucccugagucuguguacaaucccaaugaaacaggagaugaugaagagaaaauauauauauucaguugugauuauagcuacaaauugcuuccccaguaccacaaauaauaagaaagguuccauguaaaaaaauuuaaccagagucucugaaagaaaaaucuucacaguaguauuacaucauacaccaccuaauuuuuguuauuaaauaauccccccccccagcugcauacgagaggaggcagaugaguugcacuacguguuacacacaucugccauuaggaucuuauuuucggguuauuaugaugacgaugauuaauaagaagagaauauuuuaaaguucaaagaauggcaauauucauaauauauauguuucuuuagaaaagaaguuugccucauaugaaaagcaguaaauagauuguggcauuccaaacucucauacugauggcaugugcuuauuaacaggagauuaaaguucuaauaaaauauggaaagggcaauaaaaagucagauucuugaugaauauguuuuaaauuccauauaauugcuguaucuguacggucaaauuauuaaauaguugaguuuaucaaauacauuuuuugauaaucaaaucuaggaaaaaaaaaccuuuucauuaagccaucaaaccauugugucuuauuauucagugguuugaacacaacaaauauauugguguugaaaauuuaaaaaaaauucaaaccugugaaaagaaaacaagaacauuguuuucauggcaaaguuucaguuuauuaucaggaccaugcucagauaccacucauuccuuuucugaaguaaaauaacaaugauuguuauacacagagauccagaaacaaacauguccauauagucauuuauacauacauacauauauaaaugacauucacauacaugugugucaucauguccuuuauuaggugaaguauuuggcaauaguagacaugguuuucaaguuuugucacuguuucuuuuaauccauggagacauauagaaccucaaaaacacugggugauugaauauaugaauaaauacuuuaaaauaacauucaucucggaaaagucauuugggguucuauaguuaaaaaaaaaaaguccaaugcuaaauugaaaaacaggacuuggaaugucacaggguauaggagauauaauucugaaguagaaaagcaagggccauaaauaauagaugggcaucuaagaggaagggaacauguaggguucucagcaaaaugccaaauuaaucaucaauagugaaaauaacuggugauucuaccuuugccccuaaaucugcacauuuuaaucauuauuucaaaauaaaggcagggccacauauaagggaauuuacuuauguaaggccaauaucuaaguucuaaaggacucaagccuggaccuaccugaaggguagggaaacugcucugcaaucuccagauuuuaugugaagaugcuugauagacauucugucucuuuguaccugucugaucucuuucacuauucuguagccuucugcucucuacccuauagauuaacaucucuuugguuugggugauuuuaucccuagaauguuuaauggacaagucuugccuucaagccaauuucuacuggcuuggaaucccauuaauaucacagaauccccauccauuaugcuuuugauuuuaaaaauauaaaccaugagcucaacccaauuaaacuuauguaacagagaaaugagucagauaucugagugggaaagaacaaaacucacaccaugcugauccagagugcaauuaaagggucacuggggaaguucuaucuaauacaacacagaucccacuacuuguucuagaaagcagguuuauuaauauuuuagaauguuauuccuuuaauuuucuaugaauaauguguaugauaaaugggggcaguugcuucaguuccaaaaugacuaaagagaaucuuauuucuuuuuugaccuuuaccaaguaaaucugcauguuuauuacauguagaaaucaauucgugguuauuuuuuaauauguuagauucuauguucagucuaugauaggacuggauaaccuacaagaaaaauugcuauuucaaaggaaagguauccaaguagccaagucauaacacugccuuuuauauuuuccaaggucuucucaggaugcaacaguagagcauuuacugagaguuaagaauaggcuuugggauaugggaugguggagauguuuguguuggcaaaaugauugcugugcaguuaugccugaauucagauucccuauguaaaaaccuaggcauggcagcacuuacucuggaaguaagagaaaagaaaaucccuaaagcuuacugacuggcuaguuuugagaaauuaaugggcucaggguucaggaaagaucaucucaaaaccuaaaguggaaaaucaugaagaaguguauccgguguugacaucaguccccugaacauaugcacacacaauauaucuaccauaccaugcacacucaaacagaccugcacuucaacauguacacacacacacacacacacacacacacacacacacacaccuaugagcacacacacacacgugcucacaugcacacacagggagcaaagguuuugcuuaggcucagaaagguugaaagagaaacacucugacagcaacaguugaugcaaaaccaauaaauguguuauuaguugcucaauuauguacugacuacaagaagggauuccugacuacugugcacaccaauuucuguucuucucuguagacugggauugagcuucaacagcaucaccguuauggagaauggcagucuggccaauguuccucaucugagggaacuccacuuggacaacaacaaacuccucagggugccugcugggcuggcacagcauaaguauauccagguaaagcaaaucaguuccuuuuaggacuaucuggaaaggaauccucccagugugauucugggaggaagggaacucuggacagaaaguuauucacgucauggcucucucuauuguaacaacaucuuaugaguuggggguuuggagagcauucauggccucagaucagaguaacaguaucgcuagguucuggugagagccucacccaaacucugagcuucugauaucaccacuugaugucacaugguagaaagugccuuccuguagggcagcaaucccuuuugugacuguucacuuuccauaggcccauccugcaccccauguuauugaaaguuuuaaaacaugaacuugggaggauacaacagccaagccauugcauaaaaaggaacuuuaaauauugucacauaaacauucuuuugcagaaaacauguuuaauuuuuuaauuuuuaaaauaaacacaccuuggauaauuuauaaaacucacuucuaaaauagauauuucuuauugguuagccugauccaaggucaucgaccaguguaacaaauaaguagcuguuguaaaaggcagugaccagugacgguaugaucagugaugcagaauaaacaagguuuaacuguaagcuaaaaguagauucauggcugaaaaaucaaugcacugaguuaauuuuauuuaaguuaucaaaugacauagcuugauaaagauagaaauacuggaaccaguagucuguuggguugauagcuuuguguccauaaaucuacaaauauaagucauacuuauuaaguagugacaaaaauaauuauguauaacaacagaauccagugcuacuuugagaaacuaaaauuggaaaauuguuuauucagguuacuccuuuaagaaaaaaauaaaaccaaaaugaaaacccaguauuuuaaauggguuuacacaauuauuuucagggauguuuuguguguguuuauguguguaugcguguguguguuaagauuuuuuuuucuauuuugauuuguuuuuguuuugaucauuuguuugagauaaaucucauuuuguaguucuggcuuuccugggacucacuauguagaccaggcuaaccucaaaugcacagagauccuccugcccauacaucccaaguucugggauuuaaaggcaugugacauuacauucuuaagacauucuuuucauuuaaauaacuguuaaguucaaucacugugucuccaaaacaacauuuugauccauuucauaggcaaaauaauauaauauccauguguugcugguagcauaagauaggcugaucuuuuguuuugcugucaguaauguucaaagcaaaaguucucccuuucuuugugguuuaguuauggcaucguuuccaaguucaacugauaacaaauuugacauuaaaugaguuuaauuaguguuugacaugaaagugaucacaacacuccccauguuuucuugcaugcugauucuuuucacugggcgugcuuggcaggguuaguggguggauagaauuuguagcuguugguucucuaaaugaaugacuuagaagacuugacaaaauuaguuauccauuugaaccgucaagguuuccguugaguuuaguuuuguguuuugguuccacuguuaccauuuuuuacucguguuuuuuuuuuuuuucucaucagcuuggcacacacuacagaggucaugggauugcuuuacccccccggcacauuaaagaaggaaacacaguagaaaacaacuguccaauuugaugccacuucauacaauuuuguuucauagauuuuggcucuaagcuccaagugguagcacacuuugucuugucagucacggaggaagacaaugaagugugaagcucugaagucuguugaauuuaaggaaaucauuuccauaguaacacguauuugaaaagaaucacacugcgcucuggcucccuaauuuuuagaacccgcauccucuuuacaucuuuacuucacgauccuaaggauuucauauguauuacuucuuuuucuguuauuuuguaaaacuuauaaauacuuauuuuuaauuuuuauuauauacuuugaacccuauaagaauuuuauucccagcacucgggaggcagaggcaggcagauuucugaguucgaggccagccuggucuacaaagugaguuccaggauagccagggcuacacagagaaacccugucucgaaaaacaaaaaacaaacaaacaaacaaacaaacaaaaacaaaaaacaaaaacaaaaaaauaaaaaaagaauuuuaugcaauuagacaaacuauuuugccuaaauauauuauaauauauuauauuuguauguugucccuccuuacucuaacuuccuuguguccaagucucaacccaacccucaaacccuuaaacaucauaugcucuuugggcucugacucucucugucucucucugucgcugucucucugucucucugucucucucugucugucucucucugucugucucugucugucucucucugucucucugucucucucucucugucucuccuguguguguguguguguguguguguguguguguguauguguguguguguguguauguguguaaaacacagaguccaauuugugcugauaucuacaggaagauuuacugggaaaccauccacuguugguugugugugguuggagugugguuauauauccuuauagaaaacuagaaucuaaaaguuaugggagagacaagaauguaaacaagauauauugccugaaaaaaaaauuuuaagguaaauuuaaaaacagaaaaguaagguuggcuccccauccguuguuaauagcuauguugaagcaugugaggugcucccuccuccaugcugaagacuucccuggcuccauccugagcaggcaaccacagcugcugugacucacuaguaccacaacccugugauguccagaaagcccuguuuuaccucauucugccaagaccucugguucuuauaaucuuuccacacccucuucuguaaugugucuggagccuucuugggaguggguggagugcuauguagauaguguuuaugccagagcacuuuaccuagugugauucucugcacuguggcccuuugugacuuuccguauuucauuauuuauauuucuggauuucuauauucaugccaucuacggcacagagaagcuucucugacggagacugagacaacauaaacuuacauauucauccugaaaggguugucuucccccaaauuucucucugaaucauuuuaguuugucuucuucacaauguacuuuuuggcauggccguuuuuacuguuuuuaucucagacuuccucuggaauggaaaaaggauacaauggguuuuugaaaaccaaaggagaaaguaggaagagcuggcagcgauguaaauaguugaagacgaggccccagaggcuuuggcuggguugagggagcagucaugaagggaucugcauuaugugugcacuuugaagauaaggugguagaacuggaugguguggaagugucaugucuguagccugaacaucuagaaugccugauguucaacauacagagacagggcauauggaggaaggaaaagcaaauuuugaaauaaaggcacaaaaugaaauuuggcuugaggaauuguuaugucuucauacuuaaaugcccaaauuaaaaauaguacuuauaugaagaaccucaacccccaaauggagaauaaucauuccacaauacuucauguugcaggucgucuaccuucacaacaacaacaucuccgcaguugggcaaaaugacuucugccgagcuggacaccccucucgaaaggcuuccuacucggcugugagucuuuacggcaacccuguccgguauugggaaaucuuuccaaacaccuucagaugugucuaugugcguucugccauucaacuuggaaacuacaaguaacccucagacggccuaauucuuauaaucuggaaaaacaccccaauaugucaauaucauugcuaaaaagaaaaaauacuaaaaaagaaagaaagaaugcuagauucuggaaauucaagcacacugugcaugccuuuuccacaugacuuauuaugcaagcugaauauacagauugaauaauugccuacaauaaaaauauuuuacuuguaguauucagaaucacuuuuaaaguugucuguaguugugaacugaguuaucaaagucugauguaaucauaaaugucaaccacuuaguaaagcguuaaaaggaacagaauacaaagucucuguaauucauagagcuaaauuaacucuuuugacauaaagucaaaugccgccgaacucuagcaauguauuaaucuccuuuauuauuggugaagccuuauuugaguauguaaguucaauaugggcuauguaaaauuuucacugucauauugaaaaaaauaaaauuuuaaaaaugcauucaaaagauau

SEQ ID NO: 5716 - RNA, 7265 nt, Mus musculus
agaucacaguucaccgccaccacacaugcagaaguucagaaguuugcagcagaaacccucucacaccgaacugccucauuuguagcaagcucgauucuuagggguuuaauccaguaaaguacuucucucucugucucucucucuucccccaaccccgauuccagaguggaagggucuguuuuguccaccugcacuucguuagagagaagcuugcucagaggcaacaccacaagagcccacagugacauaacuucauccagaggcuggcgugauugggcuggucccccccccccaccccccacgcuccucagcucuuguaucacugagacucuggcagccagucccacccugacagaguucacagcauauguuaguggauucuuguucacagugugccuguuuaagaaauuaacggaaacagugucaagagaguaagguaagugcuuuuuuuuuuuuuuuuuuucuuacuauaccccaggggaugcugagucuuggggacaguguuuaauuuuaacaggaacaggaaaaaaaaagaucuagaggaauuuugccaauuugcuauucaaugacaguuuugaacauuuauuuucacauuuuaccuauuauacuuuccaucacuauuggauuaauuucacucuguaugccagacugauuggcaagggaaauuuaaaacguuccaagguugcaaugaaaaaaaaaaaaaaaguuagacacucaaaaacguacagaaauuaaaauguuaucuaugcuaauuagcuacauauuguuauaauguugaaaucuaguauugagacagaaaaaggccacuaccaccagcagcagucaagggguuuugcaauaaaauauguuguuacaggucgcaauaaacauucuggguuauaaaauguuagcaggaggacucaguuacuuguguggaucacuucuccguguuuugcucauuuuaaagaucugugguuuuggauauacaccuuaagguacauguuuuuaaaaguuucugggaaacaauuuacauuuuugcagaaaagcauuucuuucaugaccagagguauuuaaaaaaguaggggccgaauguaugacuuacccucacagaggaggcauuguauguucacaagguugcuuugauuucagacuguuaaguuuuacuuugccaaaacuguggaauaaauuuuuguuaguaugcauauuccauuuaaaaagucaaaacuuaaaugaaucaacagauucauuuaugugauuauguacuguuacuguguuccuagugcuaggcagggcaaauccuaacuauucaauuaaaaauucccaucagaaucaugggcaagggcauaauuuauuagcauugugacuguaucugagguuagaauuucaaguguaucuuucauaaaaucuuuuucaauguuucuuuuccugaagucugucaugauucuaagcuaaagcaaagcauauauauuuaaaaugcauggucucccaacuucuacuuccuccaaauuaccugaugcaaaugcuugucucauauuauuugcaugaaauaucaugcaaugcaggguguaauugaauguggauucucuucauguuguuucacucacaggaacaugggcuuucuuacaaugcauucugugauucccaacucuuaaguucuagccuucuuuuaugcaaauggcuagcuuuucucugaauuucgaaucauuguugaaucucaucuuagaaauauguuaugugaaaauaacuaccaggaaauuuuuugaacuuacacucucagcacacauuucaugaagccaacaucacuauuauuuuauuuuuguuuugucuuuuauucccugccuucuccugccuccacuuucugaaggcacuaaaaucugcauuagcaaaucauguuaccuuacaguuggcacaaagaagaugaacucaugauuuaaaauggagaaggacuuagcuuuuaaaguuggagagaagguuauuuucguauaauugguauccuuuuugguuuggauauaaaagccaacacugucugacguuucccuguuggguaaauauuuguucuucuaaaauuaauuuacuaaauacuagcuucagauacagcuuccaauggauuuuaaagcaggggauguuaagcugcaaauaauguaaacauccaucuaagaauucaacccccuuuccccagaauccacaacaauaacaaggccccuugaaaggaaugcgcuuauugccucuucuaccucacaagcagcaagagcaguuugccucagggcaaaaccacagauugccccugcacccacuuaggaucucucuaaugagacauuuuaaugauguugauggcagaauauacggaggaauuuccuguugucuucuaaguguccuuucuucuggauuaggggauauucuuaaauaggguuucucacauugugugagauggugccaccaggaaauacccugacugauauaucgauuaaggaaguaucagaagacagggccuaaaaauuuggaagccagaccacaagggggcgcaugcguacacaccugaaaccuguuuccacccaaaggugugaacaacacgcccccccccccccccacacacacacacccuccccuucccggcagccuucuccuuauacuuaaauagaaaguuucaaagggcagugaagacacuauuuuggaggcacugaaaaugaaaugaaaaaaaaaaaacgcacuuuguuaaugaauuuaaugaaaauugaacuuuuuuuccccuugaaauuauauuaugcuguaaugauucguuuuuccacuuuauguaggucacagaggacuugcugaaaaugaauguaugugcguucucucuugccuuggcauuagucgguagugucaguggccaauacuacgauuaugacaucccucucuucauguaugggcaaauaucacccaacugugcaccagaauguaacugcccccacagcuacccaacugccauguacugugaugaccucaaguugaagagugugccaaugguuccuccuggcaucaaguaccuuuaccugaggaauaaccaaaucgaccauauugaugagaaggccuuugagaacgucacagaccugcaguggcucauucuugaccacaaccuucuagaaaacuccaagaucaaaggaaagguuuucucuaagcugaaacaacugaagaaacugcauauaaacuacaacaaccugaccgaguccgucgguccacuuccaaagucccugcaagaccuacagcugaccaauaauaaaaucagcaagcucggcuccuucgacgggcuggucaacuugaccuucauuuaucuucaacacaaccagcucaaagaggaugcugucucggcuucucugaaaggucucaaaucacuagaguaccuggauuugagcuucaaucagaugagcaagcugccugcuggucuaccuacaucucuucuaacucucuaccuagacaauaauaagaucagcaacauuccggaugaguacuucaagcgcuucacugggcugcaauaccugcguuuaucucacaaugaacuggcugauagugggguaccuggaaacucguuuaauauaucauccuugcucgagcuugaucucuccuauaauaagcuuaagaguauaccaacaguuaaugaaaaucuugaaaauuauuaccuggaggucaaugaacuugaaaguaaguauaaagaugcccccccccccguguuagaauuauuuaaaguauacauuaaacuuuacuuauauacuuaaaguuuguaucaaacacuuugagaguuaaaauacuuagguuucacaauguaauaagaacgaauuaaaagaacaacaaaauccaaacauggaauucuaucucagucauacacggaauuguuccuagccuuuccuuagagugucgagaccaagagcuacuaaagccauaaaauuguucauuuaaucuauuaguauuauuugaggcuaacugacagugaugucucucuuaauauuuuucaguuauugcuuaguuuguuccuugcguagaauugugugcugccuuuuacuaaguggcaugauccaguagaggaaaggaagaaaaccuucagaaggcaugcgugcaguaagaacaggcuaccaagcauccuaccacuugccugacucagagcaaacacauauggcccuaucuucccuaacaucuggagguucacuauaugacccuauuaacauggccagcaccaccacucuuuuucugacacaguguaugugguccucaaacaaauucaugaggaaagguguugaaaaagguuuuaaguaucuauuuauuuaaaagauauccuuauagagcccuuagcuuuuguacagcccuucacuucacccacgucacacaugguucuuuucaugugcugauguauuuuauuuugauuuaucuccaugauggaucuggacuugaucugcucuuugaaggcuuccauccucuucagcuucaguucagaagauaugaaaacaggcaggaaaugacaccauucaaucacaaccuuaccauuuaauagaguuuagcacagaaaugugucaguucaccaaugugugaaaauuucagguggaaaacauaauuuuacauauaaagcagucauugucuauucaaauugaacuuguuuaucuaaugaaaaguucaccucccuugccaagauaaaaauauugcuaucagaaaaaaaugaaguaggacauugugacaacauugaaauguuucuuuaauuucauguaucuccuagguuacacauuuucaugaaggagaaugugauugccuauauaaacaccauuuuuucaauuucauuuugaaauggauuuuuaaauccaugaaagcaagguuugggacaguuugacuguuacaagucacagaguucagacuagcacaauucuacuggcacaacuguuuauaguguaaaguuuaauaugugauaguucauauucuuuaauuuuucuaaguaaugauuucauuuauuauuugcaauuaucucagccuaaaucagguucucaacauugaacauuacauguaaaaaugaacuuaaggucauguaaaggcgcaacauuuuguaccuauggaaaacugguucucaaacucuuuuggaucccaaacucuacugauguucaaguccuguauauagaugcuauaauaguuccauauguccguauguaugucaucuccuguacacgaaaucuucuauagacaaauuaugcuguucagcaaaauugagaugaugcuaucuacaaaguuauaugcuauuauguucagggacaaaagcaauaaaaauguuuacaguacuuauauaugcaaauuuaaaaacuauuuuuaacccguggcucaucacaucugcaaaugaagaaccaucgcccccucccccccgaaaauuacagggcuucaauauacaaccccagacagucauuccuauuccagaucuaugacuaagaauuaauuuaagucaaucuuaaucuucuucagaugaagugaauuaaguaugggaaaaagguuaaaaagauaucaauuauggaggacauucaguguguugauauaguguaaugugcuuugaacaacugaauaauuuuuguaacucacugaaagcaauacauuacaucagacagagggggcaguugagagcuccaaaugcccaagcuaagcaccagagauagccugcaaccuaaaguccucuuccuucuuuacaucauaccuucucagagacgaguauuauaggaagaccaagaaguuacauugaaaaugcuguucaaauacgcauaagagacuagagagcaaagugcuugaguuuuauuuguuauugcuuacuaggguuugagaauaaaacaaaauaacaaucugaggacaagacaagcauaaggucaaacuuaccugugugaacauagauaguucuaguaauaaucuugguuucuauuuaaagacuagaugaguucuugcuuguggcaucgucucaaccaucaaaguaauacuggcuacacauugcaugauuuaguuugugccuuguuugaaucucugccauauugugugguugauggaaaauucuuuagugauugauuaaccaagucuaucauuuucagugggggggggggguacaagggugaguuuuucacugaugagaacauucaaacaauucauauuuuuuucaggucagacuaaacauuucauauuaguugagugcuguucuaaaccuuauuaucaaaauuaaauaaauucuuuuuuugauacauuuuauuuaauucacccuaguguuuacuaaauacugugaugccacuuuaguagccugaaauauaagcucagugguuuuuauuuuaaaaauacaaaaaaaaaaaaaaaacacacaguaaagaugacuuucuacaugugacagacuaucugcuaaaaaaaucauucacggguuauuuuucaaaaugguaauuucaauauagcacaaggaaaguugacuggacuuuucuauucuucuauuugcagaguuugaugugaagagcuucuguaagauccugggaccacugucuuacuccaagaucaagcaucugcgcuuggauggcaauccucucacucagagcagucugccuccugacauguaugagugucuacguguagcaaaugaaaucaccguuaacuaacauccucucauuccaauacauugaaguauguucuggagcagaacuucaugguugggaaugugggggauguuuuaaaguuuucacaauauccuucucguugcuggugguauuacuucauggauuuuaauuaaugaaggaaauguuuuaugaacauuuaccacauuuaaauaaaagaugaaaagcaggccuuuuucauccugagaacagaaauacaaaacccguuaaacuuaagucuuuauuuguaaauuuaauguuuucuacagcucuauguucagaugguaugaaagccuuuuuacugauugcauggaaaucagccaaguuuuuuaugguucccagauuuuacauuaaugauuucaaaaacaugaaacaaauauacauggauguuuguuauccuaauccaaauuaucuugacaugucaagucuguuuugcagacauuuauacucugcauuuugaagccaguaauuugcaagauaccaaagaaaauuaaugaaguugcauccacuuacagaaauguaguucgcaguaagcauuugcacgguuacuuagugaaacuuuucuugagucauuuuccucugucauguguauguuccuuuuugauuguuugcauguuaugauuaauaguugauagcaaaauaaaacaaugaagcuggcaucuugguguu

SEQ ID NO: 5717 - RNA, 6585 nt, Mus musculus
cauuacugggagcagcagugaccaauaggaaaggaaggagaagauccaagagggcugagguaagccauccugaagccugucagaguggaaacaauacaucaaaagcucuucuuggugaccagucauccuacuuuucauuuuuuuucagacuggagauuuaauagcauaaagucaaaacauuuuuuuucuuuuuguuaucccccaucaacuuauuuuagcuaaccuaacaccagccacaggacucaacgguauauuccuggaaagcaagguaaacuauuuuguacuuuuuacaacuuuuggguuggaauuaagacuucugauucaaaagauucaagauuacaauuucaauaauuaaugcaaaaaaugcaugauucuacuuugaaaaaaaauuagauuuucuuuguuggaagccauccagaggagcauucugcagccagagggauucugacagcuugcagaagcagaccuggacuuuaaugggaggaauuaaaggccaacauuaauaagugauuuuauuuucaggucccuaugaaucagugaaauguauuugcgcuucguugguauagcuaaauguauauuagggaaauugaaacguuuauauauguguguguaacacauauguuauaauagugucuuuaaaauacuuacuauacuuauauuuuucucgagacaguaguucuuugugacuguuauauggggugcuauucaauggggaaaguuucucuccucuaaaauuaucauacaccagaauguauuaaacuaguuuuuguuaguaucuauauuggaccuauaaguauaggggaauuucugaccuauguucuaaauauuuuuuauucuuucuuauccugauuauuuaugcaauauuugaauaaacauaaguaauacauuggcaguauaugcaauuucugucauauacagucaugagcauauauauaugcauuuguucaaaauagaaagucuaaaugaaggagauuguaagaauuauauaggagauaaugguuaugugagacaauucauauuccauuucauggcugcccaucuugauucugauacuguacuuaaagcuauacaacucuuucucaaaaggaaaacuuaccugaaaaguucagaaucagagaugagucacacacuuuucuucagauccuagacccuuccuucaccauaaccuucuaaauuguccuuugaucucuacaugucuuugguccaugggccaaagaaccuggaaaauauccuccagauguuggcucauuuaaggguaaaaauaaaagcacaugcagaugcccaucucugaggaacgaagucuccacuucgcuuguuaguucacgguuuguucuuuuauacucacuacugguuucagugaaguuucuugaauuaauaacuugaaauggaaaagcacuuaaaguugcugagcuuugcuuuccguuucucagccaucgcuaugacucaguucaacccagauugcucaguggcuguggauuucuuucagugucuguaaagugcuuuuccuaugauggguacucaauaaaugugacuucguuucuaugccuggaugggaaguugauacucucagcuuuccuguaaggaaacaacgcauacggauuugaugcaugcaaguguuuaaagacuaauggauuauucguaacacuuguugcuuauuccacaggugcuguaauggcaaccccaaacuguuuaauacucuggguguuacucauagcagauacuguguggacacagagugugagacaggccuaugaaauacaggacccagaggacugggauguccacgacgacuucuauugucccagagaaugcuucuguccucccaguuucccuacugccuuauacugugagaacagaggucucacagaaaucccuccuauuccuucaaggaucugguaccucuaccuggaaaacaaccugauugaauccauaccagagaagcccuuugagaaugccacccagcugagauggaucaauuuaaacaagaacaaaauaaccaacuacgggauugagaagggggcccugagccagcuaaagaaacuucuuuuccuguuucuugaagacaaugagcuagaggagguaccuucuccauugccaagaaguuuggaacaauuacaauuagcuagaaacaaaguauccagaaucccucaggggaccuucaguaaucuggaaaaccugacccuucuugaucugcagcauaacaaacuauuagacaacgccuuucaaagagauacuuucaagggccuuaagaaccucaugcaguuaaauauggcgaagaaugcccugaggaacaugcccccaagauuaccagccaacaccaugcaacucuuucuagacaacaacuccauugaaggaauaccugaaaauuauuucaaugugauuccuaagguggcuuuccugaggcucaaccacaacaaacuaucagaugcaggucucccgucgagggguuuugaugugucauccauucuggaucuucaacugucuuacaaccagcucacaaacuuuccccgaaucaaugcuaaccugcagcaccuucaccuugaucacaacaaaauuaaaaguaaguagccauaaagaugugccugugaccaaaaugcccaucauuauguauagucucugcccuguguaggaauagcaguuuguguuguccccuaccaacaacuaacaagcugauauaauuaacaaauuauuuucaguuuucauuacacaacuuuauuggcauagcuuuaaaaaaaauccagaugcccaauucuucaaguucgggacugagaacugagccuuaguaaucuacacaaggcuuguauauagaggagacauauuuucuuuucccugggauucugauauuucucccuuuaugaguagauaucaucuaugucucaauauaucuuucagaguggccaugaauacaagaggcuugugccaacauuccuugcacuuugcggggggacaauguguugaagaaaguauggaaggcaccaaaaagcucacgaguaauauguagaauaggauuuaagggauuacagaagaguugaugucuucauuuccauaauuaugagcaccaaucaaauaugcccaguuaguguguacauuaugguaucuaccucucaguuuuugagccaggagcuuauuggguaggaccuggaccucucauucucaacaguuucccaggugcugguccugaugcucugggaaucacacauagagaacuguuaucacuacucaagguuguacucacuugaaauggaacccagugcccugggagcugucaaucagugagacuuagugauacauccucaaugaggaaaagguuacuccuucuuguaaagaucuucagauauggaguagagaguggaucaaguugaagacuacugaagcaaagauguuguuuagagaugaaguguugguacaaaguucauucuuggaaacauuugagaggaacuugaccuguucauagaaagggaaggcugucccucaugguggaacugaguggauucuauguuccaugcauaggguuacuaguacacagucuagaauucaccuucauucucagcauaagccuuuugggagguuaaucacagggcgauuccuucuggaaagcuuuuuaaaaugcagucuugaaaugagaucugaugaaaacgguuuauagaaagcaaaugaggaaaaugccacaggguuaugcgucuuaguuaccacucacuaagguuucaaugauuauauuaucauauaagcaugccauugcaagauuagaccacccuuucccugggaacugcuuuggucucaucaauuuuuguuuucuugaugccauguaugugagccuaaaauccuagaacuaaauugcaugcugcggccaccacaguuauuuuccucccugugacgagcaaaugcccuguugaauacuccagucagaaggaaaagauguaauuuagaaaacuugauagaugagcauccuuagcggagucaaacaucauaaugcuggaaucguaagaggaccuggagcuugccaguuuuuccugaaaggacgaugcuucugcaggugcacguaaucuuuaacaggagcccacagacagcuggaauagaaaguugacuucaagugucucuacguggauauuuguaugugaguccuacacacugggaacuugagacccaauauucagcagugaaguagcaucacugagagcucaaccggaaguacagcauugugucccccuaaacugaaauuuugcagagcauuuucaaaggcugugggcaugcaguccauauuuucagaauucucauauauuauccuguuucacaucaacugacuuugagaaagguuguagugauucccccaacccagguauuuaugacucgugguugugaagugggaccuaaaaacucagcuguaauacuacuguugcuuccuguccaugguuagagaaacacaaaaccucccaagagccugcuugauauuguugggaaauucaaagcggaaacggaaggucaaguaggugaucauaacuguucaaagaauuacagaggaacugcaggaccaauagcagaggcuucagcuucuuaaacaaaaugaaguccugcccccucauuuaacacagaaauccuaguuuuauuugccaaagaaauaaacacagaguagagauuccuuuucuuuuccuuuuuucuuucuuuuucuuucucucucccuuucuccuuccuuccuuucuuuguuuuuauguaaaccauuuuuuucuucacuuuacaucccaauccccgauccugcccccccagucccuccucucauccucccuccccuucuucucugagagaguguagucccccacccccacuacaguuucucccccauugcugacacaucaaguuucuccagaguuaggcacuucuccaacugaggccagacaaaauggaugaggggaauggguuccacagacagguaacaucuguaagaauacucccgcucuaguuguucaggacccacaugaaaaccaagcugcacaucuuagaauaacuggaccauaacuuuauggaucacauuguuuuauaauaauuguuaauguauguauuucuucuugucacauaauauaauuguuaaaaaauauauauuuucaagaaacaaaacuuuuauauuaagaguccauugaauuuuccagugaacuuuucuuuugugauuuuggaaaaaacaagguuuucuucacaacaugauaaggggccugaaauuuuauguaaaauauguauauacuucaauaaguuauuucuccauauucucugagaaaaauccuaacauauggaaaauuauucauuucagaauucuuguuucucacgaucugguuguuuguaugugcuggcuaucagggggagaggaacaagggauugacguuuuagaucaucuccucugauauucucugaauuuuguaguucggagggcuggcguaagggucuuucacucuggaggaggcucucaauguguaaaguuccacacuaaaauguagcagagcagagcacaaggagcuguuaguucaacauccuuucaggauuccuucaggaaacagagaagcauaauaaccuauaugacaaugguuuguaucucuauagauuccguuacauuguaucacauagccccuuaggaccacuguagugucuucuuggucuagaucuccauacucucugguguuucaaguuaaucauucaugcucucucugccuccauagaugugaacaugucuguaauaugucccaccacacugcgugcagaacaggaugccuucauucacggaccacaacugagcuaccugcgucuggaugggaaugaaaucaagccaccgaucccgauagauuugguggcuugcuucaagcuucuucaggcuuucauaauauaagacagaacccaaacugguuuaaggguagauguaugugguaugagauuuugauuguuacuucuagguccuagaccacacuugcaauuguucuuacccaccauuuucauaugugcagcuuguucuuucuguuugaggaugcucuggucagugacacacaggggccacguguauuaguuugcuuucuucugauuaacaaaacagacacagaguugaaaaagcuccucaacucaaagguauuuuuaucuccuugcagcuacuaauagccaauguuuuuuuuuuuacuguuacacauucaaaauaauuuacuugcauaugaccaaauuuaugaguacugguagugcagacuccccauaagcaccacaaugagcuagcaggaggaagcucugaaaauaggaauaaaugaaauauuccucugucaucauuauaaugagcccacuagucaaaagcuuucuaaaaagagacaccugguuauuagaaugaaacaauaaagcaagagagagagguucaggucccuuggagcgaaacaauaaagcaguaaaagguggugguucacuaucauuucuuacauaucuuuucuuagaucuuauauauuaucuccaguaacugauuccuuaaauauugcaguuauuauaacauagcaugcaaacuauccagcucuuauuuugauuaugauuugggggauuuuucuaaauaaaacuauugaauauuuucuaucaaag
